United States Patent 7,868,149 (PLANT GENOME SEQUENCE AND USES THEREOF) - sequence listing, part 120

SEQ ID NO: 66484 - DNA, 11493 bp, Oryza sativa
ccctcgctggatttgaaagaggagtagatggccaaggacagggagggggaaaaaaggaataaggaagaatgccatgtgggaccagtgggtcccacatttttttttgtgaataacaaatgggcccgcatatttttttttattttaattccacatcagcgccacgtcaatgccacgtggtacaaagactaggtcaacactgccacgtgtgcaccacgtcagtgaaaccaccctccaaaaccaccgagggagtcaaattgcaccagttttgtaagttcgggggtcaagatttctggtattacgcttgagggatacgatttagattcggtggtcagttgagggagtcaaagtgatcttattccgatgggaattacgtaggccgaatagagaagtgggccggattggttgatgggaattatgtgggccaaatgttctaacgagaattcagtaggacaaattcagtggtgggccgagtcattggatagagggtcaaattaagtaagtgggcctaattccatgatagaatttagtgggctgtattcactcgtgggcagaatatgtcgacgaaaattacctgggcctatttcattgtcatgaaataattgggctgaatttgtctgtggtagggccgaatgagtttacgagaaatcagtaggcaaacctaagtagtgggtcgactttgtggaataagttcacttcatgaccctcaactgtgattgaaatctaatccataaccctaaaccacaaaaccagatatctcgacccccaaactcctaaaaccggtgtaattcgactccctgcgcggttttgggaggcggttttgctgacgtggcgccacgtagcgcctacgtggcaatattgaccgaatcttcgatccacgtggcgttgacgtggcacttacatggcattacaattgtgggacccgtttgtcattcacacacataaaaaaaattgtgggtcccactgacatgtggaccccacatgtcatcctccttccttcttcctcctccctctctcccttctctctctccccccttcttcccctacgtctcccacaggcggcgatgggcgatggtgccgggcgacggggaggccaaacggcggcggccacccggctagagcagcggcggcgctagaggcaggtcgagcggaggcgacggcgtcgggcgacggggcggcgcaaacgacggaggcctccaggcgccgtgcaacagcctcgacctcgacgccaacctgctccgcggcgacatccagattgagccggcctctagcgccctcgcgcgccccaggccgtccgcgccaccctccgaggccgacacgccgcgcgcctcatgggcggaggctgctcggctcaagcggaggcgacggcgccgggcgacggggcagcccaaacggcagcggccgcccggctcgagcggcggtggcgctagaggaggatcgagcggtggcgacagcgatgggcgccagggaggcccgagcggaggcggcggcgacgacggcgggcgggccttcctccgtgccgtcctctccttgttagctgccggcgcccgaagctccgccttcaccgccccccggccgcccgctctcgctgtccccgcgtgccaccggccgaaggggaagaaggggagagaaagagagaagggagagagggaggaaggaggagtacggcggcggcggctgctgcacggttcgccgctcctgccctcgcccgtcctgtcgtcgtcgctccggccctcacttgcgcgccgccgccgctcgttctcgtcgcccgccgcccactgaaggggaagaagggaagagaaagagagagaagggagagagggaggaggaagaagggctgacatgtggaccccacatgtcagtgggcccacatttcttttttgtgtgaatgactaatgggccccacgcatatttttatttctaccgccacgtaggtgccacgtcaacgccacgtggaacaaagactcggtcaatattgccacgtaggtgcgacgtggcgccacgtcagcaaaaccgcctcccaaaaccgcccagagagtcaaattgcaccggttttaggagtttgggggtcgagatatctggttttgtggtttagagtcatgtgcaccggttttaggagtttgggggtcgagatatctggttttgtggtttagagtcatggattagatttcgatcacagttgagggtcacaaagtgaacttattcccgaatttgttgaagggaaataggacaaactgagggacctgaattgaacatattccgggataaactcattggtgaaacattggtgggcctaaatcactcgtaggccgaattcatttgtacgccgatgtcgttgacaggaattaggcggacctaattgattcctggccttcgtggtctcaattggtttatggtaaaagatgggttgaattcgttgacatgaattgattgggttgaattcgttcgtggtcgttggtggcccgaatttgttgacatgaactaatcgggttgaattcgttcgagggcctctgttccagctacaatactcctattttgagctttttttatcatcatcagtaagctcatgataaggcatggagtaatccggtggctgctgaaacacattgaaatcctgttaattgccagcaatctgaatgttggatccaacaccggttacacatacgagcattgcacctggcctcaagccctcaactctcattccttcctaacctatctgctggagccataaatatcaaatagttcttcatctggagatcttgaaactgaattatcaaattgtttagatgggagaaataaatcttcatggatgtaacactttcaacagaacagagaccacttgctttgtattgcgtatggtaatgacagtaggattcagatatatctgggtctgtcctgaacaacataggggggaaacaagatcaatgaggcaaaatttcaacatttgctttgtatagtaaatgaacgaaaaaattacactactgggtttacagatgtcctcaaccaaaccaacaaattcaaacttatgaagtctaggcaagaccattgggcttcatttttcaaagatgtcatatgacagggaagtccctaacagttgccgctgagtgcctgtaaggctaacatttgcctttactttgtaatcctggcagataacatggtcatcactttccaatttccattgcgtcatgcataaggagaaactactgcataaataatctccacactttttttgtcttgaaacctagcaccctgcatcatgacaaaaaatggcaagggatcatcagaaacaattcaatataatcgctgagcactttcaataaacttttccattttgaactgattaatacccttaattcatgcttctctcaaaatcagaaacatttgcacatttctcactcgcagaaaaacattaatcaaataaggatccatttttcctcctcaaagtcataatattagcactgacatcaacaggaaaaggaaacaaagattgcacacttttgcatgctcgcaagcatcgttatagggggatatgtacacacatggcacttatgacccaaaatgaagaagaagaatgtgagcacaaaccattactattttgtttggaatacctgcccgtacatgcaaactgtaatgtaaagggtaaaaatcaatatctgctcaatagatcgattcagcctgatcaaatataaacaaacctattgattatattttagagtataaagattataaacagcttttacacagggagagggactatgggatagcatattttcttttcatctagttagctcactgaatcgtgggttgcacaaactggaaactccacatgaagtagttaacatagccattctaccaaatgagctctgctcgttttcagaagctgcattgtcattatgaagagggggtctgcttctacccttgagttggctatatatcatatatatgatacatgaacaaggaaagcagtaaagatttagcaggcgttaaagcaccatttttttttatcactgaaaagtaaggcaccttacagtactagatctaagaaagagccaaaacccaaagaactttacaagtgctcctctagaactggtccatgactttgggtcagccaattagggtattttacttttgtgtgtgtgcatgggagggtgctgggtgatatctagctccatttgtggggtttattgagtagctctaattgttagtatggcgtgcggtagtcaagcgacaaccacagacaatgtggagggctgccacactatcatgggcataacagatgaggggattcaatctcccaagcttctgcaacaaaactcaaatgcaaattcttcccatggcttctagttgaaaacaagattctaacagtggataacttggtgattcgaagatggtattatcaacaaaattgtgtccttttcagtacacaccaagaaaccgtagtacacatatattgcaaattgcaatgtccctcagtccctccacgatggaagtctagttcttagccctgatttgggcattttgagatcatccatcaagtggacccgatccacttaacaaatagcaagtgacccaactaatgaccatagacatgcagagggaacttaaggggatcatcatctacatcatgtggaacatgtggaaggaactcaacagacagatcttccaacacatatcagccactgcccaggacattgccagcatacaagaggaatggaaggcatcgagcaacagcatatgctgtgctccatcagaaggacaaacgaacttgttctctgtatttctgctgttttgtacctcacccctcttacgagttagctcaaggagggcctcttggcagtggagttgtaccctgcatcactgtatttttcctcacctcaataattgattggcagaggtcctgcctttctgttccatcagaaaaggaggagcacataaaaatatacgtacaataaaagatctgaaatttgttcggtgccacttctagagaaaaaaaaattgtgtcttctgatttgagttgctaatactaaattgtaaatagaaaaaaaaattgttcaattctcttttcaactgtgttcccctaacacgaaattctggatcttccatcagcagatggtatctgcacaatcaaactgccgattacgaaaaggaagctgagaatggtgcgagaatatagggactacaatattcctgattgtgctagttaagaaatctctcaaggaaaaacagaggcttgtgacaatcatagatcacctgcagtttatgatattaatggcaacaataagacaaactaaattagtatgagtgattcctagatattggggctggtcagatccagcatctaatgcttaaaagtaggaatcatcagcctagtttccaaatatcctatttaaccttcagcctcaaattaaccagcattttttgctcttctaccatatccagtgtcatcgtatccagccatgagaatgccatcaaaagcacagatcttggtcaggtctgtacccagatcaaaagcacagagcttgtggacaacatccagatgaatggttgacgtttagttagagattcccttttccagtcgggccatcatcattttcgcagcttacgggggcacggtgacagcaggacagatgcactcaacctttttgttctagttcactcaaagaacttgggcacaatatccggtttagccatattgtcatgattgcagtggattatagggtacgaggatcccaggaagcacactcaatttgaatcagtcaatgaatcagaattttagaagtgtttgtaaaatggtcataactcacaacttccttcagaatcacaatcctatgcatattatatgaaggattgaatgtaaaatcaatttgtcttaatttaaataaaattgattagttcaactaattttcttttttaaaaatcttgttttgttgcttggagttataacatgttatactgatcatattggctgcaaaagatgagtaagatttgcaatgttaaattgaaataattggaggaaagttgaattcagtactgtaggcttgtgtaaaaatgccttttgaaaattaaattttgaacatggagagttatacaaagatatttgaaaattaattaatgttccgcagactaggcagtaggcacccatattaaaaattgtctgattcatgtgtatgatactatgatggatatgaaatgtatgatgcatttggtatgtttattgtaaatgagttttgaactaagttcagagatcagactgaaactagctcaaattagtttaattaagatgaattcaaattagtttgatatctcaaacacagggtttgaataaagggagatatgtaacattcttttgcaaatcccatgctgcatagaattaaggcaggacaaggttcaccaactactggatcagccattgccactttctcctctgacttgcacatcatcctttcaggtaatctccatctaaaccctgaccctccagatcagattatcgtgcttgttacttacttgaaggtaacatttcccagttacagactacaaatgctattcaactacttgaatgcaatgagcgatcgtgttaagaagttgaatgccactgaaacaaccatgatgttccagttcctttactcttcatccaaccaaatgggtgtaattaacaccaacaactaacccattcagtggtaggaaactaggaattatgaagtttggtcggtctgtagtctgcaattctacctcacaaccgttgttgttagagtactaactatgttttctgcctttccaccgccgaatcaaaaatttagacaattgaagtgaacgcgagatcaattccgtgaagtagagaagttgtaattacctttttacctatttaccggccaatgcagctgaatcccttgcacactgcgagccaggcagcgaagaggacgaagaggagcacgagatccgcgaggacgatgagccacagcttccgcctccacgtccacccggcgccgccgctgcgggcgcggcgctccctcttgggcgtcctccgcgcgagctcaccttccctccgctccgcctcctcggcctcggcctccgctgcggccacctccccggcctcccgcgcgagcgcctcctcgtcggggaacggcaggcgcagcgccagccgcggcatctcgtcccgcatccggttcccgggtaggcatcggagccgccggaggaagagcagcaggtgcgacgagggcagctgcggggcccgcgagaccgccgcgagcacgagcggcggcgcgaggagcaccgcgtgcgcccgccccgacgccgtgtgggtgacgtgccggtggtgcgcgggcgccccggcgacgagcgcggccgcgaccgccggggcgtcgtcctcggcggcgccgccgtcgtggggcgggggggcgtgggcgaggtcggcaacgagggcgctgtcccggtaggcgcaggcgtagagcagcgggtgcgaggccgggagcatccgaggcagcgtcgtggtggtcgtcgtcgtcggcggcggcggcggcggcgagagagcgagagattcacgaggatttcgggggggaagagaagaggaggtggcggtggctggcggtgtcgttggtacagcaacggaatggagacgaagggagccagactggacacactggactagttctctattactagttcacatttgagtttttaggaaaaaaagaaagataatgaaatgtgtatatttttttaaaaaaattgatttcctttaacttttttcactcttttttttattttcttattttttaagtttactaaaaagcaaatgatctaatgcggatttacggaataaaactaatagtgattatctgataaattagcagacggaaaaataactatggtgttccattaattattcgtacctgatcggctataacccctagaaacaaaagttttcattgggcgaattttaaacgcttatgtgacagagattataaacaagtactagcatacacatctcaattaaagaaaaataacgttcctgaatttagtagtttagctttggtggcatggcatgaactgttggttatgtaggagtattaggttgtagtttgttgagttgaccttactcactcactttgtgatccatcaacttgaaaatttgaaacccttttggtgttttaatgtggtacatgatcgagatttgacatttttcataatcttctgctaatgtttgtttttcttttggctagggaccgtttcagctgcaagcttgcaacacatatccatactaaataattatgtcggcctaatagattactagatccacgaaggaaaaaatagaaattaattcaaattcataacgggcatccatgtgggagcagttggcgtttggatctcaacgctctcccttccactagtactagtccttgacagcgtgtttagattgacctgctcaaattatttactatatttatttatttaattttattattcactataacactatcagatgtaacagatgtagtacagagctgggatggttgactggttaagatagattactaattttgaacaattaagacgaaactattagcatttgttccaataattaatcaaaaaagatttacaaaaaatacactgctatacaatactattacaagcactatataccatttcaattctcatttataaaccactaatagagtgtagtttaaactcacaattatacgagtatattatggataaatatacatgggcgcggattaaacgctagaaggattcgcggcggtggagcacaatcagtggcagatggggcacagcatgaggccgttctcgttgcacttggcgcaccgctcgacgtcggcggcggcggcggtggcgccggcggcgaccaccttgcagctgccgccgcactcccagcacgggacgaaccgcgcgccgccgcagccctcgcagccgcggccgtccttggcggcgcaggcctcgccgcgcgccctggcccagcgcatcatctcgcgcagcttgccgctctcggcgagctcggcgcacgcgtcggcgccgccgaggtagcggcccatgacgaagaggcgcggcggcgcgtcgccggcgccggctagcccgcggagctcgcgcaggtactcgccgtggagcgacacgtcgcgctcgtccacgacgacgggggatccgcccgccgccgacacggcctcggcgcacgcctccaccgccttccgcgcgcgctcgcagtcctcgaacgtgcgccgcacgccgcggagcgtcgtggtgtacagcaccaccccgccgccggatgcccccgggggccgccgctcggggtacccctcgaacgggtccctccgccgccacctcgccgccgcggcggcggcaccgccgtcgttccccttgttctcgcggtcgcgcatcaggaaagggttgtccttaacgacgcgccgcccggtgagctccggcggcggaggcctcctgtcaacctcctcgttagcgccacgcgcggacggcgccgccgccgccttcttggcagctgcctcgatcgccttcaccggctcaggcagcaccgtcgtcgtcgtcgtcggtggctgcggcggcggcgcaggctgcttcttcttcttcttcttggtcttcttcttggcgttctccgtcgtcgtggtgttggagctgagcgcaggcttgatgtcctccagggccttgctgacctccgaccacgacgccggcgcgaggtcgtagccgtcgagcttgtcgagcagcgggagcggcatcacggtggtggtcggcttcttgccttcctcctcctcctcctcctcctcctcttcttcatcctcctcctcctcctcctcgtcgttcttcttgccggtggcgatgagccagggctcctcgatggcgctgatgtcgaacagcgagacgctcgtcggcggcgggcggtagacgtcggccaccgtgacgtccttggagcccgcgcaccccatggctaagctcagctcagctcagcttggagctaagtgagagctagtgatggcgtctcactctcactctctctctctctctctctctctcttgtgttcaagttgtggagggaaaggcaaattaaggatggtttttgagtggctgagtagcgataagatgatcaagtgagagctgcacggctcatgccgggttaacgtcaatgctctccttggcgagttttgcttctgcacctctgcgccactggaattagatttcatttcatatttgaattcctctcgttctcgaaaaatcagtggtagtggttaagccaaaaaaaaaaaaagagcgtgcatttgaccaaacaggatatcaatcttagccacagtggcaggactaaattgcatctaatcagccaaatcacggtgaaaaccgaagaatcgtacaccctgcattccaaagaaaatctaatcctgactattctatatttctatatattgagatcatctattgtaaatatttacagtgactttaggctcactaacatgtgagcacgtaacaaagagggtccatatgtcaataactgaaagtcatgtgatttaagttaaaggatcacaatccgtacatgtatatgtttagaatcattgctagaattggattttccttttaggatgaaagaagtatggactaagctagagcctatagtggcacaaacaaccaaacacccaatgtattttttggaagggcttacaagatatgatgttgtcttgtactgttattgtttcgcttacaatgattacaagttgtttgtaacgacttatcaataatcaaagaataatttgtaaataaaacttatatatacatgtgtgtttagcaatctaaacacaaatgtcggaaaaaataaactacgttgaaattgtttgtaacaaactatcgataattaaagaataatttgtaaataaaacttgtatatatgtgtgagtgtttagcaatctaaacacaaacgttggaaaataaactatgttgaaaaatcccaaaatttttagaatttaaattttggctacaacttacataagctaaaagctcaaaaggtaaacgatgggataattggctataatactacgtacttgtggaacatctcaaatactccctccgcattttaatgtatgacgccgttgactttttgaccaacgtttgactttttgtcttattcaaaaaatttatgtaattataatttattttattgagacttgatttatatcaaatgttctttaagcattgacataagtatttttatatttgtataaaatttttaaataagacgagtggtcaaacgtttattaaaaagtcaacggtgtcatacattaaaatacggagagagtagttcatagtccttttctctctctcaaaaaaaaaggttcatagtcattggataaaggtgtctctggtaaccatctgaaccataaagcaaaatcatattccaaagccggaactagatacgttgattaactcaatactccatccttctctatatataagaaattttgattggatatgacacattctaatacaataaatctg

SEQ ID NO: 66485 - DNA, 5720 bp, Oryza sativa
  unsure (1)..(5720): unsure at all n locations
cgcttgtcaatggcattttatggattatctctttaaaaaaaactataaaactacttaaaaatcatgttaatatatgtttaaaatttaaaataattaatacttaattaataatgactaatatctcacctcttacgtgtcttttcaattttctcgttttcattcctctcacacacactaagaaaataagaaccgacaaaaacctgatatggaaatggatgagagtcacctccccaaaaggtcactagattgaaagaacacagatcacagatgtgcctactggcccatgtagcccagcttccccgagtaacatgccgaagtataaacaccaactcacttgagatacaaacaaaaacacagaattagcagaaaagcaggtgacttctttcccaactcatgcatttgacgagatgtactgtttatggttctgccacaagcaataaactaagaacatggtattctccccaataaacaacaaaaagagaaaaactacaccgaccacaaaagcctaccatacaacaatggcagttttaacttgagagctttgtcttccccttggatcgctaagtcagaatctgagctttctttctctgcctacaaacttcttctatcaacagcgctgaaaggtgggtggatgggtgtccgtccaaccgactgcttgctgcttgtctgcaaccagcgaacgaagtaaagctgcctctaccggtggcgcccactccccaactgattctaccctgagttcatcacgcgagacatggcggcaatcaccttctccctcgtttgctgttcggcgccagggcacttgatgatgaaagaatgcacggccgtgccgttgttgcttgtgatcttcgactcccctgcatggacttctgcctcttcgaaagcttggaagatggccctgacagggtggctttccatggggctcatcactcggactagaacctcatcctgaaccacctgaatgtccacctcaggtcgaggcgtccgatccctcggatcgatcattccagactcgataagcctttctcgctctacctccatctctttgagcttcttctgtaggtcagtgatgtatgttatggcgtcaccaaggagggatgccttgtccatttttgatatattgggtacaacggctctcagtgcatagaatcgctggttgagcttctccctcctctggcgctcggcctcaacatgatttagtggctcttccctcccgtttgcaggctttcttcccctctttctaggccgccggtcttctaatgcaggtggcggaccttcgtctttacacaagccatccacctctgcaccatccccatcaataccagctggttttttagtcaaaacaccaggtttggaactggtcccagcactgaaatctatttgcctgggagcttgaggctgcaactgttgctgactcactagttgctgtggctttactagctgatgtgatttctggagctgtggtagtttctgaagtggtggtgctttctgaagctgaaactgtgttgcagtagagctgtcaactcctccattgttgcgcggtgtggcttcattgctcacaatcaatataccgttgccaaacttctgctgatgagaattcaggccccgagcctgactccaagtgaaattctgcaaacctctttggacattggggagcaatgagctcccaccaccagtcctttgttcccacgacctttcatctgcctctgacacgccagttcctgggcctgctgaaggccggccaaggttaaggtccttcccaaaaatctttgccaaacctggtgacttatctgtagggccactcccctcgtgtctctgaactccagctttattgccaattgccccagcaaacacagatcttatggtctggagagtgtcagaactctccgctacctgttgcatcgaacccagttcaagtacaccggtctcaaatggaactagcacaatagttctaaatcctgcagcatttgcaaggtatccccggtaacagtaattggcaggaaatacgttacgttcagtgttgggaatccacaggggcacgcctgctgcaaatacttgaccagggccaccagcacggcgtggaaatgcaaagtacatagatgctagaaaaaacatctctgtgtctgtcacctgatcaatgcctggggcataatcctcctcgtcaacacctccgaatgctgagtgcaatcgctgcagcacacgcttgcgcatcctctgtttggcctcgtcactacctgcagaagcagcaggtcccatctcaccatcatgaggctcacggcaagagccatccccccatccaaggacaaggtcaccggactttgtgcgcgacagctgccagaatatggcatagttccaaccagcaccaggacgatctgattcgacaagctcctggagtctattttgcaagtccactggcaaagatgcagcaacaaggccctcggatatggcaccacctccttttgtcaagtaagcaaaagcatccgttccaagcacactggcggtgagcgctcggtcctcgtcagtccatgtcccaccagttccgccattggcaccatcctcatcagcctccatcttcatcaccataatacctactcaagatagtatatatatcaggccaaatatagcactaaaaatgcgtaatactcacaagaattgactggctggacgccacaagcacagttttagacaaatacacaagcaacaaaatatcatttggacttatgaataatcgggtgctgaactcagaataacaggaacaaaactctcagttatcatccagctaaaaacacactgtgatgagtgataaaaaaaattcactgctcttacgtcagtacagattatattcgcggacacataatcgctaaataacccactcaaataacagaaatcgtccacaaagtgtgcaaccagaatttataactaatcctgacatttcatatggcaccatttcaacggataaaagacatggagggaaaacacgattgaattctatccaaacctgacccagcaaaaagtgatacaaccagtaattttcctatctttttcacgctataggatacagccaaaacacccgtgccgatcgcggccaatcagattccaccctaagcaaaccctcctcccgcctcaacccgcccagctcgtcaaaccccaaccatcccaaacccccatccattccactgtttccgcaacagcgagcagccacatcatcaacaacaacaacaacaacaaactagtacagtatagatacggcaattctcacagtgcagcaaggcagcgggggaaaatctcaccgtgctggggctcccgcgcccgaatcggcgccgcggccacggaatccaggacgggcggggtctcctccgcgcccccccaagaagaaagaggcgggcccccccacccgccgctggctgaatccgagcaccctcccccccccccggtgacggcgacgcccggatctccccccacccacaccccacgcgagcgcgagggtcccccgaattcgccgcgcgcgcaggaggcggaggcggaggcggaggcggtggtggtgatggtggtgcctcaggtttctctggttcgcgaggggatttcgggggcggaggaggaaggcgacttgtgatgtggagagagagaagaagagggggggagaggtgtgaaaggagaacgagggtgcctttgccttttctacaccggtgggngggaaaattttnttnggggaaattncnncncggnnaagnnccccgnaangnccncgnaangncccngagccgnngtccgcggctttcgttaggggcgggggagccggctcgatcgccgacccatgggctcttctcggctttgcgcgctggtggtttgttcatacacagtgtggttgcgtgctctacgagcattcaagtcgagtcgatggagagtgggaagcatatgggttgatttgttaatcgggttaagttaaaataggggataattgatttataatatggttattattattattattaatggattctttattcgcttgttaataattgaggagctagaaatggtaacatttatatctcatgagtttcaacaaatttagtctgttgaatttcaaaatcatggggctggttcccctattccaacacaccatcatactcccattggcactagcatgtataagatatttacgaacattcctaaaagtagcgatgttgcagatataggatatcgagccgctttgtggcgtatgggagagccggctcgcttcaagccattgtttatatttgtttgggtccgcatgttttctttcaccgatggatatggtatttgtgatattcattcaggcagggacataaatgaattaatgagtagaattgaccactgcagataatttagatgcaattggaccctgctgcaaagtgttgaatgagcaagccaaactagtgtttattccccttaattgtaacctcacgagctccctgaattcaccaagatcgaagcatgcgcagggctgaggagctggggctgaggctaaggcggcgtgttgaggagattttgaggaaggggaaggggaggaggagacaacgcgtgatgtgtgaagagggaaggtgtgagaggaggacgaagagggtgccttgctttctctacccccggtgggactggaacctgagccgatggatccgtggctcgtgggggtggagaaactagctcaattcaagccttggactcttgtcagctcaggacaattggtttgctcatatagtggccacgtgctctttgatcattcgaggagacggaggttgaggagggattggtctatttgttaatcaggttaagccacaagaggagataagtgatttataatgtagttttttttactagaatgactttggtttattaatatttgtatcctaattagatggattcttcaatcttatgttaatattgaaggagctagaaattgtaaaatttactggtgggtaaatgacaatgttttaaataaatttagtttatgaaatttcaaaaccaggggttttcgtatccatgtctaccttcttcagttcttcctccccttaggcactaatgtgtataaaaaggttgtatttaaacttccctatgtttataagtgttgatggatgtaggatacctaataacccaaaccacttcatagagcatagaggaccggctcgctacaagccatagcttacctcttgcttactttcaccaatggaagtagaatttgtgatatttattaaatttcaaaaccatggggtcttatgcccttccccaccctcttgctcggttggcactaatggatataagaaagattttgtacttcgtaagatatttttggactttcccggatatggcaatgtggcggatatagtatgcctaagccattcaatagcggtttggggctttgggggaagggggaaactcgctccaagccattttggtatacatttgtttgggacatattgctttcttttaccacgacggatgtggcattcgtgacatttatttgggcagggacaaagatgaattaacacattaataggattgagcaatgcaagtaattttagctattaagattaaatctgattaagatgcaattgaatcatggttgtaaaggtagaataagcaagccaaactagagtttcttccccctcaattgtaaacttggagagaaatgcatttataggaacaactctaaactctcttttcaaattgtgctctttgggctgcaggaa

SEQ ID NO: 66486 - DNA, 7782 bp, Oryza sativa
cttgcaaaggaggagacggggatgtagagcttgggatttggaggacgtcatcggccctattgacctcgctccgtccttcttaacaacgggtgggaaactatgaaagaaggccacactaggaggctaggagaggcatcgccttaagtcggtggtgataatggacgatgacggaagatgacgatgtagtagtttggagcaaggcatacttgggctaggggagggtgggtaaggtggcactaggtgcccgggggatgtggcgcttgagttagcgatgatgatggactacaacaacggtggcgctgggacaaggcgagctagaggaagtgcgtgtgagtcacgtcttctcgcaaaggtgataaaggagagagaaagagaggatcagcatgggacccatgaatggccattgattatggctggcaattttgaacatcaaagggaggcatttggccaactggttggcaagtattttggaggttgattttttgatatttgctaaaatttagcttggagagccatctagtgagtctcttagtgttgctctaaggatttaatcaaggaacctacaataattctatagtgtaatgaaatctcaataccttgacgaataagatttacacacgttgggggtcttgtgctacacctaagataaaaacttgaatcaagtatttcccctccactagcatgatctctgctgagtggtttggatcttgacacttcactgtataaagcatcgcttgtcgacccagactaaccataatactccctcttgccgcttcccccttcttccttcattgcctcccctatttcgtgcgatgccttcaaactccaccatatataccgacgagtcctatcggcttccttcgttactgccaatcctctctctagccctcatacttttcataggagactagcgacaataagattgttatgcccttgttacacatgtttaagtcgtttgtgctcgtcacctcaacctcccctgcctctagggggtggtggcgagggttgctagtgaagttgggcgtggtactatcatggaaccaaattttggtaactcgacgaaggtgagaaggggcacaaatcttcatgcacatggaaggtaactgttaatagcaagattttgttcttaaaaaactatatgtgtataggaaacgaaaacattagttgtgttagtgtcaaagccaagacccggccactagggacggttacctaggccgaccgactcatggtaagaggcagaaatatgcgtcgtcaatatcaaacaatacctaatatcacaaaaataatccacaacatatgtgttcaaaattcatcggcacctgttcgacaagttttagatgaactaccaaaatattaatctaggaattagtagctttataataaaacatcacatgtgacatggctgacggttgtggttagaaaattttttataaaaaaaatacatttgccctgtatgaaaagcatatcttctagtagtagcataatgtggttggtagcgtacaaaaaatctcatatgctcatatacgcttctctcttaccttcacggctttgctccagccgacactaaacttctaactttacatctgtatacacatcaccaaactacggctatatgctctttcggtttcacttaaaacaaatacacctcctttttctttcttttttttccctttgcctgatcaccgcagaagatcctggccgctacgcaagtcgacccctctcgtctccgccttcacgtgaacccacaccggctcggctcagctcagatcggctccagccgtcagccggggaagcctcggctctggcccccctcctcctccgcgtgagcgagcacgtgcgcggcgcgtgtcgctgggggatcgggaaggcgactcagggggggctcgtgacgccacgtgacccgtgcgcccccgcccgaggaggaggagccccccgtttgtgctgcaccacgtccccgtccacccccagatcgcacgcgacgctgacgtgaggggaccacggttaggtgggccccacctcgcagtcacgcggaggcggggtagggtcgccgggtgagctggggggcccatcgggcgcgtgtgcgcgtggcgtgacgaggtggtgggaaacgtgaactctatttaaggaaaaacgtgacacgttttcagggcacccccctatccccggcgctaatgctaatgactctgcccttccctcactcgtgccgtgtccgccacgggaggctgacgtgtggggccaacgagggggcggggtggtgggggccatgtaggcgtgactcaggcgggtaggttcgtgggtgcgccatgacgcggctggcccccaccccgggtgattagagcagctacaatagcagactatcagcgctataaacatattttaataagataaaagataagagagaaaagctgcgggctacagatttgtagccagctacagcatggactctaaaacgcaatatgtatatgatatgtgagaccatatattagggcacccgtaatggttatctataggctctctaaaagagatctatgtcagcatatttttctacttggaataaattaaataaagagagagagtaaagctatctactaacatggagatagtctgtagagaaaaacgaggcaatagaagagagagctatagatacccatgtagacatactattgaggtggtttactattaatctagtctattactgagatgtacatgttttatagagagcaacttactttaccattgcgggtgctcttaataatatagtaagcaaatattatatgaactggctattagattagttataagtgaattggaactaagtattgggctatgctattaaacttgctcttatactggatgatgatttattagcacctaatgcatgtgttaaccctccgaaaacaaagtggggggggggggcgagtaggcgacacgagaaaaggcgtgcggggatttagatgtgggggccaacgtgatgggcgtgcacctcatgaccgcccgccccaccacgccggcgcgcgccgccgccgccgtcgaggctccggtggtgcacggcaattgggaattatctgcttcttttctgttgttgtccgtttcgttttacacgtcatgggctcgtcatctcatgggtgtggtggtgtgtctcatgtaccgtgctaaccagctatttgtctcgttgaaagtctattgttgcgcctttcatgcgtggttacagtgatagctaactctggctacgattctggatacatacatgtaggttcgttgctagaatatatttttttaaggaggggtatgtttgagaagaagaaaaaacgcaggttatttcattgtatcgaattattagcataacgtgatgatttggttattttcaccgggttaactgattttggagaatatgtataagttgtatgtatctttgtattaagattttgagtaaatttcataatactacaggtactttagttaaatcatcacaaaactacaaatttaatatgatgtatcacaaactacaaatttataacactaaatttatcacataagtacaaatataaggtggattattacaaaaggatatctacaggttttatatcaattcaatcacaaagtttggacattataactcaaagataacgttaatgctaaaaatttcaaccccaaaatatattttaagataattttataataaaatatatggacaataaaactacaagacaataaaactgtagttttatgataaatttattgttaagtttgtagttttgtgatataccatcttacatctatagttttacaataatttggtcaatatatatatagttttgtaaaatttactctaagattttagagatttacaataagttttgcatagaatgaaaccgaaagaaaaaaagacctatatctggtggcattaatttagcggccaactaccgaacgttgaaaacgctagctgggcaacaatctcactctcacctcacgtcaacgtgttatttttttttaagctgtcaagctcaccacctctctttttccttacattctctcgaggttccaaaatgtcttgttttgaatgaaataaagaaacggctttgactatgttttttttaatattttttcacttaactacctatctaatgtggtgcagcatttttgaaagagtcaaaacttgtagtatataaattcatatcttatacattaaattacatacacttgtaatataatttccaaattatacaatgtactatactcattttatgtacgataaatatggaaaaacgatttattatctatttaattgtgagaaaaaaatattagttcaaattaacatatatgtaaaaaacaatatgaaagaattaggggaaatactaatatagttatgcacatattgataagagagaataatcatatatcatgtagtgagaaaaaggagaccacaattgaatgttgtactattaagcaaaattgatgttattgttttttattttttagccaaatctatccaaccataattaatcagcccgtgttagcagaagcccatatcatcacacgccaacatatcatgagattattagtagtagctaagtaaaccgaccaatcatattatgtagagacaataaaattatagtgggcttagcatagcatggaactatcggctaacgaacaactcatctttaattatgccagagaaaaaaagtaaattatattttgtactatgtattcttaaaagttttcatattatatcatctttaaccattattttctttgacaacaactaactttacaattttgtttcaacttggaccatcccattatatccatctccaagttcggtggctctatcgtcactccacctccaaatccaatgaatctgccaccgcttcacacactaactctctctcctctttttattcttccctttgattgcgggagaactaccgtatatagtaaggaggagcccgaatctagcatctccactctctaccaggtcgactcctgcctccctgagtccctgtaagcctgacacccccggcctcaatgatgaccataataatagcgtgcatgatgataaggaaggataagagacatattgtttgtcacatttttctctcagtactgttgatatatgggtcaccaattattataaaaaactagctaaaggtctgtgcgttcaacatattatatattataagagataaaaagtaaaagcacaaactataagtttataacacagttaattgattaggcatacaatgctatataaaaaaacaaaagtattcacgtgtgaggatcttgtggtcccacatgatagcttgtgatattgaaggcgaacttagatatcatcattagcatcatttaaagtacttcatctattttatattatataagttgttttgacttttttttagtaaaatttatttaagtttgatcgagtctataggaaaatataacacaaatcaaacatattaccaaaatatattaatcctaaatttaacaaaactaatttgctatagatggttgcaaatacctttacatattgctaaaagaaaataccatggcgtataaaagaaaatctcccgtctcgtctcctccgctcttgcgccatcttgcggctgaacaggggaggggcgccgacctccatctggcgagcaggggaggggaggggattctggtgagcatccacatcctctttctgattcatctctctcccaccgggtgtgctttcgtttggaatttgcttgcgtaaaccctagcttgattcatctctctctcccaccgggtgtgcttccgtttggaatttgcttgcgtaaaccctagcttctcttctagatctgtaagaagctcttctcttaattccagagccttaaccttaatatacaagtaacagtttggtttgtttgttcccccaaaagtttgtgggtttaactgaaccccccatgtcccaagttggatccgcccctgtctacccaagctgatgagagcataaattgaccaaagagacttcgattatagtttttttttctatttgatcgtgtgtgcattgaatttaacttgtgtaagggtacgaattcttgattttagttatattggcttagacttttgagcccatcctccatttttatcctggattcgccactgctgcaggctgtgcattatgtagcatagtggcagatcactaatctttgttgctctcttttcttgtgttcaggcaggggaagacatggcttcacgctcgacgccttcgaagaggccgtttcaaaagaattcttcagagcaaaatggtcggggcaagtggcagaaaacaaagcacaattctttgcagcagcctcaactgatagtgcaacctggtgttcctattttccgcattctctgccctacttcaaaatctgggaatgtcattggcaagggtggaggcatcattgcaaagataaggcaagagactggagtaaaaatcagggttgatgaagttgtccctggttgtgacgagagggttattgtgataactgccattgataaggacagagaagttagtcatgtgcaaactaaggaaaacgacggaggtgtggcttgttctgttgatggcaaccatggaatggagaaggaccacactaaggaagaaaaggatgaaagtaacaaagaaatggatgattcagagaaaggccttggtaaggaagaaaaggatgatttagaaaaagatcatgataaggaggacagggatgagtcagggaaagacaatgataagaaagcagatgattcctctgttgcaaaagatacaaattctgagccagaggcgcagctggagctggagaagggaatgccattagccgtgaaggccattttgcttgtatttgaccggatttttgtaaatgaaatggaaaatggaacaggagatgcatctggtgagagaaatcatgtttcattgagattattggtgctagacagccaagtaggttggcttttgggaaagaatggtagtgtgattaagcaaatgtctactgacagctgttgtgaaattcgagtttcaaaggacaagcttccattatgtgctttaccccgagatgaactttgccaggtaatttttcagaattggatttcattatcttgttctctactggtccttttgtaatatatctgttagattttgcatcagaaaatcattacatactcccttcatatatcatttcttcagatcactggagagctcgactcagtcaggaaaggtctgaatacagttgctcagttgctatttactcatcctcctaaggagagtgatgttcttggtgctcataattctggttcatctcgttcattcttcaatcaaccagatgttcttcctccaggaatgcaacctaatctccatctcccttttcaagggccaaatgttgctcatcttcccaattttcctgaagctctaatgcatggccatggctcagtcccacctgaaccccttacttttaggttgttatgctcaagtgacaaggttggaggtataatagggaagggtggaaacaatatcaagtctattcagaatgatacaggctgtgaaataaaggttcttgatactgttccaaaatctgaagatcgcatcgtatttatctcaggacctgcggtaaccagcttctttccctcttgataatattcgtttgatcaatatcagtttagtccatttgtaacctgctttgtagtagctagtagcccattagtcctagaaatatattcaggatccatctgtctgagaaacatggcattcagtagaactatagggcgtatatctttttcatgggctgcaggaat

SEQ ID NO: 66487 - DNA, 3968 bp, Oryza sativa
ttggattctgtttatgtgttttttctagaattggtatgttgcactcgtgttctgtaaagtgtgctaaagtggtatgtatgtgccttatgttctgtgcattgcgggctttaattgtgtgatagtttgtttctcggacagataactagtaaacagctttaaaaagatggaaacataggttgtttgtaactataaaagacagtacattatcagcagcattaggtaataatgtgtctctagtactaaatcacgcgtaccagcatgtacagatatatgctcaattggttgttataagtaccttcaaaacaaaagatgatcgaaatgccaaattgatcatagtagcaaacaaaagagattagggtcagaggagatagcaaacatggagattaatgcttcttcaggttctaattgcttttctgttgcactattgcttaactcctcctgtggatcttcctcatcctcaccaacctcttcttcttaacccaatagcatgtttagtttgattttacactaatgcaagctctgccaatttgtttttataatcagcgatatatcttcgataaagtgctaagaaaagaacaagtaaactattgcatggtcttgtgaagctgtctttcgggtccaacttaactatattggtaggtctgactatctgtctttacctgctatcgatgtaaaactgccctatgtggcagctctggtcctccctttacattaccagtaggtaatttgtctagtgcctgtaccctttcttttgatagaggagtcagtgtaagccaatgcttaggtcttcacctccagccaatcagaatctgaagtcagcggggtattccaatatagctacttctaaggaggttccctagcactcagaaaccctgggggccaggcagtgaaacgttccgcagactgctcacccggccacacctcggagccgatgaaggctggcaatacaagcatcatctgtccaacagcctacttctcatccgtaaacatcacagttcgttagtgcaagcgggaatgagaacaccactatcttagaagaaattagtagaacttagttcagaatgtacaaatgtatgctagatactctcactacgattccagattagaaccggaatagttaaccaatggaataggtgtaggcggtttgatcgtttccttttctccgatcataaataacctgatctctttctttgtctttcatcaaataagtacaagaattgcatagatgaggattcggtattgatcgctaaaatgcgagaaaaagacccacgtttctctgttcgtccgctgtcagatcaaacgggtagggatcggcccagcctagaacaactcgcttctcataaaaacgaatccctttgtgcctggaagaaatgcaaaggggaatgctgggtcagtgtaaagaaaagcatggggcgggtctgctgttttgttatcttatagaaagtgaactgcgaatcgaaccaacttgtccggaatatgctctatcggccccgtctctcggtcaggtaagaaaaaaccaaggaattgatcatccaggcgcgcctattcggcttgcttgataggctggcgcataacccccatttcttgacccagattcacaaccgaacctatttctcatcttcatcccgacctatctatatgtgaaactctgcccaaatcctcgtagtactaagtcgtggcttacaagctagcccctactccttgtttgggcaagatctatatggtttaccaaaatggcatagacaccagatcctttttatcaagcgtgcaggaccagtgaagaaaaaagatttgcaaaaacacacatgaaacatattgaactcctaagaaacacctgacctcaggtgcttttttctcttgccttctggatggttctgaagtagtgaacagcttccgaccattatgaccttttattgaatttttgattttctataggagctcactactgctgcatttcaaatgtgcccgcctattgccttaatttacagacctctgcgattcacatatagccccactaatgtaagacagctcaagcgagtctagcttaagatataaaatcacactagccaataaaaaaagtagccaaacaaagccaggtagttttcatctaggtgaacaagtagaaagagcttacttggtagtggggaactcttgctgcattatctgagtgtatatgcctgttaaaaactagcatcgtaggaactttaagaaaaaggatattgttttagcagctcttatttctattttactgctcaactagctcttaaacattaaaagggcacttacccagaaaggtaagttttcttactaacccactttaaaggccagatcatatgcggtgatatactacggcagaaagaaaacgaagacaacaaagctttcccagtgataaaacggaggactttacacacttttgcttattaccaaagaaaagaagcttgttgaaagcgctcgcttcgtgaaaacaaagcagaaggaagcggggaatgtcccgtccaccaatagtatacagaatttggatacgtcactaactatagtgaaaaggatcttcggagtttttacgatgttccaatcaatgggtaagaagatccacccacaatatgttcatctcttgcttcaaagactagttcttccgaaggagagaaaggaagagtagttgtaagataacaccgagaatagttacaagccatatgtgactgcaaaaagtacgatttacctagcaaccatttattttgtgaattcattagcaacaagctgtttgtgtatcactttgaactgggaatgaattttgtgctttttcactgaagtactcttgcttttgaactcagcaaatccctccttttcccgcaacaaagatctttagtaatccgggctaacttttgtccataaatcccgcgtaagaagtaaaatgacaagggctgacaattcttagaatataaagagagacaagtttgttaaaaaccatattatcatatatagttttcatgcctgggcattctggcgcatgttttacaataagtaagtgcggcgcccaatagagctaaccttacacagtacctatacaggttgagcccccaaaaaaagcactcttgtgtgcctactcctcgacttagccgccgtcatagagagctttctaatcgttgaaaagccctggaactcaaataaaaaaacactcatttaagccttttttacgggcaagagaacttttatctgctcgtcttttcccaggatttctttctgaacttgtacgggtatgacccgcgttcctttcatattaaaaacactagcttgtttagttccacttcttttcacaggagaacttgccggtacctctagactcgcttcattgtcattctactcgcggcactgggtatcagttatcggagtgatcggggtgatggtgatagttgttacgatccgtaactggtgatgaacagcaaaggtttttggttagttgaccctgttaaccgtaaagaaaaggagaaagataagtggactgggcaataaatgactatgtccatattgtaataacccgagtaagtatctgagtaagaccaataaggaaagtacacggagatgtattaaagtgaaatccgctttattgggacaactcggatggattggattggatatagtagcaggctgaatccttggagcatataaggataggctaataaagtggaactgggattttttgatagaatctacccaatgaggaattttcaggaatggagaatgttgtggtaagaccgatgatattctgatagaacccatggttggacgtagattgcactatacttccccaccacaggacgtaaagacggaacgctgaaatcaggagatgaagtagctgttggtcttgcctaaattcagtattctaagttggcgaagcctcatacatatcgataggaggttgagggatccggaaagtctccgttacgttctatcttgctttgggttttgctgac

SEQ ID NO: 66488 - DNA, 726 bp, Oryza sativa
gctatatttaacataatgctcctatcatgtgtctgaccgcaggttgtgagcgaaagcttgaatccagtttggaaccaaacttttgattttgttgtcgaagatggtttacatgatatgcttatgttggaagtatatgatcatgatacttttagtagagtaagttcaattgaagtttttatctcattactggacgagtggcttgttcaactgcagacgtttgtgataacgactgacaccaaggcactgaatatgtttctgtaggattacatgggacggtgcatcctaacattaacgaaggtcttgatcgaagaagattacaaggacagcttcaaactggagggagcaaagtccgggaaactgaacttgcatctgaagtggtcgccgcaaccaatcttccgtgattcgcgagaagaggacagcttaagattcagatgagttttgtatgcgcggagagtcatagatgcgtgtgggcatctggtttctgcgggccggatgtgatgagggtttcctcctgaaaacctgatgagttcagtcatctcttttttgcggtgcaatttgatcatccgctgcacatatacatggaagaagagttatggtgttgatcagctagcttataatgtaattgtcaaacaacatttatgtgtttacttgcaatgtatgctcaaagcacatttatgtacatgtgaaaaatatataatttgagctgttggagtgagctgttgaaga

SEQ ID NO: 66489 - DNA, 5479 bp, Oryza sativa
catgcaagcttgtgaaagagcaactgctgtctgatttggaacaaatatggctgacattattctgatcagccacaaaatatagtcatcagagagcgcaccatgtaattccatccagagaaaaagtgcctgtcatttggacagccacgaagtcggatgagattcaacttttttgcatgcaataacctttggattcggttgaccgagggtttttggcaattttctcaatagccaccacccaaaggaagaaggtcaattttatttgctcaatttatcttattacctgatttatgtgatcaattaagctggaagcattacactgttttacacaattggttgcgagggtgttctaaccccgataatgctggtgtttaagattatattgagcaaggaaataagtggaatgtgtagaagtgagagaaaagggaaccgaattttttgatgtgttcctttcagtagttgaatgccatctctactagctgatagcctgataccagctcctgtcgaatttgttttgttctgcatgtattccatgtctccaaggatgagctaaagatatagagaaaacagtttttggcgatctttgcttttcagttttgcccttgttatactgagcgatgtgcacttttttgaatctctctttaaggaactttgctagacattaacccctgcttcttgtgtcttcagctgtataacatgttgcataaacccgggccgttctacgttttgttcaaacttgaaatttagttaatacagagttggaaaaaaatcaagacaaagttaggagaacctggacctaatcaatttctcttggttataccttcgcgaaagttcaaattaggtcggaatcgataaagcttaatacgaaattagatcggaatcaactattaacaaggaatcctaatgtgggaaggtttgatacgaaatgaatttctagctgatacaaagaatcctaatgtgggaaggtttgatacgaaatgaatttctagctgatacaagtaggaaggatttgttcattctctctctcgcactggaagatcagtgaaaacacaagggcagtatgtaaactctgtatgaacaaccaggtcatgtagcaagaacaaaatcattcagaggctcaagccacttttcagtatggagtggacataatcacatacttcctccgtcccaaaataaagctatttttgaggttggcacgggtattaagaaagtatgtgagaatgattggaggaagtgtgtgattagttgaaaagagaaagtaggtgaagaagaatagttgtgattggttgagaggaggaggtaggtgaagaaatagcttcattttgagataagacactgtgctagaaatagttacattttgggacggagagagtactgtactagcagtagtagtatgtcgtttaacttggaagaggtaagggcgtggccaacttgcccatccctgagcagctttacagatgagcaagaatctctaaacaattaatgaggtcccaagatccagatctagctagtcattctgtgagactctgatctgagtatcgtacgcctgcttttgctgataagaagctcacagatttggagttttggatagagagaacctgaacctgaaccatgcagcttcagttcagcaaacagcactggcacaacggattcttgccatgagcggacacaagaaggcttgaccacttgagctacaccacatgttgccaggacgaagcttgatactcaccattagctgcaacttgcaaagaagctagtagttgatgtcttgttacgtgatggttcacccatcgccatccttagcttaacttgcacattccaccgaccgaacgaagacgcgaagagcgaggcatctgcctatctgccttctgcaactgcaactgatcaacacgccgacccttttctgacactgaaaggaacacactgcagagcatgcacgctaagtctttgctttccatctagctaatcttcgctggccagcaactaaactataactaaaatgtggtctaaacctgtcggcttcatgctccaggccctgcatgtcagtgaaacactccttgtcgcctctatgttctgctcccctaatctcacccaactagcaaggctagattaaaggaagagttaatgacagatcataaacacatactttctacttgcttttagatagtttaattacgtagggctgcataatctgcatttctttttttttatagatatgcatttgtgtaatgtcccttgtgtgcacgcaacagtgaagtccagtctcacttgcttatgttgcatgataatgacaccaacagtagtggcattgttcacctctctgaaacttctcgcattgatgcatttcagtgaacttgtcttctctctagtgatgtcttcagatcaggcagttgtctatgccgctttgcatcattgtcagataagggcttgtccgtatctccgtatgttgtcattcagagatctctcttatttatgtttgattggatatggggcacccgacaccagatacattgatatatacaacattcgtttcatactataagccgttttgactttttttttaagtcaaccttatttagctttggccaaattttataaaaaaaatataataatttttcaacataaaacaaagaagctattaaaatatatttaatggtagatttaataaaactaatttaatgttataaatgttactgtatttttctataaacctagtaaaacttcttaacttagttaatttttttaaaaaaatcaaaacgacttataatattaaacagagggagtagacgagtagtgtatattgataagtgatgagtccagcctacctgaataattcttttgagttaatatggaatgaattatgtaggaggtatccatttggacaccacttcagagttcaagttgatgtcaagtgctccattaagcacactgatgtagtcccttttctgtagtaagaaaaaggcaataagctagataaccttccattgcaattgtaatgctactcatagctaatgctgtagggacactttgatggtccaccaaatcagaaatattacaatgacaaactttgtctggtcaataacgccctggttcttaaatggcaggccatccgtttgttttgcagtagctattcgtcatgttggctacaaaaagcaggaaagcaaaggttggcaatggttgttcttcccatccgtttcgagctgcaatagaaattgaaacgtccagagtgagtaatgctattctgtctatgagaaattccaatgatctgtggctgaagctgaaaacatgccctgttgttgttagtaactgacaggccgttctgcgacttgatgatagccttcaatttcagtttaccagcataaaccacgcattgaattcgttccaacaaaattttcatgcgttgagaacttgagataacagctcaagatgaggtcactagttcgtttgtcaattctcctcgaaattgtcgatcatctttgcaggccttccaagttaaggtaccctgagctatcacgctgtcacgcggacgacgtgcgtaatacttctccgtgtaaaacgctgatccgtttgctacgaacttggtacaagataaatcgtaaaacgttaggacttgattaacgctgaaaaacacgcgtgttagagtccaaaccgattcattctccatgagaccatgacaaattgacaccaacacaaacgtttcgggcagttattattgaacaaactaccaccacaaattatctactatgtattatagaaattatcgggactggtgagagccggcgatgcacggaatttttgaaacgctctacttcactaaggaagatatgtttcacttttccgatcggaatttgaactctggctggttcaggttacagtcagaggaaataagaagtatggtaagatgaatgaaaggcagaaatacaggacatacgctttatcgcagaacatctatttgctttctattcgacaagaaggacaatgaaaagataatggatatggaacacaggtcctggcactattggaaaatgaagctctctcagttcaaacatatgagattacttacccggtttctaagggcggaacaggaaagtaccaaggtgcactaggtgagaagaacttttttcgcttttttatcggaatttgactcattttagtatagaaaaacaccattctatctgacctagtaggaaaagttactattttgcattccttagggaaagtggcattttcaagggtcatttttgaaaagcatttgtcccaaccatgtgcaaaagtaaagaaaattgcttctccctcgtaaatggctccaaaatctactccatttttgaaaacttgatagccagcatggggcaatttggtagttttttcattttgcttgtaaatcggctctttttggcatcccagttctgaactttttcatctcgcctagtggaacttgagactttttccagtatctttatccagcagcaggactttcactactttcccaagtaaagctagtgttaagagactggattgtagaagtgttgactgacttgactggaaatataatatggaaagactgatggactgactaaagtggctattgacttaagtggctatttcctgattccgatatggcgtcctgaatccaatattgcttgattgtctgttgatgcccagccgaagaagtgacttgcttaacgtagcaatttctgttttcttgtgctctccacctccgcttgacactatcgtagtagatcataagagaagtattctttcaagaaattcgtatagaaagatggactagctcgagaacaagcaacggattgagcgcactagcgcaaaagcgttagcacgcgcatccgttttcttgctccttggcttcaaacaatcgattgaatctggattcctttgcttatccttcctggctatagtctctcttgtgccttcggcagttcagttaaagatttctgtatcaacagtttgtttccccatttgctcaaagaacgcataaaacctgttccctcatcgtatcaaaagatcaagcggaagagtcctcttcttcaagaagagtttttcatttcactcttccgcagcaatgcccgggcaagaaaacaatatgagcaaatccgcaaaacaatatcatagcaaacggtatgtgctggttggatagagcaatcagtagttgacgttcgaaccaatcttctctctagtagactttagattcagtcgtccgtttgttttgttttgaattgacatagagaaattttcccactacgtaattaaggaataggtggcgaaggcccttggcggactatatataaaggaaaggggttatttttcctttacggcaataagagctgattcccttgcttgtagtttttgatcgatggagtgtatttaacatatttaagagtggttaggagagagaatcaatgtttagtagtaggcccggttcaccaggttctaccactgttcggcccaatcatagtcaaaatct

SEQ ID NO: 66490 - DNA, 1610 bp, Oryza sativa
cggcccaaaaccctctctctctctcctcctcggcccaagtcggcccaagtcaagccgagccacgcgtgcgctcgctgcggttgacaggtggggcccacctgtcaggcctgtcgtctacctccggccggccgccgcccgaaccctagcgccgtgccgccgtcgtctccttccaaatccagccgcccctttccgtttccggtgaaattaatagaggggaaatgatccccgggatcccttctatcttttctcttatggaatcgtcggctaattttgtttggaaatccgtggattcgagttcgattcggatcgatctctctcctccgaaccctagactttccttcgcgtcaccggtcgccgtgagccttcgccgccgccttccaacccctatataaggacccccaagcctaccgctacccgtcgccacccttgccttcgtctctagtcgtccgtagcgccctagccccgtgagacctcgcgccgccgtcgtcgccgccgctccagccgtgcgccgctgtcgctccagtcgtcgccgtcgctcggggaggtcgccatcgtggtcgccgtcgcgtcgccgtcctcgtccgccccttcaccgtcgctgtcaaccaccggagcaccgtcgccgtcgtcaagccgaagagtgccgccgccttttcctcgtcgccgacatcgtccggtcatcgtccgccgtcgttttggtcaccggtgagttcgccgcgtcgcccgctacgcgtaggtgtcatccgtttgctccgccgcgccgtaattcgccggcgagcatgcgcgcccgagatgccgccggtggtgacgtcgtcgctgacgtcatcgtcgtcgtccatccgtgagccgcggtggatccgatcgatcttggccgtccgttgtagttaggatcgatctcggccgcccaatcttgtgaaccgccgccgtgcacccggttcaccgcgaaccctagccaatgacgcaataattcccttttccttttcaaaaataattcattattgcgtcataattcaattaaaatctatataagtgttttaaaccgatttaatctttgaaaattcataactaattcatcttagctcggatttagttggttcaagtctctaaatttttctaaaattgagatctacatgttaaaaatatctacatgtactgttcatgcttgttaatgtgctgttttggtgttttgctcctttctgtttagattccgacgtttccggagagtccgttttcgcaggagaagaatttgaagagttccaaggccagcaagtgtcacgccctgaagtacccctcccttactctaaattcataaaataaatcattcgaagaaattgtttaatttaacctagagatgaatccctaagtaataaatgcaaataataatcggaatcgacatgtagaatttctcttggattctacatgtcaaaatatgctaacaggatttttagtggaattttcagagccttggaaataattttaaccaattaaaataagcaaagtgcaatattaaatccctggaaaatcttttcttctttttctttttcctcctttttctctcttcttgggccgtcggcccagtccgttcgcctcccgcgcgctcgccctcctct

SEQ ID NO: 66491 - DNA, 8509 bp, Oryza sativa
aaaccctaaattaataaatgcaaatattaatcggaatcggcatgtggaatttttcttggattctacatgtcaaaatacgctaacaggatttttagtggaattttcagagcattggaaataattttaaccaattaaaattgagcttgtgcaatatataaatccctggaaaatcctttcttcttttcttttccctcctttttcctttttcttgggcccggcccattccctccagcgccggcccgcttcacctcccgcgccgaccttccctcggctgggccggtccaagccggcccactccctccctcctctctccgggtcaccgacaggtggggcccacctgtcggccccttcttcctcctccagccgacggcaccgccgccgccgaaaccgccaccgacgccgccggtttccccgtttcccgcgcccactccgcccgtaccgcacgcccacgtcgccgcccaccttccccgcacctcccgccagctcgcgcgcccgcaaacggcgggggatttgaaatttcccccactctctctctcctcctccatttcccccacgtcgccggccaaatcggccacctttccggcctcgtccgcccccccgagcccatataaaccatccccgcactcccctccacctttttcctctttccgccgctctctcccgtgccctccatcactcccgcaccgctacacccgccgccgccgccttttccactcctccggtcgccgctcgccgccgctggagccgccgccgagccaatttgccaccgccattagcttcgccgccgccaaagctaccccggccgccgcatccccatccaatcccgccatcggggcccgcttctctccgcgcgccggtgagtaccaccatagccgccgccgtcggccatggtttccgcccgccgtagaccaccctctctccctctaacccctcacacttcctctcttagggtgtcccggagctcggccgccgttcgccgtcgcccttcggtcgctcaccgtcgtcgtttgccgtcgtttcctcccgcgccggccgaaccccggtgagaactccctctctcttcctcccgcgcgcgccgccgctccccgcatgcgcgtcgccgcgatgcaccgtcgcccgcgtcgccggccgccgtcgtcttctcgccggccgccgccgtcggaggccgcttgccgccgccgccctcgccataaccggccggccggcttgaagccgagccgagccaggccgctttcccccccccccttgtgacgctgcccggtgggtcccgcctgccagccgcccctctccctctctcctgtgcctctgtcccgtgggtcccgcatgtcggcgccgccccaccccttgctgacgtcagccctgggatgaattattgcgcaataaattgattaagggtttttcttttatagtaataaacacagtgaatcttctaaaattcataactaattcatccgagctccgattaatcccattcaagtctcagtaaattcataaaaatgtgtagaatccattaaaaatggttttgcttcctgtttcagtagtcttatagcatgttttgcttgtgtgctttgtttgtcgcgtagatttcgcccgtttcgtcgattcgtggtttcgcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactgattagtttaggtggtggtttgggcctgttgcaacgtggtgtaacgttggacagtgattggttaatatggattaattactacaactgttttactgctttcaactactgttttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacaatcagcttagaaattctggttcgtgaatttctgggcgtgacaagttggtatcagagccgaccttgaccgtaggacaagccaaatggaaaccctaagagccctctgaaaccttttcatctgcatatgctttttgcacttggatttgtttcgggaaaaattttggggttttgttcttttgagtttgtgggaaaaatcttggtcgcttatttaattggatttctcgactagggacagtctagggtttggtaaaagtttatttggagtttatttgacagtcagttgggaatttatcgggtgatatgcattaggtcgtgtctatgttcgatggggcaatgttacgcgcatcatttttcatgcatctagtttatgcattaagctatagtttagtcagtcgcattagtgtctttatccgggttcatgaaaaatgttctatgcatacaaatcatcatgcttggctagtggtttgggccatttgttgcttggtttaaatttggatttgagcatgcattgattcctatcccttgtctaccttagaagtcagacatgttcttcgatcgcaagcgccgctccgagcttcagagtcgccgcccttagctttatcgtcttcttagtctgtttgcgtgctagtttttgtgtttaggtttgttgcttgtgggttaatcggcggtcgatatcatgtgtgagtggtatgacagccttaattaggaattgcgtgcctctttttcagtgttttaatcaagattaagataattgcacttaattttataagaaagattagtttccgagccatctgttttcttcctttctcttatttctacctatcctcctccagatggtgaagacaaggaatgatccccgtgactccaacgacgccagtggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaatgactggctccgtgctattgagaagaagctgaacctactgcaatgcaacgaccaagagaaagttgcttttgctacacaccagttgcaaggtcccgcttctgcctgatgggataactacgtggcgacccgtctagatgcaacggaggttacttgggcagagttttgtcaaagcttcaggaaggcacagattcctgaagggattatggcacaacagaagagagagttccgtgcgctccagcaaggaaccatgtcagttacagagtacttgcatgagttcaaccgccttgcgcgctacgctcctgaagacgtgcgcaccgatgctgagaagcaggagaagtttttgtttgggctcgatgatgaattgaccaaccagctaatctccggagtttatgaggactttgagaagcttgtggacaaggctattcgtcaggaagagcaacgcaacaaaatggaccgaaaaagaaaggcagctcagatcagctttcctcaggggaacaatcagaagcctcgcttcatgacgggacaactaggtgggccttccaccctgatcgtctgtcagcaccgtccctatcacccgagtaacttcgacaacgactacaacggtggcagtcacaacaacagtaagcagcacaaccacaactcgactccacccccactaatggcaccagctcagtcagatccgccagctgtgtcagttcagtcagaacaacccaagaagggggctgtaggaaagccaggaccctgcttcaactgtggcaagcacggccattttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcgatagtagaacttaaaataccgatgcaggttcatacccctggaaatgatatgaggacagcacactactgcccctcggtgactatagagatcaaaagatcaccgtttctatccaacctcatccttctcgaatctaaagacctggatgtcattcttggaatggattggttgaccagaaacaagggagtgattgactgcgcaagccgcaccatcaccctaaccaacgacaaaggggagaagatcaccttccgttccccagcatcgcagaagcccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactactccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacataagcagcatctccgtctggtactcgagaaattgaaggagcaccagctatatgccaagtttagcaagtgtgacttctggttatcggaggtcaaatttctgggtcacgtcatttctgctcaaggcgtggcagtggatccatcaaatgtggaatcagttacaaagtggaccccaccaaagatagtttctcagatccggagttttcttggacttgcgggctattaccgtcggttcatcgaaaatttctccaagattgccaggcccatgacacagttgctaaagaaagatgaaaaattcaagtggtcagctgagtgcaaccaaagttttgaagaactcaagaagaggttagtctctgcaccagttataattctgccagatcagacaaaagacttccaagtctactgtgatgcatctcgccaaggattgggatgtgtgttgatgcaagaaggcagagtggtcgcatatgcttcgcgacagttgcgtccacatgagaccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcacggcctacgctcgtggatcaagtcagagcagctcaagtaaatgatcctgaaatagctgagctgaaaaagaatatgagggtcggaaaagcccgagatttccatgaggatgagcatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggccagcatgagaagagagatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccaggacatcatcgggtcacgattcaatctgggtggtcgtggatcgactcaccaaagttgctcattttattccagtacacactacctatactgggaaaaggttggcagagctttacctttcaagaatcatgtgtttgcatggggtacctaagaagattgtatctgatcgagggagtcagttcacttcaaaattttggcagaaactgcaagaagaattggggactcgtttgaatttcagcacggcctatcacccgcaaactgatggtcagaccgaaagggtcaatcagatcttggaagatatgctgcgagcgtgtgcgctcgattttggtggagcatgggataaaagtctaccttatgcggaattctcttacaacaacagttatcaagccagtttgcaaatggcaccgtttgaagcgttgtacggacggaaatgccgcactccgctcttctgggatcaaactggagaacgccaattgtttgggacggaagtattaactgaagcagaggagaaagtcagaaccgtcagagaaaggctaagaattgcccagtctcggcagaagagttatgctgataaccgccgaagagagcttactttcgaagcaggggattatgtgtaccttcgtgtcactccgctcaggggagtacaccggttccaaacgaaaggcaaattggcaccacgctttgtgggaccatacaggattttggaacgccgaggtgaagtcgcttaccagcttgagctcccatctaatatggttggaatccacgatgtgtttcatgtatctcaattgaagaagtgtttgagggtacctgaggaacaagctagctcagagcacattgacatccaggaagatctgacttatgtggagaagccgattcgtatccttgagaccagtgagagaaagaccagaagcaaggtgatcaggttttgcaaagttcagtggagccaccactcagaagaagaggccacctgggaaagagaagatgaattgaaggccgcccatccgcacctcttcgccagctcttccgaatctcggggtcgagattccgtttaaggggggtaggtttgtcacgccctgaagttcccttcccttgctctaaattcataaaataaatcgtccgaagaaattgtttaatttaacctagagagaaaccctaaattaataaatgcaaatattaatcggaatcggcatgtggaatttttcttggattctacatgtcaaaatacgctaacaggatttt

SEQ ID NO: 66492 - DNA, 8154 bp, Oryza sativa
tccttcggcttcgcagcatcctcgccgacctagtccacctctccgtttcggtcgccgaccgccggagcgccgtcgtccccgtcgacccgagccgcgccaccacctccctccgctccggccgcctcctccgtcgccgccgtcgccccggggtgagccgtggaccgtcgcctcctttcccccttccctcccttctctcggccgccgctccgccgcgccggtggtcgccggcggcgaccatcgggacgcgggcgcgccgcctcccgccggccgcgctggcttggccgccctcgggcgcgtcgagtggctgccgtgtggggcccggccgtaagccgcccgggccctcgggtgcggctgacgcgtgggacccacggcgccggccggtgtgagccgggtgcacccggtccaccgtggaccgtgaggctgccgcgtgggccccactcccgtggacccggtccgcgcgccctctcccctcggctgacgcaataattccgattttaaattaaaatttaaatgaagaaattcgcaaatattcaattaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttctgttggtcgtgtagacgctgcagcttcggaagatccgctcttcgtggaagttgaagccggcgtttgggaaagcgagcaaggcaagtcacatcatccttgaacatattaaatcccagtttataaaattattttgatttaaattattgcattgtcgctttatttaaattcccgcgttatcactgttttatttagccatgcctatttacctttgttatgaccttattattattgttattgttattattaccttgttcaccctagattaaacaaaaccccaactagtggatactctacttacggtaccactagtatgattttaggtagatgcttcgctgtttaattaggtaacattaggtggttttacaactctagactttgggatattctcatcacctggacactttggaattgttggattattgtggaattggattcacaccgccccctctattcaaaacccccaaaatggttttaggctgggctcggggtgcatggtttggatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggctaggatgggttggaaactatgtcatgtcttccgtccatatgccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataataccgtgtagctttaggatcgtctttttaaaatggctttgggcaactaagtgacttttaaatgctgtttactgcaaaacttaacccctttattattaccccttgtacccccttgcattaatcatgcatctgccggtgtggcttgctaagtactgtggttgtactcattcttgttcaatctttccccccttcagtaagagaagcttcggagaagatgtcttaggtggagtcctggcttataccccagttgagcgcctgtgaagatggagccgtaggcccgctagtccgctgctgtttatttttgtttgtcaggccgaagtgcctttgtaataatgtaaatattatcgatataataaagatgtgccttttgtatcatgtttgtttggtgtaccccggcttttcctgggacggggattaatacactagcgttcgggaaaatgtatttttctcggtcgcgacaagctggtatcagagccatctcgactgtaggataagccaagtggataaaacctaaggacatattttataaataaaactatttgcgaaagttccttctttctccttcccctaatgctatttgcaaaaggtttactcccttcttccttcttcggatttcaactagtactagatggtcaggtcagtgaagaagaagacatcgtcagttgtttgccgaagctccggaagactgcaggatccgttagcgaagtggaggaagcagtgaagccaactgtgaagcaggagtgaagatcttgggaacccgtcgcagaacctaagccaccctctagtgtttcgtttgtcgtgtgtttccttgcttgtgtgtgtagcgcgtggtttgcatcagtgggttgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtgacactggtccaacacctgattaaccagaaccgattgcttatagagatactacagcagcatcagacgccaattctgaacctgagtcaaatacaacctcaagtgcagttggaggcagtccaagcactcacaccacaagtcagcatgccgccagcatcccgaaggacccatggtgacgtgccacatgttgactcaaaagaagcaagtatcatttgttttatgtgtgatgagcaagggcactatgcaagggagtgtcctcagcagaaaagaaaaacaccaatgcgaaccgaagatgaagtccgtaagatgatcattaccagcatagaatggcctccaccaggaatgacaaaacgtcagagaagaaataccttccgaggtgcaccacagttgacagagcatcttttagctaatggaggtagggtgtctgatagtgaagattcagatcaagtctcctcagatgatgaagatgagaagtctccccaaggtttcaaccagaataaaatggaacgaaaggcatgctctcgttgtggagaaatcggtcatgttgccagctcgtgtgccactacatgcgttcattgtgaggaagaccatccacccgacaggtgcccaacgagcaggatcacttgtttcttttgtgaaggaactgatcatgtaccaaaagattgtcaattcagttttctgctgacgaagaagatggccaaccaacccgccagttccaacggagagaagcatcaaggcaacacaaatcctcgtcaagattacagttttagcctaactccagtgccaggacagaggaatcaaaatgagaaaagaaaatgccgagtccggaaagatatttgttgcttcaattgtcaaggaatgggtcatttcgccgacaagtgcccaaaaccgagaaacatagctgccagcacctcagtccacgcaactccctgcaatcagaagcttgctcctcagcgaattgtcatccatgcatcccgaagcagtcctatagcccccgttgcaacagctccaactccagcgagtgcattaccacaaggtgtcaatgctcaacttcagccccagccaccagttgacaacacagaggccagtatcggcattgtacctttggatgttccagcacagcagccaagaaatcaagtacaagataaagaacccaagccaatgggaatgagaaaagcatcaacgaaacctcaccagagctaatccaaattgtggttaaccaaaccaacatgttggcaacagcctttcaactattacagaattggaacaacccagcaggggcaaccaacgttcaagtacctacagtccagcaacagtgcaagttatcagaatttctaaaaactgagactccaacctttgccattgccgtcgatcctatggaagccagtgattggttgcgcacagtcgagaagaagctggggttggttcagtgcacagaccaggagcgggttgtcttcgcaactcatcagttggttggactggcttcagaatggtgggatagctacgaagcatcacggccagaaggacataccatcacctaggacgagttttcatctgtattcaagatatcacatgttcccgcaggaatgatcacactgagaaaacgagagttccgctacctgaatcaagaagatttgaccgtcacagagtacctgcacgagttccatcgtttggctcactatgcaccggaagatgtggaaaatgatgaagacaaacaagagaagtttctccaggcgttaaaagatgagatcgcagtgcaactactcctagaggaatatgaagattttgagaaacttgtggacaaagccatacaactcgaaagtgagcataatcggatgaagaactgtaagaggaggattgtcagcatcccagtatcttcatgtggtaaccaaagacagcgcactgagccacttcagatcatcggatcttctgttgcacatcaagagtttccgccccaagaagatggacacaatgcagacaacaacattagcaatactaatgatgatgataccaccaacaaccatgctccatgccccattagtgaccactcaaaccaagcgtgcaatgtcaacatcattcaccaaggtgtcgacgatagtatcgatgatggcacccaaaatgacaaccctagcaattgtgactctgagaaagactccaatggtgatagcaactatggtaccactgatgccaatgttagcaaggatttccaaccaccaattccaactccaagtcagaatgatcgtccccagacggatagctcagcaaagaagacgttgatttgctacaattgcaaagaaccaaggcattactcgagggactgcctgcaaccaaggcaaagtcgacctccacattaccgccaagttacacaaagcagacatcccaatcgtattgtggtcactggagcaaacaccgtacccgtgaggcctcgtgttaatcagaacccatagcagaaacaatgtaccgatgctaagcacttttccttttaggcagtgcttagtattcatgtaatgagggagaaatgtgtaatacagacaagttctatgaggattcttttggaagatgcggatatgtgattatgtgtataattgcttactgataaaggagacctagggtctcattccagaggaactatgttctaacctcgagttaataaccaaccggatgatggaaaagaaaatcaagtgattaaccaaagagacatttgtttggactaagtgtttcagatgtgtcttctttggatcaaaggcaacaaccgtcagtctagcttttgatgaaccacttgaaggttctgtgaaaggcagcaggctcaagtaccacattgccccagaagcatcctcaacacccggagcgaagagtacctggttgagaaaggtcgaaaggtgattaatggaagggatcggaaaagatgtttggttactgggaaaagaagtaggtcgaaaggtgattgataaaggataacgagaaccacgatttgtgtcactcgaggaagactcccgatagcaatcaaccctacaacagttgccctgtcattaaagtaggtgaattcacgagtaagagagatgaccacaggtagaagtacttctatggggacaaggatggaaacttttgtgacatgaccaagaagtcaagaagtaaaacctgaacagtggaatctaaagctcggttcaaccttgggctttgtatcagatgctactagaataaaagcacttgcactagtatcgttcaacgcacttttctagcaatcgatccatcgagaaagaacacatcaaggctgaaggtgcaaaggaatacgttgaatgctaaatgatgacaacatgaagagaatagtggaaagtaaactgaacataaagaaagtgaatccgagttgcttgttcgtgagagctattcccagttatgaatcaagtgatatgttcgaagataatctacagaggtcagattaaaatcacatctaacaacgaagcctcagatttggcaagataatgatcagacaataagaagtccagcagtaaaactatttgggaaggcgtcaaagtatatcaagtgggataagttggttctcttgggaagcataattcaaaggcaaagttatcgacccttgcatcaaatagaagaagtagctatcacccggagaccaggaaaactaatatgaggcagttggtggcaagttagaagtaaatgacaagcatggtattctcatgatgacaagcatggtatcttagtaatgacgagctgatctcgacgcatgacatgaagtgggtaacttgtatgaggttgacgccaaagatatgaatgataagaagttctagaactgaagccccatcctcgaccgccacagcctagtctgagtcagttagaggtgcaaccagggaaaagtcgggtgaagagaagattccatctgcaacaggagatcgagccaagcagtccagagtggagaagttttgttaggcaagtttgttatagaagacggagcggaagaagtcagacaagaagagaagaccgcccaacctatcttcatgctagcctcctcgaatctcggggacgagattcttgtaaggggggtggatttgtcacgtcctgataaattcatcccgaattaaaaatcattcgctaaaaggaataatagaattaattaaaattcgaaaagaaattgacaaacactaaaatacgtacaagaaaaattcaaatgtggcccggagaatttttgttaaattctccttggtctaaaaggagccctcaaattttagtggaattttcagagcacaaataataattattaagaaataaacaaagttaaaatgattttataaaaagaaaaaccctaaaaagtctttttctccccccctccccctcttgggccggctcggcccatctccttccctctctctcctcctccccgcggcccactcggcctctccccgagcgcgccgctgacgggcgggcccgcccgccaccctcgctgacgggtggggcccacctgtcatccctatcctcccgccgctcccgccgccccgcccgcgccctagcgccgccgccgccgcgaatcccgccgcctcccgccgtccccgcgcgcattaaagtggggggaattattccccgcgatcccctctctctttccccccatttctccctctctctcccgcgttcaaacgggcggatttgcccccgcaaatctcgccggcgccattgatgacggccgacctcccgcgccggtttcctcccttccccggccaccctctctcgccccggctctatttaaaccctccccgcacctcctccgtccggttccgcctctcgccgcccttcctcctcgccggatttgagctcgcgacgtcgctctctctttccgccgtcgccgccgagctccggtccgccgcagtcgtcaccccggaccgcctcccacctcggcgccgcctccttcggcttcgccgcatcctcgccgacctcgtccacctctccgtttcggtcgccgaccgccggagcgccgtcgtccccgtcgacccgagccgcgccaccacctccctccgctccggccgcctcctccgtcgccgccgtcgccccagggtgagccgtggaccgtcgcctcctttcccccttccctcccttctctcggccgccgctccgccgcgccggtggtcgccggcggcgaccatcgggacgcgggcgcgccgtgtcacgcccggaagttcccctcccttgctctaa

SEQ ID NO: 66493 - DNA, 1259 bp, Oryza sativa
tgaatccttcgtgatggaaatgccctcgcctacttgactaaactaaggacctcaacggaagcttatgtagattttctacttttccattttccttcttgtttatcaatcaccaatcaagacaaaccgggcactacggtgagacgtgaaaacacccgatcctattccgacctcgatatatatgtggaatcgtcttgcgccatatgtactgaaattgttcgggagacatggtcaaagcccggggtaaggctaaaggagatttcttgaagccaacatccagccttagtggcccctctctgataaggttttaaagttttcaaaacgaaaatcaaatgatccgaaaatcgtataaaaatgtgtggttccaaatgcgctaacgcgcaacagctttcgcgctagttgctcaaaaaatcgtataaaaataaagcaatcaaaaggtgaaggcagggcagtgggcgtgggactgtaaatcctttttcgttcgctgggcctgggccctttggactctaaatccaaacggagtgagtggttcgattccactttagaacgaaagcaaatgcaagtgaaacgagacaagaatcaaagatttttcagtgccgctaaaaccagatctggaaaagtgttcagtgcatcctaatctgaatctgcgaaacctttctattctaagacggctaagtcgagggcagacacaacaggtcccgaagaggttcgaaaaggcgtacatgagttcctcctacataaggggctcattggttgtcaaccaagtgagaggggtctaataaagctgaaggatgagtatagataccttcagccgagatcgcttgggaggcatagccgcctctaccaggagattctctcttatttcttaagaaagtatgaattgccatagaattcttcgaggcctgattcaagatctgaagtatgtattgaacattggttttttcctgtcaataatatccgttaaaaagaagagagagagagagagagagagactgccatcgccatctctctctctgtcatgtcaaatcgagattgtgtgggtgttcggtatcacaatccctgtattctaggttctggctggttagagcagaggactcgaaatcctctttagctttgcgcgttggactctaaatcctaacagagtggttcgattccacctcagaacgaccttcacgaaagtgaaaaatcttcgtcctaccaaaaccggatcttgaaaagtgttcagtgcccaacacatcggtgaaaccggggagagctggaga

SEQ ID NO: 66494 - DNA, 2585 bp, Oryza sativa
aaaggacacctatcacgcggtcatgccttgaacgcagtaaagaaattaataagcttcgaataatagctacgctagtctccaatagcgtcttaagcgttggttttctttgcgggcatcgtaatggattggtggttcgttgcctctattttaaatagggtacggcatactcgcctgaatcttctctctcggttactcagtggagtgatctctctcttaaattcccataaggataaggaaaagtagacggttcgaaacccgtgcttaaatcctactgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaagaatggcataatagggttgcatttgcaaaagcagcatttagcaaacttttgagaatttgataaaacagttaagtaattaaacaatattaatccaacgctatacaacataccctgttgtataggcccaaccattctgaacaaccaccccggctgcacagttctatctccaaaccaggaatataccattccaaaccaggagctaatcaaattattaccagtttaagcatcttttacaatgatgagaggtgtgagactaatcacgaaagacattgttagacccgcccataacagcgggcacggctattcgaatagttttactctgatcagaggtgtaccactgtacccacaagacacaaccccacatcatgtcaccatgtgcctcaataccaccacggtacctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataataatgagtcattagttatcccgaatgtgtactaatgtttctaagcagggctaagcaattatatctaatatctagttgaaacaatataaataaagctcaactagtcaaattgtaataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcactaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaaattgaattatgacgcaataatgaattatttttgaaaaggaaaagaaggtttattgcgtcagcgggctagggttttggtggaccgggcgcacgggcggcggttcacgcgaacggacggccgagatcgaaccaatccaaaacggacggccgagatcgatcgggtccacggcggctcacggcggacaaccccgatgacgtcggcaatgacgtcaccgacagcggcggcgactcgacggagcggacggctcggacggcgcacgctcgccggcgaacggcggcgcgaggacgcaaacggagggcaccagcacgtagaggacaacgcggcgaacacaccggtgaccaaaacggcggcggaagaacaacggacgacgacggcggcgaggaggaaacggcggaaaccttcgggttgtcgacggcgacgaagctccgacgatctccggtgacggcgaaggggcggacgaggacggcgacgtgacggcgaccacgatgacgtccttcccgagcgacggcgcgtctggaacggcggcggagcacggctggagcggcggcggcgacggcgaagctagggcacacggcgctagagcgaaaccggcgacgagaggcgaaggcgagggtgcctaaaaaaacaggag

SEQ ID NO: 66495 - DNA, 2079 bp, Oryza sativa
aaagaaggcgccccggcaggaattctgtaagcttgacttgcgcgcagcgtttgggaatcaaagataaaaaataactctatgggacttacggaactggaaaaaaggtagcacctaggcgtaagaaagaaagtaaatagagacagcacctactacgctatctattgaagcttactatataatatataaaagaaaaaaaaaggccatataagtgagatcctagccagagaagagcaacaggagctataaaaaaggaacttatggacttgaatcagagattgggttgacatccgaaacagagaggaaaagaggaagcaaacatagctagctcacgaaagaaagcttgcaactacgcgttatatattttattttcaactgcgctaataagggcacatccgctttctctgtatgtagattaaaaaaatacataccatattttttcccttgctttgctatttgaatgcttacctcagtgcaagagcagggaagaggtttgattgctaataaaatgagtggaagaaggccgtcatggaagagtttggggtccaaagccacaccttctttctcccataggaacagaggtcaggagctaccggcagggcgctgcttttaatctgactgatggctcaagataagttggagacgtacttgagatagataatttatgtatttcgctatttcgaatacctaaactcaagcggtgctaatttgctaatccaagccttatcaataataccaacacgccgtctgatccaagattagcaacctctctttctctcacagaggaacctcactgacgcattcagggctctgcagttgaagcgttcctaccatccatatatagggaatccataccgtcagcttgtcgatccgggatcgcccaggatcgggtggaaggtcagagaagccagtcttcagtggtgcttccatggcagttggatagtagatcagagaggcaggccagtagaatatggagttgtttttgttctcttgttattcttttatggctataagtctttctgtcttggattcgtaatgtttggccattaggtttgaatttccttctctttctgtcttccatttgaattctgtgacttatcctgcaatttggagagtagttgatatggtctttcttggctttggctttcaaagtccccttcttttagtattaggtagtagagggcatcgccactcagagattctacgataacccgcatattctaccttttgttccccttcctctggccccagaactctgtttgtccctagtagcactcccgtcttcttccaaggatgaagcctcaatgccattccctctttctcgggcattagattttgcttgcttgtactagaagttaacatcttcattactcgatggtgaaacctactctggtggggtccgagaacatagctagcccagaaagattgaagtgagagatttgcctggaaaagaaaggtttagtgctgcctgggttgagccattcctaacaactcatccagctcgactagcttgcattaagagtagttcatttcctataaagtgtagcgagttttctcccttttcacataaccaagaaaaaaggaaaagttaccctactacatgtattagctagttttgtctagtcaacatctaacgctcatttcactatgggatttatttactccgattgcttctactctcttacaactgggtgcgcctataaggaagacttttcatagattgactttgggcaggcaagttgaactatccggcttcactaacacaagtaagaacaagtataaaactccatattaagggttccttttgacctagtgattagcacaaaggaggagagaaaaaaggattgaataagcaagcaccagcattgactttcttgctttaactaacctgacaccaggcccttttgctctaggctctactccttgtcattgatttctagctagctttcccactcgcataaaaggaatgaatcgagggtatttacttgcatttctttgtcctacttgggctttaagaagagaggatttattagcacgacgagcaacgcatgctaacctagggattgaataggatatcataga

SEQ ID NO: 66496 - DNA, 1321 bp, Oryza sativa
gactttttagggtttttctttttataaaatcattttaactttgtttatttcttaataattattatttgtgctctgaaaattccactaaaatttgagggctccttttagaccaaggagaatttaacaaaaattctccgggccacatttgaatttttcttgtacgtattttagtgtttgtcaatttcttttcgaattttaattaattctattattccttttagcgaatgatttttaattcgggatgaatttatcaggacgtgacattaacccaacgctatacaacataccctgttgcataggcccaaccattctgaacaaccatcccggctgcacagttctatctccaaaccaggaatataccattccaaaccatcccggttggcacggttaatgtttcacagccgaaactcgtgaaccggtccttaattgtcatgagcacgaccatcaaaaccatgtgctcacaacccaccattatcaggttttagttggcaaattaattaattaaccaatcacgattgaccatcgtgagctatcattaagacatcattaaataatagtgaattataagttatcccaatagtgtgctaatgtttctaagcatggctaagcaatcatatctaatatctagctgaaccaatatataaagcccaactagtcaagttataataacccaaggtatcaaggaataaagtaatcaagaacaaaagggctataacaaacaataggttaatttcacccaatgacattcgaaaataaatgcaatagttgaatagaaacaatagctttaaacgggatcaacatgctcaaagggttgtttgggatctgtgtgacttgccttgctgtcacgcctagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcaatccttgacggcagcgacgaaaccaacctcttcgagacatcttcaactgggaaggacttcaactctggtgtgggggaaaagagagcaagactgagtactacccactgtactcagcaagtcacaccagaagaggaggtatgatgcaagatatatccaaggggggctaaaggttcttttgcataaagccggcatttcaaagcagtagttgaaagcagtaaaacagttgtagtaattaatccatattaaccaatcactgtccaacgttaca

SEQ ID NO: 66497 - DNA, 802 bp, Oryza sativa
tatgacttgctgagtacagtgggtagtactcagtcttgctctcttttcccccacaccagagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacaatcagcttagaaattctggttcgtgaatttctgggcgtgacacgccgcctcccgccggccgcgctggcttggccgccctcgggcgcgtcgagtggctgccgtgtggggcccggccgtaagccgcccgcgccctcgggtgcggctgacgcgtgggacccacggcgccggccggtgtgagccgggtgcacccggtccaccgtggaccgtgaggctgccgcgtgggccccactcccgtggacccggtccgcgcgccctctcccctcggctgacgcaataattccgattttaaattaaaatttaaatgaagaaattcgcaaatattcaattaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttctgttggtcgtgtagacgctgca

SEQ ID NO: 66498 - DNA, 2795 bp, Oryza sativa
tgagcagtaagcaggttaaagataaattctatttgcacatgtatcaaatactcatactctttttaggaccagcttgtataaagtccaaataaaagttaatagcgaaaaaccatactacgctattaaggcggatgaaagcattaacataccaccctcaaggcattttctatataataagtccacaataacatccgataaaactgaagaaggaaaacaatgtgaaaaagaatatgcacaatgttcatttttcgggtagatctggacgtcaaattgctcatgcataaatttatgtcacactttcaggtcaagctttgcgctttcagacttctgctcaggctgggttcgggcgggcctgagaaattgtagaaatgccaaggaaatggagctggaacattcagatgtgcagtgactagtaaagcagtgactgatgcatctttgctcagattcttgcattatcaatgtatagcggatttggttgatatgttggtgtacgcagacatatggcttgtttttaagttaaattttgttgaaaagctaaagaactatatgcctgaacttgtagcacaatgtaaaatgctgagcatgcacttcaattaagatgcaaagcaagagaaacagaaagactgaccttagctggttaaacaatccaggcactggagaagaaacagtgagtggactgttaagaattgctaccttcagaactttgcttgagttctttagtgcccatgttagcccatatgaacctacaagaaatccctagaatgaaaatgaaagaaacgattcagaaaatatatatgagaattattatgaaaatgcaggttcctaatgttttgggcatgtacctggacaactaagaagaatggctcagtgatatttaaagtactaagaagctcatcgagtgacttgtggaactcctcttctgcacatgatacaatataaatgagagtttagtaagattcattaattttgtcaacatttgccacacggccacacctgtgtagtcgaatccatatccgggctgtggcatatcactgaacccaaatcctatccaatcaggagcaaagcagtggtagccagcatctgccatctagtagcaatttcaatagctgcttagtgggtaaaatgatcgatagaaacaaatcgttagtacgatttataaatttatatttaacatgaggatccctatttattaagcttccagtataatgtcataaatatgctccatattcaaactatgtttttcttttaaattttaatagtctctggaaggtcacccatctgtctcggaatcataatcaacaggacatacacatgctgcagctgttagatgtctaaagtcaccacttaaatggtgcatggagctaaactttgcagcgaaagaaaacatattttagaaagaaccacatactaatttaagccagaaccactgatattttctgtctggtaatgcaaatcaagaacaacaaattgtttcataaattaagtttagtccaacaagctgcaagataaatgagtctgacctgagacataaccatacgatagctaaatgactgagatggagcaccgtgaataaacacgacagtcccacgtcgtgcaccagcggaacctacaattgtatcaccatatttatgaagcaattacatggggctttttatttgacagagacaattgcaagatggctctgtttgcaagaacacctggtgagcccttcttttcatggttcagcaatgacaactatacaaggacaaggtacaagacaaacaaacaaaaaaaggtacattttccttaagttttatagaggcagaattatagcaaattgggacaggttttgtttcctttaaaagctttgcagaaggagatgaacttatgtactactgtaggagaaatcaatattactgaaatacacaaaggtctgacaaaatccactatcttagtgaaagtatcattcgtttttattcttaaatactaaatttgtattcacaatgcaatactgcttcgtcgtcagtacacaccccatttcactggatcaacgtgcatacaacgttttactaacgttcagtgatcactgcaataagatcatctttcatctaaccaacacagaaatgaagaaacagtacctgtttccctcacaaaccaccgcagctttcctgatttcactcttgagccgaactccctccccttgtcctcgatcctctgcacgcgtcgagattactttacagcatactagaaatggtcaacaatgatacgagttcggaatcaaggaggtgtggcgaagtgggcattacgtagagcatctggccgacattgccgtcctgggcgggcgactccggcagctggatggcgccgcggctcgacgggttgtccgtcacgaacccgaacgggttgaactccgactcctcctcctgctttttcccctccgccgtctcatccttgctgccgctcgccgcgactaccaaactccgcttcgctcctcctccacgcgccctccaagcggcggcgttggcgctgctgccgccgccgccggaccacctgcctctgcaagcggggcgtggcagggagagaggagacgaggtggtggtggtgcaggggcagcaggacatggcggcggcgttcgggtgggtgtgcgcgcgcgcgctccggcgagacgtggcggcgcggcgagacgctttcggttggcgcagccgcgtcgaacggtcgggaagaaagaagattctccgcgaattgcggtggggccgacaagatcacttctcatgtggctcccgtgcacaaccgcaggtgagccactctctcactct

SEQ ID NO: 66499 - DNA, 3371 bp, Oryza sativa
tgtcctgaagttgcaggaagattggccattaaatcaaatgttgttcatcaggaaaagtaccatttttgtttccatggtttcacggggaatgaaaattacctggagtaaatggaggacaaggatgtggaggagcatgacgaggaaatgggccttgatttgcatggaacggaggacgccaaggatataagtcttgacctgcaaatggaggacaacgccgaggaaagaagccttgatttggtagtacaggtggaggatgccgaggaacgaagccttgaccagctaatgcaggaggaggacaccgaggagcaaggccttgatcttctagtacaggaggaggaagccgaggaacataaccttgatctgctagtacaggaggatgccgagctgctaaccgttgatccccttgtgcaggtggaggatgccgaggaaacgagacttgatctcttggtatgttcagacatccagatggcatatttggatcatgaccagaagagatgtcttctacttcaagtggagtataagatttctgagtaattggaggaaacacttgtgatggtgctttagaccctgtggagttcttcaaagatggtgatgtatgtttacttgaaccgctttgatgcagtttctcattatccaacccctggaagtgacactctggcatgtcttcagcatcaatgtcatctttgctcttgaagttctctatttctgccttgcgatgagatacttgattcgttatctcccttgaaatcatgtctgtgacattttctttcacctcaaccttttcatgattcttgatgccttcaacttgaaatgatggttgcgatgattgctggaatggactgtttgacttcttatcagataacctagggcaaatcagcacatcagaagttattgtagtttccctgttgattgaatgcacatcacaatttcaactcaactaatatggagattagcgaagtcaacttttggaaggtcatctagatcattagctctatgagctccataagtatcaggctgcagcaaaaatggattagtctcctgttgttttgaagactcaacagcatttgatgcatattcttgagttatgctgcctgagaaggcctccgccatatgattctacacaatttacaggataataccattcaacagattaacacttgcaaccaaatagaactgattgcacaagtaactagatgagcaggttaccttttgtgcagctaaatcatagtgggtagttctctgctgaacatgcaaggatttcagagacaatccttgagaatgtgaagtaggatgccacactccaaaagatccagaatgagaatctatgatggactgaacatgttgctgaatttctgggacttcatgcgatgccaattcgaacggtgaaacctgtgacaactggcatcctattagtgatggtgctttgaacggtggctgcggggttagctttgatgcaagtttgaatagagaatggggcactactttttctgtaggatctctttcaccagtactcttagcatgcccacactgagatagcaaacctggataagaagtaaacgtaaataattcagtaatcaccatgtacatgcgctaatcagtgaaagaagtttaccagttgccacaggatgcgttttcacagaattgctctgaatttcttgcatttgatcaatatcattctgaatattgcctgtgtttgttctagagtccatgccaggattgttggagcatgatgttgcctgatgtccatctgaaaatggcaacgaagttggatgccttgctccaacatgaggcacacaaggagatccctttccaatagtttcagacctgctatgatccacaatttttgacagtggatttcggcgccacacaatgcaccctatcaacgagtcttggtttgtatcagctgctgacatgcctttaaagaaaccacatttcgctaggattgtaattacagcatcacttctggggcagacatagagattggaaccatcacatacatctgcaaaaccaaccttctggctcgcttcaaagttctcggcaacctataccagtgtctcaaatgagttagatccaatgtccagaaaagtccgtagctgttatctcaaatgagttagatccaatgtccagaaaagtccatagctgttacagatcaaaatgtaattaagtgcttgtaatacctctttcattcccagtaagccagcttttgatgtcccaaacttccaacaaagagaaattacctatacatacaggtgttggaatattattagcaatgttacattaactggtacagttaccgtagaagacaaaatttacaaactctttctccattggttttaaattcataagcacacaaatgtaattaagcctaaaagaaagaacctcaaagcataattaagtgggatgaaccttttttagcgcaaaaggtagctaactgtgcatttgattagcaatgaacatagtggatatttacttcaagaatgaaaggaagataaattatcaaaggtttattaatatatcagcaaggattgatgagaaaacaagaaataatcttaccatcaaagatcgggtttgacatcgacggagttcctggacaaacttttcaaacacatctaatttcactctccctttgatttctatgattttcggccaagtaatgtcgtgatttttttctccgctaccaagaaaacaagcaaagacgtatttaacatgaaacaatgtataccctgtgaaaatattcatcattcacaaagataacttcgactcaagctaaatagagaaatataagaatgattattcataaaagtcagtcaactcagcacaagaactagcaacgtagttgaacaaaagtagcaactataatttctctagcaaaaaaatgatttatcaaccgcatagcatcagactagttgtgcttccaagcggcacaaacttagctctggcgtggttatcaagttttgtacaaaaacaatgagatacacaatttatatgcttccagaatccaataaaacttgttgaatatggtatttcagatttgtaaaaaatggatactcttactaactcctcaaagaggcacataagtcacagctaaataggaatttggtgaagttttctacctttttagtataaagtagcaagcaataatcaaatgtagattgtaaaaacgttcatggcttttgccaaggtaggatcagaaatcctatatttattagccttactatttgtctgaagctaagaataaaactaaatacgatcttactagggatgggatgatgtaataaaatgcaccatagagcacaaatatggacactatagaattatcattcttagtagacacgaaagtcaccttttgaagaaggcgatcacagacacct

SEQ ID NO: 66500 - DNA, 10163 bp, Oryza sativa
ttgcatgaactagttgtacatctaatgccactcagttctgtggttcctgacagaatatcttgaggagcaaaaccctgtgagttactcaaaatagagctcaacccagctggaccatttagaaatgattcttcaccttgatgactatctttagcactagtgactaacccagatccatgagaaacggccctattagattcactgtagtgaacagagttcaaaaattttctttttcttggcgtataaacctgaaaaatcatgtcgggggaattactttggcccgacatcctttcctctggaacagaaatattatatggttgtttgttccacgctgttgcgaaggcagaattaaaggaatgaaatcaactgtagattgcagcactgcttccaacaatagcagaatgccagaatatgaagcctgccaaaaacacagtgaataggaaggcccagtcactgaaattggtataagagtgtgagaaaaagtgacatctttacaagcaagctaatctacatgtaaaccattccctcgcagttgctctggaaattcagatggttctatagggaacatcagttcactactgacaatccatgcagtgacagaagagcgcaaacactgcaaaactccacaaaattgatctcctttgcgtgtaagctgccacccaaacaagtaactaaaaattgcccatccgcaaggcagcattaactgaaggaactactagcgcaccactgatttgcagcatccaccacaaaaaccgcagttagccaatgaattccaacatgactactgagccagcatgcagccccttttttacactccatcctatgatcgtccaattttggagggatcaaaggggaaaaaatcgggataagactgaacattgggggggggggagaggaatggtatctcgattgatggaaaaggttcctgcgccaagattacaccctaccagcggcgaaaagaggccgctgccaccgccgcctccggtggctaaggggatccacaagctgaagcatgtccgagaaaaactcgcggcggagggatttgtggaggaggaggaggaggaggaggaagcacgagttcacctgggagagatgaagttgcgagggttttgggcgtcggaactcggaactgtccgatcgacgcggcgtcgagcaggcgagcggccgcagcctacaggaagcaaccgtcggagtcggacgacgaaaacactagcgcacgcgttagttttcacggaggatgcacacggaacattcggaagggtaaagggcagaagaactgcaggtgggaccacccaactttcctctttttcctttggactaacacaagtcacaagggacacaatgtatcccaccttctaggaggagccaccaaccaccagtgtcatcttttatttatgtgtgctatattagaacccatatgtatccaagtgtaaagtgtctatcacatttacacacacataagtatggtttctcatctatttaagcaaataagggatagagatctcaaattaaaaatctaggatcgtgaatcagaagtatttagtatgaatttaggtttgagagctaacaacatcataccctatcgaaaacaccaaaatcaacatacatagtacaaagcaaaccacaaatcaaacggtgttaataacaaatctaaagtaaatcgcaaatcaagtggtattaacaaaagatgtaaaaggagataaagggatttgcttaaacggcgacaagaaaaagtgagcaacaattgagtgatgagatagggttggcgtgaccgtggagggggcacgacggtaagaagattgcagggatcgtgtataactagatctacataccttgggaaggaaacatatgaggcgcttagctctccacaagactaccatccatgggaagcggcggagaccggagatagaagggataagatgcaagagtgagtgagtgagcaaagccaataaatagggaaaagggaagcactgaaggtgtaccctagccgactagccctatgccacctaatacaatgtttgcctatatgggccttagtgcataacaagtaggttgggcttatgagagaagatcaaatcgattgtttcttctaggcccaactatagtcatagtcaaatgaaacttgtggattgggcatacattgtgtactattattgccatagaaagttacgacactactttaaaagaggcttcatagctagcccatcacgatcagttcataatggattctcgcctaaatcattatgaattggcaatgttattgagtatcaccaccgatatgctctagctttgaaactacagtcgtgcaactgattcccgaaccattgccaattcgtcggaacttcgaatacttaacgactcagctctagttgctaggccacccgaatattgcaatgggcctgatgatatgggccaccaacggtaagactatccagatcgtcaatgattcacccctacggccaccgctagagcaccatcaaaactctaccagtaactaaaaaagggtgagctaaaaacctgtcatgaaagtgtctcactatttcttttttctctcatccttttttatgaaactggagagctcctatgttagatttaatttggcactggcccatttaaatcaactaaatcaaataaatctcaagactcatggaatgctaggagttatggtgtttaattcatcatggattattaggaggaccccaaaaaaaaaaaaaaaaaaatattccaagaaatgattaacaaattggcaacatacgtcaattgtatctaattgatggttagttgatggtggtgtagtggaggatggttgatgacaataagttactctattccttttcctatcacatgagtctctttctcttcattttccttctatcctataaaaggagaatggatctgatttcccatgcgcgatagagaacatatactttcatccattttcactttcgttgctgataaggtgatcccattctgacaagtgcgtacacatgcgtgggagagcatgcctctgaaacccccatctcctgatcttgcacaggaggaggcgaattaggtttttggtgagcacatcgcgtgactcctcgccggtgttcatgaatgactacatcgactagactacttccttttcatcatggctagtggcgagaatgtaaacggctacggttatccttccgctacaactattgttgaagcaccgcatgttattttcctcttctattcttttctgttagttccgtttatatgcgcaaacgagttagatatgtttgtttcgatggtctacactaatagcatgcctatttcgtgtattcttcttgttgagagtagttcatctatggataacgatttcattgtttacatttacatcgctatggtttactctgtttatttctaaattaagtattacgatgtctgacatcctgtattggaagctagtaaattaacgtgcaattacattctcatggctattagccatgcaattgtttgattttctagatccatattcaattgagttagactctcaaggataaaattagcctatgtatctgttaacagtaaaatttggtaatcggcaaagacgtcatcggcttagaatcattatcggctgcagcatctcggaatcagccgatgggagttatcaagtcgtcaatagtcgggttcctgctatatttgattaaggaaatcaatctactaaaggaagcttatccctaagtgactgagtttaaagaggatgcggcatggcaatttatctattaattaggaatagtttgttagtttccttttatctttaggttagtttctttcttatccgacaaggacttgtatcaacccatgggtataaatatgtacacccggggtctatgtaatctatcctcacaatcaatacaattcggcgcatcgccaccttttgccttttctactttattttatcgtctggcgagacttggcatctgacgcggtggtgcatcggtgttcgatctccggcgaaagggtaagtccaatgttccgtcggcccaggcaattgtattgtttacgtgggcgtcgttcaagggtgcatcagtacattcaacctcttggatcgctctggtttggatgatatatttgcctacctatttatcatatgtctctattaatctagtcttagcatatcaatttagctctatcggctgcttctcgttttagggtttctgccgatatcggctaaatcgcgttgctagattagattagctcagacatctaccaccctaaaaatcagtcaacggcttgattgtctagatattatgtttcttttcatacttggtgctgcatcagttaagtttgatctactaagtcatgcttaaaaccataatctctagcctgcttcttgattgctaataagggtttcatcggggtttcagctggtgagttatctggacgttgcatcggctcataaggattgcatatacatataagttggatttagccgatgacaacaaaggcttcactgtttaatctaatcttgtggatttcatgacatcggacctccatccgatgtgtgctttgaccttcggatcgatgcttatttatcatatcattatttgctgattggtttatactggattatattgttattttattacatcgtcgtcagccgattgcctttatatcattatctacattggacatatagccgattgcttaaaccctatcggcatcggctgctatcagcatcggctattatcggcatcggctggaactactccatcggcttgtcagccgatcggttgttttgatctactatttgcatatcttgtcagttacaggatcaaactgactggcacgctcgtatctcaccaatctttagacctgcactggagttaagcagatctctcaggctggtgtgttcgatttttttcatcagtatctagcatcgatccacatcagggccatcctagttacatctacatgattcatttaataacctccttaattgatgctaccataatggttttattttggtactaatcaaaacacacttttgaacaaacttgagaggataagcgttggaatcggtacaatatttagagtatatttgccacagcttcagctctatcaaacggttatgcttcacttaaaaaggaagtggatgaactgattagagttctatcacaaaataaattaaagaaatgaagtaaagtttaagctacttcatagctctattctatactcaactcctgaagttaattaaatttataagagatggagttttaccgaacatgcagtactctcttagctagaaatatgtggcgtatccgcatagactgggctgggatagagaacaaggcctagttggttttgggctagaattttgacgagcctttttcacaaaaaagagaacttttgatggaccatcaggcatcagcccgagccccaaactgggccaggcaccatcagtcatcatctctctcggtctcggatagcggggatgcgctttgcgtaaccacgtaacgcgcgcacgtacacggcacggtacccccactccctggccaccactgcttcgcctcgacgagatccatacctcccgggctcccggacgcgcgcgtgctagctcgctcgccgatcgatccatcgtctccacgtacggccgcgcgaaggcacgtagtgaggtacgtgaggcagcagcagcagcaagcatggcgggtgcggcgtcgccggaccacctgttcggccttcgcaacagcttctacgtcggcgcgtaccaggccgtcatcaccggcgtccaggccatccccgcgcgcgctgccctctcccccgacgccctcgccgagcgcgactccctcctctaccgctcctacatcgccatcggctcccaccaggtacgtacgcatcgcgtgcacgtgtccatcgatcgattgatcacgccctgtgtgttggatgagaaaattggcgtaatatcatcgtcaaacagggtttcgctcaaatactactaagcagttggaattcgtcgctgaaacaccattttcttccaattctctctttcctcttattttttctgaccaaaatacccctagttgaattaattaattttactaggggtattttttttaagtaattatgagaggaaagagagaattcgaagaaaatgacatgagcgaagcccctcaattgataatggtatttcggcgaatctcaactgcatagtggtatttgggcgaaaatcctttttgacaatggtaaaatgacaattttctcgtgttggatgacctagctgatcgactcgtcgagcggttggtttctcgtgtgaaatgcagctggtgatcgacgagatcgggccgggcgcggccacgccgctccaggccgtcaggttgctcacggtgtatctctccggcggcgccggcggcaaggttactcctgttgttgtttcatccgcgcgtgcatttcaatttggatccaattaattaccgcgctatatatctcattgtgcgttttgtaatcaatctctgtgtaattaaggaatccgcgatcaggaagctgaacgagctcctggcagatgatgcggtggggagcaacccgattctccggctggttgcagggacggttctcatgcacgagcgggactatgccggagcactgaagcacacaaattctggtgggactatggaattgtaaggatcatccaaccttccatgtaacttttgatccattctgcacagtatcttatttttaccccatgtgttgttccatgattgatacgattgcctgctcgcataagaattatatatagctgaagatttccatgccatcagagaattactgcatgttatgttttaccattgggaagactgaagtcactgaaccgattcacgtctggtgtttttcaggcttgcgatgaatgttcagatatgcctccagatgcacaggtctgatcacgcagagaaacagctgaggataatgcagcaattggacgaagaccacacactgacgcagctcgcaaacgcatgggtagaccttgtcatggtaggaatactatgggttgttacttgagagttgtttatgatgataaatcaaagaggcaggagagaaatctgagttctactgcttcccattgcttctgattctataccagggcgggtccaagatccaagaagcgcacctcatcttccaggacttgtcagagaagtacccagcaacttgcttaattcttaatggtaaagcactgtgcctgatgcacatgggtaactttgaagatgcagagggattgctgctggaatcactgaacaaggtcagttctaatgatgtttttagatcaaaagttctaatgatgttaacctgtccatctgagcatttgctctagataatctacttctcaaacagagtgttagtgcttaacaaaaaatggtcaaactgttcaggatgccaaggatgcagaaactctagccaacctcgttgtgtgcagtctgaacctaggaaagtctgcatcccgctacctgaagtaagtgggttctacactgttatattttcattttgaaggccatttcctaatgccttgtcttatttctgcctgataagtcaagatgtcaaggctctaataattgttatatttctgtacaatttgagcgcttaatctgaactgtaattctgataaccgttgcagccaactgaagctggcacacccagaccatatgctggttaagcgaatgtcctctgctgaagacagtttcgacagagcctgccaagcgatatcatgatttctgcagtgctgttacttactttgctgttagataaaccaaaagcaatgcaacactctgatcttgtcatgacctagacaagctaatttttgttcattagcagttcatgaacaatcaacagaagtactacactttgtcaataaattggtacgagtacatcagtatctttactgaataaaattacggagtacggagtactatctcttgatgcattggcagctgttgttaaactaaatgaattggcagctgttgttaaacaacaatttcggaaataaatgcagacgtagtacaaatacatgctgttttccggacaagacagcatgtgagctctgaatctaacatgtgagagtgccaccataccaacaaaccacgattattatataggactaggagtactaaatttaatttcttagcaagagtcagatgtatctgccagcaaaacaatggataagaggagtacgaaatctagtgacgtgttacttaaaaggacacctaatcataaggatcaacgacagagacagaggttagtggtggaagaaagaatccgagagaggaagagacaagagtccagcttacactccatcgaccaccgtagctcagatctattccaaacagcgatcgacacagtcagtgcaaaacttttgctaaacttaaaaaaaaagagaatattttaaaaaaattgagagagaaaatttgctaacgctggaggaagttcttgtcaagaggcgtttcagttcagctcttcttcggagcggcgtgctgccatctccctaccgtttctgaactcaacttcccaaacggcccagcgcctgctatcgcagtcacatacatgtggggcccattttcgcttgggcccagtggcagtgacccgcagataaaaatctcgcgatccattccacccggaattttatgacgttaaaccccacgtccccaccaaaccaccaccactctcctcggcttgtgtcgcgtgtgtggcgcggcggcggcggcggcggcggagctgagcggccgcggcgatggcgccaagggaccagtcatgtggggacggcggcgaggtggatccggagggtggcatcgaggcgccactcctctcctccggctcctcgttcttccaggacccggcgcacgaggacggcgatggcgacgaggaggcgcgacggcggcggcggaggttcctcctcgccggccgctcccagtccaacaccacctcccaggtggccctcgtcggcgtcggcgtgtgccccatcgagagcctcgactacgagtacggcgcccccctcacttttcccttcccaattcgaggcgcgcgattcgctcgctcggttttccatttgcgatttgactccatggaaaacgcggtgttcgtgggggtgctgcaggttgatcgagaacgaagtgttcaagcaggactggagggcgcgggggcggggtcacatcctgcgctacgtggcgctcaagtgggccctctgcttcctcgtcggcgtcctctccgccgccgccggattcgtcgccaacctcggcgtcgagaacgtcgccggcgccaagttcgtcgtcacctccaatctcatgctcgccggcaggtaagcagcggttgcagagtggtttctacttcagagttcagactaggttggattcagtttgagtaactgatggactttgacttctacgtagttgtctgatgattgacatcaaacattgatttagatcagatcacgggcacagcagtttgcgagtgttcctgagtttacgaatttcgcccttacgatgttagcaacggtgctgacggtgtatgtggcgccggcggcggccgggtcgggcatccctgaggtgaaggcttacttgaacggggttgatgcccccgacatattttctctaaagaccctggtggtgaaggtagactactgttatatctctttcattcaagttatttcatcacagagtactggtaattcttgacacttattagttgtccctgtgatttttttttccaagaagaagttgtctctgtgattgatttgtggcaaacatatatctagtcttttgttccattctgtttttgttcaacatcattggagacgatttaaataagttgaaaatgttggtctgttagacatgatcaggtttgtatgggctaagaaatcatgtatatataactacgaataatatgcatggaagagttaggaaatacacattgtttggtctctggcaggacatcagtgtctgtgtctgtggtacaacttgtttgttattcattttggagcagctctattgactgttggacatgtatatatagtttgcgatgtaactctatgttcacttcaaaagcagaatttagaacctggcaattagtattgagttctgtgtcatctggagattttccccgttccttctctcttgaccaattgtcatctcggtgaagcatgactctttgtttgctttctt

SEQ ID NO: 66501 - DNA, 3915 bp, Oryza sativa
agggaaaccaaagaatgcatttagaagaattggggtatgaaaccttttagtttttggattagttctgatgtattgacataacctttgcataagaaagatcatgcctatcttattctgcttgaatgtcggggttcaatttggagatgctaaaacgattctgaatgattggttttactcaaagtgaacatgactgcccaaccactctagggcaatggtagctagaaaatatgttctctgacttatacataagtgataaattgttatgcaagaaaaacaccattgttcccttccgttgatatatctggatttcatatatactgttttttggacagattgtgggttgcattgctgcagtatcatcatcattgcatgtgggaaaagctggtcctctagtacacacaggtgcatgcattgcatctatacttggacaaggtgggtcaagtaaatatcacctgacatgtaaatggctaaggtacttcaagaatgatagggaccgaagggaccttgttacttgtggtgctggtgctggtattgctgctgctttccgggcaccagttggtggagtcctgtttgctcttgaagcagtgtcttcatggtaacaactttgaatatgcatgtgaaaactccttgttcttttctgttactaattaaaatgtgaaccacacaatttctgcaagacgataccattcatatacagtgttttgtttacaataccattagctccttttttgctttctttgcaggtggaggagtgccctactctggcgagcatttttcacaacagcaatggttgctgttgtgcttagggcattgatagacttctgcaaaagtgacaagtgtggcttgtttgggaaaggtggacttataatgtttgatgtgacttcagattacatcacctaccatttggtcgatttaccgccagtaatcactctaggagttcttggtggagtactaggaagcttgcacaactttttcctggacaaggttcttcgtctctacaattttattaacgagtatgtactgctgttggcttaatgttaatgatcttcacttctgtaattttaaactgcaggcgtttcatatttccatttcccaaagctttagctgacatgcacacattacttccctgtactttattaaaactgtttttaaaaaatggcaaagtacacctactggcatattgcagttatctgttagacttgcgcatcctttttgaagtgaaatatatccctaaaataacttgccatgtaacctcttcagcttactttcaggaaagggcaaaagtacaagctgctcctggctgcagtagtcaccatttgtacatcctgttgtctcttcggcttgccatggattgcttcttgcaaaccttgtccaagtgacaccgaagaagcctgtccatccataggaagatctggtaattttaagaagtatcagtgtgcaatgaatgagtacaatgacttagctagcctgttcttcaacaccaacgatgacaccattagaaacctttacagtgctggcactgatgatgaattccatatctcttcaatacttgtcttcttcttcacatcgtatttcctgggcattttcagctatggccttgctttaccatccggcctttttgtgccagttattttgacaggtgcaacttatggccgccttgttggcatgttaattgggtcccaatcaacattagatcatggcctttttgcagttcttggctctgctgcccttctaggaggatcaatgagaatgactgtctcagtttgtgtcgtcatcctagagctgactaataatttacttatgcttcctttggttatgctggtccttctcatatcgaagacagtggcagatgcttttaatgcaaatatttatgatttgcttgttaaattgaaaggatttccttatctcgaaggccatgttgaaccttacatgaggcaattgtctgtcagtgatgttgtaactggtcctctacaggcattcaatggcatagagaaggttggccatatagtgcatgtcttaaggacaactggacataatggttttcctgttgttgatgagccaccattttcagattctcctgtcttatttggtctagttcttagagcccacttgcttgttctgctgagaaagaaagatttcattcctaactgctcagcttcagcactggatgcttccaagcaattcttgcctcatgattttgctaaacctggctcaggaaagcatgacagaatagaggaaatagaattcagtgcagaagaactggaaatgttcgtagatttgcatccgttcacaaacacgtctccttacactgtggtcgagactatgtctttggctaaggcccatgtgcttttccgcgaagttggattgaggcatcttttggttctaccaaaatcgtctaaggttagtgatactattcacaaatatatttttttgtcggattcttcttcattctactttttatttcctttgctttgtctagataggtctagctattttgcaatcgtcagtgtctattaccttttagaaatgcctttttagaaccaaagggtgataggctgatagcattggcacccctgtttcacttttatattggcaaatgttgcttccaagttccaaccatgaccgttgctaagacaaaccaagatgattagtggcaaaaatctctaaatagccatacatattcttcttggttactagcagcattatcgctttcattgctcatgacagtatttgaaattataaaactttctaataattaacagtgataaatctttgactggttaattcctatcaatgcagagagcgcctgttgtaggcatactgacaaggcacgacttcatgcctgagcatatattgggtcttcatcctttcctcttcaagactagatggaagaaggtgcggtttggcaagtcagcattcaccaacctcgtcttctgacgctcgctagtaactgatgagtttgctcaaggatgcactgctgctgtaaattccatcttgatgctgggagctgcacagtataatcttatatgatgaagaccacaaaaaaatgtagtagattctccagcctgggaatctagcagctaattgtactgcattttcttttcttttctttttttgttacgattgtaccgagtggtaccatattcagaatgttcaagctacaatggacagtgcaagtaggaaatctttttttgtaaatgtaaatcttgtttggaacgtacaaattttgttagtcgaaatgagtttaatcgaaactataaagatgcatgatatataagaataatcatcattccataacttctcgtaactgcatcacaaactttcgttttggcgttgggctatcgctgggtggggtcgacgagtccgaaaaggctaggggcgtcgggaagaggcggcggcgtcgggcccatgaccgaatgggccagctgaaatttataccgggcttttttgttgggctttcgggccggctattcacatcggcccacaagcagccgcggcgtcggtgggagcctacaagtactccctcctaacatgtgaattcgtctaggacagtgacacggtctccaaaatataattttaacttcttatttctataaaaatatttattgaaaagtgatatatgtatacttttatgaaagtatttttcaagacaaatatattcatataatttttacattttcaaactcaataacttgagagttatttatgatttatattctcaaggtttgacttaaatattattctaaacgactttttttttttttgagtatagagggagtacaagcctactgtatgaccatgtccagttgattacgcgaaattaattactcgtatttcaccggcgtgtttgtaaagtgattacggcagcttttatgagaaaaaccagcatttgcaattagatataacgaatacgta

SEQ ID NO: 66502 - DNA, 4174 bp, Oryza sativa
agtccaagagaaaacaaagacaactggtcgcttttgtcgagatctcttcctcccccgttccgttttttttctctctcttttcaaactccgccccctcctctcctctttctctcccacatcagcagcagcggcggcggcggcggcagagcgaagagctccacttgtacgcacgggaatccaatccgctcgaagccctcgcgccgtggagtgcgtgccggccgggcaggggcagtgcggaggcccgcgcgcgggtagctggcgcctggcgctgcggcttttagcatctggtgctttgcgcgttcgctggaagctttgcggccaccgcggccagatgcggttgattgtgttgtagtggttgggtttttttgggttggaacgccgagtcgccgaggaggaggaggaggaggaggggaaggggaatggggttcctggtggggttggtgctggggatcgcggcgggcgtggctctcatagtgggcttcgcccgcgccgagaactcccgcgccgcccgccgccggcagctggtagttatactactaattgcctagcccctctcttactccgtaataaatttgatttgtgtgatgtttagattggagcggtagcttcgaagttgataggagattaattgcgttgtttgtgaatcgagtggaaggcgaatcgcttaccttctaccgattgattgcgttgagctggatggtccctgcgttaggtagaggcgctgcactccccatgtcgactgcttttccattggagcgtatgactagtcaaaatggaaacatgttttgggcttattgagctttcaatttacgaacatgatgatgcggtttgctacaaacaaagtttgttggagttggaaagcactcatgttagggggctcaagttgcagcggaggcctcaaattgtgggggcaagtgcaagcgcttctaataaacaacctagcatgcatagtgcaatgttgggctagaaggccggtgttcatttgatccgtgttgccactattctatttgatgcctattcttgtgccatggctgctggcatgctaaaattcatggctgctccctgctactgactcactgcgcttatggcattttgtttaggccagttgtccatatatgattgcttgcatgctactctgtaaatttagatagctttgatctctgatctttttcctcctgattaataaatgaaactaaaaggggattctccttgtttgtttggacaggctgccacaattgctagtttctccaagatgactattgaagattcacggaagttactcccagctgacctgtacccttcctgggttgttttctcaacacagcaaaaggtatttgacagtatttagttagctctcaattttcatgcttacacactagatgtgaatgagagtatatgctaatgggggcaattttgcagttaaaatggctcaatcaagagctgataaaaatatggccatttgtgaacgcggtatgcattcctttccatgggagactagaattaggatttgacttcttttacaaatatgcttttcttcaatgtcttcttctcttgtcaattgttgtcgcaggcagcatcagaactgatcaaaacctccgtggagcctgttcttgaacaatatcgaccaataatcttagcttctctcaagttctcaaaactcactcttggtactgttgcaccacagtttactggtaagaagctattatatatcattgactgtttctcattatattcttgacagcactgagctatattggtctgctttctctactgtatttttgttagtcaaagtaaatcaacttaattttgcatgcattaagccaagagtgcaatgactgaatagctgacaataaccaccgctgtctggtgtcagcagcttgtggatattagattgtacatggtgtttgatgaaatgttcagaatcatgaaaacttaaaagggttttgatttttgtggttgcaagcgtgagccctgtgtttagatgaatgatagtgtgtaattcattattaagaattgcatcctttggaaaatgatgccgtgtatgtattctttaaacaatactaatttatgctaatgtacttattttatgaggagtttaatgcgctcgcttcattatgttgtttgttttttttagaatggttttaattctttttcttttctacctaatgacaccaaatatttggtatacattttatattttgctaccatattagatttttctgttggttttggtgcaggtgtttcgatcattgagaatgacgaatcaggcattgtcatggaactagagatgaattgggatgccaatccaagtatcatactagacgtaaaaactagacttggcgtgtcacttccaatacaggtgatttatttcatgttgcttgttgtcctgtgttatgaatactgacgaggaggcactgaggcatttacatagtgaactagacctagttcacaaggtttgacagtaggctttgtctattggaacactgaattggtgttcttgataactaatgattaagtggacagttctggcaaaaaagaacatgaattcaagttgcaactaactttggtgcagttgatcttagttaataatccaattttgtgggggtatgtaattcttcatgcagtttttatgtgacatcatgagtagtgtgatggtctgattggatagtgatactgtagatattatctttttattataattgtgctatgtatttcatacacttaaattaattattctttctataataatcttgtgagtgccttttgccatataggtgaaagatattggctttacaggagttttccgcttgatcttcaagccacttgttgatcagttgccctgctttggagcagtttgcttttctctacgaaagaaggttccttttcttggtcgtgttttttattaaaaaaaaatctggttgaaggtattttctcattaatctgatatttttttctcaaatcacttcagaaaaagctggatttcagactgaaggtcattggtggtgaaatttctgctatacctgggatttcggatgctcttgaggtttgaccatacttctctgttttgttgctataaaagtttagtttgcatttcctacagtcaagatggtgactggaacatctcgtgttacaggacacaataaaaaatgctatagaagactcaataacatggcctgtaaggaaagtcattcctataatacctggggactacaggtaattactggtgatttctggggacatactagttttattctcttgactgaataatatcattgtcattacttactatatcaacatatgaatacaaaaatggataaatcccataaattattgtgtgcaacagtgatttggaactaaagcctgttggtacattggaagtcaagctagtacaagcgagggatttgacgaacaaagatctgataggaaaatctgacccttttgcaattgtgtatgtacgacccttgccagataaaatgaagagaagtaaaacaattgtaagtatcagctactctattccctgtttatgtgctccaatagatatgtatattttttaatgcatactgacagctgtttatgtgcttcaaatttacagaacaacgacttgaaccctatctggaatgaacactttgagtttattgttgaagatgcagatactcagactgtgacagtgaagatttatgatgatgatggtattcaggaatctgaattgattggctgtgctcaagttactctgaaggatctacagccaggcaaagtgaaggatgtctggttgaagcttgtaaaagacttggagattcaaagggaccggaaagatcggggtcaggtgagccctgttttcttggcagtgccactctccattttctgtttctctaacacagtaaaatagctcgatcttcttatattgttattcatccagggttgtaaatacatagtatttctcttgtttgaatatcacctcaacaggtgcatcttgagctactctactgcccatttgacatgaaggaggagactccaaatccttttagacagcagttttctatgacatccttggagaggacaatgacgagcatggaaaatgggtcagggagcaatggttttaacaggttgtcttccaggaagaaaaaagaaatcattatgcggggagttttgtcagtaactgtgatatctggggaag

SEQ ID NO: 66503 - DNA, 3683 bp, Oryza sativa
aaatgtgacatatgcagtaccattgtgtggaattacagatagcgcagtagcaaactagcagcctcggaggcttgatttaaaatgcagcaaagaatgttgatcgaagatagctcaagtgcctttgattaaaacaacatgacagactacattgttgatttagtagttgctcacacttctgtagaacattctgtagaacaaaaccaactcggaatttcaataagaaaccaaaaaacaagacgattcatattgctttgctgtcttacagggtctgtgtcaggttccagaaatcatctctcttaggccaggaataagaatagtatcaaacagtgatgttattagatgacatttcaagcctggcaagcacattttttgacagaaacaaacacagtccatggttcaaattcagtacatgacaaacacagccccgtcgacgcgcctcgcggagcccagcgccacgccgccacgaaccagagccctgccgcccccgccgcgccgacgcccctcgcggaggcgcgcggcgcgccgcctatcccggagccccgccgcccccgccgcgtcgacgcccctcgtggagcccagctccgcgccgcctctcccggagtcgtcgaggtcgccctctctccctgggaagtggacagagggcatttaggtttggggatttttggggatttaggtttgcgacagagggatttaggaggggggagaatgcaaatgtactgcagtcagacctggtcaagcgcggattgaacctgagatggtacattaaaacgagatcgtggatctaaacatgcattctctaagtttacagatataagtaagaccgctctacatgtactttcttttaggatcgtaaaatttctgaagaaatagcatacaggaaatctgtgaatgctgtcgtcagacgtaagaactaacgacataagacgaacccattgtgtacgccgcctcatcgtgttactcccgtcatgccgattcggcatgaaaaaaatctgcagcatagatccgtgcctccaacgagaatcatgcacgaaacatgaaaatctccaacgaagacatcgttgtagtaccaagcatggagtattctgtaacatttctgaaactctgaaagctacggctgatataaaatatgcaggagtaaagatttctaggtcaggacacgagccgcacgagcatcccggggtttcctaccttgggcagattcgcttcaggtttggacgataccaacagagcatcatcgtgtgcttcatccagcgcccaataaaaccaagctccgagccccacgggtagaggcacgctcctcccggctaaaaaaatcaggcacaaaacatatgcttctttcttttttgttttgttaatcacgcagatgattctcttcacctggctttgttaattgatcagtaatgcgcacgacgtcgcaatctggtaaagctttgacagcattcatgatcccagccagctttaacaatggcacataatggaaaagacgtgcttcttaagggaatcgaattacagaattaataccatcagatttagatacccaaattaaggtggtccttttcttatattttacctcaggctagctatttgctagctatgcctaaatgtactaacttattatttttatgcgtcaaatctgattttgtcatgatgcaagcgacatcgttatgtttcttgcttttaataacatctgaatcgacgggctttgtatttttcttatgaatcacagcttgttaaacagtataatgtggtactctagtgtcacgccgattgaaccagcacatctgcctgccccgtactaatatgacatatcggcatgcgtacatacatgctatacagactgttcatcgtctgtcaattgcttgcaccctttagagatagatagcagtagcaggtgtatttttgtttcgaagtctacaagctgccacacgtattagtgaagcagtttccggcacaaaaacaacttttagcttgtgtctatatgtgtttaactttaacccatcaatctactggactcttcctggctttgttgtcatctactccaaccggagtgacaccttgctggtagtacacaaatcgcagtactgacaatgtgatactagctagcttgaggtgtccagaaatattccagactgcgtatatgcgtgtaggaaaccaaaactgtactgcgtctcgatctcaggctcatgcagtccacgttttcaatccatccaggtatgttcacgctaaaattaaaagtttggttcaaattgaaacgatgtgatggaaaagttaggagtttgtgtgtgtaaaaaagttttgatgtgatggaaaagttaaaaatttaaagaaaaattttggatccaaactcggcccaacttaccatcaggcaagtccttcggtaattgatttccaaggagaaatcgcccgaaggtctcaagagctagagaggacaatttcacgatggacgtcagtcagttaaccatcgacaacgcaccacattctctgaacatggcaagcaattttacgccctactgaaattccactgaggtaccaacgggggtaggatctctgacttcttctcatgttcacctccgtccatgtcccaatcgggtctgaatgatttctccaggctaataattaacctcaccatggatatcctatcaccaaactgaattatcacgttagctaagaaacctactatgaccaagagaacgtgctccgaatcacaaaagaactctacacaaaccatataaccgtcctaaaatatagcactatattatcaatattttttaatgtagattcgtagtgctatactgcgttaaactctggttttatattgttacattttgttgctagacgcactgacaaacagaaggagagaatagtggccagaagcgtcagagctaggcgcctcggatcggccggtgaatcgaacagctccggccctggcttagccgtgagccatctggccttccctcctctcctgccgctgcaggagacagacagagagagagagagagagaggtgagccctcgcgtcacgtaccccacagccgcgcttgtcgccgtgctccgctctctcgtgaccgtcgaatggtagccgctactgcaatgcaacctgtgcagcagcctgtatcacacagcttttcttttgttgtcattagtcattaccaagccagagttttctttctgtacttggggtggagtaagctgagccgttgattgagccgtgcaggacaccggaaagcgtgatacgtagcgtgttggtttggaccccacctgtccgcgacacgaaacgtggggccccgtgcggcggacgctatcggtggtgaggcaggagaacgagaggccgggatcgcacgaaaatccgtgggtttcagatgagcgccctcgcacgccgcacatcctatatcctctccctctcctccccaaccccaacctcgcgcttcactttccaacgagcgaagccgtcgtcgaggcgtccgtctcctcctcctccttctcctactgctgctgctgctgcttaaacccctcagggctccgggccgacgctccatttgtggctgttgggtttggagcttcaggcgcaatggcccccaagggcgccggccgtggcaagggcaggggcggcggcggcggcggcaaaggcgacaagaggaagaaggaagagaaaggtattgtgtagtacatgttgctggaagctcg

SEQ ID NO: 66504 - DNA, 2733 bp, Oryza sativa
catggcccgattctttccttggtgtaacgcacaccgtcgtgcggttgagtcatgcgttctgcgagctctagatgaatactctgttttcactttcacctcgacatgatgtcgccgtctccgtttttaaggtttttttctgcagctgttggtatgatgctgggttcttcttgtttttgcagttgtgccgagtgccatagacgtcacggttgtcactccctatgaatcccaggttacactcaaggtatgtgtggctgcattagctggctggtacttgctgcacacatgaacacacaaaatacctgaaaggacaatggacaggacaagcaaaagtgaacagaaactggtatctttgggaaaagggggcctaattctgataactgaaatgtctgcagctatttgcaatgagctgcaaagccagttattacttactccacactgcatgctcacaatgagtccgggaaattgagcctttgaaatggaacagtgaacctgagtgaaaagattaatcttgtttttgttctgtgtgtgttcaggggatatctacggaccgtgttctggacgtgaggaagctgctgggctcgaatgtggagacgtgccacctgacaaactactcgctctcgcacgtggtaatgcttgcttcttgtctgctaattcaatcaattgcagtgcttgcagtatctactgataattcaattgcagtgctagtactagcatctatcattccactcttaagtcaaagtgttaattactacttaattatctgccacttctttgctactcttctggaattcacccgggattaatttgaggacagtaacttttaatgtatgtgtgctgcaatgctgttaattctgtaactaattctgtataagctgtgttcggtgaagtctgaatttgtgaagcgtgtgatgtatgacgcagacgcgagggcagcggctggaggacggcgtggaaatcgtgtcgctgaaaccatgctctctcaccatcgtggaaggtacggtccatggtgaaagaatccgcacgctagctgctcttcacttgttcttccttgctcgttttgtttctttctcctttctttttttttcgcttggcaacatggaatgcttcacataacatgatcgaggtggggtagctggcattaggacacataattagttggatgcttaagtagacgaagcaacctgacgagaggacaaaattaagcttgagcttgtggtgtaccgtgtggcacaatctgttagcatgacagtgttatgctacagtccaagtgtccaaacagtctgccatcaatgattaatcaaccaacggtccggatttttccactgaaagctctaaagtctgacgctaatattgctaatattagggaagaacctaatatcaaataattagaaggggtgaggcttcaaatctaggtcgtctagtccaccatcttgtggagctagctggaagacccctaagtgtttctcataagctctaaagtctgaacatgcgtttgccgttgtccgatggtgaagctagtggtttttgttaatgttgactcaccggtagatcatatcaaacctaacttcaaaaatcataatctattcaaattgggacggcacaatgcacatagatgcagccttgtttgtcgacgcacagcattgaatcgaagagcatggaccgcgccggcctttcggctgaataaacttcagaagaaaaaaacacacacatatgactagatcactagattcgcatgctaaggtgcaacctcccacgactccttgtaaatgcagtcatgcgcctccatcacgccccaatactggcacaccagtgagttagataggagcacagagtacaatctagttcattatacttcataattcttgccacttagacagcgagacgtgcaggcaggcagcagcagcagctttgcatagtgcctccagtttcagacattagaagcagcgcatcctgtttcagacacttagcataaaattgtttagaccaaaaaaaatgtgatttacatctcgggtctctaccgttatcctcagatactagcagcaaatggtagccggtttcagtgccgcatctgtagccgatgggagatatagatcgtggccgtgacgtcgtcgcgcgatctgcctctccgcggttggttggggcggggcggctaaggtgttttttccacacacacacacatgtcccgtctctttcgctgccgatgtcgcatttgccgtcgccgcgcgaacgtttcacggcggctttgccagtttccgggaggaaggaggcggcggttgaaccgaacctggacgcccccgcgcgcacgccggctaataagctgaggccctgtttagatgggactaaaacacttttaaaaacacttttaagttcctatcacatcggatgtgtactaattataaatattaaatgtaactattaataaaatctatccataatcttggactaattcgcgagacgaatctatttgagcctaattaatccatgattagcctatgtgatgctacagtaaatattctctaattatggattaattaggcttaaaaaatttgtctcgcgaattagctttcatttatgtaattagttttgtaagtagtctatatttaatactctaaattagtgtctaaagatcagatatggactaaagttaagtccctggatccaaacactcgctgacggatgccggtgatgtttcgtatggttttttttcaacgaaacgtgtggcagcgatggtcg

SEQ ID NO: 66505 - DNA, 5844 bp, Oryza sativa
tgcaaagtggcatttggacaaactggaagggcattttcactcgttgatagcgcttgattagttgcctaggcgaagtccgtcttgtgcacttctctagtgggtcagagcctcttgttctgctttgggaaatacatgctcgttaattaactgaacatagtgctccacctgctgtctgtctcatatggtatttagaactgaaagctatactagtgtacaattaattactgcagaattatgcgattttgtagttgttgtatgctccaaggtctgagctaatggctcaccggttgttgtcctgtcctaaacgccggtacgggacaaaaggacgcctcttggaatcagcgttgggcgttagctcaagtgcctaacttattttactcgccactcttctgacgaatcgacgggtttgtgaattgtgattgtacatttgtttgtagtattggtgtttaggtggtcactgactcatactggtcagtacagtacgtgctagacctgctaccggtcgtaccgatgccatgagtcaaaatcacgttgttggccatgtgtttctaactcgctgacaccgctgggaacgtgatagaatagcgacatagcggtgatagtacttactactatgacacgagtatcaaaacttcagccacgttcctgtggatgaacatcagtcttaagccattttttttttatttttacatttgaattcgatttattctattttgatttgattcgacgacttttgttcaatatgatgcagcagctgctaaaaaaacaaaagaaattgcttcgcttatttgttccagaattgatgggcctgttcatttataaagggaagcccagcacttggcctattgggcctgaattttggtagagctaatcgagcccatgggcctttttgtgcagaggagtacgcgacggaggcggcggcggcggcgcaagtccggcggctgctggacatcgtcgcctgcaccaccgcgttcgtgaacaagccccgcgacggcgccaagcacaagtcgtccaagcacgcgcgcccggcgacgccgccgtcaccgcccgcgctcgccgcctcccccgacgcccatggcgccggcgccgcccaggcgccgccgatatcggaggcgcacgacatggcggccatccgtccgccgcccaggctgggcgagttctacgacttcctctccttcgcccacctcaccccgcccgtccactgtaaggccgaatgctgcatcgcgtttccccctttttgcgaggcgtggaactaggggttggactgacgcgtggttgcggtgtgcagttatcaggaggaaggagagcaatggcgcttctcaggaaggcgactacttcgaaatcgaggtgtgatgcgatgtctctcagaacgctagagagttcgtctgatctgcagtagccaactccgcgatgagtctatgactacgcacttcactgacgggagttgatgtgtggccaggtgaaagtttgcaatgggaagctcctgcacatcgttgcttccgtcaagggcttctattcggcagggaagccgcacaccgtgagccactccttggtggatctgttgcaacagctcagcagtgcatttgccaatgtgagtaaccatgaatcctgaacatgtataatgtataacgcgttgctcgatttactttctgctcctgtttgtttttggctaactatacagccgaccttatctgacagtgatgtcttctaattcattttgcacaggcatatgatgcactgatgaaagcttttctggatcacaacaaggtggttatagtaaatgctgtttcctttttttttttcccccttatacgtagatttagtcaagtaaaatgctaaatttgacaaggatacttctttgcatctccagtttgggaatctaccatacggatttcgtgcaaacacatggcttattcctcctatatacttggattctgctacaaagtgcccagcattaccagttgaggatgagaattggggtggaaacgggggtggcaatgggcgagatggaaagtatgacagaagacgatgggcaaaagaattttctactttggctagaatgccatgcaaaactgaggaagggagggtgatcagagaccggaaggcttttcttttacacaatctctttgtagatacagcaatttttagagctgcatcaacaatacagagactcattgatctgtctgggaactcaactagtcaacaagctggcctagatggttctttagcaatcgaggaacgtgttggtgacttgcttataactgtaaagagggatcaggctgatgctagtttaaagctggaggataaagttgatggagttgcactctatcaaaccggttctatggatatatcacaaagaaatcttctaaaaggtttaacttctgatgaaagtgtcgttgttaaggtggtggcatactactttcatatctctttttttttcaaattattttttgtccttaatattaattaccgatttccaccaacatgattaccattcaggacacctcaatactcggagtggttattgttaaacattgtggatatacagcaacagtgaaggtttcagggcgcacaaaggacggaaatggtggcaaacaaaccagtgatatctgtgatcatctcgatggaatttcgaatgttgatgtagatgatttgccagatggaggttctaatgccttgaacattaacaggtttgatatatgttcccatgtaaacttattcacatgcttgctcatcagtagagaaaataatgttcactggtaactagtttttcttacatttggcacacaataatgttccattaacacaactctctctctctctctctctctgtatatgtgtgtttcagtctaagaatatcactgccaaaaattgtcaactcagacatcgctagtactcagtgtcctactccgcagtctcatgttgataatcatgcaaggaaactagtgcgcaaaatacttgaagatagcttgatgaagctggagaacatgcctgccaataatcctagaaccatcagatgggaacttgggtcatcctggctgcaaaacttgcagaaaaaggattcgccggcatctgaggacaagaaaaatgcaggacatgttgaaaaagagacaactatcaaaggtcttggtaagcactttgaacagctaaagaaaattaaaaagaaagaatgccatgttgaaggtgctatgtctgagaaggaagactctgacagtaactgctctgtcataaatggcatggaagaatctgaaaacaccaaggagactgatattagcaagctgatgtcagaggatgatttctgtcgccttaaggatctgggagctggacttcatcaaaaggtaatttatagctatacagttcatcaatcaatatggtctgaacaatttagttttatgtccggtaagctcatacatgctattttgcttgggattaaagttctaatctgttaaaattttcaccagaagccttgtgttaagctgaatatgatgtagtagcagaagcgcagcattgtatttttccagtaatcaggaatatattggttattttgctgtttaatacttaactttgttatttcttgaactagtcccttgaagagctcactatgatggcccataaattctatgatgatactgcgcttccaaagctggtaagccttgccttgtttatttggagatccttatgtaaattctcgaacattttaatcggcactctcttctctgaaaacaaagtagtcgctttttgctggcattggtattgtttattgtttattgttgtagtaagtagtttagttatggtactaatgttcagttagttcatttgtaattttgaggaagtagtcaatccacattaacaattcgcaccacaaagtccaaaagaattacagttcttgaaaatttttgcgtgtaaagaagaaaaaaaaaacaatgttttttttatgttgtcttaaactttcttaattattatttgatgcccataatagatagttaattttttcttggaataaaataatgacaggtggctgattttgcttcccttgaactttctcctgtggatggaagaaccatgaccgatttcatgcacacaaggggtcttaatatgtgctccttaggccgtgtggtgagtttaaatttattctgaattacttttgcttctatggttggatggaatttccagaataaccttttttttatatataaattaaacaggtagagctcgcggagaagcttccacatatccagtcaatttgcatccatgaaatggtcattaggtcctttaagcacattgttcgagctgttattgcagctgttgatgacatgcaaaatatgtctgcagctattgctgagactttaaacattttacttggatgcccaagacttgaaagtggcactgaaacagatgcacatagtgaacataatttgagatttagatgggtagagaggttcctttctaaaaggtacaattggaaattgaaagatgaatttgcacacttgcggaaatttatcattctgagaggtctttgcagtaaggtacaatccaaagtgtgttccaaaacattcatagagtacagtttctgaacatgcataattaatatgtttatttctcaggttggacttgagttggttgcgagagattatgatatgaatagcccaaatccatttgacaaatctgacatgttaacattattcctgtatgcaaggtaggacactatcagaaaacttaccactgtactttccccaccacctgaattaataattatatctgatttgatctgctttggccttgcgcttcttacagcatgtggtgtactcttctattgatggtcgaaacttattagaatcatcaaagatggctttggataaaggaaaacttgatgatgccgtcaacttcggaacaaaggtatgcaataatcagttcttttttctgtacgttgtttaacagctatgctaaaatatttctcttcctgctttggttgggtgaagttaccattctaaattctttcattaactatttttttttcttttcttgaaggcgttgtccaaaattgtagcagtttgtggtccataccatcggctgactgctaatgcgtacagtcttcttgctgtagttctttaccatactggagattttaatcaggtatttcaatgaatttggtgggctgtattctatctgctgcatagtgatgtgtttttggcacaatgtttggcaactgcatttttcactagacttctgttctttctctgtaggcaactatatatcagcagaaggcacttgatatcaatgaaagagagctaggtcttgaccacccagaaactatgaagagttacggggatttatctgtcttctactaccgtctccagcacatcgaaatggctctaaagtaagtgctgctattaggtgttttgttgtggaaacacaaaagctagtttcatgacttggcttgtagctggtattactatcatgcacaatgtcgttacgctggttcatttctagccattacatgcattaaatatattgcctgtagaatggatactactgcatttgtacggcactatggctgtattaatttgtagacttgaactgtgcattgttttgcattattgtccatgattgttacttgtggtttgcacggaaacttgctgaaggcacatatttgcttgacaatattgtcaaaactcatcttccatctttctttttttgccttttgttttttgtatcgctaatggtatctttttcttaaaggtatgtcaaccgtgcactatatctactccaattttctgtgggctttacatccaaattcagctgccacatacataaatgtggctatgaggaagaggtatggaaagt

SEQ ID NO: 66506 - DNA, 11912 bp, Oryza sativa
tattttgatgtctagacccacagaaacagtcttttctgtatatttcaatccgtttgacataatgcatgtaactacggacaacttcaatggcgtatttgttatgcatatgatcccgtgattcagttaacatgaattttcatgcatttctttgaacaacagactgctgcgagctatcatgccatagccatagccctctcaatgatggatgcatactccttgagtgttcagcatgaacagaccaccttacagatacttcaggagaaactaggacaagatgaccttcgaactcaggttttttttcccttcaaaatatgcaatgacgagtccaaatactgctatgttctcttggactattagacatgataattttcctgctgcaggatgctgctgcatggcttgagtattttgagtcaaaagcattagaacaacaagaggccgcccgaaggggcatcccaaaacctgactcatctattgcaagcaaaggacatcttaggtatgaatacactgtgcattatcagtcgcaaactgtgatgatctggattgaaacatttatctttccagtgtatcagatctacttgactacataagcccggatcaggaaagaaaagagagggatacacaaagaaagggcaggcgtgcaaaggtgattataacatgcctactttttcaaaattattgttgttaaaatgtagtcagaagagataagtgcacactggacagtggagacaattccatcagtattcatgaaaagtctagatgagaataggattggcacaataacttccatataggatgtctggtatatgaactgatgaacatatgctggcagcaaatcagcaatcctatccagttcatgaaactagtaaaaggttatgaaccatcatcactgacataataaccatgacagttatccccaccagtcattgttggagcatgaactatgagaattgaaaagatattcccgcatccacagctagtccattgataccaggcatttatccagatgattccagttcaacccattaacttagcaatgaattgacaacacaatttcttcttagttgggaatttaactccctttacatatggatatttaatcctttgttttctaatatgcttcatgaattgggaatcacaatatacatattttggaagtccattgatgtcatggtttcaattgttgcctaaacattatgcaagcttttattttacccttactaccctttgctttccttttcaccttgtatagtattaaatgcagaataatatcagagcccatcaaggtgaattagttgaagaaaaggagagctttgagcacgacataggatctcctcatgaagcaaacaaagaggagtttcaacaagtaaaatcgaaggcacaccctccagcaatatcagaagaaaattatgctatccatgatgagctgaagcaagttgatcctttatcacctgaagaatattctgatgaagggtggcaagcagctaatttgcgtggacgatctgcaaatgtacggaagaaaagcagtcgcagaaggcccgctctcactaaattaatggttgatcgcttggaagatggccgcacaggttctgcttatagggctggtgtacaacaacacatgaaaggagataaagaagatgttataaactcttctagccagctctcctttggcagctttctaaaaactgacaaggtgaatgggaattccagcaatattgaaaataaggttttcaatgctatatctaaaccagaacgaggcataaagctttcaggaattaacagacctgctactatagcttccaagttggtatcatacaaagatgtagcagtgtcaccccctggcacagtcttgaaaccgattttggagcagaaggaagcaaaggagaaggataatgcacaaaatactgatctaatagtgtcatctgaggaggaagataagaagttaacagatgaagatgaagaaaaggaaaagccaagtcatgacagcagcaaagaggttctttcaagtgaaccagaggaaatcggcaatgatgaaaaagctccggacagcaacagtgatgaaagcccaactgaatctaagaaaaaaggtggaagcaagctttcagcttcagcgcctccattcaatcctggatcactcttatcgatgtcgcacccttacagtacagtggcaatatatgatgctagcgtcgttcttcagccaataccaagtcaaccaatggagattctccctcacgccattgatactagggtaccccgtggtcctcggtccacattgtactaccgtactgggcataccttccaaagaaaacagggttacgcacacagccagagcaccattctgaggggtagcaactcccccccaaccatgaatcctcatgctgccgagtttgtgcctggaaaaacttcgcaacaacctgatgtggctaacagagagcctagtgcagatgtttctgtaactgattcagcagatcaactgttggcaccacagacatcagatgaagtaaaggctggtatgcctgcagcagaacaagcaattcaaggtgagagcaccagcccatgcaaaggaaaggaaaacagagcgaaagatgccttgagaaactcatgcaaaacagagctggcaaggcagattttgttcagtttcatcgtcaagtcagtacatgatagcttaggttccactggagctgaatcggacagaaaaccaagtggaccagacgaatctggtaatgcacagagcagcaacaacataaacaagagtccgtcaggtcgcaaagagcttgacaaacagcagaaggccaccgtggtacctaagagtgagaaggatacagaaggatttacagtagtttcaaaacgtagaagaagcaagcagcactttgtgcatcccatacatggtctctattcccagcagtcaatttgcacttctgtcagctaaaggtcccggtagatctctttttgggagtcgccatattttggaagaaaggtatcgcttaattacttagcttagacgcttggtagcaaaagtcttaccctatccagatgatcgagagcatgtagtgaaactgtacaaagctttccgcaatgtcttttgtgtaataaattttgtaattttggggtagcagccgcatcagcgctgaataaaatatatttgtgtcatgtgtagttatatctgtgacagaatcatataggatatagcagcagatgtttcagtgtagagctcctttttattactctatccgtttcaaaatatagtgatttttagagtagacccggattttaggaaagtatatgaaattaaatgagaaaaaattgaacctgcaatattttgagataaattttaaatattataagtggctatattttttagatttagggagtagccgctattctttatgatgtgcactagccgaattgtctgccataaggacttgatgactgcaattactagtactaggagtaaactcaaagctgactcgagtcattttctatattgactttctctgcttaaactatgatcagctcagtgtggtgtggtctttggatgctttttcacagttaatttagcttccacggagcagagacggagcagagtcagcagcagaccagacgtgaattggtttacagttagtaagctgtagcaattgcacctgtaccactaccatactctcattctctttaactctcgttacgaggtcaactcggcagctagatggcagcagcagcatatgcatccattcacctcctggccaatagctagctcagccattagtccataaccccattacattactactctcccctgcttcccttgcgtaccacggcccatgccgtgccatgcatggcacattatgcagcatgcgacgcattcatatcctcccgtcttgctcgcttcatccacctctgaatttctgcatcgtggatgcagcagaatcagagatacccccctgcatgctgccccttgctatgctacgcatgatgctgtattgctgtgccatgctagctataccagctgcaagcctgcactacagcttgcagagactttttatttatggcgttggagtcagattcagaagaggatcagaggacggcatggcattggcatggcatggtgcagcatgaacgtgtgtctgaagtctgaactcctaattaatagttgtagctagcatttcggagctgtgtagttaatttcatctactatagctatagctaagtcacgggattccggttgggacgacgacgcaacgcaagcaacgagagagatacatatacacactcctgtcctgaagccggccgggtctctgtactgattgatccatcagaagtgtgacaagaaatgtggtatttattgcaggttgtgcatgcacatcagagctagctttgggctctgcttcgcttgcctcccatggcggccccgccggtgtgtgtacgtgtgcacgcgtgggctcggacttacgcctgcttacgtgcgagatcagatacggatcagcttattcattcaaactggtctcctgattgtatgcgtttttcctgaataatggaaagtataacttccagcttttgtgttagtaagtagttaaccgttaatttttaactcttggatgctcctattacacatcgacttttgagagagaaaagttagggttttaatcctagttcgtgagttgagagaggagtgctttaggtgcactttgtaaacacatattgatacaataaagttgatataagtttcgtcgatacgtgttttctagatcccgacggattgatcgatagcaaggcggcggtctaaccagtgggagtacgacggtctaaccgaaggcagcgcggcggtatgactggacaggctacggcagttggatcggtggtgacaggacaacgtcaagatctccatcaatttgagggtaacttttttgggtttttggttttccctaccattcaccccctctatggtaggcttggttacttgtgttcgattctacatgtatcagcatcccctccatcccgcaatatatcactcaattttagctattagttgaagaattagtgataatggtaggtcgtaagagatattaatagtagtgttatacatccgactgaatcgccgaaccaatcatcacatagttcataagcatttatgtggacccagtcaaaacaagttaaaacctagtattatgtaaagtcgtatgtaggtcggacaggtgcagtcgtatatatagtcattccgagatattaaaggagtaatttttttaatttataaatcaagagtaggtaatgtagaaacgatttcttttcaataaagtttgagagttagaaataaagtctttctaggagggagtacgtgtatatatactaaccaagcccggcgaagaaaaatattttttttagataatggaataaaacatcccggcctttgctcatcagagttacagccaattattacaaaagtaacacccaaacactgagtgtagttcaaatgaattaaacacacccaacaaaataaaagatcaaactaaaataaggagagcacatttattcaagtctatttctgaatctccatccatagtttgcaaggagttgcatgaccgttgtctcaagcctacgacatgcaaccttcataagctctcgatcatcttcacacatttgcagctgtgcccaaaatcggagccaatatgttgccctgaaaattacctgcatatatgagatagatggtgatttgtaaaaaaccatatcattcctagtcaaccacagagcccaacatatggcagaagctcctacaagtatgagtttacccttcttcttgtctacccccaagagccaaccatcaaacatattatatatagtagtaggaaggtataaaccaagagagaactgtacatatgctgacaaataagcgagcactcttaaatcagaagtttgacaagtgtgattggttaacctggatggaccggtgactagtttgtggcttttttaatttgaaacactcagtacaatattttcatatatatttggtttaattcttttgaaattcctccctcgaaaggatacctaaaatgcaactaactcaatgatatgttggtatagcagtatagactacaatggattttaggccaactagtaatcattggatgtgtttagttcatgctaaaattgaaagtttaattgaaattggaatgacgtgatggaaaagttggaagtttgtgtgtgtaggaaagttttgatgtgatgaaaaagttagaaatttgaagaaaaagttgagaattaaacaagccattatccttaaatatacacttcaacatggtaaaagtattctctgttttttgtcacacaaaaccctaatcaatgcatcacgcatccgaaaccgtttattgttcatctgcagagcagcggcgtggcacccgtgactaaatatctttgcgttttttttcacatattttaattttatttgaatgttttatatgtgttccttgacaatttcatgggtccccacatgctagtgaccgcaaggtacgttacgtgtgtagcacatacacgttgctgtcgctgagaggagaatataaacttgacgttggcatccgattcccatccaactttttgtgaccaaacatgatcgcaagatcgcctgagtacgtttgatatgctcgaaacttacgctgaaactgcttgatttgaacagcatgatctgaataactattttctttctttttaaaagatgggcatgtgaaaagtacccaacttgtgtagctctcgcgagttgactagctcattacatgacaagatcgtgcagagaagaaagcattaactgctgttcatgaattgaagaacctcttcattctggctatgattcgcaacatgcatgttttgaagcttccatggaaacctagacaggttcacaggagtagcttgtactactacttttgattgaattgaaattaattaatgtagagatatgcagagagttgattaactgatcaagacctaatcataaccagcaatggatgttgcatggattgatatattgatcatctaattgattaatacagatagatagcttggtgctacaaaggattaattaagcatggcatcgccgggattaacaagataattaaggctgattaattaataaattaagatctggcaaaggaggagctcctgggggagtggacggggaacagcggcagcagcttgggcctctcgccgtcgccggcgccgccgctcctcggcgacgagtgcaggtagaaccccttggaggcgatggccttctcctccctctcctcctcctccttggttatcaccaccaccccgcacgacgacgacgacgccggcggcgacggcgacagcgaggacgacgacgacggcagcgaggacgacgacgacgaggaggaggaggccatcacgtaggcgtagtccatgggcgacaccggcgagtgcatcagcctgtggtggtggtggctgtagtacagcggctgcggccgcgcgagctccagcctcgccggcgccgcgcgccgcctctcctgcagcttcggcctcctcatcaccggcgccgccggcgccggcttgctgccgccgctccccggcgcgcccgtcagcttctgcacgagcgcccggaacgtcgccgggtcggcctgcacgaacgtcgtgttcgtgtccaccacgcagccggccgtggcaatcgccgccgcaggcgacgacgaactcaccaccaccgacctcggcgcatgagacgccgccgccatggccgcgccgtcgagctagctatcaaccaaccaaactctctacgaatcgagagagatgtatcaagctatcaacgagaggaagctagctctagctaagctctaggagtacacgcactacatgtgatggtgtgaagagaatggaagtagaatgggcgagcgaggtaagctttttaagggacagaaagggtggcattaaagcttcaaaacctttgcatctctttatcgatcgcatccatctatcactgctagctaacagtgtttgcatacatactcacgtacatgcatgctgctatggtcgacgtcgactactcacaaactcaactagcaacatgtacacacatccattcacatccatccatctatatctatctggcccagctacgtacggtacatgcaatgcaaagccatgaagcatcttttctccctgatcgatcgtccactggtccatcaggtattcaggtgaattgcaggtatatacttatgaacacacgatacggccgacgggttgctacggtgtcccttctttccatctcttcagggttcagactacttcagaaattagctcttcaggtttttaagcagctgggacgtcgtcagtactgcagtacagtgacaatgtgtacagattggttggtcgatcacttaattggttgcttagcttaaatgatgtgctcagatcatcagcaggggtactgtacaattgcatatcgccttgcagaaggaaataaattagtaaacgtcaagatgcattaatatataccttgatatcagcatatatatttattatgtcatgttagtgtcaatcagcgagtaattaacgcgttaagcgtacaatactggtgtacatggcgtgtgcgatagcacacatacgtagccatcaaactcactcaccattaagagtaatcgagcagtagtaattacaagtatacgtactgctaattaatcgctcagagcaggcaaacgatgttgatacgtgtggccgccggccgacgcgtttgcagaagatccggggcggatcagacgcttgcgtgggggaaacaagaaggtgttttgcttgcttggggttcggatcatctgcgccgcgtcgaacgccggacgcgccgtgcggccacacgcggcggcggctgtcgtcgccgtcgccggggtgtgcgtgtctggtgttccgtgggtgtgattgcatgggagctgacctgtcagggacgacgttgtccacgtcgaatggggccccgtacgtgggccggtgtggcccagttgtcacgtaacgtcgccgtccccccgtgttcacgggggtggccgtgtggggcccgcatgtcagaggctggggccagaggcgtttgtccgcttgatgggtgtgtgtcgagttgtctgtctgtcgaccattctgcatgtacgtagctttaggttgtgctttcagttcttcagtgtcgtcggatgggatcgtctccggccggccggtgtatgtcttcgttgttaggttgctcattattgtcgatggtatgcatggtcaactggctaggtcgtcagttcgtcacggcggctccggttacgtgcatactgttggtgtcatttgcacatgttcattcattcattcagttaggatgtatgagtggctgttaattttcttgggacaaatatttaaggctctaagatgggtatatcatgtatgcatgcatctctgttgtggacttttggtgtttttgttgttgtgtatggcggattggctaatggatagctccgtttgacagttccttagcagcatgtggcacagtggcagtagtcactagtcgtatacaggtgaactgtacagtaggcgtatagctgcaagcaagcatgtgggtagtgtcgaaagtgtcggcgacacgctccagtgcctacccgacggacgtgctcccaggaggcaagtaggcaacgtcagagaatccaagcagagagagacacgccgccccgtccggtctttgcaacggggccgctccgtcgtgggctctagtactacctgttggcggctactgtccgcgaagatgaaagtacaagtactccactcgcagtcccaggcctcggcccaaccagagatgctgcggccaaggccgtgcaaaaaggccggtggtttcggtgggccgcctacccatcgtcgccgtcgcgtttgccatccgcagcggccgcgcggtgatgtgcgtgcggcgtgtggccctcgcggcgtcgacactcgaaaccgcacgcacaccggcggcgtacgtgcaatcgtgcaccaccttggaaaccaagctcatgcgcgcgcgcgcgcggcccggtgagaagagaaggcaagcgagcgcgcggcggatggataccggatggctgcactgcacgtacgacttgggcgcaaggccgcgacgtggtcggcttcgtttcttgtggggagcggcacgagtacgcgcgtatgttttgccttggtgtgaccttgtttcacaagcgatttcaggttttcttcttgggtatccgagcattcctagcagcagttggtttatcctgtgggtcgagccgtcgaggggctgatcagctgctcagccgctcagacatgagaagcttctatggaaaaccagcggaccaggcgaggcggcgtccaccgtacctgccccaagcccccaactgcccaatggtgtactgattcggcaggagccactaacacaaaaacaaggaataaattcgttcggttgcacatcgaatcatcaagttgtaaagcaagacttcttcagcatacaattattattagtagtacaacgagccccatctaattaagattagaagaagcatatgaaggttagaatgccatggagatgatggaggtggtagccaccgagattatggacgccgcgctgcacgtagccgtggccgggcgcacgctggccgtggctgagcgcgacggcacgcacgacccggccacggggcgcgcgctcaccggctcatggctctgggactcctccctcgtcctcgcctcccacctcgcgtcctgcgtccaccaccaccacctccgtggcgccaccgtcctcgagctcggcgccggcacgggcctcccgggcatcgccgccgtcgcctgcctcggcgccgcgcgctgcgtgctcaccgacgtgcgcccgctcctccccggcctcagggccaacgccgaagccaacgggctcaccgccgagcaggcggacgtgcgtgagctccggtggggtgggcacctcgagcccgaggtccaggtggacgtggtgctcatgtccgacgtgttctacgacccggacgacatgccggcgatggcgacccgctgcatgggctatggcagacggcgacagcgacagcacggcggcggcacggtggggtgggcggcgagcgaggcgcgcgacggcgtgcaggactgtatcacgtgctgcgagagcaggcttcgaggtggtcgaggtagacagggtcactaggccgctgctgcgcgaccccgagcaggccgccgacttcgccgtctatcgtctttttcgccggacaacttcgccgtccatcgtctccaatccaacgccgataactacagccgggtgttgactttcactctgtaacagtaaagccaagcttgtaacggcaccagaatcacctttgaccttttattttccaaaaggccattttgtacgtactttcttctcggttgcaggacttgtaaatgttccacaatgagtcaaggggacaaagacatagcaattaatatatgcaagtctactgtaggaagctacagtagtatacattgagaaggattttatagcaaaagaatttacagttgcaagggttgctacagcataaagtttcttcaagtcactcttttctatttcaccgccacaaaaattttccattcctgtgtgtaaagggccaagagaaaaaaaaaactacagtaacattttcgcaatcttatgaaacaagggtatttgtctaacgatccacacagatgtacactctaataaaacctggttgatttcgtgacactagagccctagaaaacgtgaaaagcgatccgcaagatttgcaatgacaaacccagaaaatacctgcaaagcacaagtaagcagggtaaagcaaatgactagttcaagcaggattgatctaagaacaaataaagtatcaaagaactaatcagtcagattttcatagttataaagaatggctatattattataagaacagaaaattttgatt

SEQ ID NO: 66507 - DNA, 2852 bp, Oryza sativa
caatataataaaaatgttatccttggtcagtgcgtaccagaagtagtctgacaatacacttccaataaggccatttgccaacaccacttcatccactttggctgagtggggtattgtaaactttggttcaatgcctaatgcggtcaatggccagactgaaaataaaagagagaaatttagcatatctggatcaaagaaccaatcatggaatacatgaatgatatatgtgcttgaaccaaactacaaaagaacatggtcacaaaggtttgtgttctacgcagtagactagaatacctgaacaaaaagaattattggcatgcgtggtgctgaagaaagagaatttcagactacgaacaatagagacagattctctagcagcacatgagatgcccatacatgacatcctttgcgattccattttatgtaccaaatactaattaaaaattgaatgctaattagtcttttagacttttcattgaatcaatttttatagttaacaaggaaaatcttaccaagccaccagagaagaacaagactgaaaagtccgaggtagccaaacagtttttggacatcaaccttttctccttcctctccagcaaacttttttagaagcactaaaataatgttgaaacaattagcagttgaatcaagacagatcaactaaaggaagcaaagaactaaccagtgaataaaccatatgacatagctgacagaagaccaaacatgtcacctagaagagttctctgagtggcactgcattcataaagtttacagattagctgcagaacttgtggccaacaaagtgagtgctgtctcaaagttacaaaatcatcttcaacatgatcttcagttacaaggccatcttaaaaatggaataaatagcgcttttatgtttttttatgcacttatatttatatgaaaagcaattcagttgcagcaaccaatctactacaagcaagcaaatgcaagggctttatgagcatagcaaattaatcacaaacaattttatatgtcctgaggcatcagtgcagaactgtgatgtttatttaagggtaaaacgcactaacccagaattgctgatttctgattcatctgatgcccaagtctgccccatggttgtcattaccacaccagccatgctaataaaaacagcaataacttttgcagcatttatagaatcttggccaagtagcacaccaatgaaaagagtgaagagtcctgacgttgaagatagtacagtagtactagcaacactagttcttgcaagtgccgcatttgacaagtactgcatccattaaacagaagagaagaatgagtaacatttagcaatcaaactactgcttgtatggttgaaatcaaatgatccctatgaattttaatgaacaggtaaatattaggaaattacctccgtcacaaaccatatgggacaaagatacaacccatacattgcaatctccttagtggaaagttcttgctccttcaaaacgtcatcgaattcagtgattccacatataagaggttttgtctcttctattacaggaatatccacatcagtatagtttatgactatagttttttgagattccatttccaacatcttctggaattcaccattcttcagaggagcacaaccaccgaaagaagatttgttggtaacttttgaaactctactacttgaagaagaccttctcaacaaattacatataaaatcctttaaaaatgaaagaggtatatagatgatcataagggaggcccccaggtaagtaattgcaaagggttgcttgtatttagtgaatatcccctgcacacataatgaaataaaattatattcatcgcataacatcaaatttatcaaaactataagaaacaaaaacatattatgttttaagacataaatcatacgtcttaacggtgggctactataactgacatgttcttgagagttaaatgcaagtaccaaaccaatatcttgttttcttcagaatagaattttaaaaattgaacacgggtagggggaacatctttttcgataataaaagggaaaaacatcttgatttgcaaaaaaactagaataatactttcccatataatatttaatcacgcattacaggtgagcaaggatgtcataaccacctccaattaaccaggtattgatgatgcgaattgtcacaaccacctcaagcaaattagggtttgacaccagccacacgaggaaagacaggagaataatcaatggagcatgtacatcaattctctagagaaattccatgagcacacaatttgacatatggaaaaaagtaactggttgcaaaagacatcaaagctcgtaagacaaaagaattgaagaatctataactcaagtcagattctaacgttgcctggacaatttttaattactggaaagaatgcatgaacagattaaacaaatcagcgaagaggaatgttccaagattcctgattaaataataaaattaatctgctgtcaaccaagcatgcatccccggccaagatctaagaacccagaaaacaaataatcacaaaagataaaaggaaaacccgaagaaatcttgtcacctgcgtgacctccgcggaggtgacccatatgagcaccacggcgacgatgaggacgaggccagcacggtacttgagattggaacccatatcaatccaaccctctcctcttgccccgcctggtggtggagtgagtgcgggtgcggggcgcggcgagcaatttaaccgcgcgggcagcggcggggctagcacccctcctcaccgagaggcagcatgcttgcggcgcggctctcggtgggtgagctccgcggcgcccctcctcgcctcatcgccggcgcggc

SEQ ID NO: 66508 - DNA, 2913 bp, Oryza sativa
gggccttgtgtacctgtgctggactggcccatgaatattttttttccttgtaaaaaacaattagatataagagcaggtacaatagcaggctattagtcagctataaacatattttaatgagataaatgatgagagaaaaaaacagcgggctacagatatctagccagctgtagcgcggactccaagacacaatgtatgacaggtggaccatatattaatagtatagtaagcaactattatatgaattgactattagatttgctataaatgaattggagttagtagtgggctgtactattagacttgctctaaatgaactgcctatccatttgtcggatggttttttaaaaatcaccaagacaacatagtttccggtaatttctcaacagccatgcagaaaacctgatcggtaacggacgacgacgcacgcagagtcctcagtttgggcccaactgttgttcctcagttcacatgtccaggatggcaggcactaggcccacgttgcttcattcaagcccaggccattactattccaattcgtttgcaccaaaacagctacaggcacgctccactgacgagagccactttgagcggctaaaataatatcccgggacatctataaatacctaatctatatctatatatctcttctctactattataaaaattaaagaatctatatctatatatctcttctctactattataaaaattgaagatgttttttatcgagattttgataagtcattcgtgtttgagtcggtttttaagttgattaaccatatatcctctctattctcttctccgtctactattataaaagttaaaaatgtttttgtcttggtatgtcgtccgaattcgtgagcaaatcgtaggaagtttgactcccgcccgcgtccgattccctgcctgtgtccgattcccgcgtgacggccgttgaggcagcacaataatgtccacgtgaccgcatccgcctccgctctatctgtttccatgtttccatgtgtggtcgggatcccaagcccacgggcatatattactgttgcacaagtccttcacgttgacggataaagcaaacatgcaccgatgcacgcataaatcaatgtacaaattgcactgatatatggttctggcaagaagcactgcttgatctgtatgcacaagaaggcaaccactgaaaggaggaagaaccatgcatcattcaaatttcgttgtcgctgctcatcaaaatagagatcaattcaatgaaatgactgatgaaaacacgttcctgagattcgtgcaactacaaagcaacattacatgcaactcaaatcgttcatgcaggtgtttccgattcggtgttcgtttgtcgaccacgtgttcccatctgtgaaggtctcatgaccaaaacgagccagtcccaacgtcccaaccatgactacttcgtcaagccactccaaaactagataatgcggtgatgttagacctaccatatagcagatcagtgcagatttcaccttgattttcatgggtctttattttcttcaacatcaccataaagaagatggtgaaatttgtattttaattaattgcataatgtaaatcttgatttccttcaaatctagcgtactgagcccagtcgggaatgttctcgtcctccgcttcatcttcttccatttcaaccccttgctcaccgtaggatgtccaacaattatagcttgacatgaaccccgactcaaacaagtggaaatgaatagtcctggatgtagaatactccttctggttcttacacttattgcatggacaacgaataaaaccgttacgcttgttagcttcggccactctcaaaaaaaataatacacgccctcgataaactctctggaccaccggtcagcgtacatccattaccgatccatctacatgaaatgaaaaaaaatcgtacataaataaatttttgtacaataatgacagtcaaacaataatgataaaataattaaaaactctttcgataagtatacaataatgacatatcattactcatataattaataattataaaataattcaacaaacaattcttatttttaacaatttttgaagttctaaactaataaactaatattaatgttgtacttctcttaattttcaatttagcttgttttctattttgtaagattaattttcatcatattttaaactatgagaataaaattcttttaagtaaacaataaaatttctatatattcttcttcccccacacaaattttctctatcatcaacttacaataaagttttagagaaaaaaaatgtgtgaaacatagctccaaaagtaatataacaagttactaacattttagacacctccgatttgtatataatcactaaaaaaaatttcacaagaaattttggcataacctcctttctttctttaagaaattttgaagtttgctcaggctctttaagaaattttgaagcttgctcaggctggaggaggaagaagacatatataaatgggggatttttaagtcccggttggtaagatcccggagggcctaacaacgtctaactaaaaatgatctttagtccggttgataatagtctcggttttaaatggatccgggactattgtgaatttcgaccgaccgaccaaagatgatttctccaccagtggatccgaacaacttttagctatgagagagatgaggcacttcaaaatttaagaatttgaattccttaaatattctgattggaagcggtaaaactagggaaaaaaataaacgaaattgaaggaaaaaaagaaggcctaaagcaaacaagaaggtcaaaaggatccaggatgaggaaaattagcagcaaacctaaatcaaaacgcaagaccaccgctccaccgctcagctcatcctacttcttcgtggaacgagaacaatgcgg

SEQ ID NO: 66509 - DNA, 9991 bp, Oryza sativa
ctcgtcggggctgctgctcgcaccggtgctgaggctgtcgcctctcccgctgctcgacgaggctgagggcgctgctctccgggtggtgtcactgccgcggctcgcaggggacgaggccaaggttgcgctgctccctccatgggcagctgcaaaaggggaaaaggaagtggctagatgcagtgcactggtggggactggggaggaagaatcgagattggtcttatcctatcccctctgcagctttaatttttttctctcctatataactcaagtgtcaagagcgtttgagaaaaaaaaataaaggaatataatcactgctgctttcttttttacctcttgtccaccatgtgttttattcttattctgtctttattttcctctctttctgctttgcttttatatttttattgtctatttttaaatatttaacctcaaatgcataagctgaaaacaatactcacttaaaaaaacatagattttcactatttagatgtgacgtcagcttttgcacgtcgtgatttagacgtgtcatcaattcaacttcatgcattttcttcacatatcaatgcacgtatatattcccacagttaaattacatagagtgctctacacaaaagcaatctcatcgttcatctgatcattccaacaatcgaagccacatgtcaaaaaggtatgcacatgataaattgttcataaattgcaggctagcggcttgatgcgatgcttgggcatggaggtggcggtggggttggccgcgacaccgggtgacaggtccgcagcgaccaggagcaatgacaaggatgtcgcggaggatgccgacacggccaccacaacaccgatgaagggtcgttctccaacgtcatcccccagcctgaccaggcaacgggtaccgcacctgggcatgtaggcggcggtgggggcagctgtggcattgggtgatgggttcgcagcgaccgggagcgacgacgagtagggcgctgttggtatttcttacaatcacagataaaatccacaagcgcacgaatataccgatgtagcacttcccctacggagtattccaaaggtatcgaatccaagagaacgtgtataatccgatcttcctccggtttatgcaaggatatcaagcaaatgctgcaagttgagagcgtctcgtcctttggaaatgagtctgttggcaaccgaaacaacccggcaatgcagataggtatcttgatgtcatccactatctctctgtggtaatcatctaccggagccgggagagccaggatctcctgccggtgtgggcttgaactggtctgttcctctgtcagtgaaatggtagcgtcgtcattgacaggcaaattctccctgtcatggtagtcctctggtgcagggagagccagtatctcctgctcaggagattggcttgagctgcagagctcatctcttgcagaagtgaactcgtcgtcgacgggggagtagccgtcgtcttctgaatgttcatcgtcccctggtgcaggaagcgccagcgtcacctggctgggtggaactggcttgctcagcttctgactcagggaaatcctggcaagctgaagtgcctgaagaacactctctatgtccatgttgcttgttggctgttgatctggccctgcatcgacctggttgtcgccatggtcatggaagcttgatgagctccagtcagagaccttgctgttcagggtggcatcactcattgacgggcttccatctgatggcgctttgatgtcacagtagcttgaacatccatccggattctcgtttccttgttcttgattcttccctgtcattgtgccggcgacattagagcttccttgagactgtgcatgacagtggtcgtgatgctcctcgtgcgcgtcacgttggtcggcagcagcttcttgtcctgatgcgtgtgattcaggaagggaatcattcaacagaaggccagcagagcggttgttgctggcgctggggtgatttttaacgcctggttttgcctcttcgttgcaatgtaccgcttgatccgcgagcctagcatgctccttgctctgctcccaaccattttctatctggcacgccttattctctgcctcaacatgaacctgagctccaaagacaaaagtatgggtaaaatgtcaaattttgaaccaaaacaaccaggtttcactcatgatactaactaacctgtgggttgcactctgcagtgcattttgttattaaaaaaaacattttgagagagcaaattatttatacttatcaagttggtagtacacatttttgtactgcatgtgcactaaatttggtagcatgtggaagtcaaggggaagttgactctctctctggcgtagttcatggtacaaagttatgagattatatttttgttgtacacatgtactactgcagaagttgcttcatgtgaaacattttctctggaagtggaagaatttggtatcacaactctgagcagtgtttctgtgtaactgtgtttggttgcttaccttggctgagctccgattctcgttgaactgcttctcccactgcctctgagcttcttcctccgcctcatactggccgatcagctcggcctgcctctcgagcaccctctccatctcgccgtccttctcgtacctgatcacatactgaccaccagtatcctcgccgtccatgtccgcctggccgtcgtcggtgcaatccgatccatcttgctgccccttctgactccaggcgagttcctcgacgtcgccgcgctgctcttccggcgccgtctacttgccattgctgatgagcagagccgtgtgatgttagaattcgacaaacaatggcgtgtgccagcgtcaatggcgggacggagctcacctgagctccttgcgcttgttcttgcggcaggactgccccatccggtacttgggctaggggtcggaggagaggaggtagaagtagctcctccggtgcttctgcttgagttgcctcgccttgcgcgggctcacgctgcggcctttccacgacagcccgccgccgggctcggccgtcccggacagcgcgtcctccgccgcttcgcactgcgccggcggctgctcctccccgcgggagcctgccgtgtcgccgtcgctcctcccgtcgcgtgggtcgtcatcctcctcgccatcgtgttcggagcccgagtcgagcacgtctgagaggttgccgccgaagccatgtgactccagaatacccagcacctccgtcgccgcccgctccgcctgccgcctctgcgccgtcaccgcctggacctgctcctccagctccgcaacctaaaaccaagtgacccaacacatgcaatcaatggcgcgaacgacagcgagaggagaaggacacggcgagtgggctgcgcctgcgcgcggtggctggctgaccctcttggcgagctggtcggcgcgctccttggcggcgcgggagacggaccgctcggagagcagccgcgcgcggaggaagtcgacggtcatggccgtggagtccgccatgcatgcgcgcgctgtgttgctggcgctcacgcactccccgagcccgagccgcgagtgacgctgctgcgtacgtatgcggcgcgcgcactgtcacatgccggcggtgtggcttgaccggcgcgggtattaaaaacggcttggtttcccgtgagccgcgcacggcgcacacgcagcgcgcgtcgtagtcgcggccgcgggcgcacggcgcaccgacagccaaggccagggagtacgctacctacgcgcgacacaagcgccccgctgcagcacgagggccatgggctgacgagaccaccgcaacggtgtagttagctaggctgcgccgtccattttcaagggagaatggcgatgcctcacctacctgtatcgactgatctgcctcctgccctgtccggggtccagtggcatattgtcaatttggcatcttacaaaatcatcagagtttgggtttatggtgtactgtgtacatgaactccagtagcacttgtttatggggtaaattcgtcgaggacaagagtagtgaacgtggtacagctttgccatgttcgagcaacgcgacgaagccagcaaaactacactcgtcttctcttgtgctaccgcctactgctactggtgctccaaaaatggccgagatctcaggctgtccttgcttggaatctttctgcttggatcacgaacttctaccgcacggaaacatttgagtcttgcaacggtttcgataaggtcattcaaagcaaagtcagctcatcgtgcatagaacaatacgtcttcaaagaccatagcggcaattagcatcgagtaacagatgtttccattaaacaactttagaatacacacatgcagggtgttgaggccgatgatcaagcaatgaccatgcggcagattaatgcagaccgtaaccacaatctcaggtacttaaataacgtcatacccggtaggcaggtttacaaaacgttttcgtaaacgtttttagccgaaatttcgctcaagaaacatcatgtctgcttagtttgacatattcaaacaagataatgacgatatctcaatcaccgctggcacagcctctgcatccacagtgaacacattctataaccttctcctctctgagatgcttggggacccggcagacacatgtagttgcaaagttgtggtctcgtgtctgtatgcatcgaagacagcaaaggcgctcatagcctggctgaaaacacacaaaaagaagcaatgatacatttgatataagaatgcctgacaaactcttgtgacaaaaaagcatcttcagcatttgcatctaaaaagtgactgaaaactttgacagttgaattcgtcacgtacatgtctcacagtattcttagggcaatttaggcccctcgttatcaatgttcagacaagtatataaagtagtaatatggaacataagtattgcatccctcccaaatctgccaacttttatcagatgtccaggaaaaaatatatataccattgggtgttagaagtctatccatgatttgatttctggttacatcagctgctagtgtggcaataaaaatacatagcagaaaatacataaacatctttagtcaactgccttttctttttgctcccaaaatcttatttttcatggtacacccatataagaaagtatatagtccataaatccccacaagtcactcatgctgcattatttcactatttcctgtggttcattgcatgaaatccaataaggcactactcaactttgacatacagctattaatcgcaggttcatacatatagattatattctaaacaagatttatgatgtgtcatgtcaaactggatcagtatgtgatagcttaacccaatataatggatttactgcaagaaatggtaggatgcggttagtttaatgttttatttttcatagtacaagtacaaaaagtatggtcagttaagttacattctaagcatgggaaaaaaagtgagaaacttaacagtgtatccagggtctatggcttcatctgaattatctttgtacacaagttaattaaagtcttaaagattatacaaggtggataaggcatcttactaaacttgcacagagtataaggaatgatgggcactcgcaaatcatgggtcaaatactaacctttttccactttgcaatcagattacggtctgcataaccctggtccaggcaaaactcatacaactcttttgatatctccttccttctgtaataaagatcatatatgtagcgacttctttgatgggaaatacggaaaattggccagagggcttcgcactttctcttcccatcatgcgtgtcattttcagctgcatgagtagatgatattagtatccatataagagcagaagtatcaataaacatctgaaaggggagcatatgtcataccttccctcattttggcatccaactcacggatagttggttcaataagctcccatcctccaggatatttgacacggcttgtctttattttaggcatgttctctcaatgaacgtcgaggggctaaagcttgcaaagaaaccctgaggacatagagtaggtgtaagattcacaatgcaaaacatttacacggtcaggctcttccatcgaactcaagagattataagaacataatggacactacacactattacatagaatttatccccgcattgaagccttacatcagatatgctatatattccttactataaaagaactgtgttgaacacaaataacacaatttaaacaggtattttgcatcttcaggctaacagtcttgtcgaatcatgatttaaccctattttgcaagtacaaaatatgtgcacctcgaatcggtgaatggacggtctaatacataaagaactaatcgacacgatgataaaaatcgcggaaaaggttccccaaaccctaggctactcggaagaatttttttttgagggaatactcggaagaatttcgtcccaataaccacatacgagagaatttcgtcccaaggaggagacgaattgaacgaatccaataaacagcgaggtagaaactactaaaatatccagcgaagcgaatcatcttcaggcaaagaaaaaaaaaacaaaatcagaatcatggaacggaagacgaataataacctcttggcttgggcggccttgcagtcgccggatggaagctgtggcgcgcgggggagcggcgatccagagggggcgcgcgtcgtccgcgccgctggtctgcgctgcgctgcgctccgctccggtcgagcaaagacggccgggtttggagtttggaccggagctatcagctatatgtcgtgattctttttcccctcctttttgttttttgagaggagctatgccggtttcacggttttctcctctggtaggagtagtatttgctacatgggcctcaagaatcaaaacgggacaccaactgtgctgaaatccaattgggcaaacgagggttggtttggtttgtagctcaactttgctaagggtgtgtttagttcacgctaaaattaaaagtttggttaaaattagaacgatgtgatggaaaagttggaaagttatgtgtgcaggaaagttttgatgtgatagaaaagttaaaagtttgaagaaaaaatttggaactaaactcggcctaagtcaatatttatgcaatgttaaacaatagtctatatgtttagattaatgccaagtgtcacagtatgtcctttagaaaattttgtggaataaaaattacttataagaatatatcttgataaaaagatattttgtgtgactatgggtagtttgtggtctagattcttcttaagaaatttatgtgagtttggatgagtacaaattatgtgagcttacatttttcgttctaagggtgtttggatgagattcagtaaccaaattacatatgctaaaaacggaaatcaaaattaacaacttgaaagtaggtggagctgggcagaggcagatctaaccctgtttcggttgaacccccaaactttttgagggataacgcagaatacctgatgaggtgtgggtagggagggatgctcaccggcgagcgacgatgcggtggaagaaggaggacgccgggcgccacctctgctcgcaggatggggatcggcgcaagcggcgggcgaggagacgaaattcgaggccgaggccggatgggatggattaggatgctcaccggtgagcgaatgaggcgggagcaggaggacgccggcgaccacctctgctagcaggatggagatcggcgccagcggcaggcgaggagacgggagtcgagggcggcgggcgaggagacgggacggattggggaggcggaggttatgcacgcggtgtcgcctgcctatgggtcatatgcacaggcccatgaggctggagttttttcatctcccaaaaaagttcatctaaggtcccttatcttatcttgtcgttgagttttaaacgactttgaacccctaatcttgcaaaatggattacggatcacttttaatccagtattgctttccggttttgttgacatggtggctgagtcagtgtagaggccacgtggaccccacaagctaaccaacaatcttcttccacctcactcccctctactcccatctcaacccaaacctccagggcattcgccaatgggtggggagaagggtgtcggtcggcggggaaaagttcgacggcggaggccgccagctaacgtggctcccaatgaccggaagcgctcacgtcatggacttgcgcacgtgcggggtgtggcgcgggtcccaactacaactgcaatgttgtcttcaccggcacgcgtgaaggctggggcttccgcctcatcacgctggccaagctcctatcccgggcttccgcctcgtcatgatggccagctcctatcccccaagctcatagtcgcccccatcgagcggctcaaaagccgatgtgttcaggtgtccccgagcttcgcctctccttcgcagaggcgaacgcgcggctccgccgcatcgtcttcgaggtcaactccatctactccacgttgcggtcgcatcgtcctcgatgcatgcgcccttttccccaacgcttgccaccgccaagcttcttgttcgctgccagccttctccccacccatcgccaggtgccgtcgtcgggcttctacctaccaccgccgcccaacaaccaccacccttctccctgctggtcaccggtcaccacacacctctctcgcgattcagcgtctggcgtcctcttcgcttgcatgcacgagcactcatgcagtcagtggtgctcgcgagtatgcttaggcgtcgcaacgtactccatctcccaactcttggagatcctctcgccaatcccgacagtgtggatgacatgcgaccatgatgtggagcaataaagtacctcgtattttaccttcagcttctggctgtctcgcaataccttctacagcttgtcctgcagcagtaccttgaccaactccaggcccaatagaagcaagccctacggccaatccagcagcaattagtggaatgcctagtttgactagttggttcagtagcagaaacaacttatttccccgaaaaagacctagcttcttggacagctcaatccggtgcggcaggaacgaatgaaacgactagtggtcctcggaaccctacccgagcttatattccttgcttcaacgcccgcgccttccgtggaaaagtactagtgcttcttatggagcaagaaaacggatgcgcgcgctaacgctttcgcgctagtgcactcaccccgttgcttgttgggcactgaacacttttcaagatccggttttggtaggacgaagatttttcactttcgtgaaggtcattctgaggtggaatcgaaccactatgttaggatttagagtccaacgcgcaaagctaaagaggatttcaagtcccccgcccgccagaacctaaagattgctttatttttatacgatttattgagttaactaaaaagctggttcgttccatagagaccagacttagaaaaggaagctctgctaaaagctaaatcgctaataagttcaaacatcaaaggtacctgtctacatctacctacccgaagctactaaaacatcatcaacaacaacatcggaaactagatgaataattgaaacaatcgggttgaatggaattatctcgaggctattatgcgcaagcttggtttccaccaggtggaaaaggtgatgaaatgtgtgacgtcggtctctttttcggtgcttttcaatggtggccaactggagaagtttaagccaacgagaggcatccgtcaaggtgaccctatctccccatagtaagccagccaatagtaccctaacttaagaagttctcttagctagcgcatgtccattaatgtgaccaccgcatgctcctgcatgagtttcatgaatggtttgtttttgaatccattcttttttaggtatactatcttgcaagaaaggagctcgcaacaaaacgagagctttttgatagcccgttcactcgactaccacgcttagtaa

SEQ ID NO: 66510 - DNA, 3417 bp, Oryza sativa
cgcgatggaaagaaataaatcgaatctagaaagacacgttctacctatgactgccatttgttcacttttatctatcgtattggatagaattcaagtcccttaccgtattcatctattccctctcctttcagtcgagttgacctcggattctaaagcaacccacgggcataagcaaagaagttatcaagcttttgggatagcaagttatttctagggtaaaggaaaacaagctaacagtctaaggctaagtccctagagttccagttttaatagtcccattcctcctgccttccgccgacctgcggccttatcatagtagcccttctttcttgccagtgagatagttactacgaagtctgcatcgggagaatgggaataacgatcttttatatgatacggaaagcgaagagaatagactgctacatactaagttggttattcgtagatttttaccttcttggaaaataggaatggggattggcagggcatctactatcaactagttacttgggcaccggtgatacaccccaggataccttacctatttagacatttatgcctcgctgcgcgccttcccaacgagccaaaactatgcctaggcctcgggcttaggaactatactacaactagttttgtatagaaaacccagaaatacccatattcctttaaccttcacgaagaagttcgttagctccccctatgtcatactcctaaagaagttgtaataaaatgtgctgatccagatagatcaaatcctgattacgacttcttcattcggtttgtagccataccgtatagagttccaaatgcctttttttggaagtaactagattcaagcaagcatcctagcaaaacgatcttttgacaatgggctctacccaacactaggactgactgactttatacagagatagaaaaggcagcaatccaagctctttttgaatcggatattggataggctaagctaggtgtagcccgctttctctacagttttgctgaacttgtcaagcccggggggcctttagggaattttggagaatgatagattctaggataacactttctaaggttgaaagggatggcatgggttaagcatctgactttggaccttcgagctaagttatttaataaggtcctactaattaattggaaatcctttttacaaatctcctcctcagagcgccctgtaaccttaccttttctgaatggtacaccttatttaagacattcagaatagaagaagagcaatcgtcgattgattgaaagtggattgacggcattcatcagttgattgaaaatgaacttttcttttatgatcgagcgaggtcccttttgggcttaaaagtcctttgagccgtggaatcccttttgtcttgatttaggagaataggcacattgattaggttacgtggtttgagcaatctgcaggaagtttttttttctttattatatataccattcatatttattattctatataccattcatattaaagtaagacggatagggcatatttgactaggaagcaagcaaagctagtccctccataccagcaagcagtcttgtttagggagtctccttctttactgagtaaggttcccgggtgcctatgtgattattaaggcagggtgctactgtaccagtagtagagtggcttgaatcaaatcgtttgtctagagagggtgtagcgataaccaaagttgactgtactagaaactttagatcctgtataggcaactggccttagaatagtgtcttgaactacaggaacgacccataatcattgacgaagaaggcttggaaaaggataaaacatattgaagagaagctttcacaaaggccaatagccgatagctgatgtcactagccttaacttctttatctacttgaaagctgatgagagtacggctttcttaaaggaagtgtccgtccctatgatattatatcatagtaaagagcccttggattcgcctttttccgtaagcctaaaggcaagggaagctcttcgtcgagcttcttatccattgaaaaagacagacttcaactttaagactaaaacctgcccctttattattattagtaagtaagataggttgcttgagccaatccttaaatcgtgggaggaaaaggcaaaaaagtgagcccacccaactaaaggaacggagaaattctgaacttcaataatcgaagagtggtcgtaggtgagcccaccccaggcaaatccacttatcgttatcttgctcctggtcaagctcccgtacccgctcctttccgtgggctttctttctgctttgacttgttccttttcttgctttcaggaagtcgtccttgacgagggccccttgatagccggtcttcattgccaatgagaaagaaaggctcctgcttgtgtgcttagtctagccttgcaagcaacctcttcctaccagaggactaccatataccgatccttgctgttaccgcaaatcgatcaattcgttacttttcatcggaagaagtagcacgcaactcggaaagaaaaacctctgatgctccttttttcttaatgatgcaactaatgtaatgcctagaactgatctattgcaagcccggatattcgattcctaacagaacaactcatgtgtgaagtagatagataagtagagttgctttcgctttgttaacttacgtaaggttgcgtaagatatgtgaatgtagttacgtgagcttgcttgcctcactttcctaatatattgttgacaacacttgcaatagggcgtagtgttgcgctgggtcgtcttgttcggaagctgattgagaaaatatgcaggcacaaattggatgcgtaaaccttggactcatcaaagctatgctatggctatgtactagttgatgagcttgcctccagtacttgatagaagcccatgactctctatctgaaagtggtcttggccgtaagccaataggcgtagttgtagcgaagcggcgtatatcgtagttgttcggatagcaagctacctgacgtgataaggctactagtgccctccactcgtgcctactttcactaacctatagctattgcatgcaagctcaatcttctatctcgcattgctacatgctcgaaacagccaattcgctcgtatagctaacgcaacctatagagtttggggagtgctgctattctttccaaatggtctctgagtgcggtctgtcaattcctgttgtagacatctgaggagagggggaagaagagtagacttactacttttgcaaatcaaagaaagaatttaaacagacatcaatcatctaatctgaattctttgacaattaatagatacctatcatagaaaaacctttctccaaggaagcttgcttcttgttccagatttgatctgatcctaaaataggttactttgctttccgctctatcggaaaacg

SEQ ID NO: 66511 - DNA, 4564 bp, Oryza sativa
aggaagagtaatttgaacagaagggctagctgtgcttattctgacaaggctgaacatgagttgctctcaaaggacttgacttctgaaatctctattctacgtttttcaactaatccacacgagaaaatcctatctttcaagctttctctcactaacttcgccaattgtccttcgctccagatggtcaatgtcttcagactagccatcagcccttggcttctgtacccttcaaacgcaaataaataaaaataaagaatttcagcacgcgcatccgttttcttgctcgaaaaaatgattcaatctgactttatcggtattctggattgagtaaaaaagggatatatgaagttcaaggccttgccaaaaccgtcatggccctattatgtataggccgtactaagccaatagtgaataacaaactctttcctgctccctcgaccctaattaactcccatcctgccaagcctcagctgccagcgcattgtatctaagcacactgcggcaaattgatacaagtagctaaagatctcgcatccgacatccccggccgaacggttaggcaacactagggcgcctgggtcccaattccgtttaccaaacaagatgtcgagaggcgaactctgtaattcccccccagcaaaagtgatagcagctgtagcatccgtgtggaagagggtaagctttcggcaacacctttttcagattggaaaggatgaatacttgtgttgggtcctgcagaccaggatagccttagatcaaaacctaaatgtgccaggggttgatcatagaagccagggcaataagtattcaggaatttgagcgcttatgtagctaataactctgccacctgaatacttgattcattaaggtcgtcacccaatacccggaagtctctatcgttttctttgtctgttaagcttcacagggttgggactccctaaatcaaactgcaatcgctgtttatcaaccactcacgacgacaccgagatcttcgacttagctcccacaggtctcggggcggaagataacgaaagggagacaaagtcctaactaaatcaacacacaataacctcaaccttctaccatccatcatatcagtcgagtcgaggagattcgttcttatctatagataaggcaagagagaacttatgacctcgcggatggagagggattcgaacccccggtattcctatcaatacttcggttttcaagaccgactctttcaaccgctcagacatccatccctgcgctcgcccgccctatctatctgcgcgctggcaggtaggggcaattctatgtgattcgctacgcttgcttgcgctccaccccgtaagctaactatattgcctagcggttagcgacacttttccggtagtacgaatcgctacgcttcgcttctttttcaccgtcggttgctgcgctccctgcgggtaatagcaagagagtgaagaacgaacgatcatcagttagcagtgaatgagtccgacttgagttcgtgagtcaaaggcgtggcaagagagcgagttcgactcgcgaacgacctgcaagtgaaggaccgatcctttaacgccagtactgttgcgagactggtacttgggggctcacgagcaacatatagactaaggttgcccatcactcccttgctcctttttgaaggcccaccgctccccctttctttaagcatctatcccggcttgcattttggggcgagtactacagttcctccataatcacacagaacgcctagcttcgtagagctgctctctccccagtccacaacaaggtgtggaatctggatctacagtgtgttctgactctattggatcaagtcagatactaagccttctactactacttaggtacttaggagagaaaatgctatatttcatagattggactctcttactgtgtttttctcagggcagttcccgagccgggttccctggatccattctgacctaattggatgaatgaagaagggggcgagcagatacgacggcctctttttagccgaataaagctggatctactacatagggaaagattaagaaagcaagagcaagcctactctactatcgattcaaaaggtaaactgcccccgaagactttatcaatgaatggatcaaagaaggaggctctatctatgtcatcgtatataataagggaagaagcccgcccctgatcgaagaatgaagaagctagcccgggtagactttaagagctcttgctctgcctatccctatcgctctgccttctttcccctcgcctctgtaaggagtgatttgtttggacaaagccgaccaggaatccaactgaacgacacgagttactctcccgagcctcctctttattcagaaatgaaaccaagccatctgatctaaccttaggaaggcggtatggattgactataactaaccaaagcgagtgagtgggatattgtgatactaagaaaggaagcaaatgtctcatatctggccaacaataccatttacatcagtcggcatgttctctgcgacgaatctacatttccttttcaatctgtgccttaaactactcccactacttactccacttcaacatcttctcatacaactcttccagtcatctcctcagtctctgcttctcctcttaattcctctcgtccacctcctccttccccatgtccttaacactctcaacaaccgacacactctatgaccactcgaaccacagatcgcactatgaaacctcagaaattccctgatttcattgcctactcatctaccctgcatccattgcctccttccaatcaagagactaaaccaacatgttattcaggggctgttaaacatccacagtggcgctctgctatggcttcagagatttcagctcttgcaaataatggcacttgggtactggtaccacctagtcctaactacaatataattggtaggttgtgggtttacaaaaccaaacgcaagtccgactgtacgattgagcggtacaaagcgcgtttagtcgccaaagggactactcaggaggatggtgtttcgtgattcattgaagctactcccagattctttaagttctttaggtcaaagtctctgcccagagctcggcagtaaaggtgaagtagatcatacgtctgtagttatggataatttcgcatctaggaagagggaattggtagagaagcaagacatattgggtggtattatgctgatcaaaatatctattggagtctttacgagctttatattactacaaggatgatgaccttgtcttttctagcgctaaccatctttaggaaggattattatgatgagatgagtacacctatagcaattcctcataggactgctgatgagtttcttcataggggagactatggaggtcatgcggatgtgtataagctgtgagaattttttctattatgacgttcgctctctgtatccgtttataatgaaatcatccccaatgccgataggtgcagctaaatgggatggtaatttacagggagaggaactgtatggctttctcgaggcatatgtggactgtcctgaaacaatgaataagccattccttccatatcgatcataaaaaagactggattgcttattttccccggtttatcggagtttactattcagagaaacttcaatatgctgatatatttggatataaagtcagacctctttgtggctatctctatgataagggtgatggtttattcgataaccacatggccccttttccctttaacgcaactaggtaacaatacctcgctacctgttgctgtcctttttaaacccgtgggaaacttcatcatcaagtgaggtggaaactacagcttcgattgcattcagccttcctcgtcctaatattgcatgataggccggcgtccaccaccattgacggtcgctatggccacattcggagacttccaaaactgaactggaagatggtacccaaagcttataaggtttaaccggtaaagcttatgagagaagttcgaacctgggacaagattttatcatctcgttcgagaacttctttatgcaagaaatgggctacccgtgtcgaccagtaccctttttactcggtgcagtacccactcggagaacgtgagagtatattcccccgccctcttctagactttatacacttgtaaaaatatgtcatgcgccactggcgccttctctgcttgcttttgtctccctacggtgtttacatacacttcccaccatgtggcatgccattgactcacttttaggacatatttgtacatcttttgtctctatcctagtcaactggtacgcatggcgtaaataaagatgacccgaccacccctgttcaccttcctcaaacccaattcaaatgatggctgtgaaagtcagaatccttcctacctaggaaactctcatcagaatcattgatggtattaactgacggctgtgtggaaggactactatctcgtacataactctgtgtacactccgtgttgataatttgagacctaatggacacatcatacataagaacccgttgtcgagattccatcaatatcttgcttggcagcttcata

SEQ ID NO: 66512 - DNA, 3293 bp, Oryza sativa
ttatttagacttcattctcctagtcctattcctgattgttatttcggattctgtgcctgggtggtatcttcttactattgattcaacctcttcgggcaaacgttgtcacttcctttatttgaaaaaaaaggggtctagaactacagtgatctgataccttcttcccttggtctgggtaggtaggttatgtaggctacaactgttcataggttgttcgatcgcaaaatgccaaataatcgattactagtatgccggatattgcctggaggcccttctccctatgtttgactcatcctagatgggttcacacttgtcgattccggtcaaagaaaaaagctttttcacggtcccatcacaccaatctacgccaagataaggaatgctgggttgccaggaacaaaccctgtgattcaaggttttgcctagaattgccttaaaaaaaatgcaccccattaattgatccctctttagggtagtataagtacatcctcgactatagcacgagtagagtcgagttctcgtactaacctaagagcagatatgccgaaatatttccacgttcaagcagctaattagtaaacgacttctccataacagtttgaagattggctcgcaacgcaagtagcggcaagaaaggagagcaagacttccttttctaaaagaagaaagaactagacttctataagaagattttgataatcgtagatcgtggaatattcatctatcttattaggtaactactttagctgctctcgaaactgaaccatcgtgaatagaactagcgcttaaggaagagtaggatctgttagcaagtcatattcaatcacccggtcttctccttcctagcttttagatagccctgattctttattggattttaatacacttagccgtgtacgtatcttggctaaactcgaatctatagtttatttaatactgatgtactcggtaaagaatcaaaaaggtacttgaagacgactttgaatgggaggaggttttctttttatccccccctaacctgattttgatgtcttcttcgttctcagtccctatggtccattgtaggatgatttttctaaggccttgaattcgttggaaaggtgatcagggtcctctccctggtcctatcgaaccagtgacttctctcctgggattgaatatgttttgcctttccccgatggttccgcattccaatgtgggtaggatttgccaggatgagcggcttatttagcctatgcgaagcacgaagcataagagaagagtgtagcgaagcgagtgtaatacttgtagcgaatataagtagtgtcaaagcctacactggcttagctctgcagatgttttcaggacgaagacggtgatacgataccactcgccagtgatgataaggttcactcatagcataggtggaagatccatccaattttctttatagatttatttgttcaaagaaaagacgcctaaaaatcattcagggctcttggtatcctttaccacattcactttccatattccctttttttagttcagacgctatcatacctcagggaaaataaaatttctatcaacgattcccacccaactttggaatgactctcccctctctcccttaacatatcgaaggcctcttatccgtcaaccggaccttaatagctcagacttccaagccttgttggatgatgcagaagggccaacatcagaggatcaattgaataaccaactctcccgccccgctgccgctactgctccaaagccaacaaatgcacttgctcatcccaagcatcactttccacaaatagtacccagcgtgtgtcctagccgccgagggcactcctcttgaggaggcagttttcgaatctaatctttctgtctgcccataagagcgggacggtgaattaccagtaggggcaggcccagaattccatgtacgcctattccacgcccctcccccctgggtgaggattagctcctatgatttgccgatggtagtaggatttcctatcacattgatagaagggaaggtcatctactaatagttaaacggaataagattagttacgaggacacctgctaactattagtaaagaaagcaatagttgggccctagtcgatgtgctcttatttgaaatctatagctttttggccgggtaagaaaatgaagtagtagtctatcaggcagtctaattcgtcttctctaaggtcaggcagtgaggcattaagaaagagcagcagcgattttgtcaagcgaatagaaagagctgctcgttaagcaagggatgggtttgtttgcctgtataggtagaagcaccggtgtattaggtatcaaaagaaaggcatctggataggtatttaatcaaatacttcttccctcataccatacttatctacttcgctttatttaatatgtttattgacccgtaaatcaatgttctactctctcatggaaaaccttctttgtagtaatatgaaagcttatcgcaaagcatagaaattaatagagcttataatcaggtcagatattccacttgctcctagaaataaggtaaggttagttagcactttcatgccaactttcatcagcaagcacttatataaggggggtgcgttaacagaggaacttgaattcccgctggaaaagtgaaatagattcagcaccaggcggggaacaactactccttttttctttcctcaatcctcaaacaaaataaaagtattccgttctacttccaattccagctttcgatacacagaaggaaagccatcccaacctagagatgaagccaacaaaccactatctatattttatgtcgaccaacaatcatatgtctgagagtctggtctaactaagcggattggaggcgggcattttcatttcaacgtagcagtagggaaagtgattttggggggttagtacacatgggcagttgggacagttacaggtagttaagtttggtcttattcttatgggcaagtggtcctagaatctctctttccttctctaaagtatagctttacgaaactagaatatgagtaaatatagaaatagaataataagaatatcatatagccgtttattagtaaggataggttttggtgagtagtagttcttggcattagtaagctagcttcactagactatctatgacaggaaattcggtaaatgcacaatatcttttcaatgaagaaagattcataggaaatgaacaatagaaagagtactattcttcagttactcttttttcttgtcttagaatagacaatgtgtcaatggattagctgactttactatgttcctg

SEQ ID NO: 66513 - DNA, 1101 bp, Oryza sativa
acagaagcaagtacagtaaggtggtactcacctaatcagtagcgacgactctatgaactcaatagatttcctgtataaataccaaagtgtttgtaacttgaacggctagcctcaaacacagtagcacaagtgccagttcctggatcctcacttctaaattccttatttacactcctagtatagactctgccatcatctaataccagcaaaggatgcacagttacaataataaactgagatggcaagctgaactttttaacccacataccagtctcagaatctgtcaaaaaccacaggtccatgcggataggaggaatattgtgaactgtaactaagcagccacctgaatcagccaacgataactgcaagttaagttccgagtaagtgctgtcaccatcctgaacatgcctgtgcaccacttctggaccttgtactgtcatccatttctctgtctcgaggttgaatgaagctatgctgcctggttcaacagggagcaccactatttcaaaataagtcgtgtaaaattccatcatgaaatacaccaccccatcgacgaccacgcatctcatctgtttactgcaacagatggttgctgggggcccctgcattttccgccacatgtcttggttgttgccatcaacggcaattacctcacacagctgcctttggtaaaatctgatgatgcggagcgccttgtacactccagtggaagagatttccccaaaagcatgagactcgactttgccatggtacatcatcatccctctcccagcagcaatttcatctgagtggttcttgggcaatgcgacggtaaccccggtggctgggttaagcacccagaggcacagagggtgtaacattctagtaaatcacaccatgtcgagatgggtgcgcaagcgcacgacagcatcatctcttatctggaatcgcaacaacctcgccggacttgtccctgacagcggctcgacggtcggtgacggccgattgaaaaagttgaattttttacattaatacccttgccgcccactgccagggcggcaaggggcctccacgcaaaaaaccagcccgagaagggctattatcaacagagctggaaagaag

SEQ ID NO: 66514 - DNA, 5908 bp, Oryza sativa
  unsure (1)..(5908): unsure at all n locations
aaaaaaaaccagccaaatgcttctttccagctgggcaaattgcatttcgccccttgccgctctctgtaagggcggcaaggaccaaagcgcaaaatgcgcacacggcgccgtcgagccgtcgtctgccatgtcagcttgccgccctccactagagcggcagggtctatttttgtaaatttttacgatgatagattatttctctaaatattttttttaaaaaaattaaaattgaaaaaaattcacgactcgtgctcgagagcagcaaaaaggcccaaggagataaaagaggagcacacacgtgttctcctcacatcagtttcggcccatacgagttggttttgggcctgattgttctcacagttcatattgccttctcaatataaattcatgtgtccacgtagacgtgacaacgaacatcgacacacaggagtagggtattacacctctggatgacttgaacctatataaattcatgtgtccctctctacgcgaggtggtcgggcctggtgaaccttctctgattacagtttgtccgtacctcactgcaaaccctctggtcagatctttactctcggggaggggtctccactcctatggtccccggtaccttgcaaatgcagatgctcacgacgggtgcatactcacccctataaactcacattcacatgcataaacagtaaatatgagcacgagtgcaagtctaggatttaaaatcggatggattggtttcactaaaaaaaaactaattagttaagctagttaagctaagttcactttgctaaaagtggtttgttgaaggcttgatattaatgattttttttcaagtctaaccatgatttagacagctgtatgtctggaaaaatgggtttgatttgtaagggagatggacaagtggtttccctgctaagctgtccatctcatgtgtgaatcacatgcatgtccacatggattgtggtatccacaacttttacagttggtcgtttcagtgcgtgcatccacaagctcgcaatgtgagatgagatctgaaagcttaattggcatgttggataattacaagagaaattgaaacccctgatttcaagtttcaaccggttgcaaggtaatttaattagttatgttcctcgaagaagagattaagagtgtgcgtggaatctcaaaatattatttcagagaaaattaacataattatcagtacggattcatactccgtaattctgtatggattattagcatgaaaatataaattgcacaccgtcacgttgatttagtacctgcaaggatgtctggtggctggagggagagaatatacccacacccactattcatatttcacttttaatcacttgttttaatttcaaaaaaatataataaatatttaaaaaggcacataaacataaagttcccctctccgaatctaaccatttaataccaattatttgagaatggaagttggaatatatattactccatccgtttcaggttataagtcgttttgactttggtcaaactcaaagtcaaactgttttaaatttaactaagtttatagaaaaaagtagtaacaattttaacccaaaataaatttgttatgaatatatattcaattattaatttgatgaaactaatttagtattataaatattactatattttcctataaacttagttaaacttaaaacaatttgacttttaccaaagttaaaacgccttataatctgaaacagagggagtacgaaacactgagcgtattaaatttttttacaaactttttataaacactggtgtgtcacagtgtcgttgaatctggttgaatctcgactttttataacttccagttaaagatttttgttaataaaaagttggtaagaattatttttagtacgtgtagtgaggagcatttcttgccacctttattcgattccaccacttgacacatccatcgatcactcctccccctaccaacgatcagctcagcttcagcttctcctcggcatgtccgccgccgccgccatcgcgtcgccgatcccggcggcgatcgccgtcgtgcagcagcagaggcgggggaggagccgcggcggcggctccggcgctgccgccgtccgctgctccgcggtggccccgacgtccgcgatcgcgcccatccttgccgacctgaggctgcggtgcgccgccccgctccccgtgctgcggcgcgtggcggacgccatggcctccgggatgcgcgccgggctggccgacgacggcgccggcgagctcaagatgatccccagccacgtctactcactccccactgggtaaccaacctacttaaacagttaaacatacacttaactagctctaattacagattagctagctggtgttgctaatacatcgtcagctactgcaggcaatgttaatgcatcagcagttcataaagttattgttactttgttagtggatcatgtggtattttaattgttcagctggatctttgtgtgaactgaacttctgaactgcaacacagtgggcttgtgaatttctgattattttttcttttttgtattgtgtttagagtggagattgatcagctagtatatctttgcaacttgagctcaggaaattaatcttggttaattatttatctggttaattttgtgtttcatgattgttgtgctgaaggaatgaaacaggactgttttatgctctggaccttggaggcaccaactttagagtgctgagggtacaattgggaggaaaagataagcgcattatagataccgagtttgagcaagtctcgatcccaagagaaatcatgcatggtataaccgaggtttgttaatttttcacaagctgtgttcttctgagcttactctattatgtagtctgtgaaatgtgatgcattcatcagaatagctgcagggacatgtatatctgaatgcctgacaacattgttgtgtcaaagcaggatttgtttgatttcatcgcgagtggcctgtcgagatttgtagcaacggagggtgataagtttcatttgccacaagggagaaagagagagttaggcttcacattctcctttccggtgaatcagacttctattgattctggcattctgatcaagtggacaaaaggttttgctgtctctggaactgtaagactttatttcataatgcattttttatgtatagtttccatgattctttgattcatgatgtatggcactacaaattcttatcttgtcccgtttttatcctagtaggatatcctgtatatgacattttccatattggtctgaaactcatccgttctagaattcacgagaaaaaaaaactgattcatttgtagaatttctgatgccaagagttacaagttacaacagtgaaaaatcccttctagaacaaagaacactacttttactcactttccagatgatggtttatgaattagcaagttagtttctttgtcagttaaatctttgttttggacaggctgggaaagatgttgttgcttgtctgaatgctgcaatggagaggcaaggccttgatatgcgtgtctctgccttggtaagcaaaaagcctatgagaataccatggttatgggctagaaatgttcgtggaaagatatcctcttcacaatacatttataaccaaactattggaattccacttaacaggtaaatgatactgtgggaaccttagctggagcacgttattgggacgatgacgtaatggtcgcggtgattttgggcactggcaccaatgcatgctacattcaacgaactgaagctattccaaaattgcaacaccttaagcttgaaacaggaaacacggtatgccataacatagacaaattctctattaagttattgcaaatggaaagtgttacgaagttaaggaatttttcttgatggaagtctctgtactgcagattattaacactgagtggggagctttctcagatggacttccattgactgaatttgacagagaaatggatgatgagagcataaatcctggtgaacaggtgaaaaaaaatgctttcaatttttattttctaagataagcagaggaaggtcctactgtgcatactatatactgacaaaagtaaaacatagtttacttatatagaagaacgacagagtctcagggaaaggaggaaacatagtagaaaatttaagcaagattatttagccagtcttgactctgagggatatatttcttcttgctcttgaaaacataatcttgatatcctggtgtgcttgcaaattgcaatatgcgcagatattcgagaagacgatttccgggatgtatctaggtgaaattgtccgtagggtgctggtcaagatggctgaagtatctgatctctttggtcattccttccccaagaaacttgctgaaccatttgttctaaggtcagttctcatgctctagcatcacaattaaattaaagtattatgctaaggtgaaaaactccaaattacaggacaccacatctatgcgctatgcaacaagacacctctgacaatcttggagaagttgagtccatcttgagtgatgtcatcggcgtaagatacttactcctcatgtttcagtcacatcacaaagggcatctagctagcacatccaaacatgcaaaatttacccccaaaattcacatccacaggtgtcccaagcttctctgctggcacggagagtcactgtagaagtctccgactgcatcatcaggagaggaggccggttggccggggcaggaatcgtagggatccttgagaagatggagaatgactccagagggcacattttcggacgaagaacagtggtcgcgatggacggtggtctatatgagaagtaccctcagtacaggaggtacatgaaggaggctgtggctgagctactgggacccgagcgatcgaatcgtatcgccatcgagcacacgaaagacggatcagggatcggcgctgcgctgttggcagctgcaaactcaaagtatgctgctgctcaaatctctacaaggtgatcgcaattgttataattgttgagttactgggccgaattaattctctacaaggtgatctcaattgttatcattgttgagctactgggacctgaacaatccaagcatatcatcatatggtggcctcttatctgaagtatggaggggcttcatatatgctattcttctgtactactagtctactatactatataacgcatttgaggaaaagaaacaccagaaatttatcaacttatgttttgtataattcatcaacttatgtgtttgtatagttacagttcaccagaaattcatcagcttatgtatttgtatagttaaagtttatcctcaattttgtgtggcctgatgtttcattgcttagctggattgtatattttgcaaatttctccaaaacatcttaccgctgagactagcaattgcccgagttgttaatgcttgctcaggagcaattttgcagcattcaggcatttgcaggattttttttaaaaaaaatacaacttatggcacaatgccaccacaaatgctaaatttgacctcacctgcaagatttaaaatccagtggtctgaattctaacacctgagttcaaaacaagattggctgtcctttacccttctcgttttcaagtcaattgatcgataaagtattatggagcaaaactaagattaactgtatcttcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66515 - DNA, 1566 bp, Oryza sativa
atttggcatcaattctagtttcactgcagacactccagccgcattcctaggacctatcatgcccatcttcagcaaatcctctagcaaacctttcatatcacctttagtaacaagcaaggaagtatccacaacctcctttccctccccagaagacattttttttcttcccttagcttcttctttaccacattaacagaggtacaacaaggaccagacttcaatcccccatggcagatcaaatattagccaaatcaactaataggagcaacaacactactcctcagtttctcaccaaaacagaacagcagcaatagcactacttctcagttttcagcacagcagcaagtactcagtttcttcccaaatcagcacagcagcagcaaatacagcagcaacagcaagccaagcgcccacttcaccttctcaagtagcagcagcaccaacacctcaccagcagcagcaacaacctgctcctctgccacacgccgtcaccagctagccctccgcacgcgttgtcgccgttggtgctccctgccgtcgacaccgtcgcttcctcactccacgtcccgccttagcagcgctgccgtcctgcgccggcacagcgccgcttcctgccgcggccaccaaccgtctctgccgcgtgcggccacgctggcctcgcgcgtgcgtcgtcgcgccgcgccaacctcgcctcggcccgcgccgctgcgccgcgccgctgcgacctcgccagctagggttcaacctccccagtcgccggcgacccgctctgataccatattgttcaatttggggaatttttctagggttagccttctcagctcaccccttcctcatctattctattagcataacactttacagataggtccttggtacaatacatatttacaccaacacgcctccacgggagagtacaaggtgctccggatgttcaaccgtcccggatttacagaccttgagctccctcagctctgtgaggtctttacagtcaagggtggcacaggccaaggccatgcacattggaggggaaaacagagccgtcagttctttgttgagatgcaaaaggcgaacagcggtgtcgtcgttaatggggtggtgtacttcttgatggatgctctatatgatgctatgattattagtggactgggagctggcattcatccagacttcatcttttcttttgaccttgagactgaggaatggagggaagacatccaggggccaattagcagcagctttgtattcgacggtgattttgatccacaggagtatttctcaatttggcatcaactttgtctggctgagttgaaaggctatttagttcatcaccagcggttttgttcaaccatggacctatggtttctaaccgattatgagacccgtgcctgggttaaagaatatagcattcagactgaatcgttcatccctgttcttgagtacgatgtaagccattgctggtattagatgatgggaggatactcatatggttaggatcgacaggactactgctcatatatgatccaagaaccagcagttttgcggaagtcaagatgagacatcttg

SEQ ID NO: 66516 - DNA, 27099 bp, Oryza sativa
caaacacaactgtactctgctcatcttctgtgcctaaactggatgctaatgaaaatgagttttgggaaattcaagtgttcgcaattacttgacatgtacagtccatgaacaaggatcaactaactcaagcctgaacttttctaaacttcagacctgagagtctgaactcaatccaactcgtgcagggttcatttttggaattaaaaaagaatcaagtaagaattttactgcctttattgcagataatcagataataattagtgctacttaagcacattcaattcaacctatcaacaactaatgatcttagcctgctaataaatacagtgaccgttagaggactaagctcctatacatctctatttctacatctacagaagaatctatttctacaaaaggacaatgtcactgctaatccatctctagctccatagatcgaacagctcatcatcaatggtgaagtcgatgcagctcaggtcgtagaagccctgaacttgactgtctaatatgcagcccaatatccacaggatacttcagataccttgaaattcgtttcagagctgtccaatggacatccataggtgaatgtaaacattggcaaatccgtcaacagaaagggaaagagctgagtaatagtcatgtactaaaattctcaccaccaagaaccgctcctctccaggaataggtttcactttcacagagaaactgcctcccaatctgcttcttgttctgaacattgtctgtcagcagcaggctattgttttaacctataaatccttgcttatttcagatgagccattttatcagtaatgatccatttcttcttaatgaatcagtagtgtatccaaagctgatacttgtatctttgatcttccatcaatctattgtcaccatttatatccttgactatgtggatttgtattgctagctcatctggacaatctgatattctacgaattcagaaaaattgcagcagagtttgcaatcaaggatatatgtgggctgtcgtattttctgagcattgaagcaaataagctatctggtgatgaactgatgctggcacaaataaatgaaaagaggtatctcattgatctgccacaccggacaggtatttgccaaacagattgccacttttatgtcatgttcagacatcagactttcagaagctatactagactactgctggtgctggtgtgctacaatacttgatgatgacagggtgcgttagtatttacaagctcctacagatgtgcgttagtactctgaacttctgaaggcacagctttgcactgagttcaaaattcagagaatgcagtcaagctcttttcagcccgttttcaaacacggacagagcagatttttctgatcatcaccagatcaactaatggaaatgtactgtgccttgtacctaacttcatatctcctggtgctcacgctgtctcacgatcaatcacacaggctgaatacaatgctacggcagagttagtatgtggagtgacaatcttgaagcaacttacttgatgacgataatgtttgcctattatgctttaactgctggagattaatacatcagcttcctaaattgatttgtgactcaaatttaggtgttcacaattacttgacattttcagtacatgatcaagaatcgattaactcatgtctgaacttttctgaagttcagacttggcagtctgaactaaatacagttcattcatagtacacttttggaattaaaagaataatcaattaacaatttggcttctttcattagatataatcagataatacaattagtgctacttaagcacatttgattcaacctatcaacagctaatgattatcagctttgctaataaatacatctctgcttctacatatacagaagaatctctttatttctacaaaggacaatgtcactgctaatccatctctagctccatagatcgaacagctcatcatcaatggtgaagtcgatgcagctcaggtcgtccatcgtctcggcgaagtcgatgcagctcaggccatccatgctgtctggaactccaaaaccagtggcctccacgtccatgacgcccgatgaggagtgctccttctccttgtccggcgatgacatcatggaccctgcaccaccactggcgtcgacttcggcttcatggtcatggccgccttttgagggagagtcgaccggattgcgcgcggcgtactcaagcggaaccttcagctcagcctcatagtacccgggaagggaatcatccaccatgccggagcagctctgatcggcgccgtcagagtcatcggggaggtccaccactgctgaaggaggaggagcggcgccggagcagccatgatcggcgatgtcagagacagagtcatcgtgatggttcaccattgctgcaggaggaagaacgagctcctcgatcagagcagtctctgacacggcgctagtgcagctctggccatccatggcggcaaagtcaaagcagctaaccatgtcatccaggctctctggaagctcgaagaacattggcgcctcgtcgttttggttgtccagcgatgacacccaagacggcgctggtgctgcacggccacccccggcaccggcttcggcttcatggccaccttctgctggagagtccaacgggtgaatattagcaaacaccatggatgaatcgtccaccacgccggagcagctttgatcggcgccgtcagtctcattgggaaggtccaccactgctgaaggaagaggaacggcgccggagcaaccttgatcggcgttgtcagaggcatagccatcgtcatggttcaccattgctgcaggaggaagaaagggctcctctgatatggcgctagtgcagctcgggtcgtccatggtggcgaagtcaaagcagccaataatgtcatccatgctctctggaaactcaaagaacacaggcgcctcgtcgttttgattgtccagcgatgacgcccaagatggcgcgggtgctgcgccactggcttccaccggtggtaagacgatcaggtcggaaagattagcaaacaccacgccggagcagctctggtcatccatgttctctggacctccaacatcagcaaacgacgacatagattgcgccggcaatgcgccaccaactacgtccgcttcagcttcatggcttccttgtggcaaagagacgaacaggttgcgcgcggagaactcaggcacaaagctctgcaactcatcctcatcggtgacgtcagagtcacagttcaccaccggtgcaggaggaggaacggcgccatcagagacagagttcaccaccgcagcaggaggaagaacgggctgtggcggcggggcgctgtcctcgagcagagcagtctcgggcatggctatctgtggggcgcagcgcgctcgaccgtcgtcgtggtgggcgctctgagattccggttccctcttgcgcttcttgccgtggccgctgaaccggatgcgatacagccgcatcgtcgacgacgcgaggtcagccggcgtcgtgatggcgtactcgtgcatcacccaccccgagctccccttctcgccatccgcgaagtagctgaggacgtacttgcgccacgcgatctccaagccgccatcggggacgaccagcctctcaccatcgacgcacatcctctgcccctgccagtaccctccgccctcgaccgtgcgcttctgccggctccccttcccattcttggcccgcgcgtcggcgaagaagaacgcctcatcgcccctgccatgatccgcaagaagcctccatggcggcgcgcagaggggatcagcgtcgaggatgacgccgtggagagggaggggcttaccctggatgcgcgcgaggaggaagcgggcgacgagctcgtcgtccttgggctcgaacttgagccccggagggagcccatctccagccgccgacgccatgggagatccgcgggagaggagtggaatttctagggtttgggaggagggtttggttgggaagagaggagacgatttgaatcgaggaggggatggggatgggagagcaacggataggaggctatttaaaggcggcggcttcgcgggatcagcctcgcgctcgcgcgcggaaagatctggtgagtttcccatttttcggaaagtttgatgaaatatcttatctttgcgattcgatatgaaagttatttagaaaaaaaatagcttcaaaattcgaggtgaggttggtttgaattttgcagttctgctcaagctatacatacgtattgctgaaggtgacactgaacaaatgatgtttgcagcctattggctattgcagtattgccaattgctgaaggcctgaagctgacactgaagaaaagagccataagaaagattcaggatgaatatcaccaaaagaaattgaccaattgagcaaatccagctgttgacgaaagttcgaagtcccttgatttgtcttttgtcttgaggaacattgatgaggttaccgcccgttggcacagttctatgttcttaattgctctgaagttcagactttagagcctgcactcaatctaaatcatgcagagtaaactattggcacaaacaaaagaatcaagaatttttactgccttcattggagatagtcagataagagcctacaataattaatgcaacataagcacattcaattcaaccattagtgattgtctgtcaaacggattttgtgatatctgaaatactgaatgtgaatgctacggttttgcactgggcttaaaattcagaaaacacagtccactctttacttctgtgagagcattttcggacgccgactgagcaagttgttctgatgatggcagatcatctaatggttgatttcctggtgcttgtggggggtgatttgaactctgaagagattgtttgggtgcagtacctgcctcaagaaactaggtgttcatcaggttcagagttcagacccctcatctcctccttggacaagtttttcagacatttttacaaagccaattgagggacggccgtttgagaagcttggatgcaatctgaaattttggactttgttaatgctagttaataacttaggattgtggggagatagccctcctctgctagcaggaagaacggatccaggagctgaagattcagaattagcatatgtacagtccaaaagtgattggccactcttcaattttttttaattaagcaaaattttgttcaaatttcaacttttttctaaccgaaatttctgtaatgtccacaatttcgcttctatcagtaaccccgaaatatttgtgatttccaccatatagaaccctacggtctttcccttaaaaaaaacctacagtccatgaagccgaatttttttaggcaaagatttgaagccaataatctttcataaaaaaacaaaagaaaaagtatgaactcaattaaataacgtgctggcgtgaaatatacaaaactcatataggagtacatctcttcactctctgctctacagaaggcactcaaatcaattcctacacgcgacaacgtgccaatgtcagtcttgatctcactccaaatcggatccaatttaaatcgtgttcggacttaaattcggattcgaactaagcgtcccggcatataaatcggatccaaattaaattgtgttcgggcttaaattcggattcgaactaagcgctcgcgccatattaagcgcgcccgccaccgttgccctcgataactcgtactacataatcagtgcgcctccggaactagattcataagccgtctcgaccagctcgctgtggcgtcatcaatggcggcgccgccgagaaaccgcacgacggagaaggcccatgttgacgacgaggcgttgcagaggtattgcggcgcgtggcgggacatgcagtgccctcaccgcggcggcggcggcggcggggacgcgttcgtcgtcggcgcggtgtaccacatcgccgaggacctcaccgacatcaccctcatggacgcgtactccggcgaggtcgtcaggcggatggacgggctgagcaggccaggcctcagggtctgcgctggcggcgacatgatctgcgtcgtgagccccggcgacgggctgctccgcgtcgtcgacgtggccaccggcgacctgaccgacctctcgatgggctgctcggcggcgacggggaggaacgtctcctccgggtacacgctggggaaggtgcccgccaccggcgagcacaagctgctccacgtctacgccgccgccaacgggtcccagtcaagcgaggtcctcaccatcaccaccggcgccggcggcggctgccagtggagggcgacgcggagccacccgccgatgaggatcgagcacgggatcagccggagcagcgcgaccgtcggcggggtggtccacttcctctccccggccaccacctccgccccgcgcgaccgcggcgtcgagtgcgacaccatcgcggggttcgacctcgcgacggagcagtggaggccggtgctgatggacggcccgctccccgccgaccagcgccaccgcgggcagcgccccaacctcagcctcgccgcgctcggcggccgcctcgtcgccgtccaccacgactaccccggcaggaccatcaacctctggtccctaacgccgaacaccacgacatggacaaagcttcactcgctcccgatcaagaacgtcctccgcgggtgggaagaagaaccgacgagccacccggcggcggcagcggaggcgaagcgcggcgggcgaagcaagaagaggaagaagaagaaggaggaggaggtgaggtggttgtgcagggagaaggtggcgcagccgctggcgatggtgggggacgggaggatggcggtgtgggcgagggggtgcgagggggcggtgcggctgcacgacccgaggacgggggcgtgcgaggaggtggcgcaggtggaaaagggcggctgcgtcctgggcttttattccggggctctcgcgcagggcgaagagttctaggtagcacttgggtgtgtagctagacgaaaccttaagtgttactgcaaaagaattgtatggtaaaatagtagagatgagtctcttgcgccgctcatatataacgggcaggcgtgtgtatggagagattctttttcttttttaaaaacaggaaaaaagtttatttagtataagttttaattactctattgttaattaatgtgatatacttccttttattatgtaatatagtaaatatttagtatttaaatttatattaaaatttggttttttctccctctcttatcttaaccaattacaattatcttctgtttagtatctctacttatttcttcatctcaaccaatcatatttatcttatttaattctgtcaatttttcagccatgtggagaactctaaaaataacttaggaccgagtacactttaccagtattaggaaaaacaaaccaaatacactctacacatttctaccctaccaaaccaaatattgataatgctaaaattcgatattaccaaagattgatactgtttattttggcatcaaaccaaacaacactttggtgagttggtatacatccggcgttagttcagacaggagaagggtgagactgctgtgagattatctagttaaatacagtgatatattataagagtaaattgtgctcgcagtatataaatttgtgtggtgggtgcaaaataggtactacaacaactataacttgcacattctgataaagtaacttgactagtccatcacaaatcgcaccgaaattatccatgcaaacaaaattattgtaaggttccaaactgatagcatgtattactatgttttagagatcttatttggaatccaaagaaaaaaataaattaattgtgcagaaattttcatgtacaggacaagaatttattttttttatcatctgtataactctgtataatgctcacttatatgttcaggagcaacaaaatttctgccatgccatagtctcctgaaaaattcattttaattttcattctcaaatactccatttcaccaaaaacttgtttttagaagtttatttccatggttgggctttttcaattgtttcactttttttcaatctaaatctgaaaaatatcgagcgcataataattatacattttgtcggtctaaattttgtgtaatagtaatatgcgccacattagctcaatttgcttacaatgaccgttttgccccaagttctcacggactaggtaagttattgtatcgaattgagcaatttgctagttgatgtacctatttatacccatcacacaacttcacgcaccatgagcgcaatttactcatattatcgtattatatctataccaaattaaaaaaaaaatctaaggcttccttagctttttttggtgcatacgtcgtcgtctctcagctgacttatttggcctcttcctcccgctcccttttctctctccctcatggcctccatctctctccttttggacctttcctccttcggccaaaagtcctttttcacttgtctccttgcctcggcctgctccctctcctctatccgttggcctagctatgcttaggctcagcccagccgttgctagttctacttcgacacacgcctccagccgacatctattcttatctcccagccaaaccctagcatcgttgccacgtcgatccgtctccctgtgtgcttcctcatcctccaaccgattgcaaaaatcgattccccactcctcccttgtcattccccatgattttccctttcaattcggctttaatttgccggatttaatctccgtctaactgctaatgatggccggtcggcgagcttccttgccgcttttatcccgagttttgcggaattgggttgtgacatttgcatgtggattctctctgatttttgggaaacgaaaagagcaaattgagtggatcaaaagctcttaaccaattttgggagatcgagaaagattcggcatatttgatggggaggatcagctctagcatcatacaaggtacgtgactgtcgttcagaggttgaagacgctactatagcgcaacgagaggagacagctgacagtgctagctagacgctccacttgtgagccgagccaaagagataaaggtcaagccgaatgaggtaggagatagcgaaccagactagggctaaacatagagaaaggaatgaattttacctaaaactaaggtaggattgtacttactttttttcaattataatgtatagtgatatcaatattttaatttattgtttagctcttaacagttgtttaacatatatctctactacttaaaaaagtgtagtggtggtcttgaatccccatccaagcagccccatggaatatgaactattggatcgcgaaatccaacgcctcgatcgcctatcttttcttttcctcgagctctcggggttttggactatttgccactctcccgaatgaattcgctattttgccatcggggagagaagattcttgcttgtgtgccatttttgagcccgcaaggcgccacgtcacccgatctaatgacaaaataaccatcttacccttcttcttcatttctcctccggtctttttcatccccttcctttcccagggcgccaaggttattgggctccggtgagctccccgcctcgcacttctccctcctttgcttgctccttacctccacggcccctgctctttcttttgtgtcatcgccggtgccttgcttcatcgtcaccgtcgtcgccttctttctcctctcggctcttttccactctccccgatgtcggcggttgtgtcaagtccaacctcgaggcttcccctaccttgtcattcgccacctagcgccaggaggtcggtccggcggtggtggtggcggtgtcaccagctcacacgcaaggaggaaggttggaggagagagaccccgagctagaggaagaagataggcaagacggttattttgccctcggatcaggtgacgtggcactttgcaggctcaaaaataatactttgcaggctcaaaaatgacacacgatcaagaaatcttctctccgatgacaaaatagcgaagccaaccttgagagcggcatttgaaaacacgccaccgggagagtggcaaatagtccaaaaccccacaacccaacaaagctctcatcctgaaaccgccgatcccctatccgcctcacgccgccgcatacccactcggtcgctccccctcaaccgccgccgcccccatccacgccaacgccgtcgccgccgccgccgccgcatcccctccaacgccatcgctccacgccgcagccgcatccccgatccacgtcgcatccctgatccacgccgcaacagccgcatcatcggcctaccctccatcgacggcgtgattccgcgcaacggctggaggaggcgaggtcgggccttccctatcgacgctccacgccgccgcagcccgcagccccgtcggcgccgtcgctgcgtcgctccatcgtcgtcccgacctcgaaggtgaacctgcttcgagtccctcacgccgccaccgatcccaggactcgtcaaccctgcaagccatccatcctgcctgtgaacaaggtaagagtgctgctcgatccagttcctgtacaggaggcatacgaggcagggtatgttagatgcataatggctttagaaatcccctgcgttgactaaatccccattgttcattattaaccattgttcactgtgcatgtatatctgtgatgcaaaactctaatccaaaatctgaagttcaaactctatcatattagtggtttactgtacctgacaagcaaacatctcaaatttgctactgttaatgtatgctactgaaaattctggagaaaaaaaaaacatcgtacgaacgttttttcagttctctaaaaaattcagaaatatacagtacactctgggaggttgacagccatccgattcaaatcgaacggacgataccgaccgtacacctctacagagctcgccctctactacgccccttctccgactccggcgagcccagatctcagcaggtcgccgcagacctctccgtcggcggcgagagggtttcgatccacccgcagcgccatggccgagctcgcggcgggaggcgaccagcgcgccgcgctgctcgcggcggccaccctcttcccgccgccgcccgacggcgcgaggttctcgtacgggacggcggggttccgcgcggagggggccgccatgggccccgcggtgtgccgcgccggggtggtggcggcgctgcggtcggccaagctgggcggcgccgccgtgggggtggtcatcacagcctcgcacaacccggtccgcgacaacggcgtcaagatcgtcgacgcggacggcgggatgctgtcgcaggactgggagccgttcgccgacgcactcgccaatgcccccaaccccgacgccctcctccaggttgcctctccttcgctggatctcagcttaccacatgccctgaccttgttagattgcgtactacagctagctagtcagttcgatttgttactgtctgacgcgtaatctctttcctctgtgttgatttttgtaacatgagagctaattttgttaataggatgagctagccagatcgccagtcacctaagttagggtgtgtttagttcacgccaaaattggaagtttgattgaaattggaacgatgtgacggaaaagttggaagtttatgtgtgtaggaaagttttgatgtgatagaaaagttggaagtttgaagaaaaagttgggaactaaaccaggccttacaaactctagaaatttattgaaccagagcaggtgatgctcgagttcttgggatgctccaaattgtgctagagcatggataacacttcacagtttctaggacagtgcatgactctttaagtctctaacatgaacaaaacatgttgctaacaagaatctgacagctctagagatgacagtattggcaccattgtcttgtcaaagttcattcagagctgaaacaaatcctctagggtaaaatatactgcaagtcgtaaaaccttgtggttgtacttggtcctcttctgagtttactttgtttctttcactccaccatctccaaagcaaattagttatattcaatcgtttctctttagaaaggtttcaggtttcctccatcgctgctttaggtgaacaacacatcaacagtttttatcttaaatcctcaagatctagttcactccagcattgtcgaacattcttgcatttgaaaaatgagtggtcatcatcctcatgaaacctccagcatattggaattatagtaatgtttaaattccttgatcaatgttaaagactctgatggtgctaattggtacttgatactgttggaaaacagaacttcagtgcctcaatattatcattggattgaactatggaactaatgaggagtggcatcttctgcctgagatgttaagtttgttcagatagttgatagttttgtttctgcctactcttaccctcagttttcttttatgtttgttgaattgtagatagtgcttcagtttgcaaaagatgaggatattaaacttggtggaagccactcggcacaagtgctgctggcaagagacacgaggccaactggagagtacctccttgatgtggcggtgaaggtatgacatcaatttacatcctttattctgtattcactgtatgtctcatgttcatgagtcaatcttaatagttttctggaactcatgcatgaagggagtaaatgcggtaataggtgcagtagcagttgacatggggatcctcaccactccacagctgcattggatggtccgaagtaaaaacaaaggactgaagtcttctgagacggattatttttcacaagttattgattcattcaggttcttctgaatttaattctctgctactgtaagtaataaatatgtggcatctatttgtttgcataatttaactatattgcaataggtgtttattggagttagtcccaaaagataaagaagctgatgtgataaacaatagactaattgtggatggagctaatggcattggtgggttgaaacttgaagaaataaaggcaaaaatctctggattagacattcatgtgaggaattcagggaagggagaagggatacttaatgagagttgtggtgcagactttgttcagaaggagaaagttgttcctcttggctttggtcctgaagatgtcggtttcaggtgagtcagttaattgctccttaaatttctacttgtcagttgtcactgatcttacctggccattctgatctaactttcaggtgtgcaagttttgatggcgacgctgaccggcttgtttatttccgtatcgtatcctctagtgacactaggattgatctcgttgatggtgacaagatattatcactattcgtgctgtttattagagagcaattagatattatcaatggaaaagacaataaaggaaatgaagtacttcctacacgttttggtgtaattcaaacagcttatgcaaatggtgcatcaacagattttctcaagaacattggtctcgaagttgtattcactccaactggagtgaaatatcttcacaaggaagccctaaaatatgatatcggtatctactttgaagccaatggacatgggacagtgctattctcagatcattttgtctcacaactggaatctttgaccagtgagttttcttcaaaggctgcaggtgaactcttcatgatttttccagcatttcttttctcttttgcattgttggatctatttgtttatggttgtcgtgatgtttccccctttccttttaccttttcacattaggttcttcacaacaccaagctgctatgagattgttggccacaagtcagctaattaatcaggcagttggagatgctttaagtggaatgcttttggtggaggctgttttgcaatacaagggctggtcgtttcagaattggtgtgacctgtacactgatctgcccagtagacaattgaaggtattttcgccaaagtacctggagttattacctcttcttttctaagatacgcctctagttatcactgtcatatcaggctcccataatataattatgatttcaggttaaagttcaagatcgaaattctattgttacaacagatgcagaaagaagggtttgccagcctaatgggctgcaggaactgatagatggggagatatgtaagtaacatcttctctgagcatataatacttatgtttctttccgacatccgattttcttggcataaattgaagtgttactgaattctgaggtaccctgcagcaaattactctcatgggcgatgtttcgtgcggccatctggtaccgaggatgtggtgcgtgtatatgcagaggcatcttcagaggaagcagctgattgccttgcaaaacgagtggcgcagcatgttgagcgcattcttggataatttgccttccctttttttatctcttcattttccagaagtttaaagtgttcactttagctcaattgcctgacacatttgaagaatatcaaaatccatttgtttgtaatgcaacactacatgtttattcgaaattttcagattgtacatactgtgtgtagagccatcagttattgtaccaaaaaaatagtatgaacagattgagttccaacgcttctttttttaagaaaggaagttgtccgtgcagaaccagttctttgattctttttagctggcgatatactaatgaagttatcatttacaaccataggtgaattccttattcacatgcccacgggagttaggaaaatggatactgaaatgaagagaaaaaaatagaaataatttatactgcatgtactccctcctttagaaaaagctttattttaactttccaacttttatcggaaggacttaagggccccttagatttgtaagaaaagtgtagaaaatttgaagggtttcaatcctacggaaaaatttcctatgaaaccctttgaaacaaatgattgaatcctatactaacctttaaaatttctatgtaatgggtaatcctacggagattttggaggaaagttaacaagaggtccaatctcttagaaaaattgattccttcgtttttcctatggtccaatcaaggtccaatcaaacggtcgttcttgtgtttttcctgtatttttcaatcttctgttctacagctatattcctgtcagaatcttgcgtttttcctattcctctgtttttccattcctgtgattcaaaaggcccataattgatttttcttagaaaaaacatagcataaatcaattagttttattccttagatacctatcagccatctcttacctatcaattcacgatactattatcatattaacgaggacgactttaatttcttactatggtcgttaatttaaagatgaagtttcggtgatacgaagttactttcttcgttccaagatgggcacaatattaaattagtaggtagaaataataggatgaaggttgtgatttgttgagaaaagaagatgacggaagaaattaaatggagaataggtgcaattggttaagagaagataatacgtgtagaaatagctctatttcagaataagtcactatgctagaaataactatattttaaaaacgtagcacttcctctatctcataaatctgaatatatctctgtctaaactaaaagttctactccctccgtcctaaaatgtaagtatttttagctacaaatctggacgcatatgtgactagatttatagctaaaaattgctatattttaaggcagaggtagtacttattacatccgatgctagtttaggttttcatgagatcgagagagtaaattagtactccctccgtcccaaaataagtgcaaccatggttttccacgcccaactttaactgttcgtcttatttgaattttttttaaaaaaattaaaaacataagtcacgagtaaagtactattcatgttttatcatctcataacaataaaaatactaattataaaaaatttcaaataagacggacgatcaaagttgggcgcggaaactcatagctgcacttattttaggacggaggtagtactactcctgtacatcggaccagaaaaactttagggcccctttgaatcaaaggatttatgtaggaatttcataggattcaaatcctataagaaatttttctatttggccctttgattcaaaggattgaagctttctaaatcctatgaaattcctatggaatggcacattgcatgtggattttggaggaaatttagcaagagcttcaacctcttggaaaatttcctttgagtctatctctctcatctgattcttgcgtttttcttgtgctccaatcaaacaaccattcctatgtttttcctgtgttttgcaatcatctgttttacacttcaattcctgtcataatcctgtgtttttcctattccttcgttttttctaccctacgattcaaagtggcccttagaggggcggatctaggaacaaaaaaattggaggggttcaattacacagtttcttccacctccagctatctagaaacctttagtttattattcatggtgaaaaatttgaagggggtgctccggggatattcatgggtcttgtgggtgtagggagcctcgagtccccctgcacccacgttggatccgcccctgcccttactctatgtaggaatacagcatgaagtgaccactgaataatgaccagtccccccacaaaaccacaacaggcccgtcagcggtggtttctctgcatgtcgaaaaccaatcaatccctcacaacgggcccggccgtcggccgtggtttctccgcatgtcgaaaaccacagtccctccactccagcgaagctagtccttctcaaacaccgtccttttaagcatttgtaccgcttctttttttttcacaaatatttacaccctccgtctcattttaagtgtagccatggtttttcacgcccaactttaatcatatatcttatttgaaaaaaatttgaaaataaattaaaaatataagtcgtactattcatattttatcatctataacaaaaaaatactaatttataaaaatattttaaataaaacagacgatcaaaattgaacacggaaaatcacagctacacttgaaatggaacgaagagagtatctcccactcctggattccattccacgctttcttgatgagttgcctgcaaaagaatccgtcgtactactactagtagtacccatccacagtagttctatcctgctcattggttaaaattgctgccgctccccacccttttcacggacacaattatggaatggtactcctcccaccgagaaaaaaataatatgaatgtatgcccattgctgaaagttgagattcgataaaaatttcatggttatactgatgatgttcgctacggtatcattttcgcacttaaatttgcaaatctcacggccagattatcgatgacgccgtgacaggcctcgccgctgcatcggacctcctttccgttttcatgcaaaataataaaataataaaagaagtgtcagcagctaattactagtatttttttacagcgtccacaagcaaatacatgatcttcaggtgtctcacagcaaagaccacaatctttaagtgtcccgtagcaaattttgccctagatgaatggttcttgggcacccctcatcgtgcagctctgttttaaggatgatgaccaggtcaacatactacgtggatggtatattaggtaaaaccatcgagggaacttaatttacactggttttaaatgttttgagtgattgtcacgccctgaaaatcgcctcaattagaaattattttaaaagcctacaagttaaactctaataatttaggaaaaatttcaacataaaattgagctagataaaatttcattaaatactttgcttgtttatctattttctagatttttctgaaaattatgagcaagggaagtatttttaataaatgaaacatcatttcatgaattattttaattggaaaagtcttaaaaatcctctcctaggctgttcccggcctaactcctctttctctcgcgcgtggccgtacggcccaagcctagccgtcgcccccctcctttcaaccgccgacatgtggggcccacatgtcggggttgtcttcaaccttcggccggcctgcccgagcccaagccgccgccgttccccgccgaatccaccccaaccggccatctccgagtccaattggttgaggggtttttatccctttgttgtcctctatcctttcccccaagaatcggagctaattgcttcgtattttatccgaatcaaactcgttttcgagtttatctctccaaactaacccgaagattttccgtcttcgattcctctcggttggagtccgatctccctaatccaagcctttaaatagcattccctagtcgtcctcttccgtttgcctcttgtcccaagtcgagccgtcgcccgtagcgccgccgccacgtcgccctagccgtcgccgccgcctcctttcgccgccgtcgggtgcgcacggaggaggagcaccccagccgtcccttcgccgccgtcgccggtcgccagagcgccgccgccgccgccgacccgagccgagtcaccgttggagctcgtcgccggccgccgttcgccgtcgtccgtcatagttttttttgcaccggtgagttcgcgtcgtcgtcctctacgcgtagatgtcctccgttagcccggccgacccctctagcgccggtggtcacatcacccgtgtcatggccggcggtgatgacgtcatcatgacgtcataaacctctttttagttttctttattagatgaaaatcgattaaattttggaaattcataactaaatcaccgtaactcggattcgagtggttcaagttgctaaatttttctaaaatcaagatctacatgttaaaaatatccacatgtactgtttatgcttgtttttgtactgttttattgattttgttcttttgctttagtttccgacgttctggaggagagcgttttcgttgaggaaggttcggaagcatttgcggaagttcaaggcaagtcacacagatcccaaacaaccctttgagcatgttgaacccgtttaaagctaatgttttatttcaacttatgcattattttcgaatgtcattgggtggtgagcctttcctaattaattaatggtcgaatatgactttattttcctatgggttataaattgattagcttggaccttatatattgaattggttcagctaaatgctatatgtataattgcttagccatgcttagaaagataagctcattaatgggatgaatcatatatactatattattaattatggttatatttaatggtagctcacgatggttaatcgtgttttgttaattaattgataattaaaacctgattaagggtgggttgtgagcatatggttttgatggttgtgctcatgacaattaaggaccggttcgcgagctactgttgtgaaacatttaccgtgccaaccacaagccagcgtgggcaacagctttaccttttgtatagcatgattcattatagggtgccagactgtgaagcggcgagaagtcggtgggggtcgctggggagtccattgcctctggttttgagggggagattatgatccaggaacggtgcactgtggtgagttgttagtttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttatttttgaccaacttgtcacgcccggaaattcactaataatttccgaactaatttgtgcataaaatcctcgtccaggaatcagccgaggtacacaaactgacaatttaatatacaaatccatcaataatagtgttacatactttcaaaagaaaagaaaactgcagcggaattacggtctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagaggagtaaaacagtggagtaattaatcagaaattttaatcaacactgaacagcacacccatgctgcacaggcccaaccatcctgaacaaccatacccggctgtacagatctaactccaaaccaggagctaaacaaattattaccagatataacatccataattattgtgagaggtgtgagactaatcacgaaaaacattgctcaacccgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatcacccccttataaacaaggcatggactccccagcgacccccgtggacttctcgccacttctcagtctggcgcactataatgaaccatgctatacaaaggataaagccgttgcccacgctggcttgtggttggtacggttaatgtctcacaacagtagctcgcgaaccggtccttaattgtcatgagcacaaccatcaaaaccatatgctcacaacccaccttaaccaggttttaattatcaattaattaacatcacacgattaaccatcgtgagctaccattaaatataaccataaataataatgtagtatatatgattcatcccattagtgagctaatgtttctaagcattgctaagcaattatatatataacttttagctgaaccaaaccaatacataaggttcaagctaatcaatttattacccaaggtatcaaggaatagggcattcaatgcaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcgatcttcaattaaccttcttgatcacttccgacgcactcacgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattccgacttcaaatgaatttattatgaattttacaagattaaatctaattaaagtccatttaaaaagacttaaataaatttaattcaatttatggacaattttaatatgtagatctttattttagaaaaatttagcaacttgaaccacctgaaacggatctatggttatttagttatgattttccgaagatttcatctattagaaaaaaggaaaaaaaagaaaggatgatgatgtcagcatgacatcacccacggaggccggctagggttggcgacctcgccggagctagggaccttggccgggtgattggaggacacctacgcgtagaggacgacgaggcgaacccaacggtactcaccacaatgacaaacgacgaacgatgatggccggcgacgaagaggacggcggcggcggctcggcttgacggcgacggcggagctccggtggtcggcggcgaagggggacgggcggccgaggttctcctcaccacggcgcacctaacggcggcggcggcaagcggcggcgacgacgcaagcgacggcgcggcgtggctgaagacggccggcggcggcggcgaactaggtgcgcgcggcggcgactctacggagcacgggagaccacgggagatggggcaaacgaaagaggggaactagggggtcctatttatagccttggattgaagagatcggactcctcccgcaagaaatcgatccgagaaaactcggttttggagataaactcgaaaacgagtttgattcgggcaagatactcaaccatttgctccgattcttgaggggaaagatagaggaggataagaggaatatttcccctcaactaattttagaaaaacacaaggggaaaggtcagatttggaggagaaaaaccgagccaaatcggtctcagttcggctgctagaggtggaagataaacagtgtcgagggaggcaaattagacttttcgtcttgggctggctgaaaacaaagcaaagaaagaaagagaagggggaagctcggctgggccgacttgggctgcacggccgtgcagacaaaagagggagatgggctggaaagggcccaagactaggaagaggattattattacttttccaattaaattaatcaatgaaatgatctttgaattgttacgccgcccagaaattcactagtaatttccgaacttatttgtgcataaaatcctcgtccaggaatcagccgaggtacacaaactgacaatttaatatacagaatcatcactatttatagtgttacatactttcaaaagaaaagaaaactgcagcggaattacggtctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagaggagtaaaacagtggagtaattaatcagaaattttaatcaacactgaacagcacacccatgctgcacaggcccaaccatcctgaacaaccatacccggctgtacagatctaactccaaaccaggagctaagcaaattattaccagatataacatccataattattgtgagaggtgtgagactaatcacgaaaaacattgctcaacccgcccataaccgcgggcacggctattcgaatagttttactctggccagaggtgtaccactgtacccacaagacacagcctcctcatcatgtctaccatgcgtcgcgatcctggaaagtacccgaatagaggctgtgacaataccctttgcacaacacaactcaccacagtgcaccattcctggatcataatcaccccctctataaatataaccagaggcatggactccccagcgacccccacggacttctcgccgcttctcagtctggtgccccgcaatgaatcatgctatacagaaggtaaagccgttgcccatgctggcttgtggttggtacggttaatgtttcacaacagtagctcgtgaaccggtccttaattatcatgagcatgaccttcaaaaccatgtgctcacaacccaccattgtcaagttttagttatcaattaattatcataacatgattaaccatcgtgagctacgattaaaccatcattaaacaatgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaattggccataacaaaggaatagtttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaaactaacacgcaaaacgaagaaaaagactaataaaaaccaaataaaaagtacatataaagtaaacaaacatgtagatcctgattttagatgaatttagcaacttgaaccactcaaaaccgagttacgatgatttagttatgaatttccgaagatttaatctattagaaaaacaggaaaaagaaaaaaacgatgatgacgtcatgatgatgacctcatcaatggccgaaccaagatggcgacctcgccggagattggatggtcggctgcgactttggaggacaagaacacgtagaggacgacgagacgaacccaacggtactcaccctcgaaccaaacgacgaacgacgacggccggcgacgaggtctagcgtcggcgcggcttcggtcgacggcggcgacggggctgcggtggtcggcggcttcggggagatagcggccgggcttctccaccctcccgcgcacctaacggtggtgacggcgaccggcggcgacggcggaggcagcggcgcgacgcggatggagctcggccggcgactacggcggggtggagcacgtggcggcggcgctacgaggcacgggagaccacgggagagggggcaaacgaaagaggaggactaggggtcctatttatagccttggattgaagagatcggactcctcccgcaagaaatcgatccgggaaatcaaaaactcggttttggagataaactcgaaaacgagttcgattcggataagatactcaacgattagctccgatttttggggataaagatagaggaggataagaggaatatttcccctcaactaattttagaaaaacacaaggggaaaggtcagatttggaggagaaaaaccgagccaaatcggtctcagttcggctgctagaggtagaagataaacagtgtcgagggacgcaaattagacttttcgtcttgggctggctgaaaacaaagcaaagaaagaaagagaagggggaagctcggctgggccgacttgggctgcacggccgtgcagacaaaagagggagatgggctggaaagggcccaagactaggaagaggattattattacttttccaattaaattaatcaatgaaatgatctttgaattgttaaaaatacttcctatgctcaaataattccaagaaaaatcttgaacatacttggacacccaaagtatttaacaatattaaaaacagaccatttaatgattaatttaatatgtgggtaattactgaaatgctctttgtatgattaaaaattaagaattgagctccgaaacatctgagaaaatttcagagagtgtaattaatcatggagaatttaatcaaaattaaatccatccatgctttatatttaggaaattttatttcccacatttaacttcacttgtaaattaatgaacatttaatataaattctaataataatttattaaataatttataaatcctgaaacaaaaatcaggatgtgacagtgtgagaggtattgtcacagttcctttccaaggtaccgtggtggtactaaggcgcatggtgacatgttgtggagctgtgtcttgtgggtacagtggtacacctctgatcagagtaaactattcgaatagccgtacccgcggttatgggtgagtttaacaatatttttcgtgattagtctcacactactcattaatgataatattgtgttaatttgactcctggtttggaatgatatattcctggtatggaggtttgatttgtacaaccggggttggttgttcagatgaggttgggcctatgcaacacagttgtgttgtatggtgtttatttaatactgattaattattcaactgttttattattctctcaaaggtttaataaatgttatttatgcaaatgagctttactatgccatcctttgttatcctgtgcacttgcatatttgttgtgtggcttgttgagtatgtcatatgctcattcttgcaatattcattcatcagaggaggagtatttcagtgaaggtaatgatttggaggactaggctttgtccgggttaagttgcttgtggagtggagtcgccatagctgttctgtattttgttttatttccgctgcgtagaattttattctttgagaggaactatccacctctgtaataatttgctattttgcgaatattaattagctgtttaatagtactctattatcaatttgttattgtgtgcctcggctgattcctggacgaggatgtaacacacatgtaagcgtttggaattttgtatagaaattccgggcgtgacagtgctctatccaattttgcggttgaagaatattattggaacctacctagtacccatattctagggacgtaaagtagacttctccaaaaaaaaaaagaaaaagaaaaaccacaacaggcttcatcagccgtggtttcctgcttgtcgaaaaccgatcccgtccagcgaccagtccctatcaaaccgtccttccaagcatttgaataatcatttcattttttttcttccaaaacaaacatccatattggattcccacgtttttcttgaactaacctccaaaaaaaaaaaatcttcagtatcactccatcgtcgtcgtaccatgcacacaggagttgtagccttctcattggctgaattgttgctgccccactctttccacggacacaaataatggtgctcctcctcctcctcctcctcccaccatcgccaccattgcaaggagatcccctcctctcttcgccgccgcaccggaggtgaggtagacgaaggttagtttccaccggagttcgtcggcgtcggatctgaaaccaacccccgctaatcttccccttcgtactatctagctagctagggttcttgatttcttcgccaccagaatcgcgcgctgtgtcgtcgtcgtcgcatcgactgttcttttatatcttccgtttcgttgtttttttaagttaattgtactttgatccatattttatattattaaaatttcactttggataattctctagctaatactttcattttggaccagataagattatcgttgttgcacttttggatcatctcaaatcacttctccagcgacatctacatactctacacgtaagtt

SEQ ID NO: 66517 - DNA, 9195 bp, Oryza sativa
ccacccacctcgtcctccccaccaccaacctcgacctcctctgcgtcaccgaggtctacacctgcagggccaccctcctcaacccgatcaccggcgccgccgtccacctgccggagccgctgtcgacgccgcactccctccggggaagatctctgagcgacttcgacggctccttcaagtacggcagggacagcaatggcgattacaaggtgctccgcgtcctcacggattgccacaacaagcaattccccgaacagctgttcgagatcttgagtctggacgagagcagcagataccatatgcggtggagggccaagaaggcgctgccgatgtgcgtccggagggacgccatcggcggcgtcgtcatcaatggcgtcgtctacttcttgctggatggccgtcccaatggcgtcaagaacgcgcatcgcgaatcctacgagatggatcacatggccctgttcgatctctgctccgagaggtggatatcatacctggagggaccaatggcgacccatccggagatgaacaacatcgatgagatcctccctgagccccttgagatgtcggtgtaccagaatctgtcattgtccgagctgagtggtgcattggttgtagctcagtacacggattatcgaagcgcggagatcaaatcctacgtagacctctggtatctgatggactcggagaagcagatttgggagaagaagtataggattgttttggagatggatacctgggacactgaacacattttccctcatgcacatccctcactgattctagatgatggcaggatactcatctacataactgtgcacttagccaacttcgaagggcaatacacgaggcgggtgatgcggttatatgatccggagacggacactttgggttcagacttggtggatgttaagaatattcactcaattggtttcttttcaggaagcttgttgagcatacagaatggccaggggttgtgaacttgtagtagatgtgttactgtgtccttggtcagttcaacacatccactggttcttaagagtagtgtggcctgaacttctttaccagattatatcattgttcggagttcagacattttgagctaggagctgcatttgtgttactgtctgagcttcttactccaattatcttcttgccaatcttgagaggcaagatgttttccattctaggagtctgaaccctggctggcttgctgtgttttcctagtttcagttataaactttgtactcggattgtcctgctctaattaaaatgtatgaagctggtgaatatggtttttagtccatgctggggagtggagtaacttgaattccagtgggtaatttttgtttggctttcagctttttctcctcttagatcgcaacatgcaatgatcttgtgtgataggcttccctgatattatttcttgtatgattatgtaagttattaccaagacttaaggtacttttgtttgatagtcatctatgtgcatgctgttcttggatggtattttcttatgtttgacccggaccattagcccctgttctcttgagattgggtacagggataactgcgagaaaagggtatgggtgtgtcttcaaatttctctgatcacctcatgttcaaaaactatctttttcgagtctttccttagtctgtagctattagtaatttgggatgattgattagttgattcggaggaagttttttaatcgtgttcaaagaataacataggtgtgaaacaaaatgagcaagttctgtggttgcttataattgacaattatctcaatgcaatctttgatatttttccctctgataattatcaaagcttcattgtttttccaattctgtggctgtatagtgatatacctttacgaggttttgaatgatgttaatagaaactgttgtatctttgtctttttgttgctgggaaatggaaatacaaatgaagaggctatttgttctgaagtatctaaatccattcatagtcttcaaagttctctgattgtttctcatgaatctctgagcaatatgctagaccctgtagttcttgcatttttctagcttgggttttgttacatctttcaatacgagatttgaggggttttttttacatgacaaaatccgtcccccgaagcattttgtcatgtaaaaaaaaacttgcatgaatcatctaggaagttgttagtttcccttttaatcgtgttatctgctaatgcatctaacctacttgttacatagcaaaacttgcatcattcaacatggcggctctcttatatttcatttcatatttaaaaccgtactccctgtgttccacattataagactttttttctttatatctattgtctagattcactaacatacatgtaaatttggacacatatgaagcacatacatgcatccaagtattaaacatggtttggattttcgaaataccacactcagatcttcagatcttcccaagactaaccaaacgtttagtcttgtgatgcgccagcttaatctttatcttcatgagtttcaaagactaccatataggtaggaggagcatcacaggctaacagatggctggatgggtcagcagcacagaaagcataccagcataaaacctctgaagaacattcaagatttaaccggggcccaactttttgggatgtcgtagtgccaggtattagttgaaatacttgatgcgattccctgtgtgacttgttggccacttgtgtttatcaatcatctgcttctgctccatgtaaacgcctctcggctggtgtgaggtgatcgtagtcgccttcgcgcttgcaacttgcaagctgttcccttcctctcccatcttgtcagtttcagtcaataattcatcgttaggattacctgatacgacttcagagcttccacctgaagaacatttagtcaagttaggcgcaaatttactacattaagtggaattaaagcagtacatatattggtgattttttttaataatgaaatataacatcccggcttttactcaaaagagctataacccattattaattacaatctagcactcaaaacaattgtactctaaaaataatagcaaccatcgcataaagataaaaataaccaataaaagatatggagaatgatgtctatttgtgaatctccatccataattggtaaaaaaatgcataaccatcgactcaagctttttgcatgcaactttaaaaactctccgtcttcatcaaacctttgtaactgtgtccaaaaccggagccaatatgttcccctaaaattacctacatatatgaacatatgattatttatcaaaaactacgtcattcctacacaaccatagagcccaacatatcgtagaagctcccagcaatataagtttacttttcttcctgtcctctcctaacaaccacccataaaaaatatgagaaatgctagtaggaatgtataagccaaaataaaactgaactgctctccatatgaattttgcgtaatggcaatcgataaaaagatggttaattgtctcatttttcatacagaaacgacatcttgagctaccatttcagtttcgtcttgctaaattatctttcgttaacaccacccctttaatcttaagcttccaaattatcttattcctcccaatatagcagttattaatcaaagctagatacattgaccttacagagaaccgaccattctgattataattccatgagaaacaatccgaagattgattcaactggatatgtacaatagaaacacacaaatcatgccaaaatataagattctgaccaactaaagctctcctgaaaatacattaagtagaacagaactcatgacggtagcaattaaagaattcttccttctgacaatagcatataaagaaggatacttatctttaaaggccatattacctaaccatttatcttcccaaaatcttgtttgttcctcattattcactatccaagaatccatattcaagaaagtattcttaactttcataagacctaaccagaaatgagagtcaccctgtctcctatcaatctgggttatatacttattataaagatattttctcttcaataaattctgccaaaccccttgctcatttattaacttaaataaccattcactcaaaagacatttgttctatatttccagattatgaaccctcaagccactctgatctttgggttggtaaataatatcctatctagcaagcatgtactttttcttattatcatccccttgccaaaagaaatgtgatctataataattaattttttaaagaacccttttcggaatctcaaaaaaggatatcataaacatagctaaactcgaaagtacagaattaatcaaaaccaatctcctccaacagacatatgttttgctttccaactactaaacttcttctcaattctttgttcaataagtttccaatcattgttactaagttttctaaaatgcattggaataccgagatatttaacaggtaaggaacctaatttacaacaaaaaatattagaatattgatcataataatcccctgcatgaccaaaataaaataattcacttttgtgaaaattaattttcaggccagacagtttttcaaaaacagataaagttagtttcagattcttagcttgttgtaaatcatgctcaaaaaaacaatgatatcatccacatattgcaatattgataaaccatcatctactaaatgagggataacccctttaagataccaacatctttagccctcttagttagtaaagtaagcatatcagtcactatgtcttaattagtaaagtaaacatatcagtcacccttaggctgtgttcggatagtagggatgggaacccaatctccccgcacggaaaacggagcggtccattagcgcgtgattaattaagaatcggctaatttctttttaaaaaatggattaatttgaattttttaagcaacttttgtatagaaactttttacaaaaaatacaccgtttagcagtttgaaaagcgtgcgcgcggaaaacgagggagaggggttgggaacttggagttccaaacacagccttaaggttgtgttccataggatggattgggaacccatcccctccgtacggaaaactgagcagtttattaatgcgtgattaattaagtattagttattttttaaaaaaatagattaatttgacttttttaagcaacttttgtaaagaaactttttgtaaaaaacgtaccgtttggtagtttgaaaaacgtgcgagcggaaaatgacagagcctaagtttttgaatgttacatatattggtgatgcagttcacttgaacgaacagaaaagggtgtaatataagcttacattaatttactacattaagtggaatttgcttaggcttaatctcaaacagatctatcgtcttcctgccttctggtcctacctgcttcgttccctacttccgtagtgccattattagcaaacagaaagagtcaaacagagagcatctttcttttttttcctaaaaaaatgaacaataaaaaagaaagaaacagagttgagtattgaaacttaatttgttggtttattttaagtttttcattgtaattcattttcagcctttgctttaaattactaacaacacatatatgagtataaaagtttataaacaatattttttttgttattaataagttgttacggcatagcgcaataccaatgtttattgccgaacatcctatgccagttggtcagttgttaaagttctacgtggataatagatgtgggcacatttacaaataaaaaagactccaaattaaatcaatattttactaggtggggagtgaatggaacatagggagaggagagattcttagattttttttattcacttatggtcgatcctaatcttatggttgtttttctttttcaatgtcataatagttatggttcaccttaatgttattttttacaacgttatcgttgtttttataatcagtataagtaacacccaaagtagtctagcaacctatacaccatctaatagctagtcatggaggttacccaacccctagcgcctaatagcggagtacaattccggtcaaaaaaaaaatagcggagtacaattgcaggctaccaattagctataagcatatgtagagaagaaaagagaagagagagaaaaaaagcggacttgtagttagctgtaacacaacacagactctaaaatattgtgtgcgtatgaaaggtgtgaccatatgttaatggtgtaatatatatttatagttaactattgtatgaatggactattaaattggttatatataattagagctagtagttggctatactactcccttcatcccataatataagggattttggtgggatgagacacatcttagtactatgaatttggacagagaggtgtctagattcataatactagaatgtgtcacattacggtaaaattcattatatcgccccataatataagtaattttgatggtatatcacacattatagaatcacgcatgttgatagagaggtgtttatattcatatgactggtgtcacatcgcactataatctcttatattatggaacagagggagtattaaacgtgctaacttaggcagctcctaacacttttgaatagagatagtagtttatatatttgtatattgtagcacaggttgtattttagcacacagtttgtagaactgatcagcatttcttttatgttagcatgaattcgtactataataacaatagagttatatgcatctacaagtccctgttcgagattttgctcgagctctcgccatcacctatactggtttttaatagtcataatgattgcggtagcaattgaattagacgagccatagttgactacttgccatttagaagtcagcgatcaaaagggtcaatacttgtcaagttctcttgttgggtgggaaagctggtgaacacaaattctagcggagaattattgtctgtgatgagatacatattgcacgccactaatacgtcctaatccacaatttattctgacaaaaaaagaggggcattcttcctcgtgtgaatccccctttatgaataaaattagaattcaaatattttaattcattttacccaagattcaagcctgcgacatttggctctaaaagttattgcatatgcaaatgcaatgcaccagccaattttcgccgctgaaaaaccgattagttcagtgtccttcaacacattttctcagcaacagttatgttaatcaccggtacaccaatgaattagcattctctttgttcacagtttcagagattttggcacaagatcagcatccatctcgtacacacagactttgcacaggtagtagcaacataattaagtgcgccaattagagcgtattcttcttgaattggctgtcaactgaacatttaacacccccagttgaatcgaatcacatggcgtcttgtcacatcttgcaacagttgtactccagtacgagtgaaaactgtagaggaggaggttgtacacagctgaagtatagtagaagtgcagggaactacgtgagacctgatatgcacttgcacgtgagccagggagaaaaacaagattttgcacgatgcacttttcataatcccattgacttgtaatgttcctgagaaaaaaatcactggttaagataggcgctttataaatctattaattcaagaatggatttcgagggctattttggtttgaaccccaatttctaccaatgaaatgcagtaccaaatcttacaatatggtagtgccaagatttttgcactaccaaatttgttgtagtagaatttgtattaataaaaggttaatttgcactatcaaataccccatattaattttaacctactaattaaaataaaatattgatagtgctaaaatcttggcactaccaaatttgttatagtagaatttgtattagtgtgagcaaaatttagcatccaatcaaacatccatacaatactgttgaagacaatcttctttgccttctcttaaaaaaaatactattgaagttgccaaaaaaatagtaggataaaaaatggctttcatcaaaacatgtctaaggctgaattgagttctaaggtggtgtttgggtgggctaatccctcgtttaccgtgagtatgctttctaaatcgctaaatagtgtgttcgtgcaaaaactttccatatagaggttactttaaaaaatgacagaatttatttttcaagtttataatagttaatatataatgaatcattgttcatctcgtttttcgtggcactaaatagttaagcctacaactatttcaaacccacaaaataaatctaacaatttggcagttaaccttacaaaatttaataatatataaattattattggttaaagtctgaacaatagaattgacaccacatggagaaaggattccatctggttggatgtaaatacttgatgtttctaggataagattcagccaaacttgaccaacagttttatattagaacatattcatactatctaataaggcagcgttcgagagggtgagagagtgagtttgtttgtttcgttttccgtgcgcacgtttccaaactactaaacggtgcgttttttgtaaaaatttctataggaaagttgctttaaaaaatcatattaatttatttttgaaatttaaaatagttaatactcaattaatgatgagctaatagctcacctcgttttgcgtatcttcccaatctcctcaatccccttctcctcaaacacaccctaagtgtaccaaacttcttcttagctgtgttcgctcatccaagttcccaacaggaacagtacgcgtggaaaacggagtggtccattagcacgtgattacttaagtactagctatttttttaaaaaaaggattaatttatttttttaagcaactttcgtatagaaactttttgcaaaaaacgcaccgtttagcattttgaaaagtatgcgcgtggaaaacgggggagaggggttgggaaaaggggtgctgaacacccccttcttctggtttcaaataactgccaccattgatcaatataattttatctttgaccatcaaatacttttaaaatgattagaccatgacttacaaaagaattaatgaatatatgtaggatgtaaaacacttcgttaaaaatataatacttttaagtacttatattttttctaaa

SEQ ID NO: 66518 - DNA, 3272 bp, Oryza sativa
gagtttacctatggtcaaaccacctccaaattggaccacaccgtcccccaccacagaggatccacgtcaccccctgaaacaacagtcagactgacaccacctggcccatctcgatccacgtgtccccccgcctctctctccgcgccctccatggaccgggtgtacgaggactacccactgacacgtgggccccacttccgcatcttctccggaatcctcatgcaccgagtctacggacgagtccggaaatcccccgctaattacattcctaattacattcccttcacgcgctctgcgccaccgcagtagtaaacaaattgtgttttttctttttttttttcaaaaagtaatctcaaccttttggccaaaggaatgtgatttagattatgttaattaacggattagggtgttaattaattactcgaggcgctcctcttcttcctcttcttcccccatatcgccattggccctcgcctcctcctcctcctcctgcgaagccagtgcacggcccacttccgccgcgcccgcgcccgcgcgctgcgtcggggtaggcctagggtgggaggcggcgcaatgcggaggccttcgtcggcgtcggcgtcggcggcggcgggggcgtcgtgccgccggcgcgcgatcgaggtgctcgccgcggtgctcgtcctgtacgcggtgctcgtgttcgtcctcgagtcgccgctcgtgtcgacgtctctgtcgggtggtgggggaggtggagggggaggtggtggtggcgcgaggtatctgcggctggcgggggcggggtgcgggcggccccggcgcgcccggcgaaggagccccgcctggcggcgtccgcgtcggtctcggggccctccgcacgagggcggcgcctctcggggatggtctctggtctcgacctcggcctcctcaactcgtcccgcgccggcccgctccgccgcccgattgccggcgccgtcgagacgggcgcccgcgtgttcgcggaactcgaggacctcgacaccgccgccttcgagtcgccgtccgccgagggggaggcggaggcggccaagtgcccgcagtcggtcatgcgctccgccgacgagttccatgggaggggccgcgtggtggagctcccgtgcgggctgacgctggggtcccacatcaccgtggtcgcgacgccacggccggcgcacgccgagggtgaccctaagatcgccgtgctgaaggagggggagcagccgatcatggtgtcgcagttcatgatggagcttcaggggctaaagaccgtcgacggcgaggacccgccgcgcatcctccacttcaacccacgcctccgcggcgactggagcggcaagccggtgattgagcagaacacctgctaccgaatgcagtggggcaccccgctccgctgtgagggctggaagtccaactctgatgaggagaccggttggggacccctgcaattccattttgattatgttagttcaggtgaattctgtggaaatttgttgatcgagtgaataattttttgtgcagtggatgggttcgtgaagtgtgagaactggattctgaacgcggatgaacggtccaaggaatcgacgacaacctggctgaaccggctgatcggacagaagaaggagatgaattttgattggccttatccttttgtggagggccgattgtttgttcttactatcagcgctgggttggaggggtaccatgtgaacgtcgacgggcgacatgtgacttcttttccataccgtcctgtaagtacatttgttcctccatttatcttgtgtccaagatcgaaattgtggtgaatgacttgcataatgaatgatagaacactatgatttacggtagttcaaacatcagtgctgggcaacagttgccttaagtttatttttgttttgctttggctcctgcagggatttgttcttgaggatgctacaggtttagcattgagtggggaccttgatgtgcaatcagtgtttgcggggtctttacccacaacacacccaagcttttcaccacagagttacctggatatgtcaactgtttggcagtcgtctcctctgcctaacgaacctgttgacattttcattggcatcctgtcatctggcaatcattttgctgagcgtatgggtgtgaggaagacatggatgtctgctgtcagaaactcaccaaatgtggtagctcgtttctttgttgcactggtaattcttgagaattaacttgatagatttccttgcttcatgtcttccgtaaacctgagctgatgaactttctttattccagcatggcagaaaggaagtgaatgtggagttgaaaaaggaagcagaattttttggggacatcgtttttgtgccgttcctggacaactatgatttagttgttttgaagactcttgcaatatgtgaatatggggtatgccaacaattttcttgctcaaactgattcttatttaatgatctataaactgtagctgttattttcgtattttctgactggttgacttgtctgctcaggttcatgttgtctctgctaggtatgtaatgaagtgcgatgatgatacttttgtcagacttgattcaataataactgaagtcaacaaggtacaaagtggcagaagcttctacatagggaatatcaacatccatcacaggccgctacgccatgggaaatgggctgtaacttatgaggtaaagcatatgtattttgtttgatggtggttgttagataatattgcgtatgcaccttttgtcatcgtttcttctatttgcttgaagtgagcaagctaattactttagtcatgagtgatagactccattagaagaacttggttatggatatgtactactaatgttactctcgaagtccaaacattgttcacagtaaaaaagctgaaaatatgtgttttatggatgcttattatagttgcaattgatatatgcaactttttttctctgtttttgctgtgtgctgtctcagaacttcctgttatgtttaaagttttgaagactgaaaccatgcctttgtagatatcaaaatctgattaataacttgattcattctttgcataagttttttttcactgttttatacaaaccagtgtgaagaacaattacttcctgcaagtgatgaaaggtcctttcaaggtgtacataatcgaagatctgagatatcaatctttgttgattattattaacatccttagttatctgtgttgtccagtagaattgttttgcaatcagttaggcatttaggctgtcttgtttgagttttttttt

SEQ ID NO: 66519 - DNA, 1965 bp, Oryza sativa
  unsure (1)..(1965): unsure at all n locations
caacatcgcaggagtggccggaggaggtctatccaccctatgcaaatggtcctggatatgttatatcttctgatattgctggtgccatcgtgtcggaattcagagaccaaaaactgagggtactatcttatagttttctgtaataaaatttccgtcactctgcgcattaactgtcctccttttattagtacatcagtaggggcctgccctcctgttttcccctaaaaaggagaataccttaactatcactttgaacagttggtttagaaacataaaaaaatatataggatgaaagagacaatagattaacttcaccaaacgaactatatatgattcttacatgacaatttagtaatgaaaaataagaaccttcccttatttggtatcttgttttcgcactggtttaaactggtagattgattactacataagtctggcagaaatttcctaatcataatccacgttgaagaagaaacttatttaatttataattgctttctgtgcagctcttcaaaatggaagatgtgagcatgggtttgtgggttgagcagttcaacagaacaaggcctgttgaatttgttcacagtaccaagttttgtcagtttggatgcgtagatgattattatactgcacattatcaatcaccaaggctgatgttatgtctgtggcagaagttgctagatggaaaaccacaatgttgcaatatgagatgacaatagtttaactggtagcaattgaatcataccgtactggcaatcttcatttaatcaacaaaagggatggatttgctgatgtccttcagtagccatttatcactaactatatctttgatggtaaattaagactgcttgagactgacatgtagaaattgatttcctagattacttgagagtagccagcttagtttcaacatttgataagccagtgcactattactctcttttcttaaaaaaaatgggtacaagtttttaggtactgtagaaatgaatgagcatcattcctgaacatgaagaagtggcaattcagttaagttacttctacttctaatacgactcactacaacgtggcggttgttcacagcttatctggtgtggtgagagcttgaagtataggttgattttgtcctgcaacctgtcatgtaatttagtcgctacctgaatgaactagtctttttctccttgactaatcaaatatgtactcttaactcttctattttttatgtctacaacaaagtatggtctgggaaatttcatgtgatgcgacatctttaaaactgcaagctttcgctgttgctttagttcttacatgaaagtcgtaccttcacaaatcgaaggtgcttatgtaatggtttgctgtttctgatgcctttaataaatatacttttttccactatatccttcatgcgtgcaaatcattcatcatagttttgtctagtaaaagaaaaccttgtatttcggttgttcatgtattctagttgtctgctcgatgaatgtgctgttatcatcataacgatttccctattgatttatgtgcaaaatgcttgctactgaacacttgcgatgaaggaaatgttgtatttttttccccttcccaaacagcaaggctcctattgtgaatttgtgattgctgaataattgaaaatgccactaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66520 - DNA, 30150 bp, Oryza sativa
gttgttacggtacagcggtcggtaccggtaccgccaggtaccaaaatcctagccgttggatctggcccgatccaacggctggtagagtttggtaccgggcggtaccaattctgtctctgtgcagtaccacgcggagaactgagatggaagggcaaaaacgtaacttcgcgtgcaataaccggatcgggagggatggacgggcagctcgaaccctagaagggctgggattctcgatcgatcgacgccgctgccgcctcctggatcgacgccgccgcctccgggaaggacgacatcgacgccgccgctgggaacgacgagttcgctgctgccgtcgcctgcttcaacatcgccaccgctaccgccacggggaaggacgacatcgacgccgctgccgccggaaaggacgacatcgacgcctccgccaccaggaacgacgagttcgctaccgccgcggcttgcttcaacgccgctgccgctgggaaggacgagttcgatgccgccgcagcggcctgcttcaacgcatgccagaatccgccgctcgccgccacttgattgcttcaaggcatggccagcgccactctcttccgatcctacccatgccggaacgaacggcagatgcgtactggtaccgagcggtacaatttgctggaccataaaaaatctctttttttttaaaatggtgatttagtacacattttgagcataaactagcaatatccagtgcatattgtgtagtactacagagattgttcctttgcaaggaataaataatgaaaattagatttggccacggaccagcactctttgtcattgggttcacgctgtctgatttgcaaaaaccttgttaattatttttacaagcagaacgagtagtagatttctgaatcgtcatacaagaatggcacctctaatggatgtgttagatgcaagatacaatactttgctctagaatagttttttttcttatgataagagttaagactatcatgtatctggagtttattgcactatgattgcagtaattttgatgattttgttcatctttgtaactttcttgttcactcatttcaccttgtaggtcacctgaggttgatgggggataacagattcctgatgaattggatgctcttggccgtgacattttggattcttaagaagaaatcatatttgaaaaaaaagttgatggcatttctgccagggggataatgatgagctctttttttttgcatgtctctgttgaaaaaaaagtttttaaataatttaaatggtcaaacatgtttaaaaaagtcaacggcgtcaaatatttagggatagagtgagtacgagggaagcttcgaattcatctattgaaaactgaggcttacgtactgattgaatggtcgttcacattagtcggtatgacagacagtagtcgtgttcaacggaaaatcactctcatgacgattggaatgagttgttgagacccttttcttgtatgacatggatttatgtgggccgctttttgtaacgcaatcgctctatgaacattttgttcttggctcaggcttcctttctatagcagattccctgaactctttttaagaaatggcaggaggttctgcttaatcaaattagcaggcaaagatgtttttgtacatgccattcttaccaggagcttgactctcttcaagctctgtctaatgctgtactgggtgataattgttatttaaaaaatccttctatttcgcctcttgcaggtggatacatttactgaccatcgaaatgttaaggtctgttttgattcagttttctgatgcatcagaagtggacaactggtaagatattaagatgtgattaattgctcatacgaacagaaagttctatatactgaaagaaagttcctgcaaaaaatccgtgcttgtaagttcactataaatgaaagaaaccaagtcggttaatttcttctgtcagaggaatccatctacgaaaacgaaacttacgttgacgagcattaatttcatcctactatttgcataaagtcgttgcatcaggtaaaactcgagacaggagcacacgatccctcaaactcgagctaacggcatatgcttaactccagaattgttgatatgattacagaacatatcgcaataacgcgatcgatcagagattcagagacatgacgaagacacagcaaatatcagctacaccattttttttgttacattttcgagggacatcagctacaccttgatgacaccaaaccgaaacatcatcagagcagtagagatcctaagtgcccagctttgtggtagcacctcgtacaatgccctgccaacctacaagacagaagcagaaaccaaaataaatatatgtcaagctgaactcatatggtcaagataaatagtgccaaccagggccacaggcatgtgacatgtcccagaccaagaaagccccatgcccgtgtttccaggatcaagaactcccaccacaacattaaaacatttccattcattacttaagttctatagtttattctcaagttaaaacctttcagatgtatgacatcacaagataaaacagtggtctttttagttccctaataatgacataaagcataattggcattccaagtgtttatcatactgccaactgaactttttttccctaatagctatctgggagactaacctttttctcccctagtatcatgcagttgagaaaacaatcgacaaatttaagctagagactcaattatcagcatggactcatgctactaatctccatttatgcaattcggtgaagcgatttgcaactttcaatatttcttggccactaaaaacgagattaaatgatagaacaatccatttttatataaacagagtatatgaaaattttgatataacttatgttttttctattttcatatgcaaaattattttccgttttaaaaatattgtgataaagactcaaaagaccttccaattattttttttatcaacacattgataaaatatatgtttgtttaaattaataacaaaccctccttaggcgacaactttagcaagaattgccacttgccagcagtacataactacaatacatctcaatgagcagatgattaagtgtttcattaatcattggattcttctcatttctgctataattatcatttatcaaagtatataggcccatttgctaattgcagttggagaaacatcttattttcttgacctatggaagtttttaacatcataaagaatgatggatatttcaatggaactggtcatttttcttgaaataaatgacaaaataaagatgctgaaactaaacatgataaaaacacacaaatataaccaaattacggcatgaatatcaataatgtgatgatgtgaaaccaaactttaccttgtcacacactctgtggacataataaacttccagtgaacacacttgctccagtgtagatactaatctgaattatatccgaggaagtgtcagttactggatcataaatctgcacaaccccttttgatcccatctgcatcgagagtactatctttccctcatccgtcacaagcaaaggttgcactttcagataatctccaatcccatgaaaaacagcatcaacattaatcctatgatctttggaccatgtacccttttcagaatcagttagaaaccatagatccacggtataaaattgatcattccagtgcgatgtacacaaagtgcctttaagtccagataacataagctgattggcaaggtcatgatagctgagcgtgccattggattcctcgagaattctgttcaacggcccttggagggccacactccacttctccgtcgcaaagtcaaaggaaggcatgcagcccctctcgaggaaggagggatcagagaaacagtaatccaagatgaagtaagcagcgcctttgaacacaactccattggtgcagttccaaccaaggtagcctggcgggttcgccgtctccctccactctccatccgtgtcgccgatggtgataacctcggataggtgacgagagttatcaatattcagtaaaatccggactaatttgcactcccccgtggaagctgtctgaccaaatgcaaaccaggccgcaatcgttgaggggtctgcgccgccgcagcgatggctaggtaaaattgaaatggatccagtggtagggttgagcacgcggacgctgtggtcctcgccggcgacgaggacacggtcggcggagctcccgctcaccaccctgcctttccccacgcggaggatctgcttgacaaggttgccggagaggtcgacgaggtcgacgcagagcctggggaagccctgcacgccgacggcgaggagcggggcagggtggcgggcggcgtgcgcggcgacgaagtgcgggtcggtggtgaaggcgagccacgagcggcagacggcgcggaggcggcagatcggcccggcagggaggcgcagcaggacgtcgagcagcagctccggcggcaggacgccgtccacggctccgagcccccaccccgccgccgccgccgccgactccatcgccggaggtaggagacctcaaatcaaaaaaaaacggatgagatttcaacccatcttctctgctcaggggatttacctgaagcggagctagcgcggtggccggtggtgcggccggagtccggcacgtcggcggcggcggctctcgccggagactcggatgagtcggggactcgggatgtgtctctgcttttgctgggtcttatctcattctgaaaaataaccgtgggacccttaaaaaaataaaaaataaccgtagggcccttaaaaaaagaaaaaaaataactgtgggacccctaaaagaataaaataaccatgggacccttaaaaaaggagaaataaccgtgggacccctgaaaaagagaggaaaacgtgggctggggccggatgtagtcacaagaccacagtcgcaattgcgtcggtttgatatatacactctgaattttcttggtttaacgaaagcctcagtttgaacgatcaagttgagaatttggtacgaaacaaaggcagcagctgcaaaccaaatttttgcagttgcaaaatgttaagactctgctgaaaaatacaaaagaaaaagggagaaaacatttcaggatttcaggaattcgcaactagaaatatccaccccattgacctttgtttgatctgaaggtgtattgcgcacaatgcaaagtgatgggttcaagaatgtcaaaacataagctggtgtaactgattatgatctgccagacagcatcttcagttagcaatggtgaaagaaaaaaggaacaaaattctgaacagatacagtggttcaaattgtctggtgattcagaggcctactgcatgttacctctgcagataaatatggtccaagagaccaagatctttgtgtggctggaagtcgatctcaacactagcaaccagaaatagccaatatctcccaggacagtttgtgctacatttttctatgactgaataatcttgtgctactcaaacatgcttaaaaaaaatgaattcagactagcactataccattgcagatttgcaggtgcgtatatatagttgatgatactacgtaagtattacatctagctagaatcaaaatgtaatgcatttgctgcacagtgccactccatgcaagttcagaggaatttgttttttagaaggatagttcagaggaattaggcaatccaggagatctgaatccggatgagttaacagttaactcatgtacatacaaaagggaatactactggatgatgcatcggttcaacgagcagacattaatagggggattttcttaacttggtgctaaccaggtgaaaaccacattcttgatcttaaaaggggtaaccacttattattcccaaactgtttcaattcattaagcataatgtccttttttattgtcttctcaactaaatgtttcccatgtttcagtccttcaagttcagaatgggtaaaattcttcagttctttcaagaaaagatttcttcagaattcaggggatggcattaggctgcgaatccagagcattttgcagtgtcaacgtcagcaatagcgcaacactaaaaatctcagttcgaaattcgaagctattccaaataacttccaaactgaataaaattgcatcaaactttcaaacagaaaaggggaaatttccacacggctgagccctagcctgatctccccgcgcgcgcccgcgaagccgccgcctttaaatagcctcctatccgttgctcacatccccatcccctcctcgattcgaatcgcctctcctctcttcccaaccaaaccctcctcccaaaccctagaaattcctctcctctcctgcggatcgatccatggcggcggcggctggagatgggctcccgccggggctcaggttcgagcccaaggacgacgagctcgtcgcccgcttcctcctcgcgcgcatccagggtaagcccctccctctccacggcgtcatcctcgacgccgatcccctctgcgcgccgccatggaggcttcttgcggatcatggcaggggcgatgacgcgttcttcttcgccgaggcgcgggccaagaacggcaaggggagccggcagaagcgcacggtcgagggcggagggtactggcaggggcagaggatgtgcgtcgatggcgagaggctggtcgtccccgatggtggcggcggcggcggcgtggagatcgcgtggcgcaagtacgtcctcagctacttcgcggatggcgagaaggggagctcggggtgggtgatgcacgagtacgccatcacgtcgccggctgacctcgcctcgtcggcgatgcggctgtaccgcatccggttcagtggccacggcaagaagcgcaagagggaaccggattctcagagcgcccacgacgaacacggtcgagcgcgctgcgccccacagatcgccatgcccgagactgctctgctcgaggacagcgcgccgccgccacagcccgtccatcctcctgctgcggtggtggactgtgtctgtgacgtcaccgatcagggctcttccctggtgtttcctgatcaacccgggtcaatctatgaggatgagttgcagagctttgtgcctgagttcgccgcgcgcaatctgttcgtctctttgccagaaggaagccgtgacgtcgtggcagaggctgctctgatcgaggacttggcgctctcgccacagcctgttcctcctcctgcagaggtggtgaaccaagctgatgactccgatggcgctgatcagggctgctcgagtgtgtttgctgctcttcccgacctgatagtcttgccaccggaggaagcctgtggcagtggtggtgcagcaccggcgccgtcttgggcatcatcgctggacaaccaaaacgacgacgcaccagctttctttgagtttccagagagcatggatgacatggttggctgcttcgacttcgcctccatggacaaccagagctgcactagcgccgtgtcagagattgctgtgctcgaggagccctttcttcctccacctacaatggtgaaccatgacaataactctgtctctgacggcgccgatcagagctgcttcggcgtgggggacaactctaccctggtgttttctgatctaaccgggtcaatcgatgaggatgagcttcagagttttgtgcctgagttcgtctctctgccacaaggaagctgtgaagctgatgctgaagctgacagcggtggtggcgtagcaccggcgcagtttgctgaatttggaggtccagagagcatggatgacccgttgaactttccagcagaagccagtggcggcggcgaccgtgcagcaccggcatcatcttgggtgtcatcgcaggacaaccaaaatgatgaggcgccaatgttcttcgagcttccagagagcctggatgacatggttggctgctttgactttgccgccatggatggccagagctgcactagcgccgtgtcagagactgctctgatcgaggagctcgttcttcctcctgcagcaatggtgaaccatcacgatgactctgtctctgacatcgccgatcatggctgctccggcgccgttcctcctcctaattcagaagtggtggacctccccaatgactctgtcggcgccgatcagagctgctccggcatggtggacgattctctttccgggtactatgaggctgagctgaaggacgccagcggtggtgcagggtccatgatgtcgtcgccggacaagcagaaggagcactcctcatcgggtgtcatggacgtggaggccactggttttggagttccagacagcatggatggcctgagctgcatcgactttgccgagacgatggacgacctgagctgcatcgacttcaccattgatgatgagttgtttgatctatggagctagagatggattagcagtgacattgtcctttgtagaaagagattcttgtgtagataaagaagcatagatgtgtaggagcttaatcctctgatggctagtatagtggtatttatttagctaagcagatatcattagctgttgataggttgagttaaatgtgcttaagtagtactaattgtactccttattcatggcaataaaatatttacttgattcatttgtttatgccaaaagtgtactttgcatgaattggattcagttcagactctcaagtctgaatttcagaaaagttcagagttgagttggctgtttctgtttcatggtctgtacatgtcaagtaattgtcacaatgtccttgactccttgtagcacaacattgtcctgtttgaattgaatacaagcaagtctagcatggataaaacctttcagaagttcacggattggcaataggctgcaaagagtatttttcagtgtcaacatcagcaatatgtataccttgagaaacactaaaatattctgcccaaactttgaaactagggacagtctagatttcaggcaactgaaatctttgaaaaaatcagttaccttttatatccaaactaaacatcaagacattatgtctcatcaaaccttccaagaaaagacacttcccctggtgaaaagaacaaaattctggacagatacaataggatggcacagaaggaattatcaaggaaaaaagattcagaaccctacaaaacaagtcagaaacattcaggatttacagccgatatactacctctggacagaacttcaagttgggaatctcaatacagaaccggattcactgacatggaaatacacagcatctcaagtctacactgttgaagcagcctccaaaacacttcttttttttttaaagcaaaaggcaggagctatgccgtttgttatgtgttaagaagaaggagaatgattgtttttacaagtactgaggttacaggaaaacataggcacgaatagcattggtactgttacagcatcaaaaggctctagtctataaattggaaagctaactctctttggttaatatcctggattaccatggctgccacctgattttcgtttaggtgcgtattctggagcactcttctttttctttctcacaattagtgcccaagcgatcttcctttgatcttgcagttcataggagcagttcaggacagtctagccagagatggccttcaaaccgccatgaagaaagaagggatcttcatctcctttcatctcttttcagttgttgcaatccactattttgtaatcgctcttatgtactcctttattttctaatcttctaatatattcggcaaatcttttgccgctttcacttcaaaaaaaaaatggaggcagaaaaagatgctagttcttcctctatggttattgtcgcaggaaaaacaagcattcactgtacaaaaactgaacagcaagacagtgtgctaatgatgataccttcaaactcttaatttggtcatcaacaggagaatgcaaggcatttgttactgcattgttacatgacaatcagcctctcctgcagccgctcagaaagtatgaaacaacaatcttgagctcacttatctgaacttgacaaaggagtggcaatcggtttgacaaactgcataccattcggatgtagcagatcatggatatggttacttgtttaacttgtgtcagcatcagtccacttccaggtagattaatttgtttcaatgcccagaaaatatggcagctcccattaatacttgatttgaaactctgatgcaattttactgaattaatgcagtggcagattgatggctgtgaaaacacttaggagtattagcaccaacagtcatttagataaaatggattagcatcaacagtactgcggtatttaaacatcggtcagcttctgaatatctgattttttgaaacctcaatcagaagcatgttcaggggcaacctcaatcttcttcctgcagctgagactgaaaacagagtgaatcttatctcatgtatagtttaggttagatacaattgtatcagttgtaactaataaaataaagttgttatcaggtgatctaggcctgtactactcacgtccagcaatacaatagaagggaagcctgatgatctgaggtgtgcaggattgcatcaaattactcacatgaggtattgatcgtacattctattgaagcatgttctaactgctaatcctttttgaggagtacacagtgacaagagatagtcatcatatatcatgtagtgagaaaacaggaccacaatccaatactttattattgagcaaaatatatggtattatttttatcttttcttaagctagatttatctaaccataattaattagcccgtgttagtagaagtttatatcgtcatgtatcaatatatcataagattgttagtaatagctaagtacactgatcaaccatactatgcagagacgataaaattgtagtgggcttagcatatcatgagactatcggttaatggacaactcatctttaattatgctagagaaaaaaaaaagtaaattacagtttaaactatgtattcttaaatgttttcatattatatcatcatttaaccattcttttcatttacacaacatctcactttacattttaatttggaccacctcattctatcaagtccggtgactttgcaaccattatgcatactaactctctttctctccgcctttttctttatccagcaaggaggaacccggatcaagagtctttgctctttatcaggtcgactcttgcttccccgagtccctacaaagcctaacacccccaacctcaacggcgaccatgacaatagcatgcatggcgatgggggaggagaaaagatatgtcggtgactagagggtgcggttgcgcatgcaaagacagagaggaggaactatggtggctcaacgagaaagagcagcggtggcggtgtgtagagcggcagttagtggttggtggtctgagtagtttgttgtcaacacaatcctcaaatgagtttgttgcatttttttctctcagtgctgctgttatgtgggccaccggtcatcataaagaaatagctagttttatagtagtaaaagaaatggagatcttcagtggcgatgaaaaaggttcagaaacggacggaaaccacttttgtcgtttttgtttccctatttttttcgaaatcggaattgaaaaccacggatacaaaagcataatcaaatattatcgaatacgagtaagagcgaatagggtaatggatatttatcagaaaataaaactcgaacttctcaaatcaatgaagagctgtagtttaatatcttttctaaagcaataaatcgatatttctaaatttttatcaattaataattatacaactagttgtacactttattttgttggaagaaaagaactatattcatctgtcactacaattataagtactatcttgtatcttgtagttacaagtactagcacatagtataaatctaaataattgaagtagaaaagtttgaaaatcagttgtatatgagaaatactttgtttctgattcggagaaagaaaaatctggattcgtttccgacagatattagtattatcacattagtttttgtttccgtttcggaaagtttccgaaaaaatttccaaaccgttttcatcttcccttggcgtaagagaagatctcccgtctccgtctcctccgctccttgcgcggcaagacgagtcgcggctgaattaatctccatctggcgagcatccacatcctctttcggattcttccctctctcccaccggtactaaatttgcctggaattttgcttgcgttcgtgaaccctagcttctcctgtagattgggaagaagctcctctcaatttcagagccttaaccttaatctcaatttcacagtttgttttttgttccccaaaaagtttgggggttcaactgaagaactcccgtgtccccagttggatccgcccctggcagcagcagcagcagcaatctcatgcgcacttttagtccgagagaagttgaggaccaattccacatatacagactgaaagatgagattgcagcagttgttgccacgatcgacaagatctacagccacctgcagcttgacaagggttcattggagaagaagaacggattttgctttggccttttggatcccgtaaccaacatcctcatcaacagcgccatctctgaattgtctcctgctactgcagctcaggcggtagtaggaggaggaggagagaaagctaaggacctgaacaacaatgctgctccgcgggtggaagcaggaggaggatcaagaaaacgacgacgaagaggagacaatgctgctgatctgagccagcgttcgcttgacggtctcaccgccttcctcacctgcctcttcccctacctcccggatgccgaggcacggctatacctcgacgccgcggacgctgacccaattgtggcctcgcttctcatcatcagaaggcgcggaatccgggagttcgacctcagctcccagcccaccgaggcagcggttgaggtcgccctcagatgcgccgcggtcgccgccaagcaccccgatccgcggagcctcgtgctagggtggaagctgctctcgcctgtcgtggaggcgctcttcggctctgcgccatcgtcaccacgcgagacgacgatgcacggcgacgtagcgcgtcgcgtactacgtcgcctacacaaggataatgcggcagctgatcctgtccttcggctggaaggatcgtgggaactcgccaagaggcggcttaagcgagaaagattgatgggaatttatgcagggcccaaatggctgcctcctgcccgggcacacatgaagcgagtgctgcttgcaacaatccatggattctacctgcaggcgatgggcaggctgccaacctcggagctgtgcgattcgtttcaccgcagcatgctcatgggtggccactgctacggtccactggaccctgtctccaacatcattgtcaacaccatctggtacgagcacaacttcccggcaagcaaacagtttccagtgggccatgattagcaccacgatgctgtcgtgcattgtagctcgatcgctctacggcctcgtgtccttcctgtgcactcgataccgaggcctcacacctgacctagccatgcagcgcctgctggtgaccggggttaacttgaaagctgctgatcccaacctttctcctacgcctagtgctactagtagaaaaaagcgtctggacttttcagattgtgctcaagttcttgacaatcctgacacttctcatattcagcactctgtggttgaagaaagcaccccttctgccggtgttgatgaatcatatattgccgcggccaccgccgggtttcatggctaccctcttgcgcagcaagagttccttgcgtcgccaactggtttactgagtaaacttgagcttgtctcagaggttctgcatatccaggtttgcgtcccaggatcacagtctgcctcggatggcccactctccccacagaagcttagtttgcttcgcacgatattacaacggtgtccctcctctactggcaagctgcaccaacaacaggatgtagcatgtagaaaggtaaaaaagagagactataatcacatatgtcaatgcaggaataggttctggggtcagcatgcccgagtcaccagcatggtgagagatgcattggacaaattcaacaataccatggttggtttctccccctacactcctttactcattccatagttttcactttgtgtattctgtgtatttgtgctatgccgtgtttccaatctaacactcttcatactcgtggttgaaggaggatcacccgtttgaacttcatttcatctgtggtgtcaatgagctggtatctggcccggtgcgcagcttgggtgagaaagttggagactacaatccatggactcgtgacaaatattatcacacccatatcaactttctagcagtttgcaaagcccgcttatatgatcctccaacactcttctttgctgaatgtggcaaagatggtgctgatacatgttggtgtgtccctgtgattccacagaaaccagaagctggtatgctatagccttgaccttgcaatttccatcttgatatttttctatctagtagattgagctctttcttttttttatcaacttcacaatctgcaatgtttggttgcctataattcatccaaatatcatcaaaataatactgcatgtatgctatcgtcagtgctttcttatgcttaactatagagtttagttgctacatggtgggtacttttcacattttgatccgtagcccaatgcaatgccatcatggggcatcatgcagtagccattgtcccacctgattattgtgtcttacaaagaattttcagtaatacatcatttactgttgcatggtaatattgtttgttggagatcagttatacattacactaagatcatggaatatcttgatttgaaaatatttcgtggactgctcaccatatggtctatctttttctattacgcttcaagacaacattaaatcactgttctaaatagcaaccatgatgaccttgaaagaatttatagtctttatagcagactgaaaaattgttcttttaggtgactccctaatgaaagtggtaattggactggtgcttgatgagcaattatgatggcttgggtgatgttggctctactgggaatcaaaagaaattatcacataatagtttagatagaaatctgttggtataaattgggatggaataagatagaacatagacttattgcatgttattgccccttttgttatgatgcaagtttagtttatggtgcttgaacccccccccccccccccttttgctgttatagtcacgtagcacttactccctccgtcccaaaaaaactcaacctaggaggggatgtgacccctcataggacaacaaatctggataatctcctcctaagttgagtttttttgggacggagagagtagttgcttagccttagattcaattgatcctttgacagctccaaatttgttacgattcatcctaatgaagtatgctctcatagtcatatggaacaatgtgcgcctatttcaagggtatgcatgctgccatgatttctgatcccactaatttgtgtcgaaatgtgtttttgttatgaatggcaggacaagttcgttgtatttattgtgagtatcaagggaacagaattctgcatccaaccatggagagtttccatgggcgtgatgagttcgagaagttattctatggatcaaacggttcttacaccaatgataagctcatcacaaatagcgatttagaggtagattgggtacatggcgtgcaggatggtgccatctaccgggactgctgtcctgatagtgatgatgatgaagatgactggatagatattttctgagtgctataaagtggcagttagcatcttattgtgatactttgctttgttgggttgaattgttatagtgtggttctaacaggctatcaacctcttatcgcaaatactttctccgtttcatattataagactttttagcattacccacattcatatactccctccgtttcataatgtaagactttctagcattgcctgtacatatctagatttattaacatctatatgaatgtggacaatgctagaaagtcttacattatgaaatggagggagtatatgctaatgaatctagacatatatatgtgcctagattcattaacatctatatgaatgtgggcaatgctagaaagttttataacttgaagcggaggtagtactagattgtcatatcttcggtactagtatgtaagttctggactgttttggtgttcttttctcaatgcttaacttgtaagtcggtattcccgacatactttgtcccatgtcactcatcatagatatcacttcacctccaggtagcttattgatgccctgaaaatacgttgattgactaggtgtatgcaactgagaacattaattgttgattggttgaatcgaatgtgcttaagtatcataaattgttctaggatcttatatatactgaagagtcaagacagttaaatactagagtcttgatttgtttgtttatgccaaaattattcttgaatgacttatgagttggattgagcttttgtttagcaaaacagcatgtgcgttatgagttcagaccttatttccccaagatgggattgagtttagacttgagagtacatgtgtcatgtaagttggaagccctctctcatgctctcaatctactatttctgttttacagagaatgtcagagtacactgcacggaggaaaaaaaaacctcaatctttttttttttttgaggagaaccaaaaaaaaaaagcctcaatcttaaccggtatcatatcaccattgttcagatctgcacccaaaccatctctctagagctcggatcacccctcaagttcagagttttcacgagcaccacgaaatcaaccattagttgatctgccatcatcagaataatctgcccagccaatgtccaaggacgcctgacaagagctgactgaattttctgaattgtaagctcagtgcaaagctctagccttcagatatcacataatccgtttcacagccaaccggtgcaccttgttaacggattgtgaaataacatcttgtgatcctcaagtattgcagcgcaccaacaatgctctggtatttttaacatttcagcttctgaaagactgaaaccacaatccttagctgaattctgaacttcaaataatgaagtgtatccaaagctgatatcactaattgttgattggttgaattcacggtgcttatgtttcattaatctgataaactaaattaattgttgattgattcttttatttattcccaaaagttcactccgcatgagctggattgagcgtagactctgaaatctgaagttgtgaacttcagaggagttcatacttgagttggtggttctttttcatggcccggttttagcaagctaatttatccagtagttaatcacatatagctgtgtaaatgatcaataacatcatcagtttcctccaaacaaaagacaaagggacattgagctgcatcaacagcaagtggcgatacagcagcaggctgcataagagcagtttgcagtgtcatcttgaacaataatccctccgtcccaaaataactcagcttaggagtagatgtgacctatgtccagattcgttggcataagatgggtcatatctcatcctaggttgacgccagattgaatgaaaagaagagacgagtatcagtttcggatcactattgatgtttgacaatgctcataacaaaagggaacctttgtttgacttacaactaagggaaccttattaactgctaatatcttttttagtggtaattctttctgagtggaatatcacaaatcttccataaattaattcattagacttcagttacgtttaggatattcaattcattttttcactcagggtcaggatccagatttttttcacaaagcccttttcagtctgaagtttttatggtttcagcatccagcaactgagactgaagaaatgtgttaaacaaagtgatcttatgatctcgtgtatagtttacatacaattgcatcagttaaaactagtaatcgataagattgttatcttgttaactagacctgtactaatactattatctccaacaatataaatagaaggtaaggattgcctcaaactgctgtcttgtagaacccatctttaacatatgtatttttttcttcccctcaaaaatacatatgacatagactgtacattgtacgtagattatgctaacttataatccttttctgagtggtatacattcaagtaaggtcccagctccattttagtggaaaatctcaaaaaaaaaaattcaaactgaaccattcacctccaggtaagcagagcatggcagagtgtacgagtagtcaattagtttccaactgaaactctgttttttcccctctgtttgattgtcttatttcatcatacgattctgtctagctacacaccgaagtgctacctagaactcttccctgcacacacgcacgtactcctccatctcattctcagcagcgagagagcgccggacatactttttagacaaaaactatataacaataatacgattaagatagccttcacctattacaacgcacggacatattttctaattacaaaataaaggtaagtacaccaaattaattaacaatagagtaattaaaacttatactaaataaactttttcctttttcttaaagagaaaaagaatatctctccctacgcacatctgccagttacatatcagcggcgcaggagacacatatttactattttaccatacaattctttcgcagtagcacgtaaggtttcgtctagctacacctacacaccgaagtgctacctaaaactcttccccctgcacacgcacgttactcctccatctcaacagcgtgagacggcgagagagccccggagtaaaagcccaggacgcagccgcacttctccacctgcgccacctcctcgcacgcccccgtcctcgggtcgtgcagccgcaccgccccctcgcaccccctcgcccacaccgccatcctcccgtctcccaccatcgccagcggctgcgccaccttctccctgcacaaccacctcacctcctcctccttcttcttcttcctcttcttgcttcgcccgccgcgcttcgcctccgctgccgccgccgggtggctcgtcggttcttcttcccacccgcggaggacgttcctgatcgggagcgagtggagctttgtccatgtcgtgtcgttcggcgttagggaccagaggttgatggtcctgccggggtagtcgtggtggacggcgacgaggcggccgtcgagcgcggcgaggccgaggttggggcgctgcccgcggtggcgctggtctgcggggagcgggccgtccatcagtgccggcctccactgctccgtcgcgaggtcgaacgccgcgatggtgtcgcactcgacgccgcggtcgcgcggggcggaggtggtggccggggagaggaagtggaccacgccgccgacggtcgcgctgctccggctgatcccgtgctcgatcctcatcggcgggtggctccgcgtcgccctccactggcagccgccgccgccgccgccggtggtgatggtgaggacctcgcttgactgggacccgttggcggcggcgtaaacgtggagcagcttgtgctcgccggtggcgggaaccttccccagcgtgtacccggaggagacgttcctccccgtcgccgccgagcagcccatcgagaggtcggtcaggtcgccggtggccacgtcgactacgcggagcagcccgtcgccggggctcacgacgcagatcatgtcgccgccggcgcagaccctgaggcctggcctgctcagcccgtccatccgcctgacgacctcgccggagtacgcgtccatgagggtgatgtcggtgaggtcctcggcgatgtggtacaccgcgccgacgacgaacgcgtccccgccgccgccgccgcggcgagagcactgcatatcccgccacgcgccgcaaaacctctgcaacgcgtcgttgtcaacatgggccttctcctccgtcgtgcggtttctcggcggcgccgccattgatgacgccacggcgagctggtcgagacggcttgtgaatctagttccggaggcgcactgatcacgttgtacgagttatcgagggcgacggtggcgcgcgcgcttaatatggcgcgaacgcttggttcgaatccgaatttgagcccgaacacaatttattttggatccgatttatatgctgggacgcttaattagttcgaatccgaagtccgaacacgatgtaatttggatccgatttggagtgagatcaagactgacattggcacattgtcgcgtgtaggaattgatttgagtgccttctgtagagcagagagtgaagagatgtatatgagttttgtatatttcacgccaacacgttatctcattgagttcagactttttctttttcttttatttatgaaagatcattggcttcaaacctttgcctaaaaaaaaatcggtttcttggactgtaggtttttttaagggaaagactatagggttctatatggtggaaatcagaaatattttttttttgccgggggttggggggggggacattgctgaaatttcggttagaaaaaagttgaaatttgaacaaaattttgtttagttcattttttttagggaagtttaattaaaaaaaattgaagagtggccaatcaattttggactgtacatatgctaattctgaatcttcagctcctgaatccgttcttcttgctagcagaggagggctatctcccctcaatcttaagttgttaactatttcctttgtttcacaatgtaagactttctagcattgcccacattcatatagatgttaatgaatctagaaagttttacattgtgaaacggagggagtagcattaacaaagtccaaaatttcagattgcacccaagcttctcaaacggccgtccctcaaatggctttgtaaaaatttctgaagaacttgcccaaggaggagatgaggggtctgaactctgaacctgataagcacctagtagtttcttaaggcaggtactgcaccaaaacaatctcttcagagttcaaatcaccccccacaagcaccaggaaatcaaccattagttgatctgccatcatcacaacaacttgctcagtcggcgtccgaattttaagctcagtgcaaaactgtagcatccacattcagaatttcagatatcacaaaatccgtttgacagccaaccattaatgaattattaatggttgatttggttgaattgaatgtgcttatgttgcattaattattttaggctcttgtctgattatctccaatgaaggcagtaaaaatacttgattcttttgtttgtgccaaaagtttactctgcatcatttggattgagtgcaggctctaaagtctgaacttcagaggagttaagaacatagaactgtgtcaacgggcggtaacctcatcagtgttcctcaagacaaaagacaaatcaacagacttcgaacttcgtcaacagctggatttgctcaatacgtcaaaaaaaaaaattttgtgatattcaccctgaatctttcttatggctccattcttcagtgtcagcttcaggccttcagcaattggcaatactgcaatagctagtaggctgcaaagatcatttgttcagtgtcaccttcagtaatacgcatgtatagcttgagcagaactgcaaaattcaaaccaatctcacctcgaattttgaagctattttttttctaaataactttcatatcgaatcgcaaagacaagatatttcatcaaactttcccaaaaatgggaaaccacacctgatctttccgcgcgcgagcgcgagctgatcccgcgaagccgccgcctttaaatagcctcctatccgttgctcacatccccatcccctcctcgattcgaatcgcctctcctctcttcccaaccaaaccctcctcccaaaccctagaaattcctctcctctcctgcggatcgatccatggcggcggcggctggagatgggctcccgccggggctcaggttcgagcccaaggacgacgagctcgtcgcccgcttcctcctcgcgcgcatccagggtaagcccctccctctccatggcgtcatcctcgacgccgatcccctctgcgcgccgccatggaggcttcttgcggatcatggcaggggcgacgacgcgttcttcttcgccgaggcgcgggccaagaacggcaaggggagccggcagaagcgcacggtcgagggcggagggtactggcaggggcagaggatgtgcgtcgatggtgagaggctggtcgtccccgatggtggcggcggcggcggcgtggagatcgcgtggcgcaagtacgtgctcagctacttcgcggatggcgagaaggggagctcggggtgggtgatgcacgagtacgccatcacggcgccggctgacctcgcgtcgtcgacgacgcggctgtatcgcatccggttcagcggccacggcaagaagcgcaagagggaaccggaatctcagagcgacaaccaccagatcgcagtggcggagactgctatgctcgaggacagcgcgccgccgccacagccggttcatcctcctgcagcgatggtgaactgtgtctctgacgacaccgatcagggcttctccggtgccgttcctcctcctgcaccggtggtgcaccataccaatgactctgacgtcaccgatcgatactcttccctggtgttctctgatcaacccgggtcaatctatgaggatgagttgcagagctttgtgcctgagttccccgctcgcaacctgttcgtctctttgccagaaggaagccatgaagctgaaccggcgcaatctgtgtcgtcgttagctgatgttggaggtccagagaacatggatgatcagagctgctccggcgtggtgtttgctaatcttcccgagctgatcgtcttgccatcggcgccatcgctggacaatcaaaacgacgaggcgccagtgttctttgagtttccagagagcatggatgacattgttggctgctttgacttcgccgccatggacaaccagagctgcactagcgccataccagaggagccctttcttcctcctgctgcaatggtgaaccatgacgatggctatgcctctaacaacgccgatcaaggttgctccggcgcctttcctcttcctgcagcagtggtggaccttcccaatgagactgacggcgccgatcagagctgctctggcgtgggggacaactctaccctgttgttttctgatgttaccgggtcaatcgatgaggatgagctgcagagttttgtgcctgagttcgccgcgagcaacctgttcgtctctctgccacaaggaagctgtgaagctgatgctgaagctgacagcggtggtggcgtagcgccggcgcagtttgctgaatttggaggttcagagagcatggatgattcttccatgatgtacccgttgaactttccagcagaagccggtggcggcggtggccgtgcagcaccggcatcgtcttgggtgtcatcgcagcacaaccaaaatgatgaggcgccaatgttcttcgagcttccagagagcctggatgacatggttggctgctttgactttgccgccatggatggccagagctgcactagcgccgtgtcagagactgctctgatcgaggagctcgttcttcctcctgcagcaatggtgaaccatcacgatgactctgtctctgacatcgccgatcatggctgctccggctccgttcctcctccttcagcagtggtggacctccccaatgactctgatcagagctgctccgggtactatgaggctgagctgaaggttccacttgagtacgccgcgcgcaatccggtcgactctcccgcaaaaggcggcaatgaagccgaagttgacgccagcaatggtgcagggtccatgatgtcgtcgccggacaagcagaaggagcactcctcatcgggcgtcatggacgtggaggctattggttttggagttccagacagcatggatagcctgagctgcatcgacttcgccgagacaatggacgacctgagctgcatcgacttcaccattgatgatgagctgttcgatctatggagctagagatggattagcagtgacattgtcatttgttgaaggaaagagattcttctgtagatatagaagcagagatgtataggagcttagtcctctgatggcttgtatttattagcaaagctgagattattagttgttgataggttggataaaatatgcttaagtaacactaattgtaatctttattcatggtaataaaatatttgcctgattcatttatttatgccaagactgtactctgcacgagttggattcatttcagactctcaagtctgtgaatttcagaaaagttcagacttgggttgacagtttctgtttcatggtctgtacatgtcaattaattgtcacattgttctggtggcacaacattgtcctgtttgaattgaatacaagcaactctagcatgtttcgattcgtcagttttactcagcatggataaaatctttcagaagttcaggtattggtaataggctgagatcattagttattgattggttgaaccaaatgtgctgaagtagaaatttttgtaatatttattcatgggaataaaatatttacttgattcttttgtttgtgcaaaagtactctgcatgagtttgattcagttcagattctcaagtctgaatttcagagaagttcagagttgaggttgttgtttatttttcagagaagttcaaacttgagttggtcatttatttttcagaaaagttcagacttgcattggctagttgtgatgttgaagctgatgcgggtaattttggaacagaattacagcaacagctagctggctatgctactgttttttgttttgtatgcacatttttgtttaacagctcccttcaattttaaccgagatcaacaaggttctgattgcaccaaagcttctcaaatggcattttcagtgtcagagtacacatttctgcaagctggtaaacactaagctccttgatcaggggctgcaccaaaacaactctacatgagcaccaggaaattaagttggggtccaaggtacaatacatggccattggttgatctgtgatcatcagaacaatcggtagctgcaaacgcgctgacaagagttgactgcattctctgaataaatcgagtatgaaatgtacatattcggtttgaaatgtctggacttgtgatcaccaagtattgcagcgcatcaaaagtatcaacttctgaaagttatagttcaagaatggtgaaacattcgtgttatgagctggattgtgttcagacatgctttccctgagatgggatggagttcagacttgagagtatgtgtcatggactgagctaattgagctgagatcattagtcattgattgtttggattaaatatgcttaggttgcaataattatttgcttatgccaaaagtgttctctgcatgtgcggatcaagttcagactccctaagactgaacttctcttgagtgtttcttgttcatggactgtacacgtcaagtaactgtgtcaacttctttctgaatgccagatgtatgcagaaacaagtgttttagttgagatcactattgattggtttaactaaatgtaaatttaaaacgagtgtatgtaaaattaattaattgttaattggttgaactgaagcgtacttgattcttgattgaattgaatatttgaatactagtcctacttgagttatttgcttactggattcttgaatcctttgtatgtcaaaagtgtattgtgcaaaccataatatgtagttcaagtacgaacaaactgcatgcacaaatatgagttgcttcgagtgacagaacacaaaattcagcaaagcaaggctaaactaattaagcaccaaggaaaacggcgttttacccggcttcaaattacccagcttggccacaagcccacaattacgggcccgctaataagtagtaaccgccgtgattctaatttgctaccaaattttcagtcagaatcagttgaaattcagatgtttctgccaaatgttcattcaaaatcagaaattccttccggcagcaatcgataattcagtttttcttggaataccagatcctgcaggttctgtaattcaaactgcatcctaaaaagaattagaaacagacgagtagcttcagatcaagctcagctcaacaggaaaaaaaagacaaacgaggatgaaattgttcagaaaattcccattggtaatcatgtgcccaagctaaactgacagtgatacacggttttcccatagtcttaaaggacaagtaccatgcatacagatcacaccaccacaggtttgtcgacattttaaaaagacggtaaaccaggctgataacatcagcttgtaccgtcggaatacaaacaggtatctgatataggagtatttcattattgtaactgaatgagatagcatcatttgctccatctggggagcaaattaagagacgaagtagctcaagtagcctcagcaagcgaaagcagcaacatctttgtctttggagaatacaagaggcgcaatggtctacctgcaagaaccaaaacagcaaacgtcacatatggtaaaggaaacagacagtaaaaaccaaagataaatataagcatggtggaccatggagtacataaaaactcatggtcatggctatgatactatggaaaaggttctagagttgcccacagtaaggccttttggggacaaatattatcttttattaccaataatgcaaaattatcatgtcaaaccacaggatgatgaattacttgaaacgtgttcactaagtcagcagaagttaaattgcacaaaagatcaagaaacgtgttctgtagcacccaataccattttttccctggcaggagagttgcatggctttcgtttaaagaaagaagaaccgacagtgcatgacaacacagtgtcacttcaaaataggcatgccaagcgatcaaagggcgctacggacagggacctacaatgatcgactcgaatactccggagcgtaactctcattcctgagaactcaataaaacgacttgtaccttaacaaacatttaacttgacaccagtccatcaatatgatccccctagcttagccctactgccagcacactgcatagtcagtgcatcgatacctgccagtttgggcacctaattgtgtgaatatataataagaatttcaatgcatacgatggagcaataagaaaggcatggctcacagtgatcaagacggcgctagtcaagcaagtacccagtgactaacgactatcgactagacacgccgaggcgacgcctaggtattccaccacaagaggggcaaaaccatgtattagagcggaggcaagagtttcgatcaggtgaaagtataagcagtgcaagacaagcactgaagcaaagctacggagaagcaaggtaggaggagcgcttgcttgtcgcggcaccgcgttggccattgaaatggagggaaatggagggagggaggagggagatggaggaaaaggagatgggaagaacgcaaggagggaaagagaccaatctgaaggagaagaagctgcttacggtgctcgtacagttgctctcgtccatgtcagccgcagcgccaatgtatcccatggttgatgtggacagagagagaacgatgaaggcggcagctgtgggaatggaatgaatataggaaatcctagtacactcatgggccaagtgggccctgaaaaatcacagccgttggatgcaagttatgtaacccaactaccccatcgtctacccctcctcctggctgcataatgcacacactgtcgcccgaaagaaacacagcacagcagcatcgagccagcgagcagcaactctgtcacgcccggaaattcactagtaatttccgaacttatttatgcataaaatcctcgtccaggaatcagccgaggtacccaaactgacaatttaatatacaaatccatcataataataacgttacatacttacgaaaaaaaagaaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatatatgctcatttgcaaaagcagcatttagcaaaacatttaggagaagtaaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgaccctcgtgggcttatctccgccacttctcagtctggtgctccgcaatgaaccatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaaataattaattaaccaatcacgattggccatcgtgaactattattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaatagagtaatcaatgcaaattggccataacaaaggaataagttcacaccacccggtgacattcgaaaataaatgcacagttgaaataaatagagaatttaaatataggatcaacatgctcaaaggaattgtgtttaggatctgtgtgacttgccttacaataatcggtcttcaattaatcttcttgaatacttccggcgcactcgcgaaccttcgaaacgacggaaacgacaagctaacacgcaaaacaaggaaaacactaagaaactccaaataaacaatacatataaagtaaacaaacatgtagatcatgattttagatgaattatgagacttgaacggcctcattctgacttcaaatgaatttattacgaattttacaagattaaatctaattaaagcccatttaaaaagaattaaataaatttaattctatttatggataattttaatatgtagatctttattttatataacttttgcaacttgaaccacattaaactgagttacaaagaattagttatgaattttcaaagattaaatcggattaaagcatttatatagattttaattgaattatgacgcaataatgaattatttttgaaaaggaaaagaggattattgcgtcatcaaaggcgatccacggtaaaccgggtgcacgggacggtctaaggaaacgaacggccgagatcgatcctatccacaacggacggccaagatcgactggtccacggccggaccacgggagacgacgacgatgacgtcagcggtgacatcaccaccggcagcggctcgggcgcgcaagctcgccggcgaacaacggcgcgacagcgcgaaaggagagcaccaaaacgatgcgggcacgcggcgaactcaccggtgaccaaaacagcggcggaagatcaacggacggcaacggcgacgaggaagaagcggcgac

SEQ ID NO: 66521 - DNA, 3769 bp, Oryza sativa
cggcgacggcggcacgaggtctcacggggctagggctctacgggcgatggcagtcgaagacgagagtggcggcgggtagcggcgggcttgggggtccttttataggggttggaaggcggcgacgaaggcccacggcgaccagcgacgagaaggaaagattagggttcggaggagagagacgaatccgattcgagatcgaatccacggatttccaaaccgaaattagccgacgattccataagagaaaaggaagaggagatcgaggagattatttcccctcaaacgacttcaccggaaacggaaaggatcgaccggattggaaagcggcggcggctagggtttcggccggcagcggcgcgaggaggaagacgggcctgacaggtgggacccacctatcagcggcaccgagagagagaaggaagcgacggcgggctgggccgactgggccggggagagagaaggctttgggccggctttcggcccaaagccaaaagagactttcaaaaacctttttcaatttaaattattcatgaaatgatattccattgattaaaaatacttccttggctcaaataaatcccagaaaaaatctaagaactatagaatcaagtaaagtatttaatgaaattttatctggccccattttatattggaatttattaattaaaattagatcttctcttctaggcttttaagatcatttctaataattcccttttagacaacaatttataatttaaggatttttaaacaagaaaagctcttaacaattataattagatcattaatgatcaaataattactgaactgttctttgtatcatttaggaattgagctctgaaaaatccgagaaaatttcagagagtgtaattaatcatggagaatttaataaaaattaaatccatccatgctttaaatttaggaaattttatttccgacatttaacttcacttgtaaattaatgaacatttaatataaattctaataataatttattaaataatttataaatcctgaaacaaaaatcaggatgtgacaaactccaactccgagcagctccgtgcctcgtgagctcctccgagcagagccgagccctcccacctccatgtgccacctccgctgagccccgccaaaccctgcctagcagcgccaaatgccacctaatcccgcctcggcaggtagccccccgactaagtgcaaatcgcagcgggacttgccacctaacgctgatttttagaacactgaagcaatcacattcaaattttaagaccttaaaaccaatggacacattgttacattgtaatgctaacatgagaggaacaaaaggaggtggaagggatgagacatggatcaagataaaactggtttacaatcatgatccttcctcacccagaaacaacgatcagcagcaattatactccaattttcatgtactgatcctagtatagtctaacatttaacattaattgctacatttgcagggagaatcactagctgttaaatacagacccatgtagcacaaaagaaaagcataatgaaaggtgtgggtatctatgcaatgcgctatattttaccaccttttctagtgtccactttgtacatacaataagcatgccgaaacaaatctgaagaaatcatggaatttagttacaattttttttgtccgttttaaccatgaaactagtatgctttgattctttctaatgtatattttcattcattgagaagctctaattgttaaaaggcttaaatcaaggagagttgttccacgcaccaaatgccttaaaaaatatagtaccaccattgaaaagcagctaccattgcaatgcgatataaagaaaacatcagcaaataatacttacataatcagttcagaccaccctccaagctcaatagatctccagtataaatgccaacggatctgaaatctggcaccaccaatatatcagtgtatgtgtcatcctttagatcataactttgtagaacattagttccccgcagtaggaagacaatcttctcatcgtctaacagcagcaaaggataagcattgttattatagtattcgaaatctatgctgtacttcttaacccagagtccttgctcaagatctgacagaaaccacaggtccatgggggaaccgtatacagcatgcaccatcactaaggacccattcaagtcggctagcgagaggggctccataatttccaaggttgaggagataacaatcatatcccgtcccctggcgactggtttcggtccgtttagaatacccatccattcctccgtctcaaggtcaaatggaactatgttacctggtcgaataagcaagccatcatttgagcaatagagcctcgaataatctaacaggaaatacgcaaccccattgatgaccacacttctcatattgttacttgaacaaacaggcaactgaggtccttgtatcgccctccattgcaaagcgccagcactgttcacggtcatgatctcgcactcgtatagctcacatggattaccagaaccaaggagacggaccaccttgtactctcctgtagaggggaccttcccaaaagcacaggattccattatgagacggcctgaactcagcaaatccttattatccgcagagatactctttgccgggatgtaggtagcaccggtgaccggatccagcacggtgacatccaaggggctaggcccttcaacgaggcagacgaggtcgaggcgcgtgcgctgcactctggatccactgacttcggtgtaaatagtcttgacgatgtcgccggaggacaggtcgacgatgtcgacgccgccgcaggactcgtcgccgtcgccgccgtcggcttcatcggagaagcacgcggcgacgtacgggcccgggtggcgggaggcgtgcgcgtcgacgaaggcccggtcggaggccacggcgcgccacgaccggcagacggcgcggaggcggcagacgtccctcgccggcagccgcagcatgatctcgaacagcgcgtcgaggggcagccccgcgcaccggcccgccgcccgacgaccacgccgccccctcctcctgctcgtcccgggcggcgccatcgcccaccccggatgccccccgatctacgtaaaaccaccaaatcgtgagaaatcctcctcttatagaacgcggtgattacgacacggcggatccggacggcggcgcgagagaagggaaagggagcgtaccgtgggggaactccggcgaggtgaggtgaggcgggcgcggcggcgaggtcgcaggcggcggcgagagggagtggatgaggagtggagtggagtggagaggcggcggcgggtagaagtagcggccgcggcgccgctctcgctgtctggatgggccttcaaatggcgtcatgtccaatccagcccaagcccaacctatccgtgcgttccgttggggcccggcccatgggcagccgagagtacggcccatctggaggtttcgtttgggtagggcccatggaaacccacaaaggagaacggtccatttgattagtgtgtttggggctggcccatgaaagaccataaagcagaggagctcgaggaacactgaaatttttacaatttagcttttcttttagactattttcataaatagatcttaaaaaactattttcagaaatgaatccttttctggagccctttttagaggctggcccctaggttaaatggctcggcgccaataagactaatgtcgatctctcttcccatgaggctgttcacagtgcgccttgatgtcgagtgg

SEQ ID NO: 66522 - DNA, 14276 bp, Oryza sativa
ctggcgggaagcagcgttgtgaggatggcctagcttgtggtgctggaatctttaaagaagcctcatccgatatgacatactagattcctcttaggctgtgtttggcactgcctattcccatcctctcctcctcgttttccgcgcgcacactttccaaattgctaatcggtattttttaaaaaatattttctataggaaagcttctttaaaaaatcatactaacctatttttaatttttttagctaatacttaattaatcacgcactaatccatcgctctgttttctgtgcgagaggtgagggaacacagccttagtagtacctttcactgtaagagcaagtataataaaaggccgttagaaggttgaatgctaacgtggatgagagaggagagagagagggaaagcgagtggtatgcttaaaactagcttaggcataggaaccaagaaaatatgtgagagaaacatgggaaccatatagtttatagttaagagctaactactacatgagttggctgagaggtagactgtgaagatcttataccacatttgacgtgatttgggctcgtcgtctactccctccgtcccaaaataactcaatataggataggatgttacatattctaagacaacgaatctagattgagttattttgtgattctctccatcccaaagaaaccaacctaagaggggatttgacccctcccagtacaacgaatctggacactacatctcctcttaggttgggtttttttttacggaggaagtatttcttacggatagtaactttaggggcctatttatgaaaaaaaataaaaaggggcttaaatgtaaaattttcagtcgaaaaacacgaggtcctcatccgaaattcctaattggcgactggtcgcgtgccccctcaccccgcgcggatggacgcgtggcgcgcgtaggagggggagggggcgcggcggccgcgcacagtgggaggcccgcgttctttttttttcgccggtttttatggttgttttcttcggttctttgtttttttaaaaaaaaaacatcacatatataaagtttgtatatacagtatacaaagtttatatacatacgtatataaagtttatatatatgcgtatagtgtatatataaaatttatatacgtgatggttttcctctatttttttttattttttaaaatgaacatatataaagtttgtatatatatcataaactttgttatacgttatatataaacttttgtatatgcgtatatatttacatataaaatatattttttaaatagtactagtagtatataataacagtagtagtggtgtagtggtcctagttaccagtactagtagtactagtactagttctagttagctgtgtttattctagagtaaagtttagattttggttgaaattgaagatgatgtgactgaaaagttatgtgtgtatgatagattgatgtgatagaaaaggactgaagtttagatccaaactttggatctaaacacagccttagtagtagtagttagtagtactccagttactactacttcctccgttttacaatgtaagtcattctagtatttttcatattcatattgatgttaacgtgtaataaatgctagaataatttatattatgaaacggagggagtagtagtttaaagtagtacagtggtagtagtactagtagtactttaagtatatactgtactccgtatagcagtaccagtcgcccattagccacccccggtcctcatccacctaggctttaaaggcttcgtcacttccacacatcctctgctccgctctgctccaccaatggcgcccaccacccccgcctccttcctccgcccgccgccgctgccccaccaccaccacccccgcatcgtccgcctgccccctccctcggcgaccttccgcgtcgctgacctcctcggcggccggggtctctgcaacggcgaggtcggcatccgcaaggagctcgcctccgactcccccgccgcgccgccatccaccaccacttcttccgacgagcccgcggagtcgccaccgccgccgccggctgcgtccggggtggacccggacgcgttcgacaaggagatgatgggcctcaccggcggattccccggcggcgaggtcggcctcaaggacttcgtcgccaagaacccgcctccccccaagccggcgcacaggaaaggtctcgccgccgccgccacggtggagcggccgagggcgccggagctgccgctgttcctccccgggatggtggtgctcgtcaagaaccccaacaacgcctaccacatgtactgcggcatcgtgcagcgcgtcaccgacggcaaggtcggggtgctgttcgagggggggatctgggacaggctcatcaccttcgatctcgacgagctcgaggggagggagaagggcccgcccatggtgaaccctaagtccgtgctgctcgagtccctcgccgcggagatggaggacgatgtggccaaggaggaggagggagaggaggccaagaagaagaaggaggaggaaggcaccgccgccgcggcttgaccaccattgctgcttctgcttcttcttgtatgtatacagctatctatattttcttagatgatggaagtgaaaggggtatatatatatatattatctattcgatgagtaatttcgaagtgagtaaatgtgttgttgttaattgctatatgtacagttggaatcttagtgtgaattggcactatgaaacaaacgattcggagataaaagtttagcttctttgttgaattgctatatgtttgatcaatttgatcacgtttggtccggattgctagtgaaatgcctacaagggcaccagttgccatagttcattatgttggtaggattaatttttttttttacaaacttgaattatcatctcttgcttcttgaagcgaagaggctatgacagtcaggtaaccaggctttcatgattgtaaattgtacagagtatgaatgttcaagtgttcgttattcctgacatgacttcaaaatcccgcagtatttcgcacagcaactatctatgcattgtagtttacgtttgcctgatagctggtttcccatgatttttgtttatttgaaagagtatatgaaaagatagggcctttacttctatataacctgccttactcaggaataagtgtagcagcagatttaaaaggatggtaaaggaagacagtgaagtaacaataatgatatagtgttttgcaaacagagtacaatttgtattgattaccaccatctatatctatatctatactaatataaaaaggagttgtacccctccaatcctacgagccaaatcactcggattaatccctaccgtccatccgcgcgcacgaattcaccaccgcacgattccacgcccaaacttcactcctcctcctccacacgcgaagacttcgctcctcctccacgcacggacttcgcttctcctcctcgctcgctcctcctcctccccgcatgtagcgccgccgcatcctcgccgtcgccggagctcctccccgcgcgtactgctgccgcatcctcaccggagccgctgcccacgccgacatcttctgctgccgccgccaaatccggcttcttccctaccgtcgcggccagatccgacctcagccccatccgccgccgccgaggtcggcccctcccgtccctgccgccggagtacatccatgtttcccttctcgctgtcgtccacaggctccgccaatgcaatgattggcctctaccttccctcgaccaccgtcttctggacaaaaaagcagaagtaccaacaggtaaggtgaaaatgcccaaaatcatcttctattttgcaatctggctactcttttgcatgtattcttctgccatatgggctggaaggggtgaatatgaaactttcagattaattaatgtgttgcagtttgccgaataaacaaatcaacagttctttatattatattggtattagaatgtggttaagaaacttgttttctactggattcatgttttttctctaacgatttgtttactacacgcttgcagacaattatctgaaccacaaggggatatcacaccaactcactctctcggcttgtttctggtatttatcatacccaacctgttctccaaacataatatttgtaccgcaactcacatattagaattactgtaccattgtttcaatagatgggaacacttcaatcaaaagttgtgttgtctcactttcgttataaaataaaataaaatccagtgctcttcaaccatgttggcaacatagccgagtgtgaattgttggggatgattattcttttttgattgtttggtgagatttgataattctaattattctatacaattctctattcttgtgaattactgatatttttttgagtcttttagaaggataccctagagttgatgccgataaattgaggtttatttgttggtaaaggatatttgtaggctatttgattcgttctataaattgcagagcacctatgcaaaatacaagtgttgtagggctaacccttacaattttggatcattttggttgctatacatgtcatcctgaagcaacacttctttccaaatactacacatcaccatagcagcttaccatggtgatctaatcatggcagttaggagggcagtaaatggtgatgtatgttgactagatactttggaaattaaatgaaggcattgagctggcaatttgggcaaagtagatgggaaatgttgagcactattagtatgcacatataattagaacttacaacatgcactttagtttacaactctctaatgttttctgccaagaagttccatatcaaaatgcctgctaaaatatttctgggtgtttgctttcagaaatattgctatatataatagaaatgtaaaatcaatcagggttgtcaaatcaaggcataaggcgtaatgttaagatttagtaaggactgctagccctgttaaccagttcagcatgcatgcctgaattcatttttctttcttactgccacctaattgtaatatttgattgatgtgaaacagggttgtggtccgacgtgagaatctgaacagctattcatatcctagatatcatcttcctaagattttctttttcagtaatagatttgagattcatgcagttaaaattactgcagagtatatcaactttacagtgacatgctatgagcctatgagttatgatcttgttcttttcttttcaagttctccaaaaattggaactacaccaagcagtagcaacaccaagtgatgtatccagcgtcactggcagaatcattcgtgacctatcaatgatggtcatccccattgagcatcacatggttcacagaggccatggcatctttgatttccaacaggttaatccttgtcgtctcatgttttgaatttttcatctccacgtttgcttttgatggtttacactttaagtttgacactaaaatgttcatactccagatgaactggttcttgatcatgtgatcatcagatacttgaaaatttgcgcatttggtactgaaattagactcaaagtggactctgcatttatgtttccaactacccggtccaaaaaatgcttgtagtaaattacaattatcacctaaaaatgttggtggcacataacttaagaaattacgatggttctttcgatataaagtgatgtcatcggaattgcttcatgaattacttgcaaagttgtttagcagttgaatcttgtgcttattgtaattcaataatcttttgatcatcaaattgaccttgaaaatattagcctttactatttctgatgagatatcctttatctttatgattggaatctggattttctttggtcaatgttaatttgacttgacatacactgtgcataagaaaatattttactatcaatactgatcctttatcttggcatacattgttttgtgttttacttgacggatgaagtgctgaaggcgaaagaagttggacagaccttctcggtgtgacacttgacaacacatatgaggctgtggatgtatgagatgtgagcaactgggtgtgtgcatgatcctgattttgtcataagagggaggtagtgaagttaagtcgtgcggaatacactgtaataaacaagtatagtttcacataaaataggcttagcactttcacttatttatatacagtatatatttattctggtgatggattctttggtgctaccatgcatgtataacttgcttgctgttattcttatttttctcccacaatggttttaatttacatttgttactacgtgcaatgcacgtgcacggttactagttagttactaagccactcattgtacctcttgactcttgaagcacaactcatcttagtgctcccttcatcttatgccacatttgaactttaaaaggttgtgcatgttgggattcttaatgaactttgctttcatgcaagcatagtcaattttggacaaatttaccaaattcgtggtaatgcaatatatgatttttagtttactcaaactcagatactattcatgataatgaattggagaagcaatccttactagagtaccaagcttatgaatcccatagttaatctaatagaagtgcattgtagtttgttgatagggaactagaagtctgataatcaattagtatctggtagacttcctgcgttgttagtcttgcttgcagggaagctttcaagcaagaaaatgccaccttaatgagggaaactatgttttattcttctgttcttgttggtgctaaaggtcatgaatccagaattttcttaattgtcatatcgtggtcccttgataagtcaaatgttgcaataaatttcttgggtgcttcccaaaattccgagcacaaccatacccaaactataaacaccatatttctgtcacatgaagatatataagacagctctacagaaggaaagagtacatactatactaggaatcaatgattggatatggatgcttttgatatgagaagaaagtatataacaagagctaagtagcaatatgtcccagctagtccactccaattagatgaatcggacttcaaaattcttgctgttatgctgtacggaaatctgagacataggccttgggcctcgagtgtaactagttagatgtcgtggctcacagtcatgatgcagataacataaggaggtgctgcccaaggagaaggggaagcaagaggacaccacaggtaaggataatagaagcgtaagcataaaagagtttacagaaatcgcacaaacattcatagtacttaagcatatatcactttagttggttatctagattgatcccaaacctgtaggatatcaagtactatctggtagtgttgcttacactaatgtagaactgctatttaggactgaaagtctgaaagctcaacatatcagaattgagtactaacttaggctatatgaaaggagcagttatgcaatttattcttttggacaatttctgtcatgctgaaatgtcgataattatgctgcaggcatatatatatgaatgataacaataatcaattaaatatcagaccttggggatatcttcctaagggtatcagagggcacaatcatgaaagtataaacggttaggagaaatcatgaaagtatagacagttaaacactatctgttgtatccagtgttcggatgttaaataccccatcagttaacaatatatgaatgcagggtttgaagatctccagatgctcggcacagccttgcaattgcgttggccgctgctgcaatggaagcaccctcgagcatccatggtgcggactgaagccagtgcgggacaaggcgatcgacgactgttttagaactgccacgcccacaaggatcaagttgggggatggaggaacatctttctgggtagatgattggttcccagacagtggtgcagttgctaacctggtgccaatcgtctccacttctgtcaaaccggagaaatggacggtggcaagtatctgaactttctcttcaggccttgaataggtatctgaactttgtgtgttggttgacgttgttgcatggaagctgtcgatcaatggagagtattctgctttatcagattaggtaaactatcgcaagatgatctgaggaagtgcgaattctttcatgtgcaagctgttctagcttacaaccttctgaaccctgtggttgatcaaatctctgcaactccttatttcctttctgatgaacgaaatcggccagcgatctctctttcacagccctgcgaaatatatataaatatacataatcagttgtatcggtttgtgccaatatctttgtgtgcttgtggtattgttatgctgatttggatatcttggatgatctaggcaggctcctctaacttaagtaagagagacgtgttgttgatacgtgggctcatgtgggtgtgcctcacctgtcaggacctatgttccactaattttaagttagaggagcttcttctgttcagaataccagggttccgtgccccgctagttctcgaaaacatgaaaatttgaccaaatatcgaataaacttcaacataatttactttccaaattcggatttcctgaaaaccatttgaaatccagccacccccccaaatcatgaaatttatggaaaacgaacccccttttttggcttcacctaggaatggatgaaaaccgaccctctaccattttcatttctatattttttttatcgaaagcggaatcggaatgataggcccgaaaacggtaacgatatcgataatattggtatattagaaatgggactgtcggaatggaatctatcgatattagttggaagtcgaaaattcatatcggaaacaatggggcgtggcataatcacacatttaactatacatgaagataactttataacttcattcgtgcatcatcacactccacataacactattatatgatgattaatgatatgataataacttcgacgaacaatataaacaaacttcaataataattcagcatcgataagttgaggagaccaaagtttagcaaagtccacatgtcacgtcttaacaaccttttcccctggccacttcccattcctaacaggctgcaagcctaccagacttccttcatttataggcttctggttggttaggctagctagatcactagggaacttttcgaattttgacggaaattactagacaaatatggttaccacaaaacggtcggaaaaacctccatcctattttcgttaccatttccaaaagctattaccgtttctatttccgacaccgataattaccgataccgacagtcggaaagtggaaagtggaaatgacagttggaaatcttggaaatttttgtaccgttcgtcaaactaaactaaacttaaaaagagagaaaaaaaagtttgtttggcttcgcttagcatgctcgaatgatgttatagcctgccactccgtagacaacaccaactagcgccgtaaacactaccattgccctaccctccacagttaagtccaatacaaaagccaacacaaggcaagtgacgaatacccccagcgatacgcccgtaacgattatctgaaaatgaggacagaaaagagagtgattagaagaatatatatatgcatagatcaccgtatatacgggaaaatttgtactttcagtcaaaaagatttgagttgtaaagaaaaaaattatcagttacattgattttctttttatatttcaaaaatagagtactttcaacgatgtggcttctacatggagtccatataggcaattagtgatggcatcaacataccaatcaataataaataataacaataaaaataaaaatactgcttatctatgtgtcatgctcacctccgttttctctttctatcatagacattatatatttatatattttaaatttctaataaggatatcaagtgacgctatgtcttcgaaaaacaccctggtttaggccaatgatgaaatacgaatagtttcaagagtagagagattagttaagagataatcggactatgaccatagctgagggagcaatatggactttttcctattaataattaatgatgtttttttaatatactagatattttccagatcaaggcatactatactccctctgtttttttatatttgacaacattagcttttgcacatacgtttggttaattgtctgatccaaaagtttcgtacaaacacaagtcatggttaaagtgcttgtaacaacaaaacaagctacaacaaaataaacaataattacataatttttttacaagaaaattggttgatcaaatttaaaattttagaaaatcaacggcgtcaaacaaaaaacggagaggagggagtgtatatatatagaacacaagcttaccattagcaatatcttcaagttggcgtccaacaaagcttctggcctctcatgctcgggcgtgacactcactttctgcggcagtgttgttgtcttcccctgctccatcatgctcacctccatgtcagacaaaaccactccacccataccgccagttggctgccactgtacgttgcatagatcagatgcgtagatcgagttctgactagatcaagaagctacttccttggttctttgttagttttgtttattttggaacgaagagagtagctgcccgagtctaggcttgtgccgttacgtgcttaatttatggaagctagctagctacaggttgatgcaggcgaggcgggcaacatgattgaatatataggaatgtacgattcgaatatgaatttgcttatacgattcggatccgaattagttttaattacactacgattcggctttaagttgagctcgatagttgttactgctagtactgttctaaaacaataaaacaatgatggagaatatgcagtgagctacgaataaaaattgcacagaaacctagaaaatttgacgaaatatcggttgaatttcaattcattttaatgaccaaatttatatttctagaaaatcattcgaaatccagcctcctcgaaatcacgagatctcgtgaaaactgaccggtctctttttgttgaaattgtaaacctgactgtaactgaccattctgctcttccttttgggcctcgtttaggcccggcccatgaaaagcccatataaacatagtggcaactcaagaacacgacgaacacgtcacactccccaccggcgtcgccctccgccctccgcgctgcgccatctccgatctccctgccggcgccggcggcacatcgacctagcggcggcggcgtgtcatatcgcaggctatgacaacggacgaggaacaggagaaggaagcgtaatcacgctgaggcgtttttgtgtaaagaaagcgacttaagtaaatgtgtagcgtgagttcggtgtgtggccctgagggcggaaacgcgagggagtagtatataatccccgtgaactgtagttggaaaacaagtctgaagaaatgaaatcaaaacctctccccaaactctctttcctctgcctctcttctgttctctgaaattcgaatccatcttgtgttcatcctcattgcggcggcgagattctcgccggcgacgaggttgtgacaacttggtatcagatttggattcgttcgtggcgtggggggttctgcttcgttgttcagctcggtaaatcctcgcatcagagtttgggatttatcttcggggatttctctgttaatctcgtgcttggttcgatctggttcttcgacgtagtcaccacggctccggcgaagcaaggcgtccaggtgcgtcaagttgtggcggctatggatgcgatggaggaacacatcactcaagcgattgcagtgttggtgacgaaggtggagagggtcgacaatctctgcaagcagcttaagcagatcgacctcaagcttgaaactcaagggaagcggctggattcggtccaaagcaaggtggatttgtccatgtcttctctcgggcaagttcagcatgagcaagctcaggtcgcgcgggctctcaaggcggtgacgtctgcttcttcgtcaccaactccaccgccgactccacctctgccgtcgcaaccgcctccacttcttcctccacctccgaagccgcctactaaggatggggcctcttcttcatcttcggcgccaccgtcccctacccatgtgcactctgcaccgtctcatcaggtattcactaccgcgcctactccacctgttcgtccttctgatgagtcgggggggcgtcgtcactggacaccaaagatggattttcctaaattcgatgggtctgatgttcgcgtgtggttagacaactgtgagacttatttccgtttctataatattgtggatgaatttcgggtgtctgcggctgctcttaatttagtgggggatgcggcgcactggtaccaagcttggaaacaggagatggggtggccgacttgggatcaattgcgcactgctatagctgctgaatttgagctgcacattgagaaaaccaaaatggatgagttgttgcttctgactcagactagtactgttactgaatatcgctcctagttcaatcagttggtttaccacattcgcttgtataatcctgctattactcagggctctgttttggtgtctcagtttattcggggtcttaaagaggaattgagatataatgtacatgctcagcaacctgtcatagtcactcaagcttatatggcagccctggcttttgaaggtgctcaacagttaaataaatcctttgtcaagaaggatactggggttggtaaatttggggataaagggaaatctactctgagggaattgtggaaagctcaacaactgaaggattatcgtcgtgccaatggtttatgtttcaaatgtggtgagaagtatagtcctactcatgtgtgtggcaaagttgaaggggttcagttgaaggccatggaattgactgacactactgaaattcttgatgatagtgtgctggatgctcttaccaacctggatactcctcctgatgatggtatgttactatctgtccaggctttggctggtaccagttctgctaattctttgcagttgagagctttggtgggaaatcaggtggtgttaatcttggttgattcgggcagttctcacagttttatcaatgcagatctctgtcatcgtttgcagctgcctttggtatcctgtgatcctgccaccgtgaaaattgctgatggcactctgctcacctgttctgctcaagttcctgcatttacttggtggatacagggttacacttttgtctcttctatgaaggtcttggatctgggaggttatgatgcagtgttggggatggattggctgtctcagtatagccctatgcagtgtaattgggctgagaagtgtctctcttttgcttatcaggcacaaacggttaagttgcaaggtattgtctctcactcccttcagcaactcactgctgttacttctgataaaccgtgtaagtggcaagctggtaatgatatttgggccttggctgtggttgaaactgttcctgcaccttcatctgtttctccactgccacctgctgtcaccaagttacttcatcagtatgatcagatttttcagaccccttcttctctacctccccagagacaatttgatcattctatccctttactgtctggagtttccccagttaacattcgcccttatagatactcacctgcccagaaggatgagattgagaggcaggtcactgagatgttggcctcaggattgattgttcacagctgtagtccatttgcttctccagttttgttagttaaaaagaaggacaatacttggaggttttgtgtggattatagaaggcttaattctttgacagtaaagaacaagtttccccttcctattgtggatgagttactagatgaacttgctggcaccaaatttttctctaaactggatcttcgcagtggctaccaccaaattcgtatgaaagaaggggatgaagagaagactgcattcaaaacacaccatgggcattttcactttaaggtgatgccctttggcttaactaatgcaccaaccacctttcaatgtttgatgaattccatctttgctccttatttgaggaaatttgtgctcgtttttatggatgatatattggtttatagccctgatttagactctcatgtccaccatatggaattagtgttgcaattgctccaacaacatcagttatacgctaagttgagtaaatgctcttttgctgccacatctttggaatattgggccatatcattt

SEQ ID NO: 66523 - DNA, 2860 bp, Oryza sativa
attcctgcagcccagcagaaggggttgctactgatccggacaaaactaagatcatgcagtagtggcccactcctactaacaccactgagttgagaggttttttgggattaactggctattatcgcaagtttgtgcagcactatggcattatagcaaaacctctcaccttgctcttacataagcatgtgaagtatgaatggtctgctgcagctgaagcagctttccaacagttgaaggctgccatgtgtacaactcctgtactggctctccctgatttttctcggcctttttttgttggaaatagatgcttgtgccactggtattggggctgtgttgtctcaagatggacatcctattgctttttatagcaaggctttgggtattcaaaatcagaagctctctatctatgagaaggaatttttagccattatgatggtaattgataagtggcgctcttatttgatccggggtccattcactattaaaattgatcaccagtccctttgtcatttggatgatcaagtattggggagtgaattacaaaagaaagccatgactaaattgattggtcttcaatataagtttcagtacaagaagggggttgataataagttagctgatgcattgtctcgggtggggcatttctttgctgtgcaatctgtttcagtgactcaacctcagtgggttcaggaggtcattaactcctatgtggtggatcctgcagctcagcaactcttgactgaattagcagttgtcaatcctaatgctaaaggattttccttgtccaatggtctcattaagaaagagggcagaatatgggttggggctaattcggggttgcagaccaaattgattacaacctttcattcttctccagtagggggacattccgggattcaggctacttatcagcgtttgaagaaactttttctttggcctggtatgaaaactgccgtggcggaatttgtgcaacaatgtgccacttgtcaggctgctaaacatgagcattgcaagtaccctggactattgcaaccgttgcctattcttgctggggcttggcaggatatttcgatggatttcatcgaaggtttacctctctctaagggcaagaataccattttggtcgtggtcgatcatttcactaagtatgctcactttctaccactgaaacatccattttcggctcttcaagtggctgaagtcttcctggatcaggtggcaaagttgtatgggatgtccaagtcaattgtctctgatcgtgatcgagtgtttactagtaacttttggaagacactgtttggcagatttcatattcctcttaatttgagcactacctatcaccctcaatctgatggacaaactgagcgtgttaatcaatgtctcgagatgtatctcaggtgtgcagtttctaacactcctagcaagtgggcagtctggcttcctttggcacaattttggtacaacacttgttttcacacatctctacagtgttcacctcataaagccttatatggtgctgatccttcttatggattgttgccgtctttatctgagggagattctgaaggtcaatcggctgatgctgctgaaatactcaaaacacgcaccttctattctagcattcttcagcatcatttagcccgtgctcagaatcatatgaagcaaattgctgattctaaacgcacttttcgcacttttgctgtgggggattctgtttatctgaagctacaaccatacgctcaacattcggtggtgaatcgtccttgccacaaattggctatgaagtattttggtccctttgtgatcttggagcgtattgggtcagttgcttatcgtctggaattaccggaggcaagtcaggtgcacccagtgtttcatgtgtcccagcttaagcaatttgttccttcgtcagtccctgtcttttcggagctaccggacattgtggcgctggatgaggtggagctgcttcctactgcgattttggaccggcaaatggttaagaaagggaatgcagctgtggtgcaagtcaaggttctttggggtactttgcaagatcactttgctacgtgggaggattatgaagttctttgcaccagatttcctttggcgccggcttggggacaagcctgtgctccagcgggcggcaatgtcatatcacaggctatgacaacggacgaggaacaggagaaggaagcgtaatcacgctgaggtgtttttgtgtaaagaaagcgacttaagtaaatgtgtagtgtgagttcagtgtgtggccgtgagggcggaaacgcgaaggagtagtatataatccccgtgaactgtagttggaaaacaagtctgaagaaatgaaatcaaaacctctccccaaactctgtttcctctgcctctcttctcttctctgaaattcgaatccatcttgtgttcatcctcgttgtggcagcgagattctcgccggcgacgaggttgtgacacggcggaggccctcgcggccggcccgacctggtgagcgctctctctctggaacacgaaatttcagctgctcagcctctattagggcatcgatctgatgaggccatcacacctccactttgccgagttgggatttatttcagattctacacttacctagccctttgtgttagagagacagagagtatatagaatgaaaccctagaatatgtagaatcgaaccttttgtgttagagaacatatataattgaaagtttgatatttacaacctgtttcactttgatgcaaaaaaaccttgggcctgttcactttgatgccaaaaaaaaccttaccaaattttggcattgccgaagttttggcaggatttcttatatagttattaaaatttggcagcgaa

SEQ ID NO: 66524 - DNA, 4293 bp, Oryza sativa
acaggccccttaccaaattttggcattaccaaaattttggcatagttgccaaaattttggcatgattttttatatagttaccaaaatttggcagcaaactaaatgtagccacttttttggcaactttaccaaaatttggtaaggttgaaaatggcatcaaagtgaacaggccattgccccagttaactttgttccaaacatcaatttgttcataaacttcgaggaaattagtttttttaatggtaaacgatcaaagtagcatcatttgtgaggaaattagtttttataaatggtaaacgatcaaagtagcatcatttgtatggaaaagatcggtttccacccatcgtctcaaagttcatcaagttggtctgtaccaggattcacaatatatgtaaaccggcaaaaaccaatgtaattcggacgctttttctttgttaaaaaaataattaaattctagtttgaatttttttaacttgaccggaaaaactgagtggttttgtgttatcgagccgtcccaggaaatcaggttttcgttgggtttgtgaaccctggtctgtacgcacatgtgttctcctttcctgatgctaaatattgaatgcttgtaggctttggagatggccatgaggtgttcttccccactaaccgaacaggccaggaagatgcatgattcctcaaattctggcatcctccctttggacgtgctgttcgacgtcctggtgcggctcccagccaaggagctctgctgcctccgtgttatctgccaggcatggcggtccctgacctccgatccccttttcatcaaggcacacgcagctcaccacagacagccgctcctcttggccacatttagagacgacgaggcacatgttcatatcatggatttggtaggcaatgtgcttaagacgataggaatcccggttggccacaaggtgttgtgcacacacctcgatctggtctgtgtagccacaaattggaacagctgccgtgtgcttaatccggccaccggagctgtatacgatttgcctgaaaatccagcagaggagcacatgtaccatgcccacctatgcaaaccttacacctcatttgcatttgggcgtatcaccttattgttcaatttggggaatttttctagggttagccttctcagctcaccccttcctcatttattctattagcataacactttacagataggtccttggtacaatacatatttacaccaacactccccctcaagatgggcaaaagatatcaatcatacccatcttgttacatattgattgaatctcactaggacctaacccctttgttagacaatcagctagttgttcacatgacttaatatactccaaactaagcaccccgctatcaatcttctccttaatgaagaacctatcaatctccacatgtttagtgcgatcatgctgaacagggttgtttgcaatgctgatggctgatttattgtcacaatgaagcatcacaatgtcacttcttagcactcgcaattcagtcaacaagctcctcatccacaacatctcactcaagctcaaagccatagctctgtattctgcttctgcggtagaccgagccaccactgcctgctttttgcttcgccaagaaacaagattaccaccaacaaacacacaataacctgatgtagatcttctatcatccatactactcgcccaatcagcatcacaatatccttccacatttagatgctcattcttcctaaaccacaatccctttccaggagtccctttcagatatctgagaatcttatgaacaacatccaagtgaccagttcgaggatcatgcatatacctactcacaacactaaccgcataggaaatatcaggtcttgtatggcaaagatagatcaagcgtcccaccagtctttggtatgcttccttatcaacgggatcacctgattgagcacacaattggtgattcctatcaataggcgtagtacttgcacgacacccaagcattcctgtatctgtcaatagatccaaaacatacttcctctgagatagaacaatcccctttgatgaacgagcaatttcaattccaaggaagtagcgaagaggaccaagatccttcacctcaaatgcctttcccagcctttcctttagacacctgatttcttctacatcatcaccagtgatcactatatcatcaacatacacagccaagatggtgatgtgtgtccccctatgtttgtaaaagacagtgtgatctccattacactgagaataccccatatcacacactgcatgcctgaacctatcaaaccatgcacgtggagactgcttcaacccatacaaggatttcttgagtttacatacttttccaactgtctggctattcccaaatcctggagggatctccatgtagacctcctcatgtaaatcaccatggagaaatgcatttttcacatcaagctgatgaaggggccacccaaagttcaccgcacaagataccaaagctctcactgtacccatttttgccaccggtgcaaatgtctcatcatagtcaattccatatgtttgactgtagccttttgcgactaaccttgctttatacctatccaccttcccttcaggggtttgcttcactgtaaagacccacttacatcccactgcccttttttctggtggaagttttacaagctcccaagtcttattcttcacaaggtcattcaactcttctttcattgcatctttccactttggatcctgctttgcacacttccaatcctttggtataggcattgtctgtaatgatgcaataaatgttttgtatgctggtgaaacatgagaatatgtgatatagtttgcaatgtcatgcatagaactaagatgctcaaaaccaagacgtataggaggtctaccagcattggatctagtctctctacgttgtgcaagaggtaattctacatgttcaagagttggagaagtattaccaattgtctcaagagaagccaaggaggctggaggagagagactctgggaggattcagggactggacattttgggtgtggtaactcttcaatttgactttgcactaacccttttcttttctccccctgactatcaaaccgcctcctttggtaaaccagcacatccttttgtttcaccctttcggctccctccataggacatggaattgtcccaacaactacttctccttcttctccatcctcttcatgagggaccatttctctatcctcatcttgtgtatcttcaatgacttccactactttactcgcatcatcaatagagcatggtattgatccaatcactactgcctctccattcttgtcaccaacatttttttcatgtatgtcacctctctctctctccccctctcgactatcaacctccatgacagtcgagaattcctcaagaaattggtcaagatctcctttacttttataatagggctcaaactcacgaaatgtcacatccatactcacaaacagtcttctcccaatgggatcccaacatttataccccttctgactcgaagcatagccaacaaacacacactttactgcatgaggatctaacttgccaacagaaggtcggtgatctcgcacaaaacaaacacagccaaacacctttggggaaccttgaactctcgcttacccaataactgttcggcaggagacttcataccaagtattctggaaggcatgcgattgataagatatgctgctgtcatcacagcctcactccatagatactttggtacattcatctggaacatcagagatcttgccacttctagcaaatgccgattctttctctcagctacaccattttgaggaggggtgccaggacaagtagtctggtgaataatcccctcatctgagacatatgacacaaattcattattgatatattctgttccattatcagtccgaataatcttaacttttgcatcaaactgagttgtcactaatttatgaaagtcttggaagcaacgaaggacctcacttttgtgtttaagcatataaatccaagtcatacgagtgtgacaatcaataaaggtgacaaaccacttgaaaccactcacagaagtaactgggcatggtccccaaacatcagaatgtattaatattaagggctcacagttacgaagaccgattccaacatatgtagagcgagtatgtttgccaagctcacaagcatcacacaccaatctatgcttatccactctactaaagaggtctagatacaacttactcaaaatctcaaaagatggatgtcctaactgacagtgaagca

SEQ ID NO: 66525 - DNA, 2169 bp, Oryza sativa
  unsure (1)..(2169): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgctcatggcatgcctttgtctgcttaatccacacgcagctgcatcaaatgggttcaggagtcgtttccgacaggcggggattgctccgggttggtggtgatctacgagcagtgcgtgcgtgccttctggcacgacgaccgctacaagaacgatctccgctacctcaaagtgtggctggaatatgtgagtttcatgaattcaggattggttctgaggtggattggttggattggattggattggtttggtttccttttgacatccagtttggcttgatcttaatctgtatgcaggcggggaattgtgctgattccgaggtgatattcaggttcctggaggccaaccagattggtcagagccataccaattactacttgtcctatgcgtcggtaatggagtccaagaacaagctaaagaaagctaatgagatttttaaccttggtattgccaggtgagaattttatgggggattggtagtttagtttcttcagatatgagaaaggttgcggattttcttcagtgctagtctgctagtagattattttttagtgataatagataagttccttctaaatttccatatagcctttgacaaagaattcctgttctagatttgaagtctgttttcttcggatttttagtcaacaaacatatagtcttacatatccccatttactgttttagttctatgaattatagtaactaaaatgcattaaactaatttggagtaagcttatgaaccgttgtagctgaaaacttttaccttctctatttgtttttggagggatatgacttttcttgccactctacctataccttaatacctaaagcatacgatttatgcatttgtttgactgcaaggtgtatagtcttccatattcccactcaccattttagctctatgtattataactaaaatgcattaaactgattgtggagtaagcttatgaactgttctagattaaaacatgtattcctgacttctctattttttgttggagggatatgatataatttctcaattttctgctctacctacaccttaatacctaaagcatactatttatgaattttgtttgatggaatggtgcatattaaaccgtaaaattctttggcttttttttttttggtcaggaaagcaaagcctgtggagaagttggaaactacatacagggcatttcttcagagatcatccaaaaagaaggcacatcctgaggtgtacataggctgatttagtaccctatttttaatctatattccactgcccactgaatgaattctattatctgttgaaacaggatgacacaactactgatgatcatccagtacgcaactttgggactgtcttgaaccgtggtgaaatcagtaagtttgctgtgatggtatgattaacatcaatttcaagtgcctggctgggtgaactaatgttgcattttgatgtggcaggaggccagcatgcagaaaactctcacctggtgaaaactctgcaaaggttattacttgttatacgcatgcaatcagtataaagaaatctagatgaacctggaatttttttactggtgttgatactgttgcaaatttgcagagttgatgtcaataggccacttgcagtttacacagatgagaattcgttacctagtcatggccttgctagaaccaggagcaacaacacggcctggcagacccttggatcacaagcagatcggaacaaagaaaataacatgaggcctgctaaatggacatcacacaaggttttttttttctcccctaagccactagaattcttcaaaaggtc

SEQ ID NO: 66526 - DNA, 15207 bp, Oryza sativa
acgtctctcagttagaatttacaaatatagttttcttggcaactatggttgcaagcttgcacgttgcagtctttgttccaagtataagctacaagtgtatcgcataatcaagaagtcaagatataacaacaattaacttcaaatggataattactgatacagacctgggccatgattggattgctagcatcagccagtggcgtgaggcgtagtcgttttgagatatgtgatccagattcttcattgagatcacaatcattcccaaactgaattttgtcctccttgggtcccatgaactgttccccaaaaggtaatcgggtgaatctagcaatgcagtccttttctgatcgactaccaacatgatgagaaacctttttccagtcttccccataatgcaggacggcctcaagaaggtgaagagtttctttatctgtccaatctgattttgcgtcctcagtaatttcaattcgcttgaagtctgccgaagtaagacctggccggtaattggcacggacatagcatctagcacagaggcttatatctgcctggtcataagcagaatttaaggagtttagtagtgtttccaattaaaagatacaaggaattaatgagactttcaaaatacaccaggatgatatatgacgacagtatctcaactgacgtataaagtttgcgtgactagcaatgaacttcccagacttaaaagtgtcactaagttattataatcgtttgcaaatacttttcttaatggtaattggtaaaacacgactgcaaagagtatacttgttcaaaatgagttactggccacctccttaacaagcaatggacaaatgagctgtcgtgcacgcttttgtgagagactggcgcttgcatgctagatcaccgcagcaagcagcaaagttgtgcttgattgtccttggccacaagaaagaaggcaaagagataagttggttgctagtattatctaacatgctctgttaggcagtcaatccatatagttggaatttattgcctctggtaaactttgctaggaaggtgcctaagaaaataccaaacaaaataacaaaggttgcaagaacacggatacccagaactgcctttcacagggaacaagactattgttggtttcaagaacaactgctcagagccgcagatatccccttttctcaatacccaaaccacatcatggagtttcaacaaaacataggtaaagccaaatggactgttgttccggtaagaagggcaagctctgaactgaataagtgcaatctggaaatatttgcactcttactgtctaattgaaaccatgagttttacaaacctaaagacctcaatttgtgtagaaatttgcagcacacatgtttgattaccctctcaatttataatttcataagaaactaaacacaatagttaccaaaacaaagtatatatcagactatttgtcaacaactttgtctgctcatctgtcctgcccttcctacgggacatgccaaaactagctaaaccaaatcattgcagccgaaaacatctccacacccaccaaatatatttgtttacaaatgcgtaaactcataactgcaaaagaagagaccctttgttccattccataagaaactaaacatctgaatatttacaacactgcgcagtaggtgggaggcttggatgctcccaccacccaagttcaaatactcttaagcttaactttggtgtttctttcttttctactaattagataccaaggtttttgctgcttctttcttttctactaattagataccaagttctgccttggtatcctcttttttttttccattcgaaaaaatatttaccacttcccgtatcaacagccaagcgctgtcatagcttatcagaaataattcgtgaaaaacagctaagataattctacagtggtaaacgatgcatacacattgacaaacttgtaatacaactgtacacagcactgcataaataactcatccgcaaatcaaaacaagagcaaatcactcaccttctcacaagagaaataagcaagcccgcacacggtgcggcacccggtgcaaagcttactgggcattgttgccccaatcggcaaagaggactgcgataacgctgcctcctctttcttatctctcccctgcttcgctcccgacggcgaagctccatagtttatcagcccccattcctcaaggaagtcgaacacgcgacgcacggagccgacatctccgacgagcccacgcctggcctcggtgagcgtcagccgccgccccggccgcgcccggaacctcctcacgagggtgtcacggtagtacttgtaagcctccgggcccctggacccggacgccgccgccgcctccccttcgaagaactccggcatgaggcggcgctcggtctcgtggatggagtcgtaggagaaccacgctggcgaagagggaagctagggtttcaggtctcagttcagcctcgtcacaacaaggtgggggcgatggagggggttacctgaatagctcgggatggtgatggtgcagggcgactcctcggccgcggcggcggcggcggcggcggcaggggcgggggcggcggcggaggcggctgaggaagccgaggtggatggcggcggaggggcctccgtcttgacggtgcctgccgtcgaggggggctgggagaacggcgcccccgaggacggcggctgcggcggagcgagaggcatggagttcgccgtcgccgtagtcgccgccgccgccgcctcggccgccggcgctggcatcgacggcgtggccatgagagctcgagacagccgcgtctcgtgttcgtcttgggcttcacccgcagtggagcctatcaagccgcggcccaccaagaggattgggcccaaccgaccaacgcggcagagagcgggagggcggtttcgtggtctcggtttagtaccacctcgccgattctgagcgggaggaggcggggagcgggtataagaagacgaccgggggctgagataagattaatgtatgttctgatcttattcttgaataagttcagaacatactggaataagttcactttgagtccctcaactttatatcgagtttaatatcggatatgtgggccatgttcgcatggcctgcttctgtatccaaatatttttttatggggaaaggcccattagtggttctgccactagggcccttgcgcgttgccgaggtgttgcactgctgcccgggccggcgcaccccaaccaaaactcagttccaatgtttgtaattactagaaaattccaatgtttgtaattactagaaaaaatacggtgaagtttattttaatcttattgttattaagatgaaatttaacatggttaactgagtatatggtttagttaagatgaaatttaacgtgggatactatatagagagaattacactttggaccaatttttattaccttgcttacatattggaccgggtataggtaaatattttcacttagggctagattttgttaccaaattttgcatttgaggctattggtccacatgtcagtaaccaacacatcatcttcttcctgagcagtcttccaggctttattccgtgcatgtctccagtgagcttatttcgtcctcacacagacaagctcctcttccccaatctctagccacctcgaactgcactccgctacttgacaagcctgagcacataggctttgaactaccaaaaatttgaactcatggtttgatgtcaggagcatggagaaagagacggggctggagtttgaggcgatggagaatataagggattgacggagctcgagttaaaggtggtggagttggactgttggagctcgagctcaagcagcagaggaggtatagctcgagctttgaggcagaaaaagagttgaagctcgagttgggaataatggaggaggcaaagcttgatattggggagcatggagatcgaaacctgcgaggagaccttattctttctttttttccaagcatcagcaagaagagctttgtatgtatgggcatggcaaagcttgagctcgacctgccttgctctgactcagtggttcacagtggctcttggaggagagacgcaggagagagaagctagaggttgaaagtaaaataccccctccttccctaaatatttgacgccgttgatttttttaaatatgtttaaccgttcgtcttatccaaaaacttttgtggaatgtgtaaaactatatatatacataaaagtatatttaacaataaatcaaatgataggaaaataattaataattacttaaattttttgaataagacgaacggtcaaacatatttaaaaaagtcaatggcgtcaaacattttgggatagagggaatattttgcaaagatatctagcccaaagtaaaaaaatggatgtttaacccttgtccaacttgtaactttggtaaatgcaattcactcaatatatatatatttaaaaaaacatgagctgcagttaggtgtccgatcgtcttaagttaacatgcgagtttttttaaacatatttcttatatgattcctttggtattatcaaagtgaacgatcttaaaactgactcaaatatggatatctatttccaaaagcaaacgaacgtaaaaccgactcatatatggatgacgtaccaaaataccggtaaaaacattttagtttttataatagtagagataaagagtagcaataatgcccgtgctttgccatgggataaaaaagaattatagataaaagcgttgccatgtgtacttttctttaaaaactgaacaaaatgaaatctttgattgaactcagcaatgattatgcaagacaaatgataactatatgtatgtgttatctatggcaacatatcatatacacacaggtcctcacgtgtacacacgtgcacaccaactaaaaaatatcaccaaaaaatctagaaaaaatcatacacatactttcaattgtattacacctagggttaaaatcttaacgtcaaattcattatattttagccgtaacaaaaaaaacaaaaaatctaaccgttttaaggttgcaattttgtcagaattttatcttttttgttattctctatgtagaataaatttgaagatgcgactttgcacgtaaatgtaatactattgaaagtacatgtatgaattttcctagaattttttttgataatttttaattggtgtatacggtgtgtacacgcgagggcttgtgtgcataggatacgctcccgttatctataacatatcaaaagaaaacaattaacctccgtgtgctttcattatgtccatgaatgccaaattgtctagctaagattttgtaatttacaaaaggcatttaaatttaaattgacaaatagaatctggactccacctcaccactacccctccccccctcccccaaaaaaaaaatctacaggtcatctaaggctgagttgaactacaacttcaaacaattttctcgatttccttcagcacaactgctaagggcacctacaaaagtagagaccggtatgatctctacgttaattagatgctatcatgttacaatagttaagataatacggtctctaatcattaatgtaccaaaatactttcttactagttatcttttctttattagactcaatgcaacgaaaaatttcctaataaatgctaagagtcgactctatgccgttgtcatgcgtagcaaccatctttctatttccttcttcctctctcttccacgtcactaaatatgtttgcatgacaataaagagagaccgctaataaaaactattgtatatgccttaagggcagtcccaaccctccacctaggatggtgtctatggcattaactacattgccatgtaggacttttagcttatgtggcactatattaattaagagagagagtaaagagagaaagaaactgggtctcatgcaagacatagcttcaacatgagaacctatgcactagacactatcaagttttgtattgggagagaatagtgtcttcataatagatgaagaatgaatatgattggtagagaagagagatgatgtatttattaatggcccactttaagaaaccataggttgtagagtgtagtttctattgtgatgtggcaccatagacactgcttacggatactatgggttgggactaccctaaacggtggttttgtggacgagccaaccagttgctgctaagttgcaatttggagttgtcagcctaagaaccactccttgccaatggaaaggagacttgtctaccggtgcacaacgaattcataaaagggtcatcgtcgggaaagcctactaaattatgaacgctcaacctcaccaaaaataggatctgtatgaggaagaaaaataagatcacatggctcattttcaacttcacaaagtcatttttcatcaataagcagttatgactaactgaataaaaaaactaaagctccaagttatttatctagctcattttgtacctgagtttgttttagttcttttagctctattgttatagcataagaagagcagccctcaggattctatttacaatagaaagtattaaagaacagtgcattgtttcagcattttagattaactggcagtacctctttattctccacggctcctgatctttcatttagcaaaactatatgatatatttggttcggaaagcttcagaaatataacaattgttaagactgataagttggttcaacccggcaaatatttaacacaatgggtgctatgagaatctgagttgctgtccctatataaagttttatattacatcctaatgctctcacctagttctgcaaatactttaacctgcatgtaattggtaatcaaacagaaaacaatccaaggcaaaaaggaggataatctttgtaccatacaattttccagatcacaagttctacctatgaaaccaagaatattcagaaacaccatcgtatatcatactcctacatgaatgcagcttctgtttcgaacattacaagctccgctgaaattggctgttgttctgagtccagatgactgtgaaaagacacagaggattcaatacaaagagcaaagagcattttcatgaacaaccgtcaaccctctccaacgagctcctcatgcacatacaaattcaagacctcagcgtcgatggaagtaggcggcggcacctcgatcgcactgtggctccgtttgagaagaagattgcgtcggctcgcgtcagcggccgttgccgaggccgcgagaggagggcgatgcggttgcatgagggatctgtacttatggatacagctgcatgtattctctcagccaagtcaaactcagtatgtatgagagatgcgtgccaggctaggaggacatgagcaaccaaacacactctttctgattctcttgcgataacaacaacgatcgaacgaacgatagcgtgtgttcttgtgcacgccaaatcacacaacgtgttcccgaatcggccatggagaggatggacgaaacaatcggtgagtacggaattgtcttcaaattttataattggtaactgatatatcgtagtttagttacaatgtaattacatttcgattatactatagttatagttacaatgccctttttttagatattttatttttaggttcactaataaattaggtcaatggattgattgacttaggttgtatgaaacagataaagtggtttacaattatttgatatgtcatcagataattcaattgagatatcagaaattttttgaattggtttgttcgtttccttttgcagaaaatctgctaaagataaagataaagataaatattaattgtttcacgtaaaatgaggtagtaataacgtgtgattaattgagttttaattattacaaacttgaaaaatggattaatatgatattttagaacaactttcacatataaagttttcgcacaaatatcccgtttagcaatttgaaaagcatagccaccagtatatatttttgttggagaaaagaacatggtatatacttttgtcggctatgcattgcattgcattctgatttctgacatggagatgataattgcctggcttataaactgtcataactgatatgcacttcattagatcaaattctgtaagtatagttgatatgtcttttcatgcacactccaattgaacaactgaattccctaatccacgagatgctaacaagtaaccacatatatatatgagacgtaagaaaaagtaaagaaaaactacgagatcccaacgttgtcagttgtcacgtcaggctcacgagaagctccggcttttattttctgacccttatgaaaactaaagcaaagccgtgaccgccggcatggagtccgccgtcgccggcaacgacggcgccgcgatctgggttcgaggcggccgcgtctcgtgctccaacaaggccgatgctgagagtagaggcccatctaatacattggcccacccagaaggcttcggcccaacatgccacggagcagagagcaagaacagcttcgtctcttcggtttagtaccacctcgcggattctgaggggagggaaggaggaggagcgggtataagaggagggcctgggtaacaatgcaactcatacctttctcggccttttggctaagatcaagtgtagtatctgttcttatcagtttaatatctgatatgtgggccatgtgcccacttcgatattaaatttattttttgtgggggagggcctatcacagtggcttgccactggggccctcgcgcgtcgcccaggcgttgcactgctgcccgggcctggcgcaccccaaccaaagcatcaattaaatttttaccatacaatccgaagctgcagtttcagtgaaagccttttgaagtatattgatccatataaaaaacatattttcaacatctgaatttccaatgctgtatgatgagcaaatacattaggagttagattatatttgttgttcagatcggttaactcacatgagattcatctctcgagattatattttttatatgatgctcaactttcttccaaaagattgagagttgagactccatgattattaactgaaattctagctaaacagaatgttggtattatcattcacagtgtaggtccagctatgtacactcgatgctttccatatcataaatcaccaggcaaatgaggaatagggatcccaaagaaatctgaggaagaagatgcatgtaaactgtaaaggagctggagctggaagagcaggaggagatggcacttcatcctgcactgagcatcaggatgagttgatctcgtcaagttgtcagcaacctagctctctcccctcctctctagttactccggctttgtttcgttttgcagcaacttttaggaagatcagttgtcattgagatactttgttgactatgcaagtaatgcatgcagtgtattctgatttctggtaacttgactgctagacttacataataactagagaaaatagtttgatgcacactaattaactagagaaaaactactgggcaattgaacgtcccaaaccatgagatccttaccacgtatgtgacctaaattaaagtaaacaaagctaccatcaaatatattgtcaggatcatgacaaactccagctatcagtctaccaccaatatcgtcaagctttcccagcattcagtttccactcttcagtaaaagcaagcaatgatcagtgttcatttaccagtctccaaagcaaggtaggcagcatttagcatgtcattacaagaaaaaccatggtgctactgactaaaagttacagaactaaagatggcaacaatgttttaagtgggatggtcaatggagatcatcatggcattgcagccaacacatatgaccgatcacaacgttttaccaccaccaccaccaccacttgacatgagtgaggcggcagcagcgcctgcagtcgggacgattccagtcgaattgcctggtttagagagatgcagaagcctgcagtgtgttttgcagtcaaaagtgagaaaattcgtttatgccagtctagtaataatcttgagatagctaaggaacacttagttacttacggtgctagatattcacagaacgaagtgacggctgaaacgacatcgttgtaattgtcagcagcagcaggggccgtgatttccactagctgtattgcaggagtgattggcacagcttcgttggtagcatggagttttgtcatcttgctaacagaggtaacggtcacagttatctgggcacctcggtggaaacgaaatgcaaatcctcccttcagaacttcatgatctaacttgtaccctataccgtagaagtaacgcaatacattgttgctggctttgctctctacaattgaccgcacaaggactgagatttgctctgcaccagcacctctcatggcacctccaacatgtcttatggtcctacatgaatactactggattcagaatatcatcaaatatcacaaaaatgtaaattttagcagctgaaagaaaagttaccaggatggcgtggactgagctaagtcacacaataaacgaacctctgatgggacaactcctgtatgattggaagatgtatatgagtaacaatggcatatgatcagaataatgaaaaagttgcaaactgacctagatttggcccacttttaagacagagctcatgcactctgacacgttcttttgggacaccagagaggccctggagaagaacctcaagagcatcaacatgctgcataacaagaagatcaaccaaaagttacactgatgtcaaagcaatgaaaactaaaaaaggttaaatggtgttctaagcacaagacattgacatgtgtatataaattaatccctttattgtaaaattacaaaccatataagtgatatgattcctccaattgtatataaaatagaaccatatcaacatattgaaaagagaatcaaaaaaagtctgcaagtggcagaagtagtgccctcagagtggagaaacatggttgaccatatagtggtcagcatgatcaactgtatactttttttttattatcctgaagggaagtgttgatatgctgacaagaggaagctataagagactaacaaaaggtcatatagagacaatggatcgacgacaaagtcttaatgctggcatgaattattattctctattccctgatgtgtttcgttcaagaaaaaagaaattctctatggacataaagttccaatactacttcatgctatatggagtgaaaaaataactttgttcctaagtaggactattgagatgtaatttgacattggggctatgcagttgatagatttgctacctgggatagcttaagtgttacctttcaaaaggttttatcacaattacatttacagaggtctgttttcaggcaattgacacctccaacaacaaaaatgctatcttaaatcaagtgatagaaagttcatttagtaaacgtcgaaattctacattccaactcctttggataaggttactacaaagcgaaaggccaaataaccttatgccaaaaattaaataaaattcagaattctagatacaacatacaagtaaggagcgcaaatgtcagatcagcaaacttgactagtaccgatttcccagaaaggcctaccatcatacaaaaatcaagaatccatgaagaacatcacatctaccatcactccggcttatgttacgggccatgtatgattttccgggtaaaagttcaaattggtcatgttttacagcataaacagacaaatcagtttcatatgaacaaaaatgcatcgttgcatagctacagatcactcattctcggaagaaactaccgttcacttcaacaaccgctcacacagtcaccactcatacaagtctactggcgaagtgagaaagaagaacaataacctgggtctcgatgatcccctgcaccacgcactccatcaaccccaccgcttctcgctaccacaatccctgcaagagagacaaaccctgaaaccacgctgcggaatttcgtcgaacagctacctcgcagcaacaaaaattcacccccacctttaacctaacagcaataatccgcggcgcggcgggggctgaggcgtcgggaagtgagccgatccgaggcgcaagagctccccccacctcgcaaaccccgcgtccccgaacactcccctctccgccactgaccgctcgccgtcctccgccgcctcctcctcctgcagcgatggagacgagaagaaagaattccgagaaaccgaggggggtaaagtgataaaatgcctcacccccgcgcgaagggtcgcggcgtttttgcatctaggcccctggaagaatctgaaatttcagtcatacccttcctctgacttctcctcttcctcttcctcccccacgcgctcgtctcgtcttcctctcgaattcccattttcttccacctcctcctcgtctcgaggtctcagatccaatggccgcgacggcgacggcgacgaccaccgcgtagagcgcgtgagagtctgcgtggacggctaactatggcctcgccggcgggggcaatcggcggcgcgtcgccgtcggggcgggtgctgggccctgcgctggaccggatcatcaagaacgcggcgtggcggaagcactcgggcctcgtggcggccgccaaggcggcgctcgacctgctctcctcgtcggcgtacgcgtcggcgtcggcgccgtcgccgccgtcgctgctgctcgggttgccggcggccgccgcggacgcgtgcatccacgcgctcctcctcgcgctcgagtcggcgtcccccaaggtcgccgacccggcgctcgactgcgtcgccaagttgctctaccaccgcctcctcgtcggtgatctcggcggtggcggcggcgacgacgactccccgtcctccaagctgctcgccgccgtgctctcctgcggcgcgctcgccgacgacgccatggagctctccaccctccgcgtcctcgtggccgccgcgcggtgcccctccgtcgccatccgcggggaagggctcggccagatgctcaagacctgctacaacatatacctcagtagcagcagcggcgccaaccagctctgcgctaagctggcgctggcgcaggtgctggtgatcgtgttcgcgcgcgtggaggtggactccatggatgtgcgcgtgcgcacggtgtcgatcaccgacatgatggacatgtctgaccgcaacctgaatgactccagcattgtccatgcggcgcagagcttcataaacgagacgatggagggaagcgatgtccctgagccggggtccccggttgagccggccgagacggatgggaaggaggatgttgtcatgagcaagatcagggaggatgggttgacactgttcaagaacctgtgcaagctgtccatgaagttctcgacgccggataatcccgaagatcaggtcctgctgcgcgggaaggtgttgtctcttgagttgctcaagatggttatcgacaatgctggggcattctggagaacgaatgaaaagtatgatatgatactcattattgtcttacttctgtgcattttaacagctcaacttgctgtgttgcctatctatataaatattgttgttgcagtgatttagaagaatgcagatggcttaaatgactaagggaaggaaggcataaaatgttcagtatagtaattgatatggaggcttcatgtttgcctagtagtaactcagaaattatggatacacatttttctgatactaatacattattttcacaatccaggcacgctttactattatctgcttggatgtgtcaacattttggctatatttttttaatgtattatgatggatgaaaatttttctagggaaaaaagtgcagagtttaatctatggtggtagatacatgtttacgtgacctactattctgtatttgaattgccattggttcttttaaaatgtttcaaatgatgtcctgatgataatctgcatttgtatgttgttctcttaatttgtttaagtctcttcactaactaaaaaaagaaaataattaatgagctaacaatacactggaaagggaataaaaacatgaagtgttgatttatgagctccagatgtaacatgatggccaggagagggcacaagcatcacgatattttatttataacattaggagtgactgaactttattccgttctttttttccttcaaaatatgctcatccatctaatttgctatgctgaaaaatatgattattgttcaccaagcttcctgcaagtatacggttacaatttaaaaccttttatgtttagggtattccataaagagcattctgtttactctgactccaatgggtaataaaactcttatactgaagtgttcttttctcttttttttttcaatgcaggtaccttggagcaatcaagcagtatctttgtttgtccttgttgaagaacagtgccttgtcagcaatgagtatttaccaactgttatgctccatatttttgggtttgctgtcaagatttagatctgggctgaaagaggaaattggaatattttttcccatgcttgttctgagggttcttgagaatgtccatcaacctagctttctgcagaaaatgactgtactaaaccttttggagaagatctgtaaagactcccaggttattattgatgtctttgtgaactatgattgtgatgttgatgcaccaaatatctttgaaaggtatgtagttttgttcttgatgaatggcaaccttaagttttgttgtcacagattattagcagcaggtatgcatctatttagtggcctgtaagtgctgcatgagaatcgatgcattgaactgattacagttctgcaaaaattaagttcactctctcttcatcatagttaaaacaaccctttaattccaacagatctttgcaggattgtcaatgggcttttaaagactgctctaggggttcctcctggatctgcaacaacattaacccctgcacaagaccagacatttcggattgagtcagtcaagtgtcttgcaaccataataaaatcaatgggttcatggatggaccaacagctgaaaattggtgaattttcacccaaaccttctgaaatatctttaaattcgatagacattcctaacatccttgttggagaagatgggggtgctgttgattatgaactgcaaacagactctggtaacccagacctatctgacgcttcctcacttgagcagcgtcgtacttata

SEQ ID NO: 66527 - DNA, 701 bp, Oryza sativa
agtacaaaatgcagagaagatccaaagaaatgaggtagaaagtggaaagtgagagatacctgagatcctattccaatgctccttgaaactccgaaaagaacagtgtaatacctgcgcagttagagaagttttcttaagtactcgttctaaagttagatttgctactctatcataagttcaagattaaattagacatggcattagattgtttaaccaatacagataaacataccgagcttcagataatccaaagtggttcagtagaactccgctgtgagcatcaacattaggccatgggtttttgacctgaaaatgtgaaggatgttcttatttcttagccaatgagatggaagtaaactgaaggagccgtaattaaaggagcaataattattgatcaatctagtagcattaccttgccaagctcagtgaggataggaggcacaacttcatacaacttggagacctgaaagaggataggtcgatataaatcctattgagacagtgggactgaagagagccatgcagctagaatttagactaaccagttggaaaagtggatcctcaggcaagtacttcaaagcaaactccctctgacatgtataccgtggatcggtcttacgtagaactccatgaccaaagccaggaacaacctacgaatgaatgtgtcatggcatactatctgtgaatttttcagttagagt

SEQ ID NO: 66528 - DNA, 827 bp, Oryza sativa
tatagttaagatcattaagcaaataattctttgagagttatctcttcttgatttggtagggtgtatagcattgactttattatgatctccacaaataaattattttaacaatcggtaaacatatagatagtcatgtagatatgaatatattattgagggtgtacaatcatctatataataaagtttgattaatcacttggcagtaacttttcatagcaacaagtgtgtaccttcaattacactattaaaagggacactcacttgtaatttatggttgtcccccacaataagaggttggtgatttactcccaggtagaatatgcactcacgacagttagcaatacaaatccatttagcagctgcaataatatgaactctttcacaatgctccaccttaacaacctgacaacacaaaacatataaagtataattgtcaaatgtacttagcactttagcagaacagaggtaataacagcaaatttgaagtgacaataaaaaagtgtttcttattttccacttggggccctttattctttgttaatgtacagcctatcttatattatgtttaacagtccaactcaacgcatgattaaatctatttgataggaattttccaggaaaagactgtaaaagagtagcaactagcatgtcagtttttggttcacacaacaatgtgtgacatctttcactgtctattgttattattatcatcacctcctcttctatttggacaaaatactcagcactcatgtaccattcaggtgataccaaggcatacacaattgaagtctcaaacagatccggtgcagctaaaatagtctggtggc

SEQ ID NO: 66529 - DNA, 861 bp, Oryza sativa
gttgaacgatattcagataatgacatatacaatgatgatgaagaggaagctaatatggaaacaacatcatacgctattattaaattgaagaatcatatggcgcagcagctcttagttgttcaggtacttacagtttttgttacttctgtcaataattcccttatgtaacatgccctatatttaatttaatactatactttcctttggccatccaactaaaacagtaatataacaaataaaaaatagtcttcccacatgttctacatgccaacaattgttctaagatcaaactcaccactggtttcttttcagggcatagttaaattgtatgagacacacaggtggtctttttatgctgagcatatgggaataattttagagacactatcagccattgcgtcacatgcaagtgaagtgagctccgaatctaccttgctcatgaaattccataaagcatgttcccttttggaggtgtctgagccagcagtcattcatttcgagaatgagtcttaccagagctatctcaaacttctgcaagctttggttcatgaccacccatcaatctcagaagatatgaaaattgagtcacatattatgcttgtttctgagaaaatactacggaagtatctcaaatgtgcagggcgtgaacgatctaacgattcatctggtagagatccagcattacgctggaaactgcctttgggcactgctaagaaggaggaactgtctgctagaacttcattggtccttcatgtgatgcagttattgggtggcctagagagggactgctttaggagaaacctgcccctgtttttccccttattaactaacctcattcgctgtgagcatagctctggagaa

SEQ ID NO: 66530 - DNA, 4237 bp, Oryza sativa
ttgctcagactcatgaactttgcgagctaaatctcaaatactaattcgtaagcttgcatatgtatgcaaatttctactgatatcctagtagactagcactggatttttcataattcggtcctcttgagaaacttatttcgcaaatagactgctagaaaaacttatcccagaaacggtcatttttagggcgctgagtcattggcgccgtggtccaatggcacagcgtaatcatctctgccgtcgtccccatgccactatggagggtcggcgctagggatggcaacgggtcaggtcaggcacgggtagagcaaaaccatgcttgaccccatgcccgtcttgcccgtccaaatcctacccactagggttagcgggcaaaactctgtgcccatacccatgcttgatgggcacgggtatgtccggcgggtacccaatgaatctcacgtaaataataactctaaagatatataatttaacaaagagaaataaaattaacaatttaccaaattatcagttatcaacaataatttgaattacattacaacttattattagttagtatcacaaatgaaccaagagaaaggggtataagaattaagagataagtcaaaattagctaatacatatgtatcaggtcgggcgtgggttacccacacgtaaaaaatgaaacccagccgttacccacgatatcttcgggtctcgggtgggcgtgcccatagataaaaaatcgacgcccgtacccattgggtcgggtatccacagatacccgaacccatgggcaaaattgccatccctagtcggcgctgacgtggcaggggaagcgcgccaatgtctctgcccccccaccccccacccccaccccccttttttttcctttcctctctactgtagaagagagatgtgcaactttttttttctttccttccccgttagaccacggtgccaatgactctggtgctcaaaaaggaccatttctagaataagtttttttaaaggtctatttatgaaataagttttttagaaggaccaaattatgaaaaatccagtagactagcaggtatccaaatgataaaacaatatgaggtgtatcaaatattcttcttatccctcattatttgttaatgccaataaaattacaacttcttaaagtaaattttatataacctcagaaattatggtcctagatacacggtgacgtacaatctgagctcgagcctgatcaagctttagctgagctgagctcaaatccatcccaattgagtttcgaggttgaaatgctcaaacttgtgccaagttcgagcctaaataattggggtttgcctaagctcggctcgttgacatccctagtttgagggatgtagtatatgtaccgcccatcaccacaaaaataaggagtgggttcctcatagccaatcaagaatcacccatgatataataacaacaatggtcaatgctgataaacatgtatcatgtatgtcactagaagccatcatcctctactttttgttttgtaccatgcaagggcccaaccactcttttgtcaaactaatctttgataccttcgaagtcacaatccatgacaaaaacatcacctaattcctaagttgaaaatcaccgcctaaccatgcatcaacacgcaattttcaagacccccaagaaattgacatctatctttctttccaacatggccagtaggccatcactaccagcaaacataattatattactatgtaattttattcatcaaaattaacatcatttttgtacattcttgatggaaagcattacgcaacaaaagctagcaaaactgagatatacagattaatttaagctactgcacatcacaggatgagtgaacttcgtaacttaattgatccactaattttttgcgaacgcgcaaaaggattgcacgtcaatattagttgatccactaattaatcgactaaaattcactagcaagctgatgctgtaatagacagcaggtatgatctcttgatgaactccaagcagtcggcaatggcctccgcctggaaagagctctcgccgccggcctccgccggcgccgccagccgccggcgccggcagtcctggctcagccgctgtgccctcatcacggtggtcgccgccgccgccgccgtcgccggcgaccacctcctcgggcagcaattgagctcctccaggcaccggagcagcagcccgacgacgccgaacagcctcacccgcagccggagcaccgagcccagccggacatgccgcacccgccgtccccggcggccggtcgccggccggcagctgatgctgatcacctgatgtgtcattacgcaagaagaagaagatgatgatggagaagaagaagaagaagctacatctcttttcagtttcactgacctgaaactgaaactgaactgaaaatgtgcagaagatagctagctgtggtctactgcttggccatggatggcctcttatatagcagcaaagctgcaacctgtcactctgaagttatttttttgtgaaaaaaatatattaaaattatgtgatctagaggtagtacacaagtacacaacacacttggtgtgggcccaagctggcagccattgtgcttctttaatacattatcacctggagaaaccacttgtcagttgtcatgctgtgtaggatggatttctctctcttttttttctctcttctcatggccttacctgccctttgcaatgttttttcttagttgaatatatagacatatagttgatgtccttcactagtaatatagtatggctacttctgccctctgaagatttggacattcaggttttgtggatggagttgtctatcagacgatgttaaatctgcgtgcccctaatggtttcgcgcattgttaattcgacaaaatggagattacaatagtgaggattaagagctcaacaatatgattttgctcagatgtttaccaaccttgtacttgtgagttgggaattctgaatatttttgtgcctttgttttgtgaggttgagactttgtctgatcactctcagcctcacacctctgttgcatcactatccttctggaaattgaatctgaaaaatggcaactattgctatgtgatttcgtcatgtcctgcactttatgctggcaatggggaccttgatgagacatgaacaaaatttaagcatttttagttccatggcaaacatgttttcgccatgtcggcaaaacaaggttgtaactaaaatacgtgatcttgggcccacttgcatgacagttttcaatcacgttttggtgtttgtgacctgatgggattaatatttaaaaaaaaacagtgtgaattatttggagaatctatttcatttatgattatttatttgaaacaaaatacttttaggattattcaattccaagtttagtttgtttgtatgtcgattcaggaaaagaaaaaaaaaccatagctccactaaaatttagcaaatgatcagatcaccactaacatgagcatatgcaaccaaattaagaacttcttattgctttttgataataccgaaggtcaccgcaatccacatcgaggagttatagtcaaaccagagtacaagattacaacattcaaactctcaaagcaaagcctaataaggctctgcttcttgtctaagctttagaggtttaaagcttattttggcaaaatgtcgcatcgttcaaacaagtcagtaaaagaaatgcagcattgcaccatatgaatactgcttaacaaaggctgcttaaaagggaagttgtgcagcggatttttccattagcagttcagcttccctgttaaaaaaaaaagtgtgattaaaaaaaaactgacaaagaaacagaacctgtggtaacataataagttaaagtattcttactgcgtggggtttctgcgtgttgctttcctaagctttaggatagatggttttgaactctttggcacttggggagctggttccctaaaattaacgaaaaaggaaggtatattgaaagtcgtgctccctccgtttcaaactattagtaattttaattttggtcaaagtcaaaccacttcaattttaactaaatttgtagataaatatggtaatatctataacaccaaattagttccattaaatctatagttaaatatattttcataatatatttctcttgggttaaaaatgttactcttttttttctacaaacttagttaaacttgaaacagtttcactataatttgaaacggagggagtacgtg

SEQ ID NO: 66531 - DNA, 732 bp, Oryza sativa
ttaccgtagtagtatacccaatcaccccacacttagcaataaactaacaaatcctgatttttgtgtgttttcggtcaactaaaattagtcatataatgaagccctgcctgagcaaaatccgttgtagtctagctggttaggatactcggctctcacccgagagacccgggttcgagtcccggcaacggaattgtttttgtttttcatcctttcgctttttttccccacaactttttacgctattctaatcatacaaacgaataagcatatacataggaccgctttctttaaaaaataaaatatacatgtgaggaaaatggattgttattatggattcactccatctctaactacaaacattgacatacccgagttaatattcatgttcataactagaatttgatttttttttctccgattgagagagtactaagtaaagaacaccagctttcgctttttctttccaaaactttttacgctattctaatcatacaaacgaataagcacatacatagggcagctttctttatgaaaataaaatatacatgtgaggaaaatggattgttattatgtattcactccatctctaactacaaactttgacatacccgagttaatattcaggttcataactagaatttgattttttttttctccgattgagagagtactaagtaaagaacatcagctttcgcttttttttccaaactttttacgctattctaatcatac

SEQ ID NO: 66532 - DNA, 2420 bp, Oryza sativa
atggacttctcggtagagaattccagtgaagcagatatattctgtgagatccaatcatgaacctgggcagcaggtacaggggcagcaggcatgtcaggatcagaatttgcaaaaaaagtggctgcctggcttaagggtgttccttctgagaacttcagtagaaatccaaggtgttcaaatgtctccatggtcaatacctgcacaaaaattgtgaaatacagttattttacattctgaagtgtaatggtctaccaaagcccaaccacaaagaatcctaaggaataaaaacctaaataggacgcacaaaggcaattgccttcagaaaatgccctcaaatgtaaggtgacaatgtgacatgtatcctaaatttaacaaaaagatgagttcttacttgggccagatatatctaactgggtcaaatatatgctacctttatatttgcttgtctatatattagtttttaaaaaagaatctgctatctcaaaacatctactgatgggtggtcttcgttttttttctttttttgcagggcaccttctgagtgaagttaacacctaattgaccaaaagcatactcatacatcacaatatatttagaggtatacttgtctgagaggtaggtttgcatataattttacaggatcacggccctggagttccaggcatccaacacggagatgtacttttacgggtcgattctagtgttttgagatatagaaaaacaaataaactccattatcagaacatgctatgcattattctgtcactcttttcccacataaagcttcactctactaagaaaacaagatacaaattgtcaaacagaagagtaatcaagtggatatcacaaatagcaacaagctcggcaaacttaaaagaaagaaaaggctgcgtaccagagaatcatcaccttcgccctcaacagaatcggccaacagagtaagaatattggccatatgcttttgcagataagatagctggtgaatttcctcatcagcttgagaaggcatgaatcgacggctattactgcgtacaagctgcgaaataatataaatataaagagtaagtgaaggaggtaccatacgactcatattagcaaaaggaacagaaggtgtttttatgtcttttgcttgatctgttggtttggggaagggaaattgggattgaccctaaatgtaacacctagaacaattttaacatgtaactgaggttggtagcgtaaaagctttaaatacgagaaattgaataagtaggagaaatcttgattttacaaaaactttatacaaaaaggcatgaatactaaccctctgtagccactgttaccacccaaaccagaaaaggcacagggcataggatttcagtttaaaaatattgctgatagacgaaacagaggtttagcagctgggaattttgtaagtcatatttgaatgcaccatagtctccaaattttgaaatttgagctaaaagagtggaagtaaaatattgtgcctatagtgaaattaccaggtttgcatggttccagatcaaatcgaaagaattaagcaaacatacaattgactgaatctataacaaaatggtcacaacaatgactggtcgctcaattatggcaaagtctgtgtgcttctgagtttactgttagcatacaagtccaaccatcatacgtaatttgatgcaaccaaccattcatttctgacggccaccaataaaaaagataaccttaaattgaagtcaagaagtgaccccagcatacggtaccatccatagcatccaataagtatcagcagctaggatcttcctttgcactatatatctagagctgcacgactttttactgtggagcatttcttatagctcgagtgagttacatcacatatcaatttttgttgtgacagcagataaacggcagcatcagctgcaacatgaaggatataaggtggcacaacagccgccttgtttaaatcgacggcgatgttctaagctcaattgggcacatgattaaggctaagcaatcacacatccaaggtgttctctgctgcagaggaatcatgggagcacccaaattctaattataaagcaacgggggggaggcctagatccctgacctggatcggggagagcgcggagaggtagccgtcgaaggcggaggtggagggccagacgtcggtgacggcgggcgagtccttgtgcgcgcggggcacgaggcgcttgtacgactggatgtagaggaagagcagcacgtcgcggaggtcggccctgcccccgccgccggagtccagcgcggggtcgtccgcggggagcaccgcggcgagcgtggcgagcgcgagcgccgcctgctcgtgcgggatctgcagcgcctccgcgagcgccgccgcggccacgcggcctcctccatccgcggcggaggcgagcttgtccttgacc

SEQ ID NO: 66533 - DNA, 3121 bp, Oryza sativa
tgtttggtatagaaccaaacgactcgtttgttagagctttaaattctaaatttaacttcatgaattgggtctagtataaagttgtggggcagtataaatctagctccacccttttagcagtttcatcttttcacttatgcttatgcttattagccaaattttgaattttcaacgttaaatttggagttgattttgaggttttctcatcgaagtttatttttcaaccttgctttttagatcgttaagaacacgtatataaaagttttatttgcagattatttagcctagttcattttgtgagagcgctctagccagctccactccaatttagatgaaactgaaattgtttggttaggcttaagatccaagagagatgttgctatatctggagctgcaccaaatatgcccatagtaataactaggtgaaaccccgcgcattgctgcgggaatttaatatgataacaaaaaaaataacgtgtaaaataactagataacatcagattaagtaaattaatgtggtttatgataatttaaatttaaatagtatgtagaatggttattcaaacgtaaaaagtaaggtggtatgactttatgaaagaagaaaagtagggagatagtttggaccgtaaattaatcatctaaaggctaaaaataattgatgtgatatgacttaattagaggaaaaaaggagaaagataatttggaccatagattaatcatttaagcactaactaagtgaggatgaactatataagtatataggatatcataaaacataataaaaatatacattgaaacattatgtgaattgtgttgaatgataatttaacatgtttgtatttgaaaagctcttaaattataaaaactataaatatatagcatgtttgcatgatgtttaaatgtgatgattgttagtggatgatgatgtgacatcttgttaattagtggattagtagatgatgatgtggcatctttgcatgttaagcttaaggagttagtgggggataactttatagtaagataggataaatgggttttgtagtttcagacatggcaagaagagttgatagctctagcaatccaacgttggttgttggccaaaatatggcacatgtaaggccatgtacaagtgtacaacccgtattaaatcataagctattaaccttgctaattagaaatatttgtgaaaaaaaataaacaaaatatcgttgatatagttaacaacagcacaatattgattcttagcacttacagaaagaaaacatgattacatgagggtgagaaaaaacaagaaagaacaacaataaacaaaatttgagttttcgtcgtctcaactattatattgtaaagatattatctctaaataatttaagagatcatactaggctctactattgagtatgtcctaaactgtgttttttatatgaggaaacaaatggtttaatctatcatttatcgatcaaaactggtaataatttattgataaattttttatagtcatatgattgtaaaaataaaccatgataaaataattatcaaaatcagtttgaaaattaaatatttaaatttaaattctggctacgggtaataagccaaaagacaagcaaaggagtagtttatactttttgtagaaatataaaagtttccagttacaattttgtggcatcgaaaatattctgatttattttaattgcatcgaaattagctatttattattttgtttggcagttcattttgtcgcggatttttaactctcaaaatttagcagtaccaatgtttgattaggtagcaaactaagctactcttagcattattacctttccaaattttgttagttcagataatttcctttcatacgaacactatcaaactttgctaaggttgtgttttttttttttggggaagagctgggaattactattgctcaaccgactgctaaggttgtgtttgttgttacatttctcaactcatcttcctcgttttgcgcgtacatgctttttaaataactaaacgatctttttttaaaaaaaatacgaaagttgctttaaaaaatcatactaatctattgtttttaaaaaaactagctaatattttattaatcatgtgctaataagttatgcgtaggacaaactaactcagcctaaaaagttgacaatggccaaaggtgtcaataccaaaattgggtatgaacaagcccttagttacactggaaggccgcatttggacaacctattgttgaaatttctagcagtccgaaaaaaaaaagttgaaaaacaggcctaattttggaccgaactgaggcccatagagctgatgcctgatcgtcgctggcccgtgggccgtttcccaactccaaaacccacgctcgctagctgatgagaaacggcatgatgggaaaagagaaccgaaaatttcagaacattttgaaattaattatgttcaataattttgtcagtaattaacttaaaattacattttcctgtcacggtttcaaggagcatgcaggaaatatatattcattttcttagatcgaccgagtagaagattctaatttctaaaagaacaaattaagccgtcgctttattacaagagactccatttgtggttggaaacagttgcttttgtaatggtcaagttcttttcatttttcaggatccaagacttgaccctaattaggacaaaactgaattttccgtgcttgtgaaggaaattcccacggttaattaatcgacatcgatcacttcaattcagattggctcctattggtcaattttatttaggacatcttttttagagctcttatacataggtcaataatgtcgttattgcatttgctgttttctgaaatcgactcgtacgtgatcgttatatatacactgaattggaataacttatcagaacacagaaaatccatggaaaacaaggcaattccttcagaatcataacatgggttttccaatccaataattaaacaattagacacaatttagcatgcatccatgtgaaatgcagagaccatatattgttcctgtttattattgtagagttgactttaattagcatcatctttgtagtgaccccaagaaggtcaagatatgttctccctgaccttttgtatctt

SEQ ID NO: 66534 - DNA, 4396 bp, Oryza sativa
gtacacatttgaagtgacaacttatatcatagttcaacaagcagtttgtatattcttctgttcatccatgttttttttaattaaggaggggatagattgatcctccgtatgcactgtcacgacattatgttaattgttatgatccactctccctttcagacgcgacaacaatttgtattaaattgattgctagttagtcgaaagatagttcagcacaaaaaacatattatcataactaatttattttcaaagtataataaagataggagcttaattatgccaaacaaaatctaaaaataagggctggctgctcggaatgtaggattttcttataaaatctttacaggaattagtttaattcataagaaaattcttagaaaattattcattccaaagaaggcctaaaactataatatcgtagacagtaggatttattcggtttggaggaatttcaacatatagaaatagaaaagatagagaaatagaaatgaacacgcacacttctattcgaaagaatttttcaagaggtttgatcaaattttttctatgtgttctttttacaacttgtacaaaaggaaaacttcttctgattttcccatatttacattcgtacaaaccgagtaacactcaagaactttttcagcaaaatactcttaacaaaatttaatatcacacatgacaaaaagatatagtatcatttgtaatttaatatatctatctatccaactcaagggtaggttgattgtgcaatgttgcacaaatgcacacgtctccatgggttgggtggagtcgtttagttaggttatgtgattagctaggcaggcaaattaagtgatctctcgatcggcaggtgatttataaatataatggccggcgactaagcaaaagtaaatgacatgacatgacagccgtggacgagaaaaccaatacgtcagcatgacatcacgtgcgatccatttcttttctaagattaagatattttacctcggtttcctttagtacgcttttcaaactactaaacggtgtgtttcgcgtaaaaactttctatacaaaagttgttttaaaatatcaaatatatccatttgtcaagtttataataattaaaacttaatcaatcatgtgttaatgatttttcttgttttacatacatcaatttaatttttatcttcactagaaaaattgttcgtgcgttgcaactagtgaagtctattctaaccttattactactatatggtttagataaggtgaaattcactgtggcaatttcatttggatgtattttctttttaaaaattatgagctatggttaggagtctaatcgtttcgagttagtatatatgccagttttttttaaaagagatttcttatatgactgcttttgtatttgcaaaagtgaactaacttaaaagtcgactcaaataagtacatgtatttccaaaaacgaacgaatttaaaaaccaactcatatacggatgacgtactaaagtactaataaaaaaacatctttaatttttataatagtagagatcagcttcaaactcggattgaaagcctccattgatgatcactcaattcatcaccatcgagaggtccatcgatcctcagctatagataagctgtacaagaaaatcgtacgacgccattgccatcaattctgtggagcccacataagagatgaattgacacgtcagctaccggcgtctaagtacgtgtattaggtacgtatagtgtatgtacatgtacgtacgtgtacacgcacagtttatctagtgttgcattcaggcattcagcattgtatgatgtatgcaaacgcaaaggagtcgtccatatctgacgacacaagcaggcagtacagtttgaaccatatactcctgcacgtacggacagataattaatatatactatagacataattattttttaacaaagtaagtgtacagattatatataattaatcacggatcctaattaatacactaatgtacttacctgtgtatctcttaatttatatataccaattgtgtgtgttctggcaacctaatatttctggttaattgtgtgtgtgatatattcatatatatatatgagtttcttattaaataatcctaagggagatatatatacacacatgcagagcagaacgagattaattgaactggcagtaacagagatataaaaatatatatatgcacgctatatgaaacaaattaaacaagagaaataaggtgcttttgttggctggtttcatcaagtattagttgctatcttctcttaatttaattagttgtttaggtttggtataagaatatattatatactgaaattggattgcatgcatgcatatatacaagggtcgatcatgtgtactaatgctagatagtagctaaatgcaatgcatcattagaggtcaactcattggcatgtattttagctttgacctttacctgtataataatgtgctcattggaagagaaaggtgtagccaacaatgcatgccaggtctgttgctggccagagaagaatcaaacccaaattttgcatatttggatgctgaacatatatacaacagaccggacatagtgcttcatgggtatctggaatttaatcatgtgtcttactaattaattgacattttggaaggatcaaccaactgtggtgtctccagggcccccttcttttgtatccaagggaggaaaccctattaattatgtttatcttgtaataacacatcctttaattgttttctcttttgagtggctattggctcctgaaaagggtggacattgtggttggattaagacactgatgtttcttaactattattgccatcgaaccattacaaaagtacacggtagggaatttgaaattatatatgttcataccgtgtacttttaatttgtaatagtatgtgctatatatacagcaacataaatatatgtttacacaatccaattgataatcaactatatatatatatttgcatctcccctgctctatcaatatacacaaaggcaaagcatatgccttaattaatttgcttaaaaaatatatactagtatatattagcggctagtccaaaccatactttgttttcttgcaggacccaattaattcccaacctaaatcctgccaaaacacaacaagttgagcaaaattaattaacaagaagaaacagtgataatacttaatttcttctgaacccaaaatacccaacaacaatacaagcactagataaccttctttttttttcttcaaattgacttggaccaatgatgaaacacgtaaagatcaaacaccaattaattaacaaaaatcaatataaaaccgcgctccaaaaccagtcgcagagaccgatcaaccccgatccaatcacatatcgtattcgacctttataaaaaaagtctaattattgcctagctttttccatggccttgtaaccactccccttatatttcttgtacaagcactccacctcaactaagctagctactacaagtcctaatacttttgctacctatagctagctagcttccggtcagaagaagctaaggagaattagaagctatgtctacctagcttggaggaagaagaagaagaggaggagggattgcggcgcgatcgatcgacacgcgtcgtctaccgataaattcctcgcaaaatcaatcgatatcatatcgatcgagtctagaggtgatgagatcagatgtgaagtacttgaggagctgatttggtgataggatcgatttaattgctagctgaggtgatcatcatcaaggagaagaaagagatagtttatttgctactggggatcagtgtgtttgcatgggggataggccatggcagcagcagctgcagccacatgatcagcaggcggcttcttgctcagtcacggccgggatgatgatgcaagcttctgcgacctcctcctccatccatggcaacaacatcatgtaaaaaccctaactcctatacgacttgtgcctttttttttcctccctaattcgatcttgttttatcagaacaaatttgaagcaccttgctcaatgtttagcttcttgatccccttttttgtcttatcatcagaactggagctttaattaactccacaattctctctctctctctctctctctctctctctctctctctctctctcttgatgctgtctttcttggcagtttaatttgttgtgtcttttacttttctttcgagattatggagtgctggtttgaactttcaagattacagaattgttttgcatgttttaatttgtatgatgcatgaatgggttgattactaatggtgcatgtttgcgtcaagataagttactatatcctggttattaagggttttatttggtgtatatttaagcatctcttaattaatttgaagagtg

SEQ ID NO: 66535 - DNA, 2125 bp, Oryza sativa
gaatgcattaattgcataaatgagagtaaggtggtgtttgaatctcctgaagatgaagatgaagataacgattaagtgttttacgcaaaatgaggtggtaataatgtgtgattaattgagttttaattattacaaatttgaaaaatggattaatctgattttgtagagcaactttcatatagaaaatttttgcacgaaacgcaccgtttagtagtttgaaaagcatgccacaagtatccaaaatttcatccaactcttgttggagaaacgaacgcagcctaagagagaggagatgaaaaatttagccaaccttatagctaatctattatacatgttaactctaatgtgggtttataactagcagttagctctactattaaacttgctctaaacttattcttacatagtttttaggttgttgggttacagctggaagaaagtatgaagtttgtccaatgctgaacttattgatgtgctattaataacatactgtgctttgattttaaccttttactatagtcaaatttctccttttctgtaccaacaggttgctccatttaatacctactacccacaattgggtgaacatctggcaaaagttggtgtggatcctgcaatcaataaatgggaccagccttttgtgttgggagttgttgatccgcacgattcattatcccatcccgcgggggtttctgatgttcaggctgaatctgcagctcgtctagatcctgatctattcacaaactttatggtacatcatgtatattttgggccttctgctttgctaaacttcatgaatataggaagacagatagacgaatttattcaatctgcaccatattattttctgctggctgtcttgatgggattggtgcataacatggcatacattaaaactcattcattcatcttgcttgcattgtccatcttatccactgcacttgaatagagaggccattttgcaaacacatgctagtagtggtggtagggagctgctactttgttaaagtaggagctggtgtttttcttttataatacagctaactttttttttctagtacagtgttgtatcatgactgttttcctcctgcagattcctagttggtttgggactgaagtgcaagaacctacaaaatgctgtccttttccattgcctgaaatttattgtgcatcccagagcaaaaaggtatggtgcattgttaaattcatcaaagcttggtcttcaggtgctcttgctctgacttgattaattctaattatgtcccctactgttcttaaaaaaaactctttaaaggtcattgttcagacttcggactacctgcatgtgcattgctaatttgtctatacttgcgctggtgcctactttagaatgaaccctcgaattttttcccactccatgactttgtgggcttgtggctttatgtacaaattgaacaataccattgaaataattggtgcttcgatattcttccacaattcgcatgtctaaattgtagtagcttagtgtgtacgaatctagctgcattagggatgctggagttatggagcacaagatctggttattatttgtgaagtaggagaaaaatttgtcctgttgtttttaccactgacatttgcctcatttagatttttctaattcaactctgtgtttacaccattcatattcagcttgctgcactggaagatattaggaggactattcgggagctgcaaattgatgacaataggaagaaggaattgacaaatgccctccatgcacagttcaaagattggttatatggtaagttttcatctgtacattcagttgctaatgcattcatatctcctttatgcttgttttagtgccatttgcctatgatggttttgcctaagtcattagaattgcaccttgctttctgaaatttagtctcttcaaagaaacagtgtcaagaatcaaattgtttgctttgaccatacaaacaaatttgcatgaatggagcgctcagtaatgagtaattactgctcagcatgaggattcttatgtactgttgggtagctacaatcaaatgtgcacactaatacagtacaaacctgtcacaagaatatatgattgggtcaacctagtagcttcaataagtgttttttt

SEQ ID NO: 66536 - DNA, 6457 bp, Oryza sativa
gttggaacggcgctggtacttctcaaagaccacgtgcttgatctgacggggcagccaagcatgctactgcagttgtcgtccaatgcttgaatctttctgccatagtcagctttgtaacagcagaccacttttgttggtcgcgttggttgctgccactcaaagagcaccgcagtgcccgggtgactggttttcagtcccgagcttcgctccccagaggatgggatgtagatcgtgctagagcctagaggaggtggctggcgccgcagtgcagctgtgtttgctcaccagaggaggaactgtaagggaacaagaggaagtcggttctggagatggctaggggcggtacgatggctattgaggatagaggagaggagagtggaatgatggtgctggaggtgaagggaggaaagaggcgcggccatgcggtgctggctaactcagttgggggagttggcgatggaggagagggtgtctgcggctgggggagtttctggggagagttgttgagatagctagtgttagcagattgtagatgggctgggcctttcccagtggagtacggcggtctggcaggttgtctggtaatgtggtatacccgtgctgtattgatggaaacgaataggagatgttaattagatggaaaatctacatcgatatggcaacagtattcagtgcttctggcaagctcaccaggctaaaatggttttctaattagataattttggacttcaaaatgtatgtgaaactttttttaggatcccattgcaacataccggcaatcacctacgtatgtgaaactaattctttgagtttcgttctactttatctttttcatgcacatcattgctgatggtatatatggcttgctcaattttggtgagctctgggttcccctaaatcacattttgttaatttttcagcttcaggcaacatccgccagctctactgcctgcaaggcgactgaacatgcgatcatctgctttcataaaatggacctgtttactcaaaatattcgaccgtgtcggttgaagctgaccttactcccaggtgcgaaccaataatgtaaaaaaaacatgtacttcatcctatttctgcaaagtagtttgatgtatttctccaattcttttcccatttgctgtggcgtcagtcgttgggatgtcatctttcttttcattttctggtgattacacatttttggcccttccataaataacacggataagccagtgtaatagggattaattaattaattaattatgaaccaactttggagaaatgacctatataaacacttgatttccccacgtggtggtccacatatcaaatcattagcattcggtttcctatcatttcccttgttggtatcttaattatgtctcgttccaaatgggaaatgattttctttccaattgaaatatgaactgtatatagcccgataagtgggatttgcggtgccgttgggtcacatataatgcagatgcatgattgagtctctactgtactatgcgtggctgcgtgcagcctttggaccaggatccaagctacagtccctacaggagaagtccagacagcattcattcatgtttatgtgctcctaaatataaatggatttttgttggatgggacgtatcatagggctgcgaatctagatgggaaatattttcagatttataatactagaatacgttttatctattccaaaatctattatattaggtcggagggagtatatttgtatgagcagcaggtataaatggacgtttccggtttggtgatctgcatgcacaaacacatgcagctagcgcccaccgacgaggattacatgtatacgacctccggtcctaaatggtacacattctaaggacctgttttattatttcttgttttcaaactgttaaatgttgcattatttaaaaaaaattatatatataagttgttttaagaaaaccaaataaattcagttttcaaatttataataattaatacttaattaatcatgtgctaaggaggtttctcgttttgcgtgccagaattgtggagatcgaacggggcctaatactatgggtgtgtttagttcacgccaaaattggaagtttggttgaaattggaacgatgtgatggaaaagttgaaagtttatgtgtaggaaagttttgatgtgatggaaaagatggaagtttgaagaaaaagtttggatctaaacaagggctatgaatcagacagattgtttaagatatgtcatattcgattataggttgttatattttaacatggatgaatcagacagactattcaggatgtgtcactactgaagaaatgatctttgttgggtcacgcaaaaatcatattattcccggtttgagtaagaaccaggactaaaaatatctttagtcccgatttaaaaatccacaggtactaaagataaatctttagtcccggttgtttataccaaccgggacccaagctctaaaaaccgtgaaaactcctgagccgcgcgcgctgtgcctctcgtccttatcccatcctcctctcctcctcccctctcattttctctctacctccccctttcttccccctcctcactcctcctccgacggcgacggcggccaggaggtggcggccgggtggtggtagctgggtgcctgggcggcagatccggccgggaggtggcagaggtcaggaggaggtggccgggcggcgccaacatcaggcagccgcgaccgggaggcagtggctgggtggttttgtgattttttttttagatttagggatgattttgtgaatgacttggggattgtggatgatttttttggatgggcaattgtagatgatttgttgtgcataatttgtgaggatttgagggtgacaataaatggaagcagaaagaaacaatgaaccaatttttccaaaaaaaaaaaactaaccaaccaggactaaagatggtagcgccagccacgtggtgttaccatctttagacccggttggtattatcaatcgtaactaaagatttatcttttctcccagttattttaactgggactaaaatgggtatctttagttttaaattggacgtctcggtttgcaatccgggactataaggggctataaaccggaagtaaaaagactttccctattagtacgtacattctgatcctacacatcttatctgaccatacatggttctacaggcaaattgatcagcctccctcgtgatgcacggtcaggtcgatcgtatgcacgtacaagcccttaaacatgtaccagctagctataggcgcgttgtggggcatgcagcatatcaatgcaatgatgcagcatggcaaagggcttatgcatgcatattcgatctttggcgatcgatatgactaattacgtggataaggcgtgtacatacacgtccttaagcgtcttctaattttaacacacgcttaaattatggtttggcgaatggtcaagtgtgtcaaatctctacggtcctgtttccaagatacgaagattaattagcctgtgacggtgaatcaataacgtgctagcgatgatctaaagacacgtaggcttacctaccttctaagggcatgttcaatgatagagacgtgtatggttttttaaacaactatgaaggtggcccacgcgatacgcgggcatccatgctatcataatagaaattatattttataagggcaaactataggtcgggcatatctgaaaaccattgacttagaagatagatcaaggtcatatgacatttgaatttacttttggactaagtgagtaaatatgatgtatacgcgttcgcgaaaagtaaatattatgtacaccatttaaacacatactatataatattgctacaagtaaaaattgcgatagcaaggacttaaaattattgtgatcgaatcgtctcatgaagatgcacgatttagtgacaaccaaattaggatagattaacggttggattgtttttcccttcgtagaagttcaaaattttcatattcttttccaaagttttaaagaatttttgttaggacacaaatcatttgcagaattgctttgttgggtagtgcaaaatatcagcaattgtttgaagcttttctttttttttctttttcgcatgtttgattgttttcttcgaaacgatatttgtttgaaataagagcaaaattatataaatttaattggtatgtatagtgtttatcggatcaccatatcaccttagctgcctcaggtacgatgcttcatcacacgtgcagaaggcaaacatacacatgtgcgtggtctttagaagtttcattttacttttataaaagatagatatggcatgcttgttaataggtccttaataggtctaattaatagatccatcagtttaagtgaaaaccgatatcaaaatattttgttaaaaatagtataaaatagtgggttgagtaattaatgtaaaatattagttaacatagatcataaatgggcaatttactggtagagaatattattgcgtaacatttatattaaacaacatgtttttaaaattttcatataaaataatgatttgatataatagatgcatcggtttaagtaaaaaaaatattatattgttaatataaatggtaaaataatatagttttataaaaattattttcaaacatttgtgaatctaatttagacatatatatatgatgatatatataatctatgtttataaagttataatttcttcaaatttattaccactactaataattacaatttcgtctatacatgtagaagagaaagaagaagaaggaagcaaatgtaatttttaatgacataatttatatttttatgtttttccactttatctttttaaatgtgtgttgcagttgtatatgtattttcagcttttttacaagttgtaagtacgtacctttctcgtcggtgcgctgagagagattaggagagagattataaataggatttaatctaatggtcggagataacagatccatcaatttaattaaaaattgatggctagatattgtagttttttttctcacattttctagatttttttctaatttattagagtatattttaagtttaatacgaattttgattttgtatctcatctaacctagaagggaaaaaaaggaaagaacaaagaggagggtaggtacatatgtacgtgcacgtccatggagtgatagaggactttgggtgacgctaatgggcgatcgatcgcctggagcgatcaacctccatcccctcgtataaggtcctctcccctttcctcctccccttcttctcttcctactacaacataatttttttaaaaaaataaaaaaacaaaattaaaaaaatttatgtatagaaatactatatataaaaaatatttgaatttaaattcaaatttgaaacgggtatgtaaacttttgacttataaactttgggtctataaactttaggtgtataaagtttagatgtatagaaatactatatataaaaaatatttgaattcaaattcaaatttgaatcggatatataaacttttgacttataaactttaggtctctaaattttaggtgtataaactttagatatgtaaacttgaggtgtacaaactttaggtgcaaaaatttactaaaatagaaaagtaatgcggtgccaaaaaaaatcacgtggagaagggggtgatcgagcctggcgagcgatcgcgcattaggaattttggaggactttttctacaagtgattctttttccagatgagcgtaatttcaaaatcttaagatagatctatgttagctagaaataagggagaagggaagagttgggggtggctagagggagggagtacgtgctggctaccggaattttgtattttagatagatctaatggttaaaattaatggttcaccgatttaatgaaaataaatttttataatttattataactccatataacaatttaggagtgtttttagagcatttacattgtacatgcccttaggagtctcacgtggcggcttgagagagtttgtaggaagtttagatgttaggtgctctctaatataggccattcattttctttaaaatccatgcaaattttataagtagggtgacgtatatatacaagatattctttttggcttttttttgtcagtactatgtattcgtgtgtacgcgggattttttttgggaggaattattttttaatagatgtgatctgatgctataaaataactggttcaccaatttaagtgataatcgaaggtcggaatttctagaatctcctattataattacataattttaatacgaagatgaatgatcaaatatacactcactcaaacaatgtcaatagcataaaaaagcagggttttaaatctcctgctatagctgtttgaaaagggttttagctatttgctctcatgtataatttagccgctatagctctatttaacccactatagctgccgctatatctgttt

SEQ ID NO: 66537 - DNA, 991 bp, Oryza sativa
tcctcatgcaaccatatttccatattatagtgattaatagttgttgttaagccgttgttatgcataacaacaatgttttatctttactctttctctttcttccatgtcaacaagtattcctaattagcaatgctaagagaccactattgacaaccattgtacatgccctaatccctattttattttctggattatgtagcttagctaccgagtgacagaatatctgaacctggactatttagaagagagttgaagatagtaatcgttgtagctaatataaactcttccaaatagtgctaagtctgacaaaaattaaattactaaaagtatatatgcataaagttcaaaaaaagtatagctgcatatatacactacttaaaaataacttttgcaccgctttcttcacatgcggacctgtatataaaaagatttaggaggtgtccaataatggcccagctacaaaaatttattttcacagccagatctcttaagaggtttgcatgcgaattttggtacccagttggctcccactccttttctctcctccttgcgttaaatcatttcttctccctacttatccctcttctcctcagtcctctcgccctcttctcctcgaccgctagatccggtgatggtgaaggggtgggtaggggaggctatggatcggacgcgtcgaatttgtcgtagcggggagtgtgacggtggctagggtggtcacgacgacaacagcagccttaagggcggtgaattcgtcaatcgtggccccgatcagggtggatccagtggctatggcgactgaggggcagatccaccagcgatcttgcccctccatcgcttttccccctacctagtaaatatgactttgtaaacgtggcagagtttcatgtgagaaggacacttttccatgccggattgaaatacttttttttggcggttaggccaactcacaaggaaatgttcatatatataccttagcattataaggaaaacc

SEQ ID NO: 66538 - DNA, 7694 bp, Oryza sativa
  unsure (1)..(7694): unsure at all n locations
aatcggtgaggcacatatatattagtcagtatcactagcacatattagaagacaacagaacagcacgcaaaatctatagaaaagtttgcaacagtatgtatgatctgtcaagagtcgctgtgatgacagcgaaatttttgtataggcatctcccggttgatggaagaatccatgcacagcattttcagagatacatgtgccctcacacgaacggctgcaacggcttcagcatgattaggcctagccaataatcaaaacgtactgtggcttcttgaatatttaatttagaactttattcgagggttttttttaatttcttcgtcatttccattgcttggctctcttttcatgattgttgagaagataaattttttttaaaaaaactcccctgaaattatatctaaaaataaaattttagaatacaaatcgctttaaattatactacaaaggtgaaataagcttgcaggcctatcgttgaaaaaaaaaacttgactagagaatattggatgataaattacgcttagtctggttacttccaaggctacaaggtcaagccactaaagaatattgaatgataaacaacacccaatctctagtagtctcggacatggaatgcaattttttttacaagaatgtccctcttttccatctcaaaatataagacattactatcttttagaaaaattattatttataacatttgtctaataattaaagtcatatgttataactagatttgtatttagaagtacctatatgacgttaattttctttttaaaaaaatatatttagaaaaaatattgtcaaagtataatgttgcattgtaaaccgtgtaaacagttaataatgtcttatatattggtaggagctatatgagaaaaagtttaactcatagtatatatatatatatatatgaatgaaaatcttttttcacatttcaaacaggccgattcattgtcgacctcaaaagtgaaagcatatatggacatatcaacaacagtactatagtcacttcaagaaagtgcgaggaggccaatacgtacgggagcatgacagtacaacatgtatacttcacatcttttcctcatttgagatctctctgatgttatttgagaggaatatttttgtatacggcttattattaattcgcagccacatgtttggcagcacatgctatatattagatgttgtattatcctgcaagctaggactgcatgctgtgaaccgcaaagccgttcattggttgcacacttgtatataagcctacaggttgctactagtatacatgatatccaaatcatactagtttattaatgtgaaatctgaattattttatatctattcaatttaccaccgcgcttatttattaatttgaacatgtttactcattttttaaaaaaaccgaatgaattacaaagacatacacgtagtgaggcaccgttgttggtggctctgtatgaagaaaaaatgattcttctaaaatacctctttgccttgtcgcttgtgttatgctatatcggacctcttctttccattgccttctctcttcatccttcgcagaactagaattttcttaattctagagttgagctaccgtagttcgcataattttatctttattctctctctttttgaagaaaaaggaaaaacttacatatccttgcacaccagcactccaatctctatggttttcctttctcgattaattatagcttttaacacaaggttgcaatatgacgatgttagcggtattacacgtatgttaaattttaacttgatgagataaattggacctgcaaatgcttttttttttccaaattttgatggaaacactcacagacacatacaaccaaagcttcctttcctgatttgtccggtgtgcaaggtagcatataacctgttgctgtttaagggtccctgtaacgtgtacgtagctagctaaactccgggtaacaattttgtcctcatttattgcatttgatgtgattacagcttagactgactgaccggtcagtagattatagaaatcgggcagccgtactaattcagactactattagtgagcagtaacaataatccaactcaatcgaacttgaggcatcaccattcatgatgcatgtactttaattaaacactgttagtagttagctaaacgccggctaagtacagttttgtcctgatttactgtacctgctgatgagatgcttgagctcatgcaagacagctagaaacatcaccagtgcacgtgaaaaccaaaaggtatgtgggacgtcctgtggtaaataaaatttaattaacccagcacaggaaaagcaggagagttttattcttcggtgatagccaatctctccaaaaaaaagtatttgttgggtcctgtggttaataaaatttaatccgttctttctgtactattacagaaacgctacttatttgcatttttaatatatgatgccgttgatttttgacatatgttcaatcatttatcttagaaaaaaagtacgaattaccccccgaactatcgaggtcgaccgaattacacccccaaactcgaaaatcagacattctacaccctcaactattgaaaccggacaaataacccccccgactcaatccggagtggttttgggtctacgtgacaggccagtcagcaatttttcttaaaaaaaatcaatgggccccacctatcagttctcaacccacccccccccccctctctctcttctcaccagcacggcggcggccacgcgagggcgggagcaggcggcgctgccggtgacggagggcggcgggcggctgagacagaggcggagctcgtcgcgcaggttgccgtgcaagttgaggcggcggaggagcacgagtgagccgagtacggacggcacgtacccggacaggtttttcccggcgatctttcaataagtaaagccaaaaaagatcatatcaaagtacgacaagtcatggaatttaaatggaagacaaggagagaagacgattcgattttatttttcaaccagttatctttcactttaaaattttaaaacccaagatgcagcgctaagagtggttttagtggtgtttttttaccactttactaaccatcatgctattatatgccatgcatcatggtggctaatatatataggaaactgtatccacgtttcgcactgttatttccatcatttcctcgcgctaaagtgataagatagggagatgcggggaggaaagggaacaaagtgtatgatatgatgtgtccagtgttagctatttaatacaccctccattctaaattgatctacatatagtttttttaagattattactaaatgatatacatatttatgttcattcattaagtctatttgttatttgtgcattggagtaaatagacattaatgcatgcatccatgcacacaaatatttataacccacatgcaatatcttgatttgctattggctaggaaatagtggggatggtgcatgcatcgagtttgttgctaaagtaaatatagtatgagagagttattagtttttttggttttagtgtatctatgaaatatgtacatcaatttggaatggagggagtagttaattatagtggcggaaaatagtgttatatactatgaatcttaaacggagatttatgagccctattttttcacataaatgaaaatattaacatgttccatttataaccgcggaacaacgtacattattattacacaaagattaattgaagataagtattattcatacatatacaaatatctgtgacgcaatctataggatgtgatatacacctacgaatataagtacgtgaatttttttaaaaaaaaagaatcttggagtaaattattaacgtgatatagctagtttaatttgtgatagggaattaaggatacatagtcatgtcaccttcgtcatatatattaattattcactctcgatcgattgccaagtaattatattattaacacgcatgtggtaaacggtatacccacatacagtgacatggctagtctgatagagaaggatgtacagtcaagtcaccttcattgtcgattttgccaagtagagtaatttttttaacgcatggtaaaatggtagcttagacgtagacacatgtacagtgatagctagtctgatagagaaggatatgtacagtcttgtcaccttcagatttggcattggccattttgccatacacttgtacgtgccgattcacacgcttgtcgatctgtgactgtagtagtgtggcaagtctcggtctctctggcaatgaccctgcttcaattcatactccactggtaattttacatctatatatatccagccgtttattgagatagagacgtgtaacggggagagcaggccggtctaatccatatatgcatatttgtgtgaacgatatataggcacgaatttacaaaaaaatatcgggtattctgacttttaatttctaatgtttgtttttagagtaaactttataaaacgatgatttgaccaaactatcacaaaacaaatatgcgttttttttaaccaaaactacatatttagtgtcaaatttatcacatatctgcatatttaaggcatctacagattatgaggatattaagaactatacattttatagtttatatccatagcagaagtttagtttgtgataaaactgatgttaaatctatgtgattttctaatacaaatctattattttgtaaatgaaaattatgttaaatccataatttttgtgatacaaatttttaaatatatagttttgtgatatacaaagttgaaattaatttaatcttgtttttaatgcaaaaatttataaatactaaaaaagattacgtattacaaaagttttttttttgcttcatacgcattagttttttcttatttcaaccattttaaaagaaattagtgatcaacgtcgacgcaatattagcaatattgtttaaggaagggagtacttttttttgtatattgttggaattttatgttccctagcttgtgtcctgttcatcacgatagctacgtatatatatgtggaatcatcctgactcctgtggacgaaaaggtgggtcgcgagaagtacgttcatggtaatatcgtatgtatggaacgacgttttaccttgcgtgaagtacgtcttctgactacactttacaccattctttcatgaaagaattattttttnnnnnnnnnnnnnnnnnnnnnnttttttttttccggatggagtacgttttaactttgcttgcgtagtacctatagtagatatttcggtttttgattttttttttctctcccttgtccaggcagttgcgttttgtaattgaaatattttttttctaatatatcaacgtgtaatctttttacgcgttcgtgaaaatatacaaagagtcgtttttttttccatacgtaggacatatccgatatatgtattggtacgataattaatactgcccaggcaaagaaaatcgactcaaaatattgtacaaaccatgaagtgttattttttgcggatgatagcacggtagcgtaatcaatatgtagcacttggagattctctaatgcaaatgggctaaagatctagggaatgtcatttactctcggcacagtggaaaaatgtaacccacttccaattcaaccatttagttttccatataccataattcataacgcctaacaaaatatgatagcaaggaaagggatgtcatgtcctcttatttttacgtgtgaagaaatttgataagatagaccaatagattatgtaccactacataaacatagaagtttaaaatcgacctatacaagttaaaaacaaataacaaagatcaaatttgaacttggatgtagtgtacgtagtcagtgctctaaatatggaagtttggagtgatataccaagaattgatacatcttgttcgatttttaattagttttatggctattcggaaatgtcatgaaggaggaaaaaccgtatatatgtgctaaatcggggatgagcacacacttgcttgtcttcctacagtgtgaaatagctgtagcaaataatcttgtgagaggccactgctagctctagcttagctgctctatggcacaggagaacatataggagatgtaacagcaagtgcacagggagggaaagagagagagatgagtgattggcaatacacgcacgtgtcccaatccctcgatcaatcaagctagcctagcctagctatatattaactagggcgccacaccacagacgccggagatcagaacgaatcatatcgttcaacgagcgtccggccggcgggcgacgcgctgtcgagcaagagcgccgccgcccgatcaatcgctcgccaccatgattcaccccaaccagccgctggcgctgtccgcggcgaagaacgcgagcaccgtcgtcgtcggctcgccgctcctcgcggcgtcgccggcctcctcccccgcggcggcgtgctgtagcagccagctgcagcagcggcgagccgccgggcccgggaggaggggcgccggtaggctcgcggcgccgaggtgcagcaccatcgagcaggccgccggcgtgtcgtcggccgtgacggtggacaggacgctgacggtgaccgccacggtgaccgtgcagccgcccatcggcgtcgtctacgccgcccgcggcatcgacgacctcaccgacctcatcggcaagacgctcctcctcgagctcgtcagctccgagctcgacccaagtgagcagcacaacatatccatggcttagccgaagctccatggatgcatggacaaacacatgtagtagtaattaacaccatgtctatgcatgcagggacggggaaggagaaggagacggtgagcgcgttcgcgcacaggacgatgaagcaggacacgtacgaggcggagttcgccgtgccggcgacgttcgggccggtgggcgccgtgctggtggagaacgagcaccaccgcgagatgttcgtcaaggagatctgcctcgtcaccggcgccgacgactcctccgccgtcaccttcgactgcaactcctgggtccactccaagttcgacaaccccgaccgccgcatcttcttcaccgtcaaggtactacaaacatcgatcgatctcaccatcacaccatccatgaacacttggaagcatcatatcaacgacgtctagcgcggccatggatcgatgcagtcgtacctgccggcgcagacgcccaaggggatcgaggcgctgaggaagaaggagctggagacgctgcgcggcgacggcaccggcgagcgcaagttcttcgaccgcgtctacgactacgacgtctacaacgacctcggcgaccccgacttcaagatcgagcacctccgccccgtcctcggcggcgacgaacacccctaccctcgccgctgccgcaccggccgcccccacaccgagatcggtaaccccacctcacctcccagaaattttacatcattttcacatcaaattaatcacctattccctccgtttcaggttataaaacattttaacttttgtcaaagtcaaactattttaagtttgactaagtttatagacaaatataataatatttataatattaaattagtttcatcaaatcaataattaaatatattttcataataaatttgtcttaggttaaaaatattactacttttctctacaaatttggtcaaagttaaaacagtttgactttg

SEQ ID NO: 66539 - DNA, 12586 bp, Oryza sativa
cattgcgcaggagataggttctcgtggttcagagacgaggagttcgcgaggcaggtgctggctggcgtcaaccccatctgcatccagctcctaacggtagcaccgccattcccaaccacatacactattcacctgaggacgacgtcacttttcgatgacgtcatcccccaaaaagaatgaattttcgctcgtcccgtcctggtcatcctttaatgtgtagtggcgaacccagaatttttatactaataaatatttcaaaaaatatacatatgttgatgtctttaggagagaaaagatatatagcagtagaaaaataaacaaggggtacagtggcagatggaaaattttttacaatgggtattaaaaattatgtagtatttaaaaaacatgttagagactttatatgacaaaaaaatgaaacagtacaatatttgggtaaaagctgggtggctgagactaggaatcgaacccaagatccataatgggtatattaaaaatcacgtactccagtatttaaaaacatgttagtgtctttagcagaaaaaggattcaataataaaaagaaaatatgcatcctatatgttagcatcatactcccttcctcaatttatggcatgaagttatacccatcttaaactctcaactgagttttttgctgatgtggttttgaaatttaaaaatatatatataactaacaagttgtaaatgatacaaacaattcttttaattaaaaataatcatatattaaccatacggtaaaattttaatgtttatataatcataaaagtagcccatgaattaaatgcacaggtttcctaaaatttatatgcagaaacttttataatacatactattttatattaaaaacaattgaattcgaatctaaattaaaatctggcataaacttttggtgtaaaaattttaggggtataaactttagttatataaacttaacaaaaaaataaaaatcgcgtgacaaaaaagaaagtgtggccgttcacagtgtgcaaacattagcccttttcgctagataatttccctctcaatatttagctaaaaggttttaatggctttaaataaatgacactattgctttttctaatttctaggactatttgtcatttgttagcatcatattcccttcttcctcaatttatggcatgaagttatacccatcttaaactctcaacttagtattatgttgatgtagtttagaatttaaaaatgtatatataactaacaagctgtaaatgatacaaaaaatattttaattgaaaaatagccatatattaaccatatggtaaaaatttagtatttatataatcataaaaatagcccatgcaatgcataggttttaaaatttatatgtagaaacttttaatacatactcattttatatattaaaaaaacatttgaattcgaatccaaattaaaatcggacataaacttttgtggtaaaaattttaggtgtataaactttagttatataattaaacttagcagaaaataaagtgtggccgctcgcagtgcgcaaacattagccctttcgctagataatttccctctcaatatttagctaaaaagttttaaatggctttaaataaatggcgccattattggcttttctagtttgtatgactatttttcatttgtagaaatatttgtgcaaatagacaaacatacgagtcgtaaagtattattgatgacaaatctagtggtatccctttttttctattttgcttaacattgaacgaatgtctgtttttaaaagttttgaggaaaaaagtctcaaatggtgtgagtagcaactaaggaaaaccgaactcaccaattaattaatggcgatcgatcgacgtgtgcaggagtttcccatcgtgagcaagctggacccggaggtgtacgggccaccggagtcggcgctgacgaaggagttgctggagagccagatcgtggagtcggtgacggtggaggaggcgatggcgcagcggcggctcttcatcctggactaccacgacgtgttcctcccctacgtgcaccgcgtccgcgagcggccggagacgacgctctacggctcccgcacggtgttcttcctcaccggcgccggcacgctgtcgccgctcgccatcgagctggcgcggccgcagtcgccaacgaggccgcagtggaggcgcgccttcgtccacgggcccgacgccacggcgtcgtggctgtggaagctcgccaaggcgcacgtcctctcccacgacaccggctaccaccagctcgtcagccactggctccgcacccactgctgcgtcgagccgtacatcatcgccgccaaccggcagctcagccggatgcacccggtgcaccgcctcctccacccacacttccgctacaccatggagatcaatgccctggccagggagagcctcatcaatgccgacggcatcatcgaggagtccttctggcccgggaggtacgccatggagctcagctccgtcgcctacgccgccacgtggcgcttcgacgccgaggccctgcccgaggacctggtgcgccgcgggctcgccgttcgacaggaggacggcgagctcgagctcaccatcaaggactacccgtacgccaacgacgggctgctggtctggaactccatcaagcagtgggcgtcggattacatcgacttctactacaagtccgacgaggaggtcgcctgcgacgaggaggtgcgggcgtggtgggaggaggtgcgcaccaaggggcacgccgacaagaaggacgagccgtggtggccggcggtggacacccgggacgggctcatcggcgtcttgaccaccatcatgtgggtgacctccggccaccacgccgccgtcaacttcgggcagtaccactacggcggctacttcccgaaccggccgacggtgatgaggaagaaaatgccggtggaggagaacaaggaggaggagatgaagaagttcatggagatgccggagcacgtgctgctggacaccatgccgtccaagatgcaggccatcacgatcatggcgacgctggacatcctgtcgtcgcactcccccgacgaggagtacatgggggagcacgccgagccggcgtggctggcggagccgagggtcaaggcggcgttcgagaggttcgcagggaggatgaaggagatcgagggcatcgtcgacgagcggaacaacgacccggagctcaggaacaggtgcggcgccggcatcgtgccgtacgagctgctcaagccgttctccacgcccggggtcaccgggaggggcatcccaaacagcatctccatctgagtttcgctagctaagatagctagctgcatttgggacaagattggagatggttaagatttgtacactaagatcatgtaccaacactaatagctcccgtgtatgcctgcctgccacgggagaggcatttgctagtgtgtttgagttactagaatgccacaaattagtaaagaggttattgaactaaagctcagttcgctgagttttctagaaattggcagtatgtcatgcggacggatgggatctgctggattcagcacatatcatccaagaaaaattactcacagcagaacaggcatgtcatgcatgtgactgaatcgagcagcattgtgagttgatcaggaccagcatggcatcgtgtttatagttcattggtcactggctaacgaacatcgttacccccggggttccagacaacgaactatacagctaagctgagacactgccaggatgcgtatctttttagaatgcaagacggttaggaaagataagggtattggagccgaccacaaaggcacaaagtgattagtcaggggaagataaggctggacctgcctgttagagttcactagaaagagcattccgagcagcatctccatgctcacgccggctcatttgagtccaaacttgtggagttaaacggttcctaatacatctagccacgcgtgacttggatgtaaaagagtccacttcgctcggttctctgaggtcaagtgatcaaccatgaaaaatttcaagtcttgtgcagtccacttagcacagcagctttgggtttctccgtttgaaactgacagggtgtgcagaaagtgatgcggcgcttgaaatacttgagtaccgctcctcgagtacagaaattgggggggtggagggaagggctttatctctgggagatgcagcctccggttgcactttgacttactaaattagagcaatgaaaataaggcttcgaaatgaagaatataagaacaaaaatggaagtgtgtgttatcgagtgaggtacctgtaaaggatggctcgaaatacggtctggttgttttgaaagagggttcctgagcatcaacctccaagtgttgtgtcgtcgtgctggtcttttgaagacctgtcgactggacaagcttcagtagtttgtctgttatgactgtcattggcggacggagctctggtgatttctgcattgaaggaagaaatacagccagtaatgatcacaaatatagggtgctgaaattcattcgatgaattcataaatcattaggaccgcagtaattagacatttttcagctataatccccttcaattcccatttaggagcagagtctaagcattaaggagtagtgcatgcggtgtttcaatttgcagcttggcttctatcctcaaggtagcatagttcaactaagtaatgtgtaccagaaaaaggtaacggacagttaccttgatgcagagtaagatgatgttgcctaacgtagagatagcttgaggtggcatagatgcatgtattcttggatcagttattctttccaaagaatcaaggttatggagatgaggagatgcccaatcaactagaaactgctcattctgccttcttgaactgaagaggaaaaagaacttcattagagaaccagactacagctgtacaagattaagtgagcatatacctgtcaaaggccttctgcccagtcaaaagcacgagcaaaatcacaccgaaactgtaaatgtcagccttgatgctatctgttgctgggtcagtaagctcaggtgcaacatagcctttaccactgttgagagcttctgagtcctgttttttcaggtgaggaactgttaacggtcaacggattatacagaagatatatcattgactttgaaaaacaccagtatccccttaatatgtgtgtgatttttctacccacttctgaagggaccccggttgatcctagtagggacacacacatatacatctttcaaatatttcaagggagagtagcttgttttgatataacactataatgtataggagtctatccagcgacctacctttgattttggttgagatgcaactgtaagcaatcgtgacaaaattccaaaagtatgggtctaaactggcttattattaatttagtctttcttccttttggaaaatagttcaagagctatagcgttcaccaaaggacataagcaccagcccggtgccttggtcttaggacttgaacccaagcagatggggaggttaaacagcctcaccatcaacaggacaaacccttttccctaaaaagctaactttatggatcgttttttctcaatgcatccttctctgtctaaacttaaaattccttatcgttaagtatgcagtaagaactccaagagattggcaatccatgacaacaattagatcctagaattgttcaagtaaaacattaactatatcaccatcactaatgattatgtacagaagtaagaacactatccaatataacatggaaaactagtgagcactgaccgttcttatggcactgacaaattggcttagcctggctaatccacagtggctgaggtagggcatgagctgagcatcgagcaaaatatttgtcgctttaatatttccatgaacaactggaggagagcacgtcgaatgcatgaatctgcataagcttcaaaatttcaggaaagcttccagtatatgtctaaaaattgacatcagttcagcagaacaatttacagaaagccattaacactatgaggatgtgtataccctgcagtacaaaacaaacagctagatgatttggtaggaatctaagtccacaaaaatgtacttactccaaagcataggcaactccaagagcaatcttcatccgagctttccatgacaaagccctggaccttgtggctgctgaaaacaaaatatcatcaagagagccattttctgcatattcatatagaagtgcacagtgcccaaactcgacacagtagcccacaagcgcagagatattggggtgcttcaaattggacattttcccaagcatgtctatgagctcatcttgttccgataatgacagatctaccatgttgatcttcttgatagccaggagctgcatgtacgaggataaatacatgttatacatataaaacacagatgtaaaataatctgtagaaaaaatatgcgcctttactatttagcaaatgataaatttgataaatcacatatttttttctaatattgatttcgggaagttgcaatgagactaggaattgcatcctcctcgtgcattgaattttaaagcttatcgagagatcaagagaaaaaaaatgtcaacgatgcaagacaagttttattgccgataagaaaaggaaaacggccagttgatgaacaaaaagtagtagtaaataaacttaatacaccaactaaaggaaaattcagtattaggacactgaaacacgtagtagaaattagattcgagagcttgttctaaagtaacaaaccaatagtattttccaacagggtactaacaatatgatacctggccaccaggaaaatcacctctgtaaacttggccagtgaaaccttcaccaataaagcattctttactgaagttcctggtagctgctaagatgtcaacagcttgaaactgttttgcagttagaaagtttttggatgtcttggcccaaacttttgttttcatagctctttcaggcttaatgacgtcactagaggaagcctcacagtcattcataagagaattccaagagtacaagacctcatttgctttagggactgtaaaatgatatgtatgaatttcagtgatatgaaagaatgtaagtctatccaataatgcaacatgcaggaatggagaacaagtatatatatacatgattggatattacatacagatcctaacataaggatgaatattaagtgatgaacaagaatatatagaatatgtctagccatcaactacaattgcataagccggttatgcttaaactaataaagttccagtgctacctttttccacattggcaggtggagatttggcattgttagcggtgctcttaggactgtatgtgcagcttttcagaaccaagccaacaatgaggagcacaaaagctgtaccagtaacagtagctattgcagcagctgtcactcgagagtgtgacttcctgtgctgattatggttgtacatagaagaatggcttaaggaaggcttcaaaggttcgggcttgtgtttcaaattttccttaactgctggtggaggtggggacataggtggtggaggtgaagatggaggtggatgtggagttggtggtgaatgagcactcctggtaaatgagggagatgcacgtttgaaacctggttgaaactggttcccatcaatcctggaatgttagattagccacttatttcaactagatatgaagtcaaggcaacatgtatgcataaatatcctacggaaagaaacgtgggttattaagcagaaccgaatacctcaactcaggaatggactcaaaagttcctggcacataaccactgaagctattgttttcaatgttgctgcaaccagttgataattgtcaggaaggatgagaataaacaaatatagagaaggataaaatacagttgaatttcttacagggatgataatggaaggtctgccaacaaaataacagatcctgtgaactcattatgctgtaaataactgtaaaaccaaaacaaaatgaaccttttatattctagcatatttttgtgcatgaaatcgttaagaacgcacatcattcttacaggtgatgaaggttcttcaatgagctaaacgacgttggcaagtcaccactgaaagagttgaatgataaatccctgaagttgaatacgaacaaaaatgaggtacagactacagtgggtgaaagatcgaattactcgaagatatatagctaaatttgcatggagaattatagtagaattgcaagaaggtccaaaggaactactctagcatcaaagtgtgtgcccatattaacaggtcaaatgagcttgagccttgaagattgttttttaagaaaccataaagcaaataaatgcaaaaatagaaacaaacagactgtaaaaacttatgtatcaaatgatccatgtgatttatgtgagtgcaacgaaacatgcatttttgtggggtggctaagaaaacatgcagttattcacaataatggagggggaaatctaggaaacacaaatgtatgcagttaagcatggctgaagcttctcttgtacatgcaaatattaaataatgtttgggctgcaagaattcgcatgtcgttgcaggctacagtgcaagaaataattcatttattcaagaggataaagaaattagaatctgggagcactacattgttcctaagctttccatgttgacaaaaacatcaccaattattccagagagcttattgtggctgaggttcctgcagcaaagattaattacaggccagttatttgattctgcaaccagagttcactatagaaaattaggaagtgctccaattgccaaaaatgcactcacagatatttcagagtgtgcaaccatggtagtgacggtggtatactcccctcaaactggttggctgcgaaatttctacaggagcacaacatatggcgattatgtcaaccatagttcatatttgatatttaacccagccaaaagggggataaccgaaatacaaagagaacatacaggtattccacacttgggggcaaattgcgcgggatttcaccagcaatgttattgaagctcacatccctacggtcgtcatgattcagcgaagcaaagaaattaaagactggactaagaacagcagaatcatgatatgctaacagattatcacaaactttctggtcaaaagctcacagtattttcagagagtaaaacttgagcagctccagaccaagccacccgccaactcctagcccactaatatttctgtgtacgagtgaaagaagagcaaaatattcaactcagttaataatccctgcaaagttgcaggtgaaactgatcaggaagttaagaataactgaagaattacaaagcgacaatggacgaatccctgcaaaggactccatgccatggccgttgttcaccaccgcggccacaggggtcaccgccctgagatgtccacccagaaagctgccatggagaatccaatgttcgatataattcccaaagccctaaagctgtagaacaaccagaaacaacagaaaattaaacataaggcagcgaagtcatacacaaacatgaagacggcatgacacgcaggaattgaacaaaggtaactacgatacggtcacaatagcatgcacactcttgttgtggcacacaatcacatacatcgatgtggacaggatcagatcagaaccaacacgaacactaataccaaatgggagcaagcatagatattcatcatgagactgtgcaaactactgcacacgcactgggcaaactcatgctcgcgcaatcaccgaatcacgagtacgcgtgcggcgtgcgcgcgatggctagctgcgccgtcaaaccagcacagacccagccctcgcaagcaagcgcgcgagctcggagtagaggcatcaaacggtaactgctcgatcgctacagattaggggttgagtagactcaccatcggaggggtcggtgaaccctgatacgggggcgaacgcggcgcacagcaccgccgcggcgaggaggaggcgaggcagcgccgccgccgccattccgatgcctccgcggctcagcgcgccccctcccccccaaaatccagcgccgccgccgatcgccacgaaatccagaccaaatcgagcgatccgcgcacgaaatcgccgacgacgccaaccggaacgttctcgaactttcccaaaaccccccgcgctcgcgcgcttgctcccgacgccgccgctcccccagatccgcgcgcccccggccgtctcccgatcgggccgagcaatccgcccgcgaattggaggaacccaccggttgggggggaggatcgaatctccccgagcggccggccggagaagccacggggattcgcgaggagggtttagggtttttcaaaagtttgggaggattctcgctttgggagggaagaagcatggggtggggaggaggagagggcggtcacgtgaggggcgcgtgagaggccgttacggcggcgggaaatggaggagagaacgaggaactattttggggagcagcaaaattcttccggaatcaaaaacatctctatctgaataatttggtttctcgttcagatttcgaaaaacagaagttacaaaatctagaaaatcaacgaaaagtaaaaggcttgtttttcctcgtttagattctcacaatatgatgaattgccaccagctacttttagaatctaaaaatttcttccatcagaaaaaaaaatgaatctaaaaatttcctaaacgaattatgagaggtttgttataggaacttccggctgttacagaaacttcggctgtgttctgcccataagctttcaactcatcatcctccctcgtttatcgtgtgcatgttttttaaattgttaaacggtgtgtgttttataaaatgtttttataaaaaagttgtttttaaagatcatgttaatctaatttttttagttttgtatagctttttttttgcggggatagttttgtatagctagtacttaataaatcctaagttaacctattgtctcatgtatactttgtatcaaattatcaattgttgtttagtctaatatatgttataactaggataaagaaaatgtaattggagttcacatttgccatgtgcttgtgaaatttgtttatttaaggtgcttgcaaaatcatatttatcaatgtacgtcaaacattcgagccatgaatactagttgtgtccaaataaagggcagataattgatgtcatggcatggaaggttattggcggttttatgtcgcgacacattgtggatatgctgcactattaacagatgattatacgcttcgacatatagaaaaaggataaatataaaaccaatgatgccatgtgtttgtcttttctaattgaatattattggacaattaatgagaaaggcgtgtccgagatataagggtaaccacaatatttatttaccaacttgatagtaacgtgggtctcaatatccgacaatagttgttattagcaggtttcataatgtttagtgctgaagtggtaattaagatggggttcacatttaatgctacttgagaagattgttatgcatacacgagcaaatagtatattttaatggtttattgctagtagtaagcatactactcggttataactaccatctctaccacaatgtatcttaccaggtaagaagctagcattaattgcttattacccattttatcctcatattgtggttactctaacaacaccaaatggttttgtccaagaataaatctacagtgcgtggctttactatatatactttacctttaccaatctatatcatcatggtaactcaccttttatccaagctgctagggatatcaaaagcatcagcaaagatgcgatagggtgcataggtgttgattctaggattacgggtctgcttattttcactcggctatatatttatcgaagctaatggttatgaggttaaagtgacggcattagcgagacgcgacacgtggcaacgataatctgtatttagtaaaattgggtgtcggtatggattgtctttttgacaatattattatccggtgctttctttaaaggtggagtcatctaatattagaactttgcagtggagtgaaaaaaccatttctggattttctactttattcttaggggcaattgtattcttgcccctactttcatttgcaattgtgattttacccttactttttaaactttgtgattttgccctcactttttgacgttgaatggtctgtttgcccctggtttaaacgtctgttaggtggactcagattaaatgagtttaagaaaataagaaattgacttgcaaaatgtaaaaagacatctctatcccaaacctttcaacctaagccactgctgactcctccgtccccgattcctaaccctcgcgagcggtggcggcacacgcgggcaagcgagagcgaggagcgcgcggtcgtcgcggaggagcgcggggtgaagcaggctgggccggcgccaaatggcgatgtcaagctgagctagcccgtcgccgtccgccgtggtggtcactgggctcgtcggcatcggcctcggctatagtacccgaaccgctgcacagcagatgatcgagta

SEQ ID NO: 66540 - DNA, 13224 bp, Oryza sativa
gaggagaagaacagcaaggagaggaggagaggaacatttgagttttattgtcttttactttttcttctttgtcactccccctttagtttttatttttcttactgccttggactattggttggttcctaaactggacaggaccaacaaagctattctgttgttgaaagaaagagatgagagtagtgtttcttgtttgcatattcataaatcccttgactgttaaaatgattaaacatgcagggcaagttcatacgtcaggcattgaggcattgaattcatacctcagtccatagtgtttcttaattaataaatcccttgattttttttaaacatatgctggagaatcgcatttcttgtgtagttacaaagttggatttcgttgttaaaataattaagcatgcagggcaagttcatacctccgttttctactgtaatcgtgaaacacagccaaaacacaaagtcctcacaagccaaatctgcaagggcatagatgtccttttacctgtcagttaacaccattaaagtcctcctgacggaacaggggcatacctgagcttcagttcaaaatagtgagggtaaaatcacaaagttaaaaatacaagggtaaaatcacaattgcagttgtaaatagggacaagaacacaattacctcttattcttatgattgtatcgggtcgacatgctccacccaatggaggtaagtaaggaaagtaagctccctccagttataatgccctgcaaatttagcaacatattagtgctattgttaagatgtaccaaaaataaaatacaaccatttgtgggcaagagaaaacagataacattagcagagcaaaaaatggcatcccatttcactgcagtaaaaaaaaaaacagagagaaacggaatagcagaggctactacagggcaccgcacagtgcagcggccagcagtgcagtacaccactgcagagtgcagacgaaggcaagcgtggctgcaaccgcaagcagcaaaagcaaaaccccggaagcttcccccaaaatctctctctccctctccccactataaatcctcccctctcgtcgatcgccatggctcccatgctctcgatcgcctcccgctcgccctcgccggcgttgattgcacctcacgcctccgcccgcgccaccggtcttcgtgctccgttcgccggcaaccgcattgtggggtgggggtggggggatcaaaccaaatcaggtacggatcgtaatcgcgcatcgatctgtgtcgtcctgttcctgcgcgtccgctccggcgagcccacgcaggcgccgcgggatccccctgctgcggtaggcggcggcggctgctacgtccggctgccggcgccgccgcgagaccgggacgcggttttggtaagcacgatccatttctttctcccccgaattccgacccgctcgtttggttgattggtttcgattcggtcgtgcggcctcgggtcacgtacatttacttctactacgagcaagcctaataatacagccgacttgttggttataaggttctgtgtagcattctctcagcctacccatataatagttagctccttacaattaatacagggctcacatgtctctctcgtagagtttcttggttcctgtgtctaagccggctgtaagtttatagcccgcttctcctctctctcctctcttttctcctccacctcaatatttaaccggcttatagtctactattatacttgctctactacgaccatagcagtacaagcgtgcagttttggagtttattaaactttaaagttggagtagttgtactactatccgaaacgtaattagtaagcgcaagtcaattctactatcggacaagtaattacgtttcggttagtagttttttaatatatctctcgtttaatgcgagtagcggcttataagacaaagacatgtgtacaagcggcgataaataactatagactatagagtatggaccttatatttctactagctaaataatcatgcttttatacggattaaaacaaattaaggtttttgggacaatttcattctagatgaaataagatagaatcatatgtagaaggattattttataacattaaagcatgtagagtaattggaagaaaacatgatggggtagtcggtaaataaaaaaaaacttggtgaggtggcaacattgctctcttttataaggagtatagattcttagcggcccaaaactaaagttaaaaatggaaaattacgaaaaccttaaattaattatatatctcatgggatttaaatttggttgctgcttataagccaacgagggtctaggaaccgataaaatttgtaaaaccaaagggcgataaataaatctcagggatacgaacacatatgcttcagccagtgcccggtggatagaaaggctatacataggaaagggaaaagagacttgcaaaaatactattgttctagtagaaagtttcatgttggtaattaatttaactttttttttgatcaaagggccttaaccctccatttccattaaaagaaatgtcacagtttacagcagaaaaaaaaaacagacttaatttaacatttgtctcagttcttcagcaattgaaagttgtttcgtctggagttgggataattttactagttttacaaaggattattctgtgggacttgaatatattaacttgcggttttgagtttgtgccgtgtgatgtcgattgaagtgtggattggtcctttctttcttgaatatgttgccatctgcttttgaaatgttggcactcttgacaaattgacaaagaaaatattaggcttgtttgctaatcatttcttattttcttgtagttgtatgtagtcgacggttccagaaaactgagtagctgacaggtgctgcctttttcttgttgcaggatttatttctcaaagactaccatttcagattactgaagttgggcgatctgcataactagcacggtgccacggtttttgagaagaagaacgagcaatggttcgacaggtacctggtttaagttctttctttcagctgtttgcctggacacttcattgcattgggtcgatgttctgggctgtcaagaactctgctgcctgaacaatgatgttttttttgtttatctagttagtttgcatgtgaaaatatcattagtttattcatatttatattgaatttttattagacatatttactgcatttctttagctttgctattacatttacttcatttgttgagcagatatgcataagctagattcttctatctaaaaatatgtataagctggacagcccccaaatacatagccttgagtagaaaacaatactatatctcaaaatataagattcatagtatcagctatgcctataccatacacatcaaattcactgtatcataaaaaacgagatttggagggagaggcgttcctccaacaattaaataagaaattgtgagcgtgttggggattgaacacgggattttggggttaaaaccacacatcccttgcgctgcattatcaagtgcatctcaaattcactgtatcatagtctacctgtaattgctgagcatttgcaaattagaaccttgaacataagtcaagtgttataattctttccttcagctgttggtattgttattgattttgttacctgaataacgatgcctttcattgtaactctccctttcctttttccagtatcacgtttgcttgttcactctacttctctgcttcatccctatcactgctttggcggaatccgatatcaagaatttatttgctctgaggaaagcaatcgctgttggaaaaggcttcctccacaactggtttgagctagaaactcctccatgcaactggtcaggtatatcatgcgtggggcttactgttgtggccatagacctgtcatctacgccactctacgtcgattttccatcacagatcattgcattccagtcactcgttcggctcaatgtaagcgggtgcgggttttccggtgagcttccagaagccatggtgaatctgcagcatctccagcacctagatttgagtgataatcagcttggtggccctctacctgcctcattatttgacttgaagatgctgaaagttatggtgcttgacaacaacatgttctctggacaactaagccctgccattgctcaccttcagcagctcaccgtgctatccatatccacgaattccttctctggaggcctccctccagagctaggcagtctgaagaacctggagtacctcgacattcacacaaatgcatttagtggatcaataccggcatctttcagtaatctatctcggctcttgtaccttgatgcaaacaataacaatctcaccggatcaatattcccgggaataagagcgttagtcaaccttgtcaagctcgatttatcgtcaaatggtttggtgggggcaatccccaaggagctttgtcaactgaaaaatctgcaaagtttaatcctatcagacaatgagttaactggaagcatcccagaagagattggtaatctgaagcagcttgaagtactcaatctcctcaaatgcaatctcatggacaccgtccctttgtcgatcggcaatctcgaaatcttggaagggctttatatatcattcaacagcttcagtggtgagcttccagcatctgttggtgagctacgcaatctgaggcagctgatggcgaagagtgcagggttcactgggagcataccgaaagaactcggcaattgcaagaagcttactactctagttctgtccggcaataacttcactggcactatacctgaagaacttgcagatttagttgccgttgtcttgtttgatgtggaaggaaacagactctcaggccacattcctgattggattcagaactggagtaatgtttcatctatatcgcttgcgcagaacatgttcgacggacctctaccgggtcttccattacatctggttagtttctctgcagaatccaaccggctgtcaggatctatccctgccaagatatgtcaaggcacctttctgcagatacttagattgaatgataacaatctgaccgggagtatcgatgagacatttaagggatgcaagaaccttactgagctaagcttgctagataaccatctccacggagagataccagaatacttagctttgctaccactggtgtcacttgatttgtcacataacaatttcacagggatgatccctgacaggttatgggaatcatcaaccatcttggacatctctctcagtgataaccagctaactggcatgatcacagagagcattggtaagctcttgagcttgcaatcgttgagcatcgacagaaactacttgcaaggacctctccctcgatcgatcggcgctctaaggaatctgacagcactgtctctcagtggcaacatgctatctgaggacattccaatacagctcttcaactgcagaaaccttgtcacattggacttgagctgtaacaatctgacagggcacatccccaaggccatatctcacttgacaaagctcaacaccttggtcctgtcccggaatcggctgtcaggcgctatcccttctgagctatgcgtggctttctcgcgcgagtcccattctgaattggagtacgtgcaacacattggattgattgatctgtcgcggaacagattgactggtcacatcccgagagcaatcaacaattgttctatactggtagagctacacctgcaagacaacttgttaagtggcactatacctgtggaacttgctgagctgagaaacataacaaccattgatctatcttccaatgcattggttggacctgtccttccatggcctgtaccattggcaagcctccaaggccttcttctgtctaacaacagactcagtggctccattccttctggcattggcaacattcttccccagatcacaatgctggacttatcgggtaacgcgcttaccggcactcttccattggatctactctgcaaagagagcctaaaccacctggatgtcagtgacaacaacatctctggacaaatcccattttcctgtcatgaggacaaagaatccccaatcccactgatcttcttcaatgcaagcagcaaccatttctcagggagcctggatgaatcgatctccaacttcacaaagctgacctatcttgatctccacaacaacagcctcactggaagattgccatcagcaatagcaagggtcacttctttgtactatcttgacctatcaagcaatgatttcagtggcaccatcccttgtggtatctgcggtatgtttggcctgaccttcgcaaacttctccggtaaccgcgacggtggcactttcaccttggcagattgtgctgctgaagaaggcggggtttgcgccgctaaccgtgtcgatcgaaagatgccggatcatccgttccatgtactggaagcaaccatttgttgcattgcaacggccattgtcattgtgctggtggtgatcctggtggtttatctgagacgacggaggaagatgttgagaaggaggcagtttgtccttgtccctgccggtgacaacgccatggctgaccatgagacaaccttgagtaacaatcttttggggaggaggaggatgaagaagagggagccaccgagcatcaacctcgcgacgttcgagcacgcgcctgtgagggtcaccgtggacgagatcatgagagccaccgggaatttcgacgggatgcacgtcgtcggcgacggcggcttcggcaccgtgtacagggcggagctccccggcggccggagggtcgccgtcaagaggctccacggcgtcggccgccggttccagggcggcgaacgcgagttccgcgccgagatggagaccgtcggcaaggtgaggcaccccaacctcgtccccctcctcggctactgcgccgccggcgacgagcggttcctcgtctacgagtacatggagcacggcagcctggaggaccggctgcgcggcggcggcggcgcggcgctcgggtggccggagcggctcacgatctgcggcggcgccgcccgcgggctcgcgttcctgcaccacggcttcgtgccgcacgtcatccaccgcgacgtcaagtccagcaacgtcctcctaggcgagggcctccagccgcgggtgtccgacttcggcctcgcgcggatcatcagcgcgtgcgagacccacgtcagcaccgtcctcgccggcacgctcggctacatcccgccggagtacgcgctggcgatgcggtgcaccgccaagggcgacgtgtacagcttcggcgtcgtcatgctggagctgctcacggggcggccgccgacgtggtcgtcggcggaggtgacggcggagggtgacgacgagcgcggcggcggcgggagcctcgtcgggtgggtgcggtggatggcggcgcgcgggcgtggcggcgaggtgttcgacgcttgcctgccggtgtccggcgcggagcgggagcagatggcgcgggtgctcgacgtcgcccgcgactgcaccgccgacgagccgtggaggaggccgaccatggcggaggtggccaggagggtgggggcgatcgaggcgatggagtacgggcctctggtggtggcagtgtccagtggcgagccgccggcgatgccatgatcttgctgctgctatactgtatactgtagtgcatcatgctcctttttgtgaattaaggtgttttgatctcatcttatatgcggacacagagatgcagcagaaactcaattttttaacaagttcatacctcacaggcatttcatcaaacacctgttatgcgtgcaaccaacccgctcattataacctcatctttttttttaatgcttatccttataagttaatatttaaaattttcaaccttaaatttgaatttcattttaggttttttcatcgatgtttacatcagttgcacttgcagcacaaccaaacaatttggcggtgtttcatgcaaaacaaggtgataatattaattgagttttagttattacaaacttaaaaaatggattaatctaatattttagaacaactcttatatagaaagttttcgtacgaaacgcaccgtttagcagtttgaaaattgtgccacgagtatttaaattttcatccacttgttatagaataaactaacgggaccaaatgtaattccatccatcccacctgcggtttctcccatctacaagggctaaccttctgagcgcgctccatctctctctctcataacagacaactttcattatccagattggaaaccaagcccaacagcacaaacacaaagtcttaatactccgtacaagaacaagaacataacacgacttcattgggaataagcgaaacgacatatttgtaaacgaaaaataatttacgaataaaactttcatatatgtgatcttagcgatataaaagcaaagactgaaaaataaacttcgttgaaataacccaaaatcaaatctaaatttaaggttgaaaaattaaatttaggctgataaacataagcataagcgaaaatatgagaccgcacgaaccttctaccttctcttgacagtcttttatcatgctataatgcaccacatgtaccccttatgccaaaattagctctaaaattatatttagtgatttaaagtttgaatgccactgacaagccaacaagtaaactacagagcaaattaatatggtgcaatctgtcatcttccaatgttgacatcctcttgcttggctagtaaccacgttttagggcttggtccggagagcttaaaattatgggaagcagctagttggtagcttctgagaatctacaaaacttgggttttccaacttatgacttatagttcattttctaaattttacaattacaacttttcaaaatctaaaccaaaagctagactgcttggggagcttctgattatagaagaagctgcagcagcttgaaattgcctccaccttgacagctcggttctgctaaaagaccgctcctgcaatcgaaccaataaaaaaccggtgaacatgccagtttttccttgaaccagtggcgggtatttaagtatcgaaccggtttttatttttcctatggcattatgacaggatgaatttattatgttaccacatcacatttattttttttaatgttatgaccatgtaataataaatataatggtttatttatgcatattttcaccaatttgtgatggttatatattaaaaataatacaaattaaatgtaatattaataaataaaaaaccagcggtcgaaccgttgacccggtggttcgtccggtgaaccaatggctagagcggatcgaccctcggaccggtttttttactatgcctcaaacatgttcttagaaaccaaagaaacactacttgtatacaatgacaatccctcgattccgatgtatagctggacaataacgactctttttattcaccatggtttggaacgaaaactttggttcgaaccaaagcatctcggaatataattccgtttttttatgttccgaaatccgaatgggaccgaatcaccgcgagttctgacgcaactgataagtgataaccaaccaaccaaccaaccaaatgtttgaaccaaaatcgggaagcccggcaaaatcctcccaaattcggcaaattcccagacctcgtgccctacctcaaaatagcgagcgggaatcaaaaccacacctgaattctcaaaccacaacacacacacacaaacagttggtccatagccctatactcactgacatgtggaccccacttaaataaaccccacgagcccactgaagtactgaaccagacgcgtaggagtactctcaaacacaacccgcacgcccgtcgtcccgctcactgacatacgggccccacgaagctctagaaaaaaaatccctagccaccgacctccactccaccttccccacagccactgacaagctggccccacccaaaagcgaaattaatctcccccgagccgcaaggattctcctcgggaaggcaggggctttcaaatccgcgcctcccctctcctcctccgccggctgcttcccccccacgaaatttcgcccaaaattttccctctcgcgctcgcgctcgcttcgccgatcggggctcgagtcgaggccgccggggcgagcgcgttggggattcggagatctggggggaggggattagggtttgggagcgccaggtcggtccccgatggcggagggcagcagcggcggcggcgggaggcagcagcagcagggggttgcggagcggcggctgctccggtcgcggtacctcgccgtgaagaatctcatcagcggtagggggctcgccgtgggggtggggtttggtttggttttgggtgtgcgggggtgtgtgatttgagctgtttgtgctgtgtgttttgtccgccgcagatgagaaggatgacatggcgagggcgggctccgacacgttcgccgccatcatcacgcaggtggactgcctgcacgagctcggtatacgaaatcctccccccctttcgcctttgctaaaccgtgtgtttttctgcagtttgatgtggttatccttgccttggactcgctgtttccgatttgtattgcatttgagtcacagattagaaagacatcgtgatatttgaaccttatgcttaggctgttagtactagctgctgaagtggctgctggagcacttgttgcaggttcagaaaaaagaagaaggcatattagcaagttgttcatctgcattgtatgtgtagtgaatctcagcaggatctcaaaacattggttggtcttcagataactgatatagcattattgcgaactacttctggtttattctactgttgacattttacttcaaattgctactcgaacatcagagcatcagcatgattgcatttagtttcgttggttgttctcccatgctaatgttgatgtaattactcagttcctatcttctacaagaccaatgctttgtaatttgcctgcatgattgcatttcttggcaaaacttggtgtttattgccatgttaatattagaagttcagaactcactgtcgcattccaaaattagtactagtacttcgaatagctgcttatgatatattttactggtttggatcatttaagcataagtgctatatgaagtacacaaaatgatggcatccttctacaatgcagtgcagaggcctagggagcaaatagctgatgcagaaactctgttggacattgcaaacactttggtaacatccgttaggtctcagtcaagtgaaggaatcactccctctgatttcgtaacagccatgctgaagaaatttgggcaatcagggggccttgattctgaggctgcctcattgcgctggggggatgttgggctttctgtgtcccatgtcttcagggctgcacctggatgctgcactatgtaatgaagctctcttccgtctttatatatgcgcatcatttcttgctttctataattctatccgcctggcaaatgacttaaacaactcaaatctgaatctttacaggcttggacccatgaatacagaagtaaaacaacggaaggctgtggttgccaatagaaaacggactgcgaggccaacggaaaatgctcgtcctgaacaggtagccaactaggcaactagccatatgctattctatattacaaagggtatgatagataccaacaaaaccataatagccatctgtgcatttctttcatcatggtattcattttttccctccattagtctctgaggtagttaacaggtctggtgctattgttcatgccataacaggtctggtgctattgttcatgtcattagctggaacttaacatatctatcttactgattccattttgtaattgtattgcttacatgttcaaaaccatagaacgtttctttaaaggaacatctggaacagaaacatttatattccttgtccactatcaagtttcttgtccgtgcatctggcagactgatcttttttacggcaatttattttgtttatacctggatgcaatcactgggcttgtatactgttccatggcttactctgaatagcacattgatatgatgctaccttgtatgcagcttgctgaatctttggagggagtaaagacagacactgataggaatgtgtctgtcatatttgatatcctgaggaggaataaaagggcaaggctggagaacattgttttgaacaggcgttcttttgcccaaactgttgagaacgtttttgcactgtccttcctagttaaagatggcagggtggcaataaacatagatgacaacgggcatcatatagtctgtaagacccttttccgctgccctcatttgtttccttaaatgatatgacaagatgccgcttctttagtgacatgtctaagataattctattggtcctatgcagatcctagaaatgctcctgctgctagtgcgatagcctcaggagaagtctcctacagccattttgttttcagatttgatttcaaagactggaaggtatgttagtagttctttttgttgataaaccttcagatttttgactttgattaatcaacttcaactgtagaactgtacaaaattcaacttcaagatctgatatatagaattattcttaagttttaccaccccattttgggatactggttttctcaggagtgagtgccctttgtcttcatttatctgataccaatccattttgttgctgtacattaggcctaagctagagcttaagctaggaagaaaaatccttgtgttgatttttgttttggccagctcctctataaaatgacaatttttttcgcacgccttttctctttttatttacagttctgggcatcaactaatctacaattggccctcttttttgtcatccatttccagcttatgcaagaagtcgttccggacggggaagaactgatgccacacaggaaccccgagaacatcccctgcgccgaagatcatgaccaggctgatccaccggagctatgcgcgcaaagaacacctatcaggaagctcacccggaaccggggcctggtgatgcagcaggaccagatggtggtcgcggagacgcccgaggagaagcagccaacctccaagcggaggcgcctcttcagagaccaacaatcttgaagcgaaaccccccctgccctgctcgtcggctgctgtagtttttagcactttagcgtgtgcgcctacctgctctcgtgttgtatgtagagggagagatctatt

SEQ ID NO: 66541 - DNA, 3374 bp, Oryza sativa
tctgtacaccagtcgggcgacatagctcatctcgtgctagctcgtgtaacagcttagatgtaactaatgttcttcttttaactctattagaatttagatcaggcagcttcgatttttccaaagatcggtggaattgtactcttgtagtgtgacgaaagatcgctagaatttgctccttagaggaatgtagcaccagtggctgctgcaatccttccgaggttttacaaggagcaccagtggatacagcaatctttctggagtgctttgattgccaggtacgcaagttagccttgacccataattctgagctacgactaaaaagattatctaaccaacatggtaatagtttcacattgaggtagaaaaatgaaagtgaagacacattggggtagaaaaatgaaagtgaaaacacatcgaggtacgaggtagcagtttagcaacaggaagcgcagacagcagatcatccttgtttgggtagttccaacaatcaacgagactgctcactttgccagagaaacagtcacagtagcattaattttatgaaaagcatagtaatcatcaaccacagtaggctttaacatcgcaggagaaaagggataacataatcacataaccaggcgtacgagaaatagctcaaaaataaaatgcaataaagaatccagaggtaaaacaagacagcacataagcctaaacggtcagaaaattcagcatcagccctcaaagtttcgagttacaatgactaatcgctacaaaccacaatggatctcaagcagcagctgatttccgaagctcattttcaccatgggcaaaatggcacctgtcgccaaaagtgcacgaccctttggtgaagttctcgcacagcttggtcttgaagttgcttccggggcctcccccgcggtgggatcctcccacaggtttcttgccttgtggaggggcaccgccaccgatgctgacaatcagctccctcaccattgcactagcgttcttgatctgatcaaatgtgccctcaagctcaatgtttttcaagttggtgtctgattcatgatcacggatggccagcttggcccctgtgactctggatatctgctttgtgttaaccccacccctcccgattatgccacctgcaagagatgcatcaacactgatcttggctgtggccgaagcgccaaagcttgctggagtggacatggcagggctaggcattggtggaggtgcaaagtgaccagtgggccttggtcccattgggggaggcattgagctatccatcaacataggcttgccgagctccctctcaccgtgcgcaaagtggcacttatccccccatttgcatccctctgcagtgttatacttgttgcacaggcgagtcttaacagtgggtgttggtggcccatcaggaacagcatttcccattggcattcttcctggaggcggcgcaatagctggaccaccaagattggtcatctttgcaacagcttggtagccaccagggaagtggtggaggaagtggcaaccctcaccaaaggggcaaccagaggtactgcacaataagaatatcatgagtgcaagcaaaaagatgctgcaaataatgtcctaattgaagaactacaccaaaagatttcattgtaaatgcaactgatgtttacttggaagattctaatatgtgaactttaataggtcaacatctcataaacaatgattggaaatgatattaacaagtgaagaacaaatgttaagatgcagtatggactggaggagatttctggaaccaccaccacatttaaaaacaacatggcagtaaactacattctaaatgttgagcttgacaatgggtgctaataagagatgtagaccatatgcacaaattttggtaatgactcataacatcataagcttgatagaaaataatttcaggagcaactatttacggaagtatagattcaaaccatacagtagtaaaatttatccctgcatgtagcaaatgttaggataaatattatatgttacaaaggacataagtggcaggatttcaaaatgtgagttcagttgcagttcccaagtcatgtattcaatcttcttttctcaatttgagcagatgaagctgcatcatgatattactgacaggttgttcatctgacaaggagttacatatccttaattccttatactgttgcatctttcacaggttcaaagtgatttcgcgcaactgtgcgcattccaattttactccagtgagtgtttcttaagcttggattaggtacaacctgtatcacaatctttacttgattcatgtgttagcaacaatacaattcttttaggaaaaaaaacagaagcaaaattttaatgaaataaccatgcataataaatgttaccaggtggagttcattttaagttggattataacctgaaaaatttggtgcatggcttcgatttgcttcctacaccggtttgaaatgactccgattctgttgcatcaaattaattatgcgttccaagttaatagttgttgatttgctaatctttggtacacaagagaacattaatactccttttaactacttttacgttcctactgcaaaaacagtgcaaaaataccgcattaattgaagcagctactacactctttatcaactacccacagcttccctccaagtttttaaaacccataattaattcaaagtacgccttgaaatgaagaacacggagcaacgagaccaccagatctggtttaagcagaccaaccaatctgaaaaagaaaaacacatgccaactcggcgaatcttggaagaaaaactacaaaaacattagctcgcctttacgaaacgagagtcacatccgctcttagtctctctctctctctctctctttccaaacctacaaaccctagcagaataagcagcaaaagggcacgaatcggggaggctcctcgatctaactacgcagcgaggaaaccaaatctcgccgcggcgggagagagggggatgcgattcgggaagacgagagcaaaggtcgggcacgggaaaggggaggagagggttgcgactcacctcgcgcgcgcttcccgccggcgccgttcgcaccgtcgggcttgcccctcttgcggccgccgacttccatctctcggctcccccacacccgcgcccgcgctcgcgctcgcgcacgccgcctcggagctcggctagggtttccggctcgtcgcggcggcggcggcgggtagaaggcggaagggattgggtgggcgagaggaggtgagagatgtggagtttggaagagagtggtgtgatgtgttgggccgcgcgatgtggagtggagtggtgtggtgggctttgtgccttcgtggctggatcaaagcatcgccaactcactgttcttggaaa

SEQ ID NO: 66542 - DNA, 1549 bp, Oryza sativa
tcttcttgcggagcaagcctgcattccaatttttgcctgggccatccaaaattcagcaatttatttatctgtttctacttttgcacctgctgaaaattaaaactatttttaacaagctaattattgaccaatgacgtggctgaacagtcacaggccttcttcctccccgaagagacaccaaccacgcgatgataataatatattttatatattttattttagtcatggtcgtatctaatttgtcttcctgtttgcaatttgcaatgaggtgtcaactacctcattctagaagcaatttgaacccaaaccttttggaatcaatttgaccaaattttactatctttattgaccaaagtgtaaaacggagaatttttgagggggctaagtgcgaaaagtgcaggaaaaaaatgggcgattttttttttatttataggcgaggaacaatcgctcgctcggtcgccttccccttcttcctcctctccgggagcgctttgaacaatcgctctctctctctctccctccccgattcgattcaattcgcgacgcctccgtgaaattctccaaagcgtaagtgcatttcatctctcccggttgcgatcctgttcgccgtaggctgtaggattcctgggcgggtggttgtgtagatggatttttttatgtggaatttcggtgggttttttttctattggattttggttttctacgcgggggattacgaattgtggatccgttgtagtttcgagagatttaatttgctttttttaattattatttttttcggtttgggaggaattgtttggaatcgatgtggcgatctgttcctccgcgcgtgcgcgtggtggtgtttaattatttttttgcgggattttggttgattttgggatgtattatgttctgacgaaatcgtttacttcgttgtttgtttgcgcagcagcttgccctgtagccgcgtgctccggccatggcgttcttcaggggcctgaccgcggtgtcgaggcttcgatcccgcgtggtgagccatccaacatcttgcatgcctattttctggcgatgcgtttgcatttatgtgcgctgaaaaattgttcgttgctttgtgttgtcaggcacaggaggccaccacgcttggtggtgtgcgatggctgcagatgcagagcgcatctgatcttgtaagtcaattagtttttgttcgttcgtgctaaatgtgtggttgaaactaccagttactatgtgccatctgtggctaggctcgaaagtggggaatgtgctctgaaaaaagatgtttgattgtgtttctaaatattatatgcaggatctcaagtcccagctgcaggaattgattcctgaacaacaggtttgttactttctagcacgtctaataattcacacaaagttggaaagtatatggcatccagttctttatctaccctttttgctttactgctttagcctgtagtgatatcatcttcttgcttcatgcgatattgtgtgagggcatgcttgcaacttccaaatgttgtggattatctcttttttgtaaaagctgtgctgg

SEQ ID NO: 66543 - DNA, 1035 bp, Oryza sativa
gctttaacaaaaggtacccaagttcttcaaatcagacaaatctacttcataacttaagatggactaaatgtgacactatcaatctagagcatgatgagtagaagtattgacatgtttacatttcagttctggtaaccaaaaactttaagtaattagtttaccctagatatttaagaaatctaaacatgccaagaaacaactaatacatacatcaggtgtgctgttgaaatcaccagcaagcacgataggaattccaccccatttttcagcaagagcatttgccttctccagtagcatgcggatctgaacggacagataattggaaacgaaaactgcttagcaaacaattagtcgagtaaaaagtataatatgttgaatagacatagataaagttgaggtatagtttcaatggtgcatcttaattgcagtaaaaatatagtgcgttgaatatacatagataaggttgaggtatagtacatatggtgcatcctatttacatcagcatatatgagcattatgcagtacatcagtgattaacatgaaaaaggtccagtttttgtccctcagtactttacaccctaaccttcagtaatttctaaaagatgtcattcaacaaataaaaaaccatgcacatcacatcctggtgatagttttgaaggaggtttatatggatcctacatggtgtgtgcccgtgtgctagtgaggtaatgtggcttcataatttagaaaaggaaattagttggaccattttccagaggacgagtggataccatgcgtcaaaataaaatgatggtgcagaaaccacataatcctatgcacaaaacccaaataaaaaaaaagaaacataaacagctttggatgcaatttgctccagttttaacatttaagggaaaaactaaaagttattgaaaaacatggtgaaaacaactaaattaggctccagtaatagttgaaggaccaaaagtggacatttacaatgaatattttgtgcaggcgattttaggacatgatagagaactggacgaatgatatacg

SEQ ID NO: 66544 - DNA, 829 bp, Oryza sativa
aaaaaactcaaaatcaactccaagatttaagattgaaaaaataaattttaacttataagtataaacataagcgaaaagatgaggatgtacacttttattcaataacttaaagaacgcggacataagccaccattaaagaatacatttacagtttcacacacttgacaaaggcctacggtatatccatgaaattagggaaaaaagaactcctgtagcaaatcacacgtaagttgcttcccagttaccatcgcccgtaacttcatttcagatgcacttacacggttacaccccaacaatacgcatactgcataacatcttccgattcccagcagaacatcaagattagaactattgcaaaccaaaagcaacttgaggatatcagtcgcggttattcatatttacaatgttctgatcagtccacgaccaaacagtttgcatattggaaaagaaaagaaaacatacacgatgacaagcatacagtaactaacaagccaggaaaagcacgcatctccattacatgtttgaagaaactaacgacatctgaaagaagctgggattgaaccaagaacaacaaactacggagttttatgcgacgatagaaagttaaacggcagtggctgaagcaacggttttgaccatgctttccccaagggctggaccaaagccgttatccaagacaggattggcagaggcaggagatttttgtagagtatcttcatatgcagcatcatgaacaccaagagcagcacgaccagatggatcaaggtttttggaccaggctgcgtcccattcaacagctttagcagtgctgcacgcgacgctaggacct

SEQ ID NO: 66545 - DNA, 1044 bp, Oryza sativa
attctaaggcttcggctaacaaatgccaattggttgtgggaccacagctggatccacagaagagaaacttttctagccacattagcaagaaagctacgtgctcccgaggagtgacaagccctttgcccatgtatgctgctacataaccagaccaccctgctatccttttggtcttgaagtcaaattggttcttggtgttcatactcatagggttagctgatgaagttacatctaatccagtaatcatgatgatgtcgatcaaagttggagtcatcggcccttggttaaataagaaggcattgatggtgttggactagaaattggctatggtgaaatcaaagttggcagccatcagaggttcatccttagcaaaattggctatggtgagagcaagcgcttggccgatcccaatctcatcccagtgggttttcttactagccgatatgcgttggtaccaggtggtccagctcttatcaggggtaggcttttcgagagatggccaagacttgaaagtattcttccagtgacccaagttagggttggctagtctaaaggggattctgttggtttcaccaatgatgaaatcagtggggtcaagattgccgattgggccaagaaaatagtggtttttgtgcgataggctgggaatcgcaactaggttggaaaggtgctgcaaatccaaaggaatcgggaagcagaaaacataatgagaaaaggagaaatcgatttcatgcgaggaaaagggatctagctgctgagtacttaccccagcgtactcggccgatggcgcagtagacgggctagtggaagacgacatcgccgcaggcggagatttgatcaaaagcgaaatcgcctggggatcgattttgcgtcggaggaatcgccgaagagagaaaggacaaagtttcgcttgggcggtgaaaacggaagtcacggcatgagattttttgagggcaacggttggtatttaaagcgatagaataacggccgaaaatgacagagtgcgaaacttgctggagtcggtacacggcaaatccggaacat

SEQ ID NO: 66546 - DNA, 850 bp, Oryza sativa
ttcaatctccttacgctcacggcgttcggctaatcttagcttggctttttctagtttaaattgatgttgctcaagataagcggctggagttaggacatcggccagttcttcaggaattagaacttgaactttgtgcaatcgtgtcctaatcgatccacagtcgaccactaagctatccatagaagaggcttctagccgacgcgagatatcttcaagtgttttctttgcatcgtcagataagggagctagagctttgcttgaagtatcttcttctgcctcatcaagataatctttgatatcaaaagaaaagagatcggctagagcctgcaggtataagtttagaaagtttgagagctaagtcaatatagtcgatctaaattcttgcatcaaagaaagacttactgggatagcaggagcagccggttgttcttcttccacaatatgatgactccccacagtcgatggagttcagtcactcgatgattgttgtacaggagaagaaggaggaggaggaggctgtaaacagacaagtgttagacaaaatcggctgaaatcaactagtaaaattgagagtgtcttactggtggagctggtttgagaattggtgctgccgatttcttctttatagcagttttcttcttctgcaactacaaaacctatgagtagtcggctgaaaaataatgattacaaaagagtttgcaaggaaagatgttttactctgaagaagtgagtgggggcagaaggagttgaaggtatctgcttaggcgaagccgatggtgttttttcagtatcacttacttcggctgcagcctgatcaacattgtcctcaatatcttcttcatccagagct

SEQ ID NO: 66547 - DNA, 1663 bp, Oryza sativa
tatagattatttatgggtaatccctataagtaatcgattcacggtagaaatttggatttaactactagggattttaccagtgtattatatttaatcatttagtcatagactaaattaaatcgtataatatttctaggattccgtccgatatttagctcgcgatagaaatttctaacctattatatggatataatgctcgggtagattaaattaaaaacttatgacaacaaaatatttatacccgcaaaatagtttgaatcgaaattgggtttgccttagttcgcgaataataaagttaatataaagaaatcgactttcgcattcgactttcatttggattcatttggatttttatttgaattctaaccgaattcaaatcaattttcgcacgtaactatagagcccgagggagttgcggatccaagcgaaggtcaagacccgcaagacattgagcaatgcaagtcatcactattccttgaacatgttgatcccaattgcgaaattgttttgtttacaaataaaattgcatgcaatgatgaacatcccagttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaagaagaaataaaattaaacaactgttttcgactggggcggacggaggatttgggtggtatctggaaaaggctagtactgtcgccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacggtgggacagccgttgaggtagggccgagaggcgtgccctacatcggtgtcgccattggtaggactgctgtcacaccctaaaaatcctaaatatataaactgttgtttaattggaattattagaatttattttaaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaatgtttttaaaagtctcttttggctttgggccgaaagtcggcccaaaaccttctctctctccctcggcccagtcggcccagtcggcccagtccgcagccgccgcgcgcgtgcgtccggtcactgacaggtgggtcccacctgtcggacccgtcgtcttcctccggccgcccgtcgcccgaaccctagcgccgcgccgccgccgtctccttccaaattcggccgcgcctttccttctccggtgaaatcgattgaggggaaatgtttcccgagatctcctctaccttttctcttttggaatcgtcggctaaaatcgtttggaaatccg

SEQ ID NO: 66548 - DNA, 2219 bp, Oryza sativa
ggatcggttgatctcggccgttcgttttggataagatcgatctcggccgtctgttcccgtgaaccgctgccgtgcgcctggtccaccgcaaaaccctagccgctgacgcaataaatccctttttccttttcaaaaataattcgttattgcgtcataattcaattaaaatccatataagtgttttaatccgatttaatctttaaaaattcataactaattcatcttagctcggatttagttggttcaagtctctaaatttttctaaaaatgagatctacatgttaaaaatatccacatgtactgttcatgcttgtttatgtgctgttttggtgattttgcttctttctgtttagattccggcgtttccggagagtccgttttcgcaggagaagaatttgaagagttccaaggccagcaaggcaagtcacacagatcccaaacaaccctttgagcatgttgatcccgtttaaagctattgtttctattcaactattgcatttattttcgaatgtcatttggtggaattaacctattgtttgttatagccctttttgttattggttcctttattccttgataccttgggttattttaacttgactagttgggctatatatattggttcgactagatattagatgtgattgcttagccatgcttagaaacattagcacactattgggataacttatgattcattattatttaatgatggcttaatgctagttcacgatggtcaatcgtgattggttaattaattccttgcctactaaaatttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgcgctgtggtggattgtgttgtgcaaggggtattgtcacagctcctttccgaggtaccgcggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtttcacacctctcatcatgataacagatgctataactggtaataatttgtttagctcctggtttggaatggtatattcctggtttggagatagaactgtgcagccgggatggttgttcagaatggttgggcctatgcaacagggtatgttgtatagcgttggattaatattgtttaattattacttaactgttttattaaattctgaaatgtttattaaatgctgtttgtgcaaatgaaaccctactatgccacccttttgttaccctgtgcacttgcatatttgctgcgtgacttgctgagtatgtcatatactcaccttgcaatcattcatcagaggaagagttctacagtgaagctgatggtgtggaggattaggtgtagccttggtcaagctgcctgtggagtggagccgtctgcgccgtttatcttatttttcgctgcttagatctttattgattgacaggaactatctacctctgtaatgacattttattcgcttattaattagagtaataattgtactctattatcaatttgttattgtgtgcctcggctaattcctggacgagggttcacacacatgtaagcgtttggaattttggatagaaattccaggcgtgacaactgccatgagtgtgtgagagagagaacttaacttgaaccataatttaatatgtgtgtgagacttctctttcccgggagcgccagaactcctctcactgctagaaacatggacgcctagagtgcatgaggattgaagttcatggagcgggtactgccaatgcgaggttatcgaaaagttttgccgtgacacgtctcatgtgttgggatgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattctttaacttgtgtgggatggg

SEQ ID NO: 66549 - DNA, 2424 bp, Oryza sativa
cttgctttcgggttgagctgcatcggtttcgatcttcaacaagaggtaaaacttgttatgacggcttgtgttctcgggattagtgcttccatctttatgacactctaatcttgtctatataattcgtcaagttatcatatattttacataatctttggcaatatcatcatctaacctacaatcggctaacatccgttaatagaaggcagctgattaggttaaatagtgaagttgtcctagattatatgagatatctaccactttatgaaacacccagtggcttgattgtctagatattattcttcttttcatacttaatgctgcatcagttgagtttgatctattaagtcatgcttagaatatcaatctctaacctgtcctctggttgcctattatggtagtatcggagtttcagccgatcttatctgatttaaccatattcgatctatatgcttcaatgacatgttaaatccgccttttgtgtcaagatatcgtcgcaatctaaatatattaagcttttgtttaatacattatacctgttttaatatcttgatatatagtagtatcggagtattagccgatacaagctagatctatctgatcggctatgctataaacatatataatcctgttattgatatatatttcgatctaagtgatttatactatctcggcatggtgaccgatctatcccaatcacgtgatttaagtatatattaatataagaattatatatcgttaatatctacagccgatcgaatagatttagttccttactatctatttataaccgccgatcgattcatatatgacatcggcttaaagataaatgatatgtcatcggcacctagccgatcggctatcatttatagatttaaccacgaattctttgtctctatttcttgttgataacaggatcaaatcaactagcacgctcatacattcgaaggcgagctttggacctgcactggagttaagcagatctaccctggtctacgtgttttctcatcaagcagtatacacagataatttctatatatagtgcgacaacgttggtgcatactcaatggcacaacagaaacggaacaccacggcctctgtttctcaagcgtggaccatctgcaaaggcttttgactctgtatcctgggaatatttgttggaaatgctacaatggagaggattcggtacgcggtggagagactggattgccttgttattatcgaccaccacatccaagataatgttgaatgaaacaacaggagaggcaatcacacataagagaggattgcggcaaggggacccgctttcaccctacctcttcatattagcaatcgaccctttgcaaaagatactgaatgtggccacagaccaagggatcttgtcaccaataacaaacagggtggctaagttccgaacatcgctatatgcggatgatgcggcaatctttcttaacccaagtcgagctgatgtggacaacctgatcaccctgctagaaaagtttggacatgccacagatctacaggtgaacttaagtaagagctcggtggtgcctatgagatgtgagaacatagagcttcaggaagtgctgaacaatttcaatggaaagcggactaatttccccatcacatatctaggactacctctgttaacggggagaatcaagagagtgcatctccaaccagtcatggacaagctccactctcgtcttgcaggatggaaaggaaagctgttgcaacaggcgggaaggaagacccttgtctcttcggtactaacctcaataccaacatatttcctcacagcgctgaaacccccaaaaaatttcctgcatgatatggataaaattagaaagagattcctttgggctggcgacaaagagattagtgggggcaaatgcaaagtaaattggccagagaaatttgctcgagccttgagagtgcgatggctatagttcagctgggagagcccaaataagccttgggcagggacacctcccccttgtgatgaaatggacagaaggttgtttgcctctgctacaagggtgacgataggtgatggtcgaaaagcgagtttctgggaatcaaattggattggcgaacaaccacggaaggagttagccccagccttatacaatcatgccaaaaaaaaaggtaggacggtctacgaaggattagcaaatgaccaatggatactagacatcaggcacaacctcacagtcgagctagtcaaggaattctttgaggttttctaccacgtgtggaatagcgacattgcactcacagaaggtgttgaggacactataacttggcgatggatggcaaatggaaagtacaacgcaaagtcagcctacatagcacagtttaatggcaggataagctcagcagctgcaaaattgatttggaagcattgggcaccttccaaatgca

SEQ ID NO: 66550 - DNA, 2200 bp, Oryza sativa
acgggaatcagtttgaatcgtaatctgggaaactatgaggtagaggatttggaacttgaacataaccatatacttcaaacaccagaaacccgttacttgatgccatcacaaagaagcatttcagaggtgcaagcatttgaaattgaaatggcagatgcttctggaattcaatcaagagtcgcccatgaatttgctggtcgacatgctggaggatcctctaatcttggttatacttgtcgtgaccacaagaattatctatgaaccaaacgcctaaaggaactaaagtatggcgaagctgaagtgaagaatgatgtgcatcattctcatttgtgctaccatcctcaatcagaacggtgcaatcctcagtctataatcaatctgttttcttgtaagtacgtcactcttgccagtgggttaatggtaacgaagatggagggattattttggcaccaacagaggagtaaacagaaatcatctcccgccctcaccgccagtaattacgaggctatttaactaataatctgttgattaattttatttgctatagactaatttcagccgttgctttagaacggagggagcggatagaaggaatgtcagaggatacgattcctcactatctgtgtgaatttgaacttgggaaaattataggatatgacacggatgagttgtattcgtctgtaagtatttgtattatcgaacatacaataaattctattatgaccctacttacaaacatgataagattggtagtaaatcaccatttataaagctacaaataatattaacatttttacacttcaattgcattcgtaggcttaatatcttagcattgaagatacaaatagatatatgtttcctattccagggttaataaaaaagaatggcataacataagtgatagaatattccagattatatgtatctagctagctccaactcataagagagataagggacaggatatagctttttagcaaaggtcgggatattatattctattatcttaaaaaaagacaggatatggaaaaacggttgtccgacctaattacaccccctatataggtagttttgaacttttcatcttgaaactattgtcttacatgtttgtacaaaggcaaaacctggttttcttgggctgcttttcagcttagctctattgggcttaatgggcttacacccaaatctaggaataagttcacatcgtgacccttaactgtgattgaaatctaatccatgaccctaaaccataaaactggatatctcgacccccaaactcctaaaactggtgcaatttaactccctcagcggttttggagggcagttttgctgacgtggcgcctacgtagcgatattgaccgagtcttcgttccacgtggcattgacgtggcacttaggtggcattagaattaaaaaatgtgtgggacccattagtcattcacacaaaaaaaaatgtgggcccactaacatgtggggcccacatgtcagtcctcttccttcttcctcctccctctctcccttctctctctttctttccccttcttccccttcggccggcagcggacggcgagaacgagtggcgacgacaggacgggcgagggcaggagcggcgagccgtgcagccgctgccgctgccgtactcctcctttcgaggcctcgcagctgccgccaccctgacacctctccccgccagcgctcgcggctcccatccaccgacgacgcggcttgcagcgatgcggttgcacagcctcctgcacacgcttgcggccgggggagtgcttgttgtggggctcggagtggctggtgggagcacggtggcgcggaggccgcctcctctgctgttcggcgatgggcggcgatggccattgtcccggttctactgctccaagggcgggcggcgtccggctaggaattgcgattgtgacgacggccgccatcttcgctccctgccacggccgcgtctccgcggctcgccgttgttgccgctccagcgacggccgagctgtcctggccggaggagcgaatgggcgaagcaactttcccggtgggcgactgggcgagcggatgcgctgcttcttgtagtccagccagtcgatgcctacatggttgaacacaatataatatatatatatataatgcaagaaagaacgaaagaagttaggaatcgaacgaatagagatagagattattagcgaagaac

SEQ ID NO: 66551 - DNA, 2179 bp, Oryza sativa
aaatctgtacacgtcagtatgattaattaggcccacatattgtcatactaagaacaataaggctttgtttgacaaatttcaaatcatggcctccaagaagcactgtttcgaacatttgaatttcatatggatttttttaaaaaaaaccatatggaatagtttcaagaatatgaatgcaatggctgcacctgcatataccagtttgggaacctactgctgtacagtgcgtgcaatttgatccccttgaatgtacagactgcacgctagtcctcttatcaaaagatcaattcagaatttcagaatgtcgaaaatggtccagattagaagatagatgaagtgcaggatgtcaaggaatagtccttatcctgaacgtgttccagccatcgccccatgagtagttgaaaaggactctgttcatgtcatggctgagcacgaaattatcttgtacatgctcgcttctcgagatataggtttagttcatcatgataacgtgattccccacgctttgctgcgggaattactaaataatttttaatatatatttttcgtaaaaagaaaacaaatgaaatatcagggtttatcattatttatcatgaaacaaacaaatgaaacccgcactttaatgtgaaacatattgataagtttacgttaaaatattataaaaatgatagatagatttgtaacatattatggaaatgatgagaggggtgatgattggatatattttcatattgatttgttgagttaaatatattgtagatgatgttgcatgtttgtataagattgaatatgtaattattgctgggtgatgatttggcatggttgcatgctaatctttagagtcagtgggttgtaactttatagaaaacatacatagatcatgatgcaagtttacagtcccgttgtcatggttgggaacgtctcttccggcatggaaaacggaacagttcattagcgcgcgattaattaagtattggatgaaaaaaacttaaaaaataaattaatatgatttattaaaacaacatagaaatatttcgtaaaatacacaccgtttagtagtttgaaaatcacgcacgcagaaaacgagggagaggagttgggaacggtaagaaactaactcagaccctgtttagatctagggactaattttttagtacttgtcacatcggatgtttgaacagtaatttgaagtattaaacgtagattaatgacaaaacctgttccataactttggactaattcgcgagacgaatctattaagcctaattaattcatgattagcccatgtgatgctacagtaaacatgtgctaattattgattaattaggcttaaaaagtctgtctcgtggattagctctcatttatgcaattagttttattattagtctacgtttaatacttataattagtgtcaaacatccgatgtgatatggactaaaatttagtccctggatccaaaaaccacctcagcctgatctatggtgacttcatcattctcaaaatatgctggcgtagtcttttgaaggtacatataatgatagggtgtacgtatttgaatacgtttatagagatgagtgtgcgcgtgttgtgatctctcgtgcgtttgtaccgtgtttctaaaaaaaataaagtacaattgtgataacagggaaaaagaacacctccgctagcttatccgtccacttgctgcatccctaaatacgaatgcaatggctgaggatcatctgtcgtttatggtagaggatatgcgttcaaatgtaacggccgcatttaccggtttagaaacactagtgccctacttacgtgcagtgtgttgagtgatttaaagcccttaattttattgcgtgatcaccctttaccagaaaagcaattcaaaatttaacaatggtgaaaatgatccattacaatagaaaatagacgaagggtggaaactctcaagccagaaaaataaacccttataatgaatcgtacgacgaaatggaaaaaatataaagttttgggtcgataattggttggatggaagaccccaaagatttagcaccattgatttttaaaacggcgaaaagacaatcaaattgcctgaagatggaactcaagaataaccactgactggcaatgctaaatccgattacttttgtggcggagattgatgcatgtgctggtgcaacttggaagtaaa

SEQ ID NO: 66552 - DNA, 1510 bp, Oryza sativa
ctatacaatgagttttgtgtgttttcgtttgcagaggtacttgcttgggcgaaagaaaagagaccaagcgtaactaatgcatggatgatcaaagaagttgattggagaccaaaccaagaccttatccaagcctacttctacctcaccatgtcacttttggtccatagaagacaatagataaagttctacacgttttggattcggattcggattcgagcctcctgatagcatcaacttcaaatggacctaggcgctgatctagaatgaatttcggggcccattagtacttgttggaaagcttatggagtctactttcagatggttttcgttcaacgtcaaaattcctaccgagctgtcaggaatctgtaaaacaagccacgtacctcatccagtcccaatctgattttgagttttgagccttgtaattgtgtcatgggctagcctgagggggtgtgcgcatattaattcagtagccatcatcgtttagagtggggttttgcttagattattctgtcgagaacagtttcgccgctagatcggtttgtaagaccccaacttgtgagcttaatcattcatctgcaattttggttgtattctatctcattcttgtttatgttcttcgattggcaaacagggattagtcttttcggcgaggtcattcgcgtttcgacacgggtgataactagaggagacgttgtgctgcgattgcggggctcaagagcgtgcgcgtttaagaagccggatcgatttgtgtcgcgacttcgcccaaatcgttgtttaatcgggaaccctagtgcacatcactaggaggaaaaagatcctgggagcctggtatctgtttagcaaggtttgcccctcaatccgctgttttattgttaacaaggcttgtaacctgaacaatcttgttttcttactcttctcctaatatattcggtaagtcttttgccgactttgattttttaaaaaagaattgaatgacgaagaagaaaatctcatgtacggtttcctctaaaagcaaaaatcttatctatctaccctatagttcaacaaatggttttactcattcatcattcatcgtgtgacacatccgacgatcgaaagaagtatggtgatttgcatcggacggcatccgctcctctccctccgcgcctcgcaccgcatccgcttctcttgcgcctccctctctcccgcacctctctccgagtctccgagatccgcttctcccgcacctcccctctctcgccgctatcgcctccctccccctcccgtcgccgccccagactgccctcccactgccggctccctcccaccaccactccaatccgccatcctaccgccccatcccggctccgatccctctcccctcctctctcttttactattgcaaatcctagctccttctggtcccccgtcctccaccgcaccccatgccatccgccacacagccgccgatctccgtcgccggttcaaagttggatgtcgccggttctccccgtcgaccgttgcccac

SEQ ID NO: 66553 - DNA, 3447 bp, Oryza sativa
  unsure (1)..(3447): unsure at all n locations
ttgcctagctcatatgcaaacttcagggatactattctttatagccgtgatactctaactttgaaagaagtttatgatgctttgtatgccaaaaaaaagatgaagaagatggtaccctctgaaggttcaaattcacaagcagaaggcttggttgttcggggcaggcaacaggagaagaacacaaagaaccaatcaagagataaaagctcaagtagctaccgtgtgagatcaaagtccagaggcaggtataagtcatgcaaatactgcaagagagatggacatgatatctctgagtattggaagctacaggacaaagacaagagaaccggaaagtatataccaaaaggtaagaaagaagaggaaggtaaagccgcagttgttactgatgagaagtctgatgcagaattgcttgttgcttatgctagttgtgcacaaactaagtgaccagtggattcttgatactgcatgcacctatcacatgtgcccgaatagggattggtttgccacctatgaagctgtccaaggtggtactgttttgatgggtgatgatacaccatgatgggtgatgatacaccatgcgaggttgcaggtattggatataaacacaggggatatattgggctatcacaccctcccagtgcggcttacaagggatatatataggagaaatctaggagtcctaataggaaactaatcctataaagtagagtcctattagataactaatccgaatatactgtcagcctaaaattcggatcacatatttaacggttcatactaaaatttcagatgcatgagtatatagcataatgctaattggaaaatagagtatcctgacaaatgttgttcccttaaaaataaccaaatatgttgaaactatgccatgcaaaaggtcaaacagaagaatttcactgtcacactgcactttcaaactttacgtgagtgttgaattgatataggtggaagaaattattttccttcacggcttcacccaccctatgctgcttagtggatactggattcgattattgtcagttctgaggtaaagaaagagtcgattagagtatagcctatgcaactcaaaaggtatttatttctatttcttttaattgttggaagaaattcaatagtacagtataaatgatgagtacctattttccaccgaagtggaatcggctaaaatgtagttgattggtgcatcctaagatgtgtgtgagtatttagtatttttgatgcaaaaattcacttgaggctacaaaggcatgcatccatagcctcttgccacacctacgatcaccttggattaatctcagtggattggtacttctgtgtcgaaactaactttgtgttagaatatttttttcatggtgatcgagggtaattagggtctccacgcttcatggttactggttctgtaagcttccttatttctttttcagggtagcatgttcgttttgttgattgagttcggtattgccatgggctccttgtagcttaatcatcgccctgatttctgagcatgcctgcctgaaaaaaaaattgaaatcaatttgtgcgatatttagagatgtccccgcgaggtgaagtccccattattattttaaattaattcatgtttgacatatatgtgtttctcaccctattttcagtatttggcacatgttatatctatacatagtgaattatgacataatatctgttaactataaatggagtagggtggcataccgaaatgatatatttattaggtatgtttgatccatgaattgtggtttagtttcaggaagagttatgtccaaagtttggagatctatatattgagtttatcatatttgtaaattatatattcttatgcatatgtttaaaacaatttggtgcagccatctaggtgatgattactcccaatatgtatattaattgttcagagggatcacaaatattattcccatgaccacaaataatattcccataacaacaaaaaaagttcctactgtttttagcgaagtgtattaatttgtgttgctgccaattttaatacaattctcctttgcacacagtttaaatcacgttaagaatctgcagtcagatgcttatggaactttttttaatgcagggtatttttggaactaaacattcccagtaatgctttttttttctctttcaagctttgatgcgttaaaagatctccataaagatgctaagctaagtatgttttctttacgaaattgcatatcgttgcttctttactatgcccttaattcagatagcccttaattctttactatgcccaaaattcagattagcctctttttactatgagggagttttaaattgagaaagcccttaattatttactatgcccaaatttaatacagataatgtattttgctccatactcttttgccttttcaatgattaaaaggtttatttttcacaccctttccgattcagaaattgctgagtgatcttcagggtatatcttccaataagtggaagccaaataaaggtgaaattaggggggacctaataactagaggtaatttctactctgatcttgaaacaagaacaagacatgagcatgtgctatggttggaggaagggcactgtatatatcagattgcttcataacatcacaagaagaaattgtccatgtttaacttttgaaccatatgtacttatttcttggtgcatggaggaccaaaccacctcatagtaaaaagagactgatctattattgagttgtatattcaaacaaaaagaataaagttagatgaaaatcagcattaccttggtttttatattgtgatgcttagctaatgtttggtaaaagtgctcctgttttcagtgattcattctatttgtaaatggactccgagttttttatgtacaacattttatattacgcaaacaatgaaaagcatattttcagtgacgtggatatacaacatttgtattaccaaatgccaccgtagcattaccacgagtatgttactagatagattagtttagttttaggttcagataatagagaggtgaaaacacgtcatcaaagtttgagctcaaatattggttcaggcttgtcatttgttatgtgtagtactacaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66554 - DNA, 1213 bp, Oryza sativa
cggagaacgcaaaccgccatgacaagtttcatctagttgaagatcgaaaccgatgcagttcaacccaaaagtaggaactcgtcgaaatagaacgaaagtaaaagggtggcgatgcaccgaaagtattattgaactgttgttttttattacattgggttcagccgttcaggtcatatttatacctgagatacaaaatatgtccttgccggacacaactcttatctctaacaaactctaagataccataagtctttgcggcagacttttgcccaaacatatctctaaagagaattacacgaaatatcctaattaatatatataattgtctttctgagagatttatctccatcgtggcaatccttgtgaagcacgttgattgattctagaaacagcctcggagccatccccatcggaatcggttgtattgactctaccggctgtatccgttgttctctatccgatccatctcaaacgatgcagactccagccgatgccttcgcagccgatgcatactctgttcttcgaatctaactctttgccgaatctgcttcgattccaatgccgaacctggttcatatcttaccaaatttggtcgttaacacacgcctcctcaacgcaggcgtctacttcggcttcgccgaccctgtcaacaacatcatcgccaacaccctccgcgtcgtccccagcgaactccccgactccgacggtgccatgattccgaagcgggagaccaccatggcctcacggtcgcgggtggcaagagcaagtggggagatggtcctctctaagatcgtcaccggcggcgacgtcccctcccctccagaggcgcacaccgtcgcggagcgctcgctggaaggcctgatcaccttgacatcgtactaccactatctccccacctaggatgcgctccgctacctccgcctatccatggcggatctccttctcgccgtccgcctcatcgaggttgaccgccaccatcatcgtcacaaggacagattccaattccgctcacatgctgccaaggctgctcttagatgcgccgcgttgtccacgaggctgcctgatgttgatgctgatgctttcctcattggattgtccgcgccagtgtctcacctcgcccactctttgtctgcagagaattccggcccgtcgtcgcctcctctcgattcaagatgtgaccaggttaaccagattgatgcagaagccgctggat

SEQ ID NO: 66555 - DNA, 1832 bp, Oryza sativa
gaactgttggcacatagctctctcttccggccatattcttcacctgccagagttgttatcatattcaaggagttacccttcacctctcagagttgttatcatatacaaggagttacccttataattcattgcagccaactgatgagctaacacaggacgccttgaagatggcctaaagctacaaatcaaactttttctctcaacagaacattgttcgcaaaaaggtggaacatacattgtgaaactatgatcaaaataaggttagttctggtcctacaactttagctttcgtgtaatttatgccctccacatcttacagtttaatgtgcatgccccggttgtaaaatcagttgtttagttgcccattattcctttttgtgatttttaggatgggcacatgcgaggctctttggtccagcaaaaagtacctggaggtatcggtagctcatgataccaaatcgttttcgatcgttggatatagttgggcatgacgagtattgttagatccaatggtcagaaatgatttggtaccgtgaggtactggtacgtcgaggtacttttttattggacggagcaaatctcatatttttgacacttgtgactatagggacaatatgaactacgtttcatttgcaccatgagtgtgtgggcagcaaaagcttcagggacttgaagtatgttgagaatataggcatataatgatttaatatattccataaataaatcatgacattacagatgtatactagcattaacgcatcattagatctacatatgtaaactaagcagtaaaacatgaacaaatcaaatatgcgcaacatgtcgaacacgtaccgaggtggcggaaagaccggttgctcggcaggaactactcgcggttgcgagcgtcgatgaaggcgcgcagcacgcgagcagagaggaaggcgagccatcgcggatgaacaaggagcagcgcgcgaagcgcttcccaaaaaccttattgccgccttctcccggtgcaggacgtcgaaggcagaggttcgggatacctgctctcccgatcgccggtgcacgctggcgagcgggatggagtagtccacgagcgacggcacaacacacaggaggaggcaatccctagattgatttcgtgtgttatgcgtgaaggcggcggctcggtttatatagagataaacccgcgtaaccgaaccggataaggcgacggttgcttgctcagtgcacccgcacgatctccactccacgtagccgaaccggataagtcgcgcgtaacttatccggactccacgccgttttcacgcaccgaaccggattttccggactccaaaacaaaacaaatctgaattttcctgcagcaaaacaaaactgcaaaaggaggctgcatctgcgcaaaggtgaggagccaattttgcggaccattcgacgcgtacgtcgtgcacgcgcgccgcctgccaggctaggcgaggcgagcgagcgcgcgcgtgtgttccccctcttctctccaccacacatgcctcaagtggctaggagggcatcctccattttaaggaggtccccctctcctagaataagcaaggtggtactaaactccacatgcatgccatcctatgaggtgggcttttgtgattttccaaagaattaatcttcgaatgggccttagcccatctattaattccaacaatccccaaccaaatctcagaatcccactgagatttgtcttttccaatgtattgtttatataccagcggttcgatggagaccgatcaaggttgaacatccacctagatctccaagctacacttactcacaacttgaacaatggactacgccttgaattg

SEQ ID NO: 66556 - DNA, 6429 bp, Oryza sativa
agaaactgttagcatgacacaacttttaaactgtgtgcttctgttctgttaagaatgaaagtttattagcagatgatggtgatctcacccaaaggttaacatcgctgacttctctattgctcattgttgttgtgttgttgcgtttggtttggtgtgctcttaaaatattgctcattagattggtcgaaaccggttatcgagcagggtgttaaaaatcacgcaaacacacgagaccgagaccgatcttaaagaaaaagggatttttgatcccgttgacgctctagtatgtttcttctcgtggttactcttgcctccgccaaaatccatttttagagaagaaattttacgatttctagaatgtctcgaggtaactaaattttaccttacaaattttgatacctcgaagtattaagtaccagaggtatcaaaatttacgctggaattaccctacaaattttagtacctcgatgttagcactaaaggtactaaatttgtattagaaaatattgtatttttcggtactttattaattgccccttattaaaagtgataaaactaacttattgggccggccggtttgcaagtagctcgagaggcccagcaagcagcagcgtccaccacactccagattcctctttgcaggacacgtctcctctgccgccgcctcgggctcgccatggccacgccggcggccgacgccacgtcctcctcgcccacgccatcgccgccgccgcaggagacaccggcgcgcaaggcggtgcgggtggtggtgaaggggcgggtgcagggggtggggttccgcgactggacggcggagacggcggagtccctcggcctcgccgggtgggtccgcaaccgccgcgacggcaccgtggaggccctcctctccggcgaccccgccaaggtcgacgagatggtctcccgccacctccccgtcggctcccccgcctccgccgtcaccgccgtcgtcccctcccccgccgaccccatccacccctccctcggcttcgagatcaacttcaccgtctgatcttcgccgccgccgccacgtcatcaggtacaatcaatcacgaataaagatcaagaaaacctgatttgtttatccatgttaggttgtgatgctaatactagtagtaccatgtatgctagtgtttcttcatcaataatagtccatctctatgttgagttgtgaattgtgaattgtgggctatgccaatatcaaatcttctctggaattggcacaccagttacatctcattggccactggaatgatctgcataatccagcttgcctgaataatctgcatcaaactagagatgttctagccttccaggttcctgtattatctcaattcgagtgatgcattcctctctggtttgttcctgatgtacatacaaatccatacatatagtgatatatacctcaaagttgatcaacctacctacttgattctagctagacctgcatctcagatacatcaatgctcttcactggcccaatgactgaaaggtgaagcctttttcttgcactttcactggctcaatgactcaaaggtgaagccttttcttgcagctcaatttggggcttggcatcatcgtccacctcacggagctgcaagggcttgaacaagtagcacctagcgcaaatggcgtagtatgccaggttgagcacctggagcagcgcgacgatccagtagaagtagtcgagcctgccgcggttgatgttgtcggggagccagttggacccgtcggcgccggcgctccatcgatgcacggcggagatgagcatcgtgctgacgtagctccccagcgagatggacagccagaacagcgccgtcgccatgctccgcatgctctctggcgactggtcgtacatgaactcgaggtgacccacggagttgaatgcctccgccatgccgtggagcgcgtactgcggcaccagccagtacgccgacagcggcgacgtccccgcgtcggtggtgcccgcggcggcagcggactccctccggtggcgctccacgaacccggccacgagggtagccgccacggagatggcgaacccaacgcccatccggtggaggtaggagattccacggtccagtcccgtgacgcggcgcgctagcgggacgagcacacggtcgtaggcaaggagcgtggtgagcatggcgagcagggtgaacacggtcatggagcctgctgggatctggaacgacgacagccccggcgcgaggcggcggtccatggtgctcgcctgctgcagggcgaaggtgtgctgctgcgagtacgccgtgatcaccaggatgcccgctgcccagatcgggcccatgcggagcagcgacttgagctcctcgacgcggtgcaccgtgctcagccgccacggcttggggatgggagacaacgacggcttgccgttggaggtgtccgtcgtcaggtcgccgtcggtgacgatggccgctcggtcaaaaaagctgtaccaccggagtcaagaaacatcacaatcagtgcaaaaataacagaaaaaaaatcaaattgatcataattgttgcacgatcagttaacacttttggacaattggatcgaagtcgaaatcattgcacaaaacacattcatatcagaagaaaccaaatggcaagagtttgcaatttgcaatggacattctagcactcaaccttaggctgtgctgctattagtgtacgttttctttttgttgaaagacctttataacaatttgttgagactacgaaagctttggaaatttgaatataattttaggttctgacagagctttacatcattctgggacttacggtttctttcactaagtactaaagggtacctcctatctgccattacaaaacttattgcatttctaaaggatttctccaagagcataaagtagcaaatctagagaggttttcagaaaacacagtacccctctaaaccctgaaatatattgtaaagtttggccttagtttgttacttgttactcctatccaaaccgtgctcaaagttgcatgacatagctagccttcggaagcaaagcagagactcgttttgagtttgaacagagttaccaagttcctcatgaaaacaattgaataaatttcacaaaacgccaggtttttttttgatattaaaaaacgccaggttttaggcacccatttccagatattactatttgttctgaataatcctaggttttatgacaaaatgtttaaagaaacctcatgtttaagcttatattgtcattttttgctaatatttttttgcacaataattgttagaaaaacataactaatttttagcttactagttatggtttatttactagttaagctcaatcatctttgttctctcatccaaaaaagtaaataaaccataactaattatctattgaccagaacatatcttgacagacatatgattgatgctgcaatcacgagtcactcgtagtcatagttatatctcttaatcaatcatggacccatgaattcccatattttctttggtccagtcaaattatcaaaagccagagaccacaagtccacaagagatagattatccagcggctgctgtcgtttcagtactgtgctgcagcagtgcagcgtggaaaaagctgttctaagtttcggcgccattggccgacatctcctcctaatctgcttatccatgtcttcttgttcatcaatggtttttggcttcgaccccccggctttgctggttgcatgatagtgagtaccaaatctctttttccctcaaactttgggtttgtttaggtcactccaaaattaaaagttcggttgaaattggaatgatgcgacggaaaagttgaaagtctgtgtgtaggaaagttttaatgtgatggaaaagttaaaagtttaaagaaaaattttagaactaaactcggcctttggtttatttaccagctacacgtctcttcagagttcagaaacaccacctcctctattatttttgagtgattgctatatagccccataatcagcgggtccacgaatcagtgacccatgccagaagagactcatcatgtctcttctggttttggaatgtggtagttagtagtagttctctaaataagagttgctaggtggtgttacttgtcaatgattttaatttccttatggactaaacgtgtttaaatattttgcaagaagagaaatgtaaattaaaacttaatatttttctatgcattagttgcctgaaaatttgttttgtctaccacgtaggcttcctactatacaaaatcgcaactttaatgtaactttactaaatcaattaatctgctctgttttatatttttattggtttatgctaatgtgttctcatgcttcatctatatattagtttttttttcatattggtggaaattcataaaagtataacattttttatattaatttatttcattatttaattgtttcacctttttttgaaagtaaaagaaaggtaaatatgtgagtctttggatgcttcgatatagtagtgcaaaataattgataggtaagagaaaaccagttaaccaggtaataaccgatcacatgtcgaaactatagttgttcaccttttgcattgtaaagagttcctttttctcaaaaaaagaagataaaaatgctataaatggagcaaagattgaattttcaccacaaaaaaaggaaatcatccaattttcaaaaattgaaatatatatatatatatacacactcaaaatttcgatggtgccggggacggcaagaccgaaaacaaccaaattcggtccgaattcagctgaaattaatcgaaaccacactcgatcagaaccggtcgcagtcagctggtacctgagttgttcggtgtggacgagcttgccgtagagcgagatgggcgcgtccatgtcgtcgttctcgtacagcgccgcggcgtcgtcggcgtccgtcggcacccgccgcttcctgacggcggcgacgaccacctgcgcgagccgcgtgaaggggctccccgacgggtggagcctccggtagagcgggtagccggcgacgaaggcgacgacggagacggccatgcagaaggtgggcacaccgaggccccagccccagccgacgttgtcctgcacgtacaccaccgccgtgacggcgaccagctgcgacgcgccgttgcagaagtagtaccagttgaagaagccccaggtgcgcgcccgctccgccgcctccgactcgtcgaactggtcggcgccgaacgccaccacgcacggcctgtacccgccggcgcccagcgcgttcagcagcagcgccgcgtacagcaccgccagctgccacggcgccgcctcgtcgcacgcgcccgcgccgccggcgccgctgcacggcggcggccggaacaccggcatcgccgccgacaccgtcaggaggagcatgccctgccacgcgaacacgaacgctccggtcagctcagcgcgccgcggcggcgtgcgtggtgcgtgcgtgcgtgcgtggatgtgtatacgtacgacttggtagatgagggaggcggcggcgatggtccagaagcggccgacgagggagtcggcgaggaaggcgccgatgagcggggtcatggcggagacgccgccgaagttggtgagggtggtggcggccttggcgagcggcatgtgcagctgcctcgtcaggtacatgagcatgttcgtcgtgaaccccagcacggccagcttctccgccacctcgttcgctgcgtgcgtgcgtgcgtgcaaaaacacgccaaatctcatgcgaatttgaaacaaaaactcacagcgtttcaaacagatcgagatttcctactcaccgaagatgaagggcatcgttctgaacccacccttcttcctcatcttgctcttcttcgcctcctcctcctccgccatggctgcctccaccgtctccattgctggtgctttgatgtgtagcgactggtcagtggtgtgtatggtggtagctatagcttggatatacacatatttatagcttgagctttcaagtttcgttcttcctatctagctagccagctctctttcacatttccgaaaagaagatcaaactgaagtggccgtccgcgtcagaatgacacgcctctaccggttaattcaaatggtaaaaaatattataaatcccaatcaagaaatttttgagcttggctttgttagtttggaagggttggaaccatttcccaactgataagcgcataattaattactccctctattccataatataaagtacgatcaaaattggtacggtctttaaaactagagtgaagtgtacaggcggtccttaaacttgtagatgtgtgtcatctagttccctaaactcttaaaatgcatatgtaagtcccagaacttgtcataatgtgtcatctaggtcccaaatcgtcacaaccccttcaggatcctatgtggcgttgatgtgg

SEQ ID NO: 66557 - DNA, 1636 bp, Oryza sativa
ggtgggaaaagatctataggtatcagttttagtatttccggtatctaaagtgccaacatctatgtgccttttgtagtagtgcatgtgtgcgatcagcctacataatagtgcgatatttcatattaatatagtaaaagattacaagagtatagttatgagagaccatgattaagaaaaaaaaatagacagtaagccatgccacatgcctacaatagaatacctcgttgttgagaaaataattacaagagtatagttatgagagaccatgattgagaaaaaaatagacattaagccatgccacacgcctacaatagaataccccgttgttgagaaaacaaatagaagcaccatatcccaactgtgccctcacagagggatacaagtctttttctgcacactttgttctcactcgtacgcactcgggaagaattttccgatcatcggcatccagaaaagaagttgcaacttgttgtatgagtattctattaatcctattaagccctgggccaggatgtcacatcctcaccccccttaagagatcgacgtccttgtcggtcaaccccatacgtcccgcctctgccaggtcgggacctcttacatctggcagcttttataggtcatcgactgtcctcacagaccaacacaagtcttttttgcacactttgtcctcattcgggaagaatttaccaatcggttcacccatcccaaaattgctccaggccaagcacgcttaacctcagagttctttggagatcagtatccagataaaaagctgtaacttgtggtatgagtattctattaatcctattaagctctgggtcgggatatcacaaaataggccttcaaccactcatccaagatgcttgagatgccaaggactttgccatgcccatcctggaaaatcaagatgtggttttcaactgaagaactccaccaaagacatgaggagagataccacaactacgcccctagggggttaatggtgctcttagggcacccacaatggttatctataggctctctataagagatccatgtcagcatattttcctacttggaagagattaaatgaagatagagagcaaagctatctactaacctggagatagtctatagagaaaaacgaggcaatgtattaaagagctatagatacccatgtagacatactattaagttggtttactattaatctagtctattgctgagatgtacatgttttatagatagcaccttactttactattacgggtgctcttaagcgtcgccacgaccggccttgaatagggttagcctttcgcgtggaaatcttgctcccctctcttgtcactgcatccacattgtcaccatcatccaccaccatatgaacggattaggatcgtctgccttcacagcacaggcgtgcagtcagtcctcatccaccgtccaagtcatccgatggctcacggctcgcatggcatgacgcttaatggaaccacctagtggcagcatacgcacctggctacaatggtgttcgccatcgcctgtgtatgcgccgccaccagccaccgacagcgccgagagccacggcttccccaatcccattccctaccaccactttcgtcagggaaaaaacccgtcgcacacatcgacctcatct

SEQ ID NO: 66558 - DNA, 7928 bp, Oryza sativa
tctagtgtttcgatcgtattatatatgttacagttcatctccttccagaaccagcaacaggggaaatcaacaaccaactaaacctagctagcggtcgtcaagctccacgccggccggccatgtggtgtggttaatccatccatcggcggcctccgacttcgcagcggcaagcctacatagcctcccgcagatggcaagccaaggttttcctccacctcgtcgacgcaccgcgggtcacggcagacacaacattgtgactagtgacaacggtagtgacatgatttgctcgatctaccggtccctgtgggagatgacgccggtgacaaggcaaggaaagattgttggctgggctagacgtcggtgacagaaaggcaaggaagatgatggtttggctgggctagctctcttcaacgcatacaccacgcaaaacgttagatggcatggacagtggatgatggtcaactgcacgcccgtgccttcatcccgtgaaggcagacgatctgaatcccatatgaacaccatcagcacgcggccatcgcaccagtgccccaccactagctggccatcaggaaggaggccctttcctaagaaggaaatggtgtcccatgcgccgcagaactccaacatgccattggcaaagcggtcgctagcatatttcatgtaccaagagcgtcgttgctccatgccctcctatcacgtcgggtcatttgcatgtgtcgtatcctgcatgctgcctcacactgcagccacctcataggccctgagtgaaaattttggcctcaatggagtccagccaccgcctcacattgcctcactcatatggagtacttcagccattccttgcatcttaggtggctctgatatgactggacggcagaagggaaaccttggcagggctccatcctaccatgcgatgaaacagacaaacaactcttcagggtttcaatgatcattactttaggcaatgggggtaaggcaagattctggcacgacagatggcttgatggccaattccccaaagagataaaaaaataccctttataagctggtgacgaggaaaaacaaaacagtggcccaagaactaaaaaatcataggtggttaaggccattacggaggatgagctcgacaaccgaagttcgagaattcattctcctatggcatttgatacaacaggtacaaattgatgaggagagggaagacggcctaacatagaaatggattgcaaatggaatctactcagtcaattggatcgacagaatccaattcactggaagcatacaggacaatagatctaacttcatttggcgagcaaaaacagaaaacaaatgcaaattctttggatggctcatggttcaaaagaaaatcttgacgtctgacaagctacaacttctaggttgggacaacagcccgacatgctccctctgtgggacaaaatcagaaacaacggtacatctcttcatggactgccccttcgcgaaacaggtatggacaaaaatttggatgaaactaggcttcaacatgcttgcgtcttcttctttcaatggagacataatgggttggtgggaagcatgccggagagaaatgatcaaagaacagagaaggaactttgatggcctattcatctacacgatatgggtatttggcttcaaaggaatgcaagaatttttaatgacgattatggtacggtgtcacatgtggttgattccatcatcaacatgggcaaagtttttgatgaggcgcaaaatggatagatgatagaacgccgacttttgatgttaatggccttgcactgtctcaaagtgttttaatttcctcctgttttcaaacaatagacacctcttggaggtgctcctgtacgtgaccttcttcttctccttttatgaataggctaggcagagctcctgccattatccctaaaaaaaaagaattataatggtatggtttcaactaattggatagcaattttaatttttttaataggacgaatttgtagttgcatggatcaaatttaacttaatatttatgagcacctatatatattatacccatgactccaccattataccaccagcgttttctttctatattgcttattctctactgcagagcattgtttccattattgtgcttggattccgcacgtacgtgaacaggtgtgtacggaaattatctaaattgttaattggttatgaatttttaaagaaaacataatatatattattgaattttatattgctctagagatattagtgagaaattcaatctacagaagtttagataatagattgattaagtccagcctctatatcaaccagagatgtacatagccaatttaccgatagagaaataaaacaacaaatgtaatccaatttactcagctggatgtataggccgggtaaaaaaaatacacatatctaaaaaacaaatgtaactttgatatgtccatatacctttttagttcgatttttttctagatatgtaaatctaaatttgctgcacgtatgtgttctaataccataatttatctatgatgttctatataaaaatataatcacatttatgaaagcagagcacatattttcaaggtctcttaaagtactttgatatccagcagttccaaagcacctccatatattatctttatgtcttgctcagatctgccttacaggtataaaaacgaccacttttatgagcagagaccgcgacgtacgtacgccaccagggaaatcgatcgccggccaggtcccgtgatcccgacgcactacaaatcattgagccccctgctatgtctagcgaaagcaacagtcgacaacaagttgatgcgtgattgaaccaaccatcttcctgtaggagtaagtaggacacagcttcctttcttctaactcgggaaatatgtaaaatatatagtgaaaatcacatgtattgtgaaaatctggatactaccatcagatcaaaaatgaacgtctaaaaattattcacgtcagcaaaagtaaaaaaaaaacttatagatttacctagaaactaccattggattaaaaaaatagacgtatgagatttatccaaatcattagattaaaatttttacgtacagtaaaaaatttgcaagtaaaatttatactcttggtgacgtgataaatctcaaacagtacccaagtttttactatatatgtggcttacaccacatattttcctcttctaactccctgttcttttctgcttctttatcacatcattatcataaattatttgcttcacgtatcaaaaacatgtttttttaaaaagaaatcatacatggcttcggttgtgttctagtgtccagctcccaacttctattccctcgtttttcacgcgcacactttctaaattgctaaatggtgttttttaaaaaaatttctaaaaaagggttgatgtaaaaaaaatcatattaattccatttttcaagttgtctagataatacttaatcatacgcacggaatatgagagagtataattaaattaggaaagatgagtacagaacaattgtttaaagttatttgttaatttatgtcttcaaaatattttatttatccctataatcaattagttcattcctagcaataatccgatttataatatggttcaaacatgcaaaaggagaccacatactagagaatccctctcacaaagatgacgaatttccctgccaccatagaaactgcattaataatgaagactcattaagaatgggtaccgataagtcacacgattttttttttaaaaaaagagctggcccggtttgattcgagccaatgcttggattaaagaaaaaggataaaaataatctcaaattattttccatcaatcaaaatttgttcttcaacatcacattttacgaaatcgagtcacaaattttgacacaaacaaacaattgaatcactgcaatcaaaatctattacacatatcatttgcatgcattagaagagaatagaagaagatgaacaaagaaaaaaacatgtaacaggttatcgtctctaccatagtgaaagaatagatcaccctccctgtctccgttgcagccaaccttgtggaggctagatcagggtgatggtgacgtagaagtgccccgctctccatcattggagcaacctgcactcgccatcctggataagtccatccgccttccatgtcaaacgggcccctacgcacagttctggccaccccaagctcgtggtggctggatatccaccctacctccacatttccctcccttctcctcaacggcgtgtaagagatagtgacgctatggtcagctccaacaacccaagcttaggggaggaggaagagacggcgactacatagcggtgcaatgtcaataaggaggacgtggtgtagcattgctagcagaggaggaagagatgttagcgacacagctaggaaggagacacgtcggtggcggtgaggaggaagcagtggcacagccaagaaggaggtacgatggcggaggagagagggagtgtgtgagctgggagagagggtttcaaggcgcttaaaataaccgatgacttagtgaatgttcagctctgctctcttgatccatcctattggtgttgctttagttaaaaaaaacggtaccgatattattagtgtccaactttttaaaaagataatcaccgatgagccgttaccagttttatatttaaggctccgcttaagagctgagacatacaagaagaaaccagcatatatgagttatccccgcctattaggagttatgtagtaccctacgtatagagtgtgttcctctcatgtggcctagaggtagcttgctaggtcggtgggaccgtgaaatggacgtgagctaacctttggcagtgcctcggttttgttcattctctcgcactcacggattgtgctggggaagtaaaatgcagggaagagacaaagggcaagagacagctgataggcatgcaggtaggcaggcggtgaaggcaaatccgtcgtgactcgtgaatgcatcgatcctactgttcgatcgggaagaggaagagcgaatacctatgtgtgcctgtgtggtagtgttagcttgcgcctctttcatttttgctttcacatattgaaagatgcatatgaagaatcgatcgaagacatccaagagtctgaatgtctgagtctcgtcttttgggttcagataattgaagttgcatgccacacccttttcgatcatggaaatggaagttgcagcatatgacactcagttcctatatatgacactcaagctgatcggtgacaactgacaagcgaggcagcctgccaagtaatccatcattccacaggctcatgcataagcctcctttgaaaaaaaaaagaattttaggggacttttgaacgattgaattcctatgaaaaaaaatcttatatggtgttatgtttttcctagctattgctgtgtttaaatcctgcatttcaaaggagtccacatagctttcttactttgttgtttctactgctttccatttgtgaaaagagtaaataaaacatgggccatcttggtgacttggagtgatatctgtagtatcgaaatgcaagtggcaccatgcccgtatcagtcacggtcttgagctgatctctgcatgggaaagcatctacagtcatgcaacgacaattgcctattgccacagccatgaaacttcagtcgtcctaacttatcctgtcagaggcagatgcgtccgttaaccctatcaaatcaatatcaaaagcatggactagtcatgggtagtattcctacgtagaagcaaccacaccttgtttattatcagcaagctcatgactgcaagataggattaggcagaaacagaggtgctcgatctaagtaagttgtactatctaacacagtgactgaacatcgtggattgcatgttagccctgagctagaaaaaaagcatttgagtatgacaaatccggtgtcatatggtggtcaaatgatcaactactccctccaatcacaagtgacattttaaaatacgtgtaatcaagaccatagatattattttgagtatttcaaattcaactgttaaaaatggtacggttagatctatcttaaaaatagtttaaaatattataactttgctatttttccaaatctttatactagaaaattcataatcaaacaagtgtcctgatgaccatgtcgatatgtccaaaactgtcacttattagttatttgtttctggggattcttcaccttgtcctgcagctcctcagctttgctagtctcagtgagaaagcatctagtgtgttacttgcactgcttcacatcctctctgttctctgcatagagacaattctgtcatttcaagttacttccaaatctcttgtgccatgtctgcaccgggacatttgctcaaagctgccacccttgtctattgtcctgatctaccagtagagacatgcatgcatgacacgacccaataatttgatatgctgagacatatcctgtctagcaaacgatgacaaaaagatgccaaaatggttagttcaatctgaattccagcagagattaaattgaaggattgtctcaaaaaaaatttgaaggatcttttttgcgctaggaacaggagaaatatatatatacgcacagggaaatctgtgtaagatctgcatgaagagtaagcgaaggtagacgatgaaatcagcatggtcacgactgacgatgagcagaaatcttgggaggaagaattaatgttaggtgacgctgaagagtaatcgagaagaagttcccgatttcgtggttgtggggcttagatgtttgcagtgtagcaacaaaagattgcgtccttcacctcactcgtttgtcgcgcagaagtcgtagcaaaactttagacaattaatccgacgtgatgagccaacggtatctggatagggatatgcacgagggcatcatcaagtatatatatgtctacaactgctgtgacctcctctaatatatgtaagagaaatgtctcttacgtgtattctatgagaatgagtttcacttgtccgggactcacgtccctctaactttacgtctgagaagctccttctctacaactataaatctgcatttcgaggcttctgtggcggagcgtttttttagagcagtccaaagtatctaaactcgatggaggctcacaaactcacagaagaaatttttgcatgttcttgtttcaggggtctcacctacacccactcttccactcctacacttggcggctcaagccatactgccatcagcctatatatatatttagaaaaagtctgttttgaatctcatgactatggtccaagtctaattcatatggctcaaccataaaaccagttatggagactccgttaactattaaaatcgattcattttaaggaggacagtgcggaggaaaggagtgaggacgagagttgagaggtagcttgtggcggtgaggaaatggttgaggaggacccaggtgaggtggcctagaagggtgatgtcaatggcagaatttgtcttggtgccgttagtgtcgacgtgtgatagtaaggagtggaggtggcagcaacaggcagagggatcagagtaagcaacagccatcaggcatctagcgccgacacgataactacaatgctggctaacgggggcgatgaagggaacactagtgagtatagtgagtatggcccatgagaaacgcaacgccgatgaccggtcaaggcggctgagcggtgagtaggggatgaaatagtgccacactcaatattggtggagcggagcggagttgagtcatggtaactatcttttatatagatggatataactttttccttattctgccccatattttcatattttcctttctttcccaactaacttcgttcattaaaaaacagataacttcttcccttcaagcattttcttttcagtttaaaagttaatttattc

SEQ ID NO: 66559 - DNA, 1966 bp, Oryza sativa
cgaagggatgagtcattctgcattgaacccagtagaaccgtggactgggtcacattagcaaccttaaagaattggcgacgcatgttgtgcttgcttggtactccggcttacgtaataatgatataataaccgcgctgaattaacgaatctcaaatctcaatcccacgcatcacaacagccaaagtgaccccatcaacgtgagaacgattctagcatacggaacacgtaacacagacgagccctcgtaaaactaattagctgcgcatttttcctaatgcaacagaacttgcacacaaggccaacatgcaacttttatacacagtataatatgtgaatatgaaattaatatgtactttaaaagcattcccaagacacaggaaattaaaacatagtcagcggcattgcacacacggccaggtatctctcagcagtcagaaataataacgatactgaactgcactgcttctgcctcgatttcattttttttttggggtctcccagccacgatgagaccaaactaacaacacctattgttgatcctcaaactcatggccatgatccaaaagatagttggcagccagctcttcatccttgttgcatgcgaagaagacctccaaaacgagctcacggttgaaccccattgcctccagctgtcaagaaagtatacatgaaagtttacaaggaaactcgaaaaccatgctgatgattaaatcaatgaaaaagctgttatttaaggatgccattgtctcaacaaaagaactaataatagaacaggctcatgttaaaagaacagccctaactggttataaaatttaaaatatccattcaatggttataaaacaaaagttcaaatttagaactttcaaaaaggactaatgggtattttgggtaagtttcttgatgtaaatcacaaattggacataagtgtcaacatttggaaactgaggtgtgaaaatttcagaagcagcgaattgtctttcattagaaaatccaaaatagcatataaagcaaacatacccgctgaatggcctcccgttcctctggagtaactgtaagtgcctgtggcatagcggctgctagttgacctagtatgtttctgatttaccagagcgtataaaatgtaatgtaaatattgtatgtgtatcaattagaatataatacatgttttgtagttctcttggttcttaccccccagcagcgccgctatcaggagattcattcaccagacggagaaattcagcctgattttcctgaatcaaccgcaagatttgcggattctgcttcccaagctcttgaagcattggctgtgaatcaacagaattgctcaagtcacataaaatagcatatgcactggcattttaatgtctacaaagaaaaagaaaagcaacaagaagcttatgagttgatttatattagcacctgcaagatttggggattagcctggaccaatgcaagcagcgcttggaactgagcagaaacaagtaaatagctgttagggcaatgcattattttaacaagtataaaagttacaccaacatataataatacctgtggaagttgtcgcaatgcatcaagggcaccagcaccggcaccggcaccagcagcagcaccaggatttgacccagcacttggaatgccctaaacatattttaaaaatcatgttttcaaaacaaacacaatagcaagcaaatagaaacaaaattccaggaaatacagcagtttctgtgaaaccactggtttaataaagcaaaagcaactttgcttttgttccacacagactttaactcaaaacatccaagcaacatataggaaaactacaaatatgggtgacagttactggtaatatcagctctaccaacacccatgaggaatacgcgtaaccagctaaccagaatttgaacccagaatatggatacattggactatgcattgtcaaaagtcaaaacaggtgctgaactgcttgtat

SEQ ID NO: 66560 - DNA, 1222 bp, Oryza sativa
tgtggaagaaaatagaatgcagcagtttacagaatcctgttccatatacatctttgcacaagtgaagtacaaaatataagttcattcaaggccagaatcgaattgtctcgtgcaaaattcctatcaatttattgtgttccaaacaaacacagggacctaataaaaaattgaaataatggatccaaaagggagcttacgatgcggtcacagcagcagctggagtggcagcagcagctggagtggcagaagcaactggaggctgtgcacttggaggtgccctacgaatgacatgataataaataaggaaaacaatatttgacattatacaaattagaggaatagatataactcacggttcaggtgtaacaacaggtgcttgtggaggtggtgttcttgcaactgaggcaactggagttgctggttgagactagtgcaaataaacagtaaggaattttcaggtcatgaacgaaacaaagacactcaaaagttatgcagaaataacaaaattacatgatgaacatattcaattgcttttgaacctaaaatcagctaaagctaaaacaaaaacaaaatgacaaattatacctttccataatcagaaaataagattactttctttacagctctctaagctcttgttggttctagtcattaatcacatgaattggagatgtgcaacaatttacgaattaacaaatggaaaaattaccaggaaaataacaaattttcaaacaagagatgaaggtgcataacagaacagaatatatttatcccaaatactggataccaaaaaaaaaagagaggagtgcaggttgaatccctaactaattagataaaactttttcatatgaacagagacacgcagagattattgacagaattatatatgccaataaaattacctggctcacaggtgcctttgaagcagttgaagctccacttgatgatgctttggcctgaaattttatacatattcaacaagtgattaatattcacagaaaaatgaataattaaaagagcttcaaactacacttccaccgttaatttcagcagaatttaaaatgttaacataagatcatcagaggtcaaaggctcaaagagcagtcgagatatcatttagaactcaggcaaatcatggaatgttcttcacctaaacatgttaattttagcctcctggacataacacaaacggctgttaaaactaaaaaaaaaaaggtaatta

SEQ ID NO: 66561 - DNA, 1347 bp, Oryza sativa
atgggaagcgaagtgcataaaaatgacacatgctcgtcatgatcgtgagacagcagttctcttgtatttatacagcgccgtatccttcagtctgcacacaaggaattttgcagaaaccattagttggtgaggcgttctgccaatgcctcactctgcaagtgcggaggagctgaaccctcaatactcgcaggcaatactaagttagcatttaatggatactagctagtgctgaacaaaataagaaaagaaacttactagcatttaatggatgtatttgttcttgcatcactagagcaaagcaagaacttgttgactaactattgttaactgttatgctgtggtatgatggcttgtacattgcgtactggatggaatcattccagaaatattactggcttatttgacattgttgattgaaaatttaccaggagataacaaaacattttacccctattgaacagtgatggcttatgattatgacctggaagtataactgtttctggtaaaatggaaacatggtactgtatagtgtacagtatgcctcctaaccgaaaaagtacacccagatagctgtactgccagaattcagagaaaccaaagctgtactgccagaattcagagaagcaaaagcagcaagaagtaccaaagtgtggaccttgcattctccatcatctacaaatcaaatgccgggaatgagaggccatccagggatttccaagatagggagccaaccaatcacagaccagcatcctgccacgtgtcagccagaggcagcacaccatcctgccacgtggctacccaccatgcgaggccgaggtcccgagctgtggtgcaagggtgcaccgttaatttcgtttcgctagtagatagcgtgacagtgtgagatcgagctgaaaaaaaaagagaggccacgaagagagctcagctgctgcctctagcttacttggtgataaggaggaggaggaggaggagggcaccgacatggccgcagccacggcgtacaccgtggcgctcctcggcgccaccggcgcgcgcgtccccgccgctccacgctccgccgcgcttctgccgcgccgcggcggcgtgctccaaccgctgcgcctccaggacgcgccgcgactgtccctgctccgcgtcagggccgcctccgacgacacctccacctcggccagcggcgacgagctcgtcgccgacctcaaggcaaaggtgagttcgtgcatatgtttgcatccatccatggtcccatggaacatctcgtcttaatttgacatatggttggatgcagtgggaggcgatcgaggacaagccgacgttcctcctctacagcggcggcgccgtcgtcgccct

SEQ ID NO: 66562 - DNA, 2461 bp, Oryza sativa
aacgatatatatttttatatattaacatatacttaaatcaagtgattgggatagatcggtcaccatgccgagatagtataaatcacttatatcgacatatatattaataacaggattatatatgtttatagcatagccgatcagatagatctagcgtctatcggctaatactccgatactactctaaatcaagatattaaaacaggtataatgtattaaacaaaagcttaatatatttagattgcgacgatatcttgacacaaagggcggatttaacatgtcattgaagcatatagatcgaatatggttaaatcagataagatcggctgaaactccgatactaccctaatcggcaaccaaaggacaggctagagattgatattctaagcatgacttaatagatcaaactcaactgatgtagcattaagtatgaaaagaagaacaatatctagacaatcaagccgctgggtgtttcataaagtggtagatatctcatataatctaggacaacgtcactatttaacctaatcggctgccttctattaacggatgttagccgattgtaggttagatgacgatattgccaaagattatgtaaaatatatgataacttgacgaattatatagacaagattagagtgtcataaagatggaagcactaatcccgagaacacaatccgtcataacaagttttacttcttgttgaagatcgaaaccgatgcagctcaacccgaaagcaagagctcaatccgtcataatgtgtgttaaaaattacatagggctcggggtctatttatacccgagaattacaagatatgtccataccggacacgaccactatctctaacaaactctaagataccataagtctttgcggcagacttttgcccaaacatatctctaaggaagttacacaaaacatcctaattaatagatacaattgccttctcaggactatccatgtgcggcaatcatcttgaagcacctcaattcaatccaatgtcatacaccaaattatactgtcagaatcggctgcatcggctcacctagtccgactcagacccagccgatcctaatcgtagccgatctggacttcagccgattcttgctctgttctcggatcaatctccgccttcgactccaccttgacctaatctccttttccgatgctaatatttccaaatttggtcgttaacatatacatcgccttttgatgaaagcactttgggcatttgagaccaggtcgtccaacagtgttgctaacctcatcgcgagaacctttgatatgagctttgccatcaagtgaattaagcttattggtctgaaatcgtgcaccagttgtggcgaatctttttttgtcagcggacaacttagcacatgacgacatttaggttttacttacctattagatgctgcaattggcacattacccggccgttgaggaagtgaagaatgatgtgcatcattctcatttgtactaccatcctccatcagaacgatgcaaccctcagtctataatcaatctgtttttttgtaagtatggcactcttgccagtgggttaatggtaacgaagatggagggattattttggtgccaacagaggagtaaacagaaattatctcccgccctcaccaccagtaattacggggctatttaactaataatctgttgattaattcacagccgttgctttcgaacggaaagagtggaaggaaggaatgtcacagcgtgacattaccctgtaatctaatgtcagaggatacgattccagtgatattaccctgtagtgagtgatgagtgttcattttgctctattgtatccatcccataagcctcggatcagtaaatcggttgggaaatgggtgcatgcgtagatttgctctgaagttggttggctttgtaattttatcccatagttcagtgccagcaaccttctcttttgccaccctaacatatgaaataccaaatttacccttgtctttctcctaaatcatcttcttccctgattcatctccaagctccgtccataccgagctccgactgtcatgcatcaactccggctgctattcctgtgcatgagctccactgccggcccctgtgcctgagctccagtgccctcacggttgagactggtcatggaagaattcagtggcggtggggaacgggtagtggatcttggttaggggtctaggtgagctcattcgggaggcagagctcaagctggcagatatagtcgatgcagctgcacgggtggagaccgaggtgcatgcatgcatgtgcaattggtttgccgcgtgcgcgcgagataagcatctgtcgcgtctgcgcgaattagcatttgcggtcgatgcatgccaacagttggagctcgttggtggacggagctcaggtaatgaacgagggaagaataaaagaagggaggaagatgagggcaagttttttgattaccttctgtaatct

SEQ ID NO: 66563 - DNA, 2606 bp, Oryza sativa
gtttggctgcctcttctggaaaacattcaataccctatttctcctgcaaatttattttatctacaaagtacttcatccgttttacaatataagtcattctaacatttcctacatttatattgatgttaataaatctagacatatatatctatctagattcattcatgtctagattcattaacatcagatagatatatatgtctagattcattaacatcaatagatagatatatatgtctagattcattaacatcaatataaatatgggaaatactagaatgacttacattgtgaaacagatggagtataatataaagtgagggttaataggagccatcgatatcgtcgtgaaggtataaaatcaccatgttaataaaaaaaaagagagaaaaaaatcatatgccatcatggtgaggctgacatattatagcggtgtaaactacccaaacaattcaactaattttcgcaaattgagactaatattatagcggtgtagattaatgcacaaacaattaattcaactagtttccataaagcgatagattgagattatagcggtgtagattaatacctgaaaaattgaactagctttcacaaaatttgcagtgctctgtacagacgcattagctgtcaccagaaacggcatattcttcgtgaaatccaggcaggaaccgctcctggaaagctggacaacggagtgagatttggaggcgagtgtgtgcttcgccagggcatcaacatcaagcccatccctgcggtccagttggagaagatgggtacacccccatttgtttgatgaatcgtgatccaaagcatgctaatttttgccaattgcacgcccagatcttggtcctatgtgactcgtgtccacatcactgacgccgacacatcccttccgatagatgatggaatttttactaggaacagagataaatgcatagcctttttgttacttttttacttgcaacttactcaggagtatataacttcaggagcaattttctagcatgtgcgtttcttgataattaatttaaacccatgtggatttgctctcatggagtcatggtatacaattatgaactgaacttaattacaatattaattatctgagaatgctggagaaagataaaattcttgcgtaattgatattctgaagttgtatagagactgtagctgtaacttgttttttttttttacatttataaagattgagtagaacagtttggaatgaccctatgagagcgtatgaaatcaagtttctctttggcagctggtgggcatcgtgtttatccacttgattcatgtctttgtctatgtgtactatggtatacggtctttgtcttcgtacatgccacatttcactttcaaagcaaaaatacgaacaagaatacaaaacacaagaaagaaattcagccactttattttgaaatgtttaagtgcaagggaaaaacacgtgttgacgtgtaacaggtgcagacgccaaatctttagtgcatcatcattaaagaaatgaaaaatacacaagagtagttgcatacttgcatgcatatgtttcgatcctaaagtgtgatgacatgaatcatatccttagcccgatgaacttgtttttctaaaaaaaatgagtcaaatgattagtatattgtttttttaataatggaaatggtttgtattcggactctaccgatatatatattgctatatatatcagtaaagaaggggatataaacagtacactactaaggttatgtatggcagtgcatgcagccatgttacatgtaagagaagaatctatgtccccttggtgctgattttcggccactacaaggtcatgggtgtgacagtctgacagatatatactaccttcgttttttaatagatgacactgttgactttttctcacatatttgaacactcgtcttattcaaaaattttatgcaaatgcatatgatataaatcacacttaaaatactatgagtgataaaaacaactcataacaaaataaattataattacgtaaattttttgaataagacgagtggtcaaacatatgagaaaaagtcaacggcgtcatctattaaaaaacggagggagtatgttgtaaggaataccatttcgcttcaatagaccctaacaatttcttgggtttcatcactcgtctgcacgaacttagtgctaccggtcatgctttttcctttaaaaagttaagtatgatactcaactgaaaagccatttgaaacgcagaaattatacaagaattattcaattcaagttctgaaagtgtgtgctttctggggccaaaccaccatctgagggcatattttataacaaagtagaagtggatgaattttgtaggactgaaatcccttggaaaacattttatccttttgaatactggaatgaatcctatagaatcctttgacctttgaatgaaatagctcatttcacacaaactttagaggaaatttaatataagggctagagcccttgttttctcttcattcgtgactcaaaattcttatacttttcctatgatactaccaacaaaatgatttgcaaaattctgtgccttaatttcctctacgatttgttgtggcatgataccttat

SEQ ID NO: 66564 - DNA, 2540 bp, Oryza sativa
aaagcactaccatacaagattagacgagacgatccaggagaagttgacgggcagctaacgtagaagagaattcctactaaggtgatgtggtatttccctataataccacggctaaggcgtttgttcaggaacaaggggaatgctagaatgatgcgatggcacgctgaagagcgttaacaggatgggatgctgagacacttcgctgatggttcgtagtggcgaaacatcgacagaaaatttaaagactttggaaagaacgaacgaaacatacggtttggtttaagtacagatggcatgaatccttttggagagatgagcaacggccatagcacttggcccgttacgatgtgtatatacaacctccccccttggctatgcatgaagaggaagtacataatgatgccgattattattcaaggtcccaagcaacctggtaacgacatcgatgtgtacttaagaccactggtcgaaaatcttaaactgttgtggaaaaaggaaggtgtccccatgtgggacgaggacaaacaggaggagtttaacctacgagcgctgctgttcgtaaccatcaacgattggcttgcacttagcaacctttccggtcagtccaataaggggtacaaggcttgcactcactgtatggatgaaatagaaagtacgtatcttaagcactgtaggaaggttgtgtatatgggtcatcgtcgattccttactgcaaaccacccggtacggaagaaaggcaagcactttgaacataaggcgaaccaccgtacgaagcctaaacatcgcagcgggaaaacagtgtttgctatggttaaagatcttaaagtagtgttcagaaaggggtctggaagccagcctatagagagcgaagatggtcacgcggcgatgtggaaaaagaactctatattttgggagttaccctattgggaattcttggacgtccgccacgcaatcgacgtgatgcacctcactaagaacctttgcgtaaaccttcttggcttcctaggtgtatatggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatatttgaatgcttaaagagcataaaggtaccgtctggatactccacgaatataaagcgaataataagcacgaaggagaagaagttcacaaacctaaagtctcatgactgtcacgtgttgatgacacaactgctaccagttgtaataaggggtatccttccagacaatctccgggcaataataacaaagctatgtgctttcatgaacgcaatttcgcagaagatcatcgatccagatagattagaagcccttcagaatgatgtggtgcaatgtcttgtcagttttaagttgatatttccaccgtcatttttcaatataatgacgcatctgctttgtcaccttgtcaaagagatcggtattctcgggcctgtgtacctacacaacatgtttcctttcgagagttacatgggcgttctgaagaagtatgttcgtaaccgtgctcgtccagaggcaagcatcgccaaggggtatggaacagaggaggtcatcgaattttgcatagaatttattgaagaccttcgcccaatcggggtacctgaatcacgctatgaaggtaaactacggtgaaagggatctctcggaaggaaagcaatatatgacggtagacaacaatttattccgtaaagcccatttcacggttctgcaacaatcttcattggtagctccttacatcgaggagcacttggctttagttcgcgccagaaacatcggtaagtccgatgcatggattacacggcatcacattgatactttccccgcgtggctacgacaacatctcatgggtaacaagacgatcaaccaacaactggccttcctggtgaggggaccatctggctcgatcgcgacattccagggatatgagatcaatgggtacacattctacacgagagcccaagacatgaagagcacgaaccaaaatagcgctgttcgtaccgatgccatgggacacgatggaacaactggcacgtattacggtgccatcgaggacatatgggaacttgactatggtcctctcaaggtccctctgttctggtgccaatgggttaggttgactggtggaggcgtaacgattgatgacagtgggatgacaacagttgatcttaacaaggttggatgctcggaccaaccttttgtccttgccaatgatgtaacgcaagtcttttacgtgaaggacatgtctagcaaagcaaagaagggcaaagggcctgacgagtcgaagcgtcacgtggttttcccaggcaaaagaaaaattgtcggagttgaggacaagactgacgaggattacgatcagttggatgggcaaccccctttcatggtgacgattgaccctagcatcctcgtatcaaatgaagacaccccttactcacgtagcgatcacaagg

SEQ ID NO: 66565 - DNA, 1762 bp, Oryza sativa
ggcttctccttgtttccactgcctagggcatcctcgcaccgacgccgccgtcgtatctcgccgtcgtctcggacatctacagaaaatgttacatccgcctccctctctctctcgacgacctcgatctctctctctccccaaaccgccaccggccgcctcgttgccgacgccgccgccgacgtcgacgcggtcgaacacgactccgcctcccgccgatgccgaccccgacctcgatgcggccgccatcgccgacgacgtcgcgccggcagtgccaatgatgccgccgcaacgcctccggaccgcgtcacgcccgccgtgccatgacgccgggccgcgccacaccgccgcggcacgccaccgccgtgccacgccgacgccgtgccgccacgccgccgccgcgccaagccgcagccgcgccgccacgccgccgctccgctgccaccacactgccactccgctgccgccacatgaacgaacgaaacgtgacttaggcgagaacttaacgacaacgtgaacggtaacaaacgatcgtgaatgaacgaacgtacgtgaagttgaacgaacgtgaacttaacgtgaacgtgaacgaacgaacgtacgtgaacatgaacgcggacgtgaacaaacgtgaacttaacgtgaacgtgaacgaaacgtgaacttaacgtacgttaacgtgaacgaacgaacgtacgtgaacgatacgtgaacttaacgtacgttaacgtgaacggacgtaaacgaacgaacgtacgtgaacgaaacatgaacttaacgagaacacgaacatgaacttaacgtacgttaacgtgaacgaacgaacgtaggtgaacgaaacatgaacttaatgagaacgcgaacgtgaacgatcgtgaacggaacatgaacttaacgagaacgcgaatgtgaaattatgttactttgcgtttagcctaatacatttttttgtatgttgcagaaaagacgtcgtcgtcgtcgtccctcaagccggagtggtagctagccctcgaaggaattcgcgcaggcaagtgatgtaaatatatgattatctagggttctaatatacgacacttaggcttagcatatatgactgttagagttttaatataagattattagagttttaatacaagattatttgagttttaatataagattattagatttgtaattagacttagcatatatgattgtttagggttctaatatacgacacttaggcttagcatatatgactgttagagttttaatataagattattagaggtttaatacaagattattttagttttaatataagattattagatttgtaattagacttagcatatatgattgtctagggttctaatatacgacacttaggcttagcatatatgactgttagagttttaatataagattattagagttttaatataagattatttgagttttaatataagattattagatttgtaattagacttagcatatatgattgtctaggtttctaatatacgacagttagacttagcatatatgactattagatttttaatataagattattagagttttaatacacgattatttgagttttattataagattattagatttgtaattagacttagcatatatgattgtctagggttctaatatacaacagttagacttagcatatatgactattagatttttaatataagattatttgagttttaatacaagattatttgagtcttaatataagattattagatttgtaattagacttagc

SEQ ID NO: 66566 - DNA, 3248 bp, Oryza sativa
acaagaatttattaatgacaccgggctaactacagatcaattgctacgaggcgcaccaatcgaaaaggcggaagtgaaatacatgtacgaactcggtaaaccgcttgtcaagcctgagcagttgcagtccctatccacacaaatgtacaaattccatcaactgtacatggagatgagtgccaccggtagagagatgatcggagcgaggatcagggacacggacttcttgcgaggagaagatattctctggatcaattttaagggtatctacgaactataccagctggacgccctcgacgtctctattatgagttgctgggttttgtaagtatcgttcatttagatttcttattacatttcctttagttaattaggtccttgtatataagtagactatatataatatatacttccttttatcgttgtagaatggagattcaaagggcccgacggcggggggttttcgatactggattcatcgaccctcggaaagtaaacgtcgcaatgctcgaccagtatccgcaagccacagaggacaatctcgtccatctcctaaaggcgcagcattacaagacgttcatactattgccgtacaacaccgagttagtttttactgtcttcctataccaaatttcattctcgtatgaacatgctaagtgtttcatatgtaatgcatccgatgcacattgcaaattccactgggtccttttactcttcgacttggaggcctgcaccgtcaacgtatatgactcaatggataaaaaagagtctacgtttgacaaggtttttgaacttatagataggtactgtcataagttcctatgttaattaagaatcttgttataattaattgctactacggatcatagctttaaactccatgtagggcttggtatcggttccgtcatttggtccgcggcaattggagagaaagacttaggcggaagtttaattttcctgtgagtacacatgctctaaatttatattgaatctccaattcaaatacatacaagtgtatattaattagatctctcaccatttgtcatttatatatagtgcgcaaagcaagcccagggaactaacttgtgcggctactacgtgtgcgagtattgccactgccttgcagaccaaatcatcaccacaagagagctcgatgtacgtacaaataaattcaaaatttcattgcgtacgtatcgatttgttgtttactaattaatttcatacattcatatagtttattcgtataagggataatctcacacacaaggaatttatcgcggtggttcaagaacaacttatgggattcatcaacgaacaaatccttgatcccaacggtgaattctactacgacggaaatacaattcatatgttcttagcttctgagataatgactactactacgtcgaaatcgtagctagctaggacatcataatggattgtaattaatacatatctatttttttatatgcatgtacacatttctttaatgtaaatatatattttggtcatatatatatgcacataaaatgttaagtgctttcacacacacacacatatatatacatacatacatacatacatacatacatacatacatacatacatatgcatttgcataacatatatatgtataaatacatatatatcatgcatgtatatgtattgaaacatatatatatatatatatatatatatatatatatatatatactatatatatatatatatatatatataaaccatgcagcaacagggccatgcaaatataaaaaaaaggtcagctcgatctttagtcccggttatttcacccgggactaaagatagcgatctttagtcccggattggtagtcccggtttgaaaaccgggactaaagggggttacgaaccgggactacaaacgctttctccaccagtgcccattgaactgatcagggggaaaatctaatcaagccgggctttagtcccaagccctatgtcccttgtctcattattctcaagttggagcagtgattcacatactgtatttctagaaataaattaacttaacaacatacttcttgagtccattgttaagcttttggagactatttatgaactaaccactactagagaactgatctttactcggatgacaaaaatcacatttgtcccggttcgaaaaggaaccgggactaaataagaaatctttagctccagtttaaaagcctaacggtactttatgatctttagtcccggctggtaacactaatcgggactaaagattatttttaaacagaaagttaaggaggaattcaattccataactttattcgaacaaatacctcagcaaaaactgattaccaataaagtttgtattttgcaatcctgaatacatacaataatttatccccctttcaaaatttaaagttgggagaaagtgaaagaacttctattcaactcaacaaacatatgaggtcatcactgaatcaattagttgtatatattgattgattgatttacatgtatatctcctggcctcgaactgtacccgtgcaggacaaccaatggacatatatgcatacagcacagctacaggctactactgtcaaccaaccccctgaatctgaagggaggaaaaaaactttcaaaactttcagcaattgagcgcaggggtactgtatacctctcaacaaatagtacaattcactttttagtattatcattattattatagtaataattattattaaaagtccttggatccttagcaaccatcaatggtgaactgatggaaaaagaagacgcatgtgtgaccgtaaaagaaaccagctaaaactaatgcagtttcgacgagttgttttgttcttgtgtgatttcatggcgagcgcgcggccggcagatcaaacttccgccatgcagcgctacgcgacgcacgccgtggcgacggcggcggtggcggcggcggcggcgcgcttgacgaagcggcccttcatccgcggccgcttctcggcgttgagcttgcgcacctcgtaccggatcttcttggagaagagccgcgtccgccgcttctccctgtacctcgacacccgcgcctccctgccgccgtccatccccagcctcggcgtcagcgcctgctcctcgccgccgtgcccgaacacccctgccgccgccatccacaccccctgcaccgccgcacgtcgccggagcaagtcatcagtaccagctaaattgtggagtatacggtgagacgaggcgtacggtgtgcatgg

SEQ ID NO: 66567 - DNA, 3158 bp, Oryza sativa
tacgaggcttacaaatatttgtggcgaaaatatcgcgggtttacgtttataccctacgtagcaggtagcactagccaggggtggggcccgtgtggtgcgctttttgtgggacccacgatgggtgtactttgcactttgggggtggctggtggggcacacctgtcaggccttatctgcgacgtgattggttgacggggaataccccatccggcaggaaggcctgggattgggcggagccggatttttggtggggccacggcgttttgctacgggacgcccggagtcctgtccaccgtcgccctcgcggttgatgcggctcgcaacgccgctggcagtgggcccattctaggcctgccgctgaaaagtctttctaggaatatatagggcctatttgggggagttgttctgagaaagaactggtagtgcttctgaaaatccggaaaagccgggtttttcagcttctgtcttctagttcatttttaggattttacaactacagcttctcagaatctggaccaaaagctgaactgtttgggagagcttctgattctgggagaagccgcagcagctagaagctcccccaagcaagcccagtttctttttagatataggagtatatatatatatataatatgtagtagtaataatgaaaatattttgttttaaaaaactactttgagacactactaataaaaataggttttgcattcttgtttataaaacatgttcacaacttgggttgccatttatttatttattttgtttactgaaggatataaggtaaagtcgatgcatgatgaaaatatgttgtgcgatgctattcttttgtacctatcacaatgcatccaaagggcccatccacaagcttgcacaatcatctcttcattttaggtggaaggtgcactggtaatggcgattcatcggcaacaactcttttacataacgttatatggtagaatgtaagaacatcttttggggacacaacggcaaccatgctccatgcattcagtagtcatccatcaggcaaatccgcttcctcgtgtgtggtttgcaagtgcccttcttagggagctatggtggtaaagaaaaaggaaggaagaagaatcttaccatatagggttatatgttactttttctttttcgacaaagaaagcataactagggttctatgttaccattgccttgaaaactaggttttctttatctgagctttacttttaaaatatgtttgtaagctttggtcaaatactactttgcaaatagacttcatttttagatagtcagataagtatatatgtgtgttcgctagattcgcatacaatcggtgttttggatctacattgtatttatttatttatttttgaagaaaagacaagaagatctacattgtatttatgaaatgttagtacatccaagtgataacgattgggtcactattcaattattggcacttattcggcgtaaaatttcacgatatataagtgaagtaaaatcagcatatatacatagttttcgccgcgtcctggtatatggtcccggaagaaagttgttgtgctattagccatgcctggatatgcaaccaaacaaggaacctctctcacacccaaatccgaagaaaatattgcctggggtccccaggcctgtgatttgtataccctccttgaaaagttgatgttgtggaacatagcggttgatgagcaatttggaactttgcagggaggtcagcatgggcttacaaaacactcggactcatggtgatgctgatgtgatacactaaaattgtacaggccttatccacttaagataatgccatgtaattaagtatgttcaaaaattaaaatagataatgcattctaaatattttcttatgtggttagtatccaagaagaaaagggaattatttgagaaaagttggcgtccattattaccttttttttaattccttttgcatagggaattagcactaattatctttttttgaaaaaaatgaataaatttgtttctatgcatggacatgtatgcaagtttatttggaagtatataagaatatacaaatttttagagatgtacacaaaatattgtatggatgttacttgccaactagcacgtggccttgcgttgttcagaaatatcattgctgctaatttccaaaagctggaaatagcattttccaaaagctgtacacaacagtggacctgggtggatattcataagctttatgcttaagtgttttcactcaacattgtattttaggatcccatcaaaaaccactgtattttaggatcaagtactaccaccccctccgatcatatactacgttttctaaaactaaaattggtgttaaaatgtcatatatgaatgaacgaatgaagtattttgttagttgtttattttaggctaggaccaatggtccaatacttagtaataataaatagttgagtgcatgccttatgcagaggtcgaagtaaatttattctattatcttaaacaatataattgatggtaatttggtagagctctgctctattttctacactgaaaatttggtagaggtccgccctagtatttcctttcagagatctggtctcctaattcaccgtggatctggaagtgtgtttaacaaaaaaaaaaagattgttacaagtaaggtctccttcggaacaaaggattcgtggaggaaatctgtagaaaatttttaggagactaattaaagaggtttccaaggtgaattagcaacaaggcccatgggttagcatccaatgttttttgcagcaattttaactactctagcataaatttcacattggcattatagcaaggaactggtggcacaaatggatttttttttaaaaaaaaatatagctcagctctaaaaaattattgggtgttgaattggatttggatcagctctgaattttctattaagatctgctagtgcaaatgtgacattagctatacgccttgttaggagagctgcaattactttcataatctctagcttctccaaaaattctagattctcactcaaattttgaaactcagttatagtcctagtcaccaaaagctaggtaacctcaactcccccaaattctcatcagctggttattagaatctccagctctcgcaaaagacaataaaatgcaccatccatttgaaat

SEQ ID NO: 66568 - DNA, 728 bp, Oryza sativa
cttcctcacgtgtaaccacgtgccacataccaccacggtatacagacggaagacgtgacatagtttctaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaacggtccttatatggccgaggtgctactatcaaaaccatgcaccccgagcccagcctaaaaccattttggggattttgaatagaaggagcggtgtgaagccaatttcacaataaccaaaccattccatagagtccaggtgatatgaatattcccaaagtctagagttgaaaaaaaccacctaatgttacctaattaaaatagcgaagcatctacctaaaatcatgctagtggtaccatgagtagagtgcccactagttggggttttgtttaatctagggtgaacaaggtaataataacaataacaataataataaggtcataacaaaggtaaataggcatggctagataaaacagtgataacgc

SEQ ID NO: 66569 - DNA, 1127 bp, Oryza sativa
tctcagggaggagaagaggcaaaggctatttgctcaaagtttccatagcaacccttgctaaccagaatggacgacgtctccaggcgatcccgtagtaaaatgcatatactcctttttttttaaaaaaaaaacaggttctcaccggaggagctcctccgccggcgcacccagattttacgccttctccgggggaaaaccactttctctctccatctctcgctctcgctctccaaccccaacaaccttttcccacccggcatctatccattcctccgctgcgaagtatctcctcggatcccctacgccgcacaaccccacgcaccaccgcttcaactacccatacacatgtatcccaacccccaaccaccagacgccacacgcgtgcacgccgcaccggatccgcccaccgaacgctgctcgtctccctccccaccccgtccgcctacccgtaccacccactgccaggtgggtccatatcccagtgggtcccactcgtaagtgagaggggttaggatcgggccccgtgatgtccgggagatattgggggactaagagatttttttttttcgtttcctctctcgcccctataaactttaccactactcgccccgtgcgctctcctcgtcgtcgtcgtcgccgccgcgagcgaaccgggaggagaaagtccaaaccctcgcgaaggcagagtcggggatagggatatcgccgaggtgggagaaggcgacgtcgccgacatgaagctgttcgtgaagaccctgaagggcaccaacttcgagatcgaggcgagccccgaggcgtcggtacgatcccttcccccttcccccctctccttctctctcccccaatccgcgcgattttgagggaattctccgggaatccgctcgattcggggggcgtttgggtgcgattttgggatagggtttggttcggggggatcgggcgccttgcgcgggtgtggttttgatctgaatctagggtttagagtagagtagtagacgacgcgatgcggagcttcggatcggttttttttttgggcgctcggagtttgttattagggttgtaatctgagtcgtgtgctactaattcggcttgttgtgaactgatcggtttaagttacatgtgtagat

SEQ ID NO: 66570 - DNA, 713 bp, Oryza sativa
cttatatggaagttgattttgtcgatggaactcgggataacaagttcggcaagtggtcaccaaattgggaaggaccgtttcaaatctttaaggttgtgtctaaaggggcatatatgttgcaagggcttgatggtgaggtttatggatgagcgctcaatggcaaatacttgaagaagtattacccaagtgtttaggttgacgcatgatcggctaatgttgctgatgcatgacagccgatgtgttttacatcgtcttgagatggccgatattgttatatcgctcttagtcatttttctaattgtaatcggttatggtttgccgatatataacggctgaaattgttatatcgcccctagttgttttttagttttatcaatgctgttgacattataaaattggggggcacatatatacaaaaaatgaaaaataatgaaaaattagaagttatgttaatcggcataaaggatagtgaaaacagcagggtattaaggtatcttagccgattacaagaatttctaagtcctattacacaaaagttattgagacaagtactgctggatagccgaaatatctctttgcctaatttgttcgacttcttcaatggcttgggcatcttgagcatcagtcccgagaatgatcttcagggactcggttacgtcaacaacattcttgatagccgattggagccttgcttttgctcttgacagattttg

SEQ ID NO: 66571 - DNA, 937 bp, Oryza sativa
aaacaagggcaatataatatgtttgaagatgcactttttttctttggtatgtttggttaccaaatctccacgtttagtttgcaggataaaaattctggttttgatatatgttccttctaagaaatttaaggttttcgtcactggtcatgaagtaggattctttttcgatgtaatatcagggtccttgttcaaggtctttgttgcccaagctcataatacagaatgacaatataatatacttgcagagggcaagaggcaccgtttccttccatatgtctggaaatataatttctccttgtcttcgaatcttggctagtgcgatgttagtttagcattattgcctttgtgatttttattagggtatacttggtgtttatttgtaggtgtattgtgttttcaggttcggtttggttttcgtcagagatgaaggcattaagtgatgattgcgagcgattcatatccttcccccctgggcacttgtactccagcaaaacaggtgtgctatttcgcatttgtgacatactgacagtatcgtctaacagttgatgttagaaacactgtttttaggcccagaagacgaaaaaaagaggaaggcagaaatgatcaaaactattataatattgcaaatatcattttgttttgtctatgattactgacttgtcttctaatatccaacctaggtggcctaaggagatggtacaacccaccatggttttctgaaagcattccctccaccccgtacaatcctcttcttctccgacagagctttgagaaggcacgtcccattcccatatctcttacgctgcacaaaatctcttctaaacttttgatatgttgtgtttatgccgctgattaggaaaagcttgttcaaacctcagatggtttttcatacaatagattattttagcatgatatattatactgctctcagattgac

SEQ ID NO: 66572 - DNA, 1615 bp, Oryza sativa
atgttgttcccttccaatgtactctgtttaatatgcaataaaactttatgagtttcaaaaaaaaaaacaacatgtgcacattgtttaagggctgtttggatagctctcatacttgtaaagtgtagcatgacacactttgtgttgccaagaattttttgtcacaattgtgatagtccatggtaaaaaagtagctctatgataagtaggtcagcttatttgtgtctagctatgcgacaagtagactatggtaaaatatggcataacctatttgtggcttaaatcaaacacaaaactttagtcttagtagatcaaacttagtgtctataaggttggcaactaaatttgctacgctttaacttaggtaagccacaattttagtaggtagtgtttggttcatgccacaaatctactttgcctaacccttaggacctgtttggtacagcttcaactcctgaatttagctccatgagttgagtctggagtggagttgtggagctgcctaaacctagctccacaactctagtacattttgagagagctccacccaactccactcccagttttggtggagctgaaactgtttggctgagctccagctccaggagctggagctgtgccaaacaggcccttagtcacctgggccacatgttgtacactatattttcttgtctaactttgtctaaacttagtttgtcattttatttgccacaaaaatgtggcaagactcaatttagtaaccttagtcaaaaaatgtgtgacataattagtcctcaaccaaacaaacccttaattaccaaaaaaaatgcttaagtttgacactcaaccaaatagtcccttaggccttattcggtgcagcagtttggagatagatttttattacacgtaaaacgagaaatcttattagcacatgattaattaagtattaactattatgaaagctttttctgtcaaaaacacactatttaatagtttgaaaaacgtgctaactaaaaacgagcttgaagtttggagttgaggaaatggaaacaaacttcattccatcagtgctaactcttctgagccatacacgagccacatatcatatcagctggacgatatcgctaacgttatccttacatccacgagggaaatgccgcacgtacccagaagcgtactaaagagaatcagaccaacaaaaaggttggcagaagaaaaaaaaaaaaagccattgcagcccacagcccagagcccactggctcggcatggcccacaactcccggaatccgcctcacgtggacggccagaatccccgcgcggtcgcggtccaagattctgaccccccccccccaaaccctccacaatacccacgcgtttccactctaccctcttccactgcaatcgggacccacgtcgcactctaccccacatgtcacccgcactagacaaccacccccatcctttcggcgcgagctggattagacagccgctctcgtgccgtgtgcgccaccgatgacgcagtcactcggctaacacgcgaatccgacggccgggacgcgattagcggctcgtaaagccctaattagatcccctttcctgccttctaaacccatccgtgacgcgaggcagtgcggtgcgg

SEQ ID NO: 66573 - DNA, 996 bp, Oryza sativa
ccatgtggcatgccacatcagcgccacgtaggatactagatgggatgtgtcgatttgggacctagatgatacactttgacaagttctggaacccagatatgcattttgagagtttaagagtttagagacctatatgacataaccctataagtttaaggaccaccaatgcactttactcttaaaactaatctttagcttataatttctcatatagtataaggtttgtagcaacaagggtgtgttttcaactacaccttttcatcttttatttcatcttttccatgcacaagtttcctaaactaataaatggtatgtttttaaaaatatttttatataaatttgctttaaaacatcatattaattcatttttaaatatttagctaattcttactccctccatcccataatataagacgcgtacacattgtaagattcaacatttaaaacatttgaccaaaacctagtataatatgaaatgaattttatttgctaaaaattatgtcattaaattgagatttaaatttactttcatacggagcaatgtacaggaaaaataacagaaggagacacgtacggccgagagagagttggattgtacaggtacaactgtgcatgtaactagatagcaacaggttataaaatacattcttgtttgcataatggaaattcagaaatcaagcaatattgacagatgatcgaccgagatcgggccgggaggcatgaaaagagcagaatcgatcatgtgcgcttctgcagatttcattctggaatgcaagggctcatgcgctctaatgtgctcatttggcagtccgtggcccgtagagttgatgcctacaatacgatccacgtacacacgcatgcaacctagtaataaaagcactgatggcgaagactagcttacccgttgcctttcttcctctgttttattagttgatgcatccgtactgcataaaagtctattggtgctggtcggaaatctagacccactccaatgac

SEQ ID NO: 66574 - DNA, 1355 bp, Oryza sativa
tgccatgaaagtcatcgtcaaatctgaggaacactaacaacatccctgccgaccaaagtctaacagatagtcggtgctcaacccgaacgataatctcgacatggatactgctgcaaaggaatgaaatggaagatgcacccaaaacccagctgaccttaagctttagagaagctagatggtggcgatgataaagtcttacgaacttaagatgtatcccatgggtgaggattgagaaggagacctcgttgccagcatgcacagaattgccgggaccagctttgccttgttgtgtagcttgttggttgcctgtatgatgcaggggattcatggcgtgctccttgctggcccatgacttgtgctactgcttggataactgatttaggcacagcagcaaattgatggagatgctgtcggtcgagacaatgttcttgatgctcgcatgggaggaatcagcaagcacgaactgcttcaacaactcagctaactctgcacctccaaacccaccaaatacgacgacgatctgggtgtgtgtgagcccaccctcaccggacacgacgcggctgagcacatcgctgaggaagggcacatcgccaaggatcagatggacaaaggggccgcgaaaatcggttgaagccatccagatccaccgcaaactatggctagcgacctcaaagagtcaaagcttgaagactttcggccaccggcactgtagctgaattttccacaatcaggcgtcgctagggccgacgaaatcgaggtctggcaccgcgaagactgacctccctggctgatccacccacaagatttcagatctgaagaagggaacactggactcttcatagaggaccaaagacgaagaataggaaggacacagaatgagactaactcgactacgagactaacccgactaaactactatacgaaggagacgcgattgagcctgacccctctccctcccgtcaccggcggcgagccaccggaatcaaggaggaagaggggccagagaagaggcttttttttctctgtctcgggcaagctaggaggttccagagagcactggagtactactggagttgagattgtaccacggagattgtgcacatgttgtgacgggtcattctagtcatcactagcggtggcgcgatggtttggcttcttttgattgaacttcgttggaatgtgctacttgccttagagcaagttttatagtaaatgtgactactagctctaattttaaccctatcatctactcattaattaaaagataatatgtacaataattttcttccaacacataaaatcccaataattttccaacacatagatcgaaaaacaaatatttcttgattttattt

SEQ ID NO: 66575 - DNA, 1102 bp, Oryza sativa
ccttgtcctctgcgagactgagtccttgcatgtagtagcaggcaacagggtcattgtgacctgatggcctagccgatggccacagaaatcgaactgggccgcacaatatgcagttcgaaggagggaagatggatgtgtgccgttggatgcagtggtcagcagggatgaaaccaactgcaacaccgtgactttccacccaatgtcagaggatctgtttccctcctcctcctgtgatccacgctcaccctaaccccagatcatggccggccgacagcggtgcgaggcgggagcgaccgcgatggagacggcagcgactccggcgtcgggccaaaccgttccgattgctcgcgggagggcatggctcgcaacagacgcgtgattctaggactgatgtacgggtactacgaggaggcgctcgacgcgctgtcgctggaccgtgtgctagtgctcgccgcacgctattgatgctaaaaacacacactagcctgtaagatctgcttaacttcagtgcaggtccaaaatcttgcttttaggttcgtgagcgtgccagttgatttgatcatgcaatcaataagaaagaaagataagaaaaaccgcggttaaatctataaacgatagccgatcggctagttgccgatgacatatcatttatctttgagccgatgtcatgttggaatcgatcgacagttatgaataaataagataaagctaaatctactcgatcggctgtagatattaacgatatataatgctttcttcgatgtatatttaaactacgtgattgggatagatcggtcgccatgccgagatagtataaatcactaaagtcgaagtatacactaaagtaatgattatatatacgtttatagcatagccgatcaggtagatctagcatgtatcggctaatactccgataccactttatactaagatattaaaacaggcaaaatatatcaaacaaaaagtctaatatactttaatgcaataagatctcactctaaagggtagatctagcctatcaatcaagcatatgagatgtaaagtagctaaatcaggtaagatcggctgaaaccccgatgctatctctcttgataatcataaa

SEQ ID NO: 66576 - DNA, 2412 bp, Oryza sativa
ccatcgccccagagaaattcacacctgagcagaagaaggattttgaagcaatgttgcagcaagcctgggatcagttcttgaactcattcatgcagacccgcaagggaacactggttcagaagtataaagtaaaggtagttgccgatgatcctgggaccagttcttccaaaggtgaagacgggaaacaagctccagatggctcggctcaactgagtgacaaaggtgctaccgacggttctctaggaagtcaaggtgacaactctcaaggggtccatggagttcaaggcgatagagtgcatggagttcaaggtgatggtgctcaggggttgcaaggaggaaatcttaatcagaatagtgatgcagcacaagattttttcaataatttccaagaccgggtcaactatgctgtgcaccatgctttgatcaatcagtctggggtgttagtcaataccttatcaaacatgatgaagtcaatagccgatggatcaatagctgagcatcaggctgcagacccagtttatttgcaaggagttgtctttgcaaattatcggcctttgatcactgatgcctagccatctactcaggcagctttcctcgtcacaccatcagctcagccgacggcgccggcatcgactcccttacctacttcgtcagcattggcaccaggccagctggtgaaccctcagttgttgatgagagagcagccacagcatagtgggcaggttgtgaatcggccgacgcaagatcaggttgccgccatgtttctgccgcctcaatttgctgttgatccaatacagcagtagccgattcaacagacactcccgattcagcaggttgtacaaccaatccagcaacaagttgtgcaactagtccaacaaacgccaccaaggcaacagcctccgcggccgattcaacaaacgccgttaagacagcaaatcgttcagccgattcagcatcaaggctcaatgagcgcatcggccgggtttgtggcacctggtggacagcctgtgcaacgatttttaaatcaagtcgtcccagaacacttggttcaccatgtacagccggatggcacagtaatgcctcaagttgttcccgagcatttggcacgtaatattcagccgaaccttcataattaccaggggggcaacttgagttatcaatatcagccttcttctccgcaagcccaatatcagccagggggactggctcaacgtcagtttgcgtctcagtacggtcagttcgagcccatgcaacaacagtcacagggagcagctcagcaacgatcgtgggctgatgtgattgctgatgtaatgagggaacagtttgggcttaaaccaaaagagactggaagcttgtatcggcagcgttaccctgagtggtttgagagagttcctctccccaatcggttcaaagttccggacttctccaaattttcaggacaagatggtgtcaacttatgagcacattagccgatttttagctcagtgtggtgaagcatcggctgtggacgctctgagggttaggttgttccggttatctttgtctggatcggcttttacttggttttcttctttgccgtatgggtcgatcaatagttgggccgatttggagaagcaattccacaactatttctacagtggggttcatgagatgaagttatctgacttgacggcgattaagcatcgacatgatgaacctgtgcacgagtatattcagagattcagggagatgaggaacaagtgcttcagcttgagtttaactgacgctcagttagccgatctggcctttcagggtatggttgctccgattagggagaaattctcgtctgaagactttgatagcttgtcacatctgatacaaaaggtaaccttgcatgagcataggtctgcggatgctaggaaaagctctaagaaggttaatcatgtttgtccttacatgtatgggtcggatgacgatgaggatgactctgagatagctgcagccgaatgggtgaggagtaaaaaggttataccatgccaataggtaaagagttctggaaaggaagaaaagtatgattttgatattactaaaactgacaagatttttgatctgctactccgagagaagcaaatttaactccctgctggtcatacgattccgtcggttgaggaattagacaaaaagagatattgcaaatggcataattctgggtcccattctactaacgattgcaaggtgtttagacaacaaattcaggtggccattgagggaggcaagattaagtttgatgattccaaaaagccgatgagggtcgatggtaacccatttcccattaacatggtacacacagctggccgaacagctaatacggggcgcatgaggggtaatcaagtaagttcggctagaattataaacaaatatcaaaggaaatat

SEQ ID NO: 66577 - DNA, 3042 bp, Oryza sativa
tcaagccgatgtcgacgaggtggaagaggaatcagctaggttggttctatcactagaacaggtgatgttcgagaagcctgaggggatagagaatcggcatcttaaaccattgtatataaatggctatatcaatgtgaagccgatgtctaaaatgatggttgatggtggggccgcggtgagtttgatgccttatgctacgctcaaaaagttgggtataaatgccgaggatctcatcaagacaaatatggtgctcaaggactttggtggcaatccatcggaaaccaaaggtgttctaaatgtggagctgacagtcggcagtaagactattcctaccacgtttttttgtcatcgatgggaagggttcttacagcttgttgcttggaagggattggattcacgccaattgttgtattccttcaactatgcatcaatgcttgattcagtggcaaggcgacaaaatagagatcgtaccagccgacaggtcagttaatgttgccagtgccgatttagctctttgggagatggatggcctttattgtttatctggaaaagtttggaatggagattttctaaaagtgtccgattctgatatacagccagttgaagatggagaacccaagctattattttgagggcgtcgtggagggttcaagtgtctacactaaggatatggtagatgatctcgataacaagcaaggtcaaggttttatgtcggccgatgatttggaagaaatagatataggtccaggcgatcggccaaggccgacatttattagtaagaatttgtctccaggatttagaaccaagctaatagagctcttaaaagagtttagagattgcttcgcttgggagtattatgagatgcctggactcagccgatcaattgtagaacatcggctacctatcaagccaggggttaggccgcaccagcagcctccgaggagatgcaaagctgatatgcttgaacctgtcaaagttgagattaagcgtttatatgatgctggttttattcatccttgccaatatgctgagtgggtttctagcatagttcttgtcatcaagaagaacggcaagttgagggtatgcattgattttagagatctgaataaagctacaccgaaagatgaatatccaatgccagtagccgatcagctggttgatgctacgttagggaacaaaattttgagttttatggatggaaacgctaggtataatcaaatttttatggctgaagaagatatccataagacagcttttagatgtcctggtgcaatcggcttatttgaatgggttgttatgactttcggcttgaagagtgctggagttacatatcaacgggtcatgaattatatttatatgatataatcggctggctggttgaggtctatattgatgatgtggttgttaaatctaaggaaataaaagaccacatagccgatttaagaaaagttttcgagaggaccaggaaatatcgcttgaagatgaatccgacaaagtgtgcttttggtgtatcggctggccagttcttgggatttcttgtccatgagaggggaattgagataactcagagaagtataaatgcgatcaaaaagattaaggccccggaaaacaagaccgaattgcaggagatgatcggcaagattaatttcgttcgaaggtttatttttaatttgtctggaaaattagaaccttttacaccattcttgagattgaaggccgatcagcagtttacttggggggaagagcagcaaaaggcgttggataatattaaaggatacctgagttcccctcctgttttgattcctccacagaaagggataccttttagattgtatctgtcggccggtgagaagtcaatcggctcggtcctgatttaggagttggatggaaaagaatgagttgtattttatctcagtcgttggctcttggatgcagagactagatattctcatgtggagaagttatccttatgtttatatttttcatgcacgaggttaaggcattatttactgtccaatgaatgtactattatatgcaaggccgacgttgttagatacatgttatcggctccaatattgaaggaagggtttgaaagtggatattttccttaactgagtttgatcttcggtatgagtctccgaaggcgattaagggacaagctgtagccaattttattgtggaacatcgtgatgattcaatcggctcggttgaaatggtgccatggactttattctttgatggatcggtgtgtactcatggttgtggtatcggcctagttataatttcccctaggggggcatgtttcgagtttgcttatactattaaaccttatgcgactaataatcaagctgagtatgaagcagtgcttaaagggttgcaattgctcaaggaagttgaagccgatgctattgaaatcatgggggattctttgatggtaatcagtcagttggcagggaagtatgaatgcaagaatgatacattaatagtttataatgagaagtgccaagaactgatgaaggaattttggcttgttactttaaagcatgtatctcgagaacaaaatattgaagctaatgatttggcccaaggggcatcggggtataagccgatgatcaaagatgttaaggttgaaattgcagcaataacagccgatgattggaggtatgatgtgcatcaatatttacataatcgatctcaatcggcttctaggaaattaagatataaggcgttgaagtacactctattggatgatgagctttattatcggacggttgatggagtgttactgaagtgcttgagtgccgatcaggctaaagttgcaatcggcgaagttcatgaaggaatttgtggcactcaccaatcggcccataagatgaactggctacttcagcgtgcagggtatttttggccgacaatgctggaggattgcttcaaatattataaggggtgtcaagattgtcagaagtttggagcaattcaacgagcgccggcgtcggctatgaatcctattattaaaccgtggccatttagaggttggggaat

SEQ ID NO: 66578 - DNA, 889 bp, Oryza sativa
catatatgtgttcttcaaggttcactactagagaaatcatctttgttcatggtttataagcgcaacggaatgtgattttagtcccggttcactagcttgtcaggggctatcagccccccctatctttagtcctggttggtgttatcaaccgggactaaagttagcttcctttatatatgtcttcttccagcctgagctaagcttcaaaatttcttgaggaggagggaaggtgctgccaaaatttattgtgaatttattttggtgataatatacaaattggaggcgtctaaaaggttagcaacttcatcctccaatgttttttgcttagcatattacatttagagatatgttttgcatacattattgcctctaaaaactttgatggaagttgatgagaaagaaaatttgtgtagggaggaaagaatatagaatttttgtttatgtagaattttataaaatgttttgataaaagagttgagaaggaaaaaatattgaaaattaatctaagagaacagaaaaaaagttaatttaaaactaaaataagtacaacacattaaatatgtgtttgcaacaataaaaataattaaaacaagaataatatgtgggattattttataattattgtatgaataattatatacaattattgtatgattgtttaattggtttgacttttgttgattatttttacgatttttgtgtatttcatgtagatggatcggcaatggatgtacgcggaccgacggtcaaaagagtttattgatgacgtgcattattttttgagagtggctgatgctaacaagcataagggttttatctgttgtccatgcaataagtgaaaaaaccagaaggagtattctacattaagaactattcatttccacttatt

SEQ ID NO: 66579 - DNA, 707 bp, Oryza sativa
tagatctgtagatagaaatataaagagattaacgtttaaaatcacgctagaatatctcaagaacaggtaatatatgatatgatcgtaaaaggaaaattagtctgaaaaatagaaggcatatatgtcttggttttaaagatgttcatactctcaagagcctcatcggtacgaaatctttcagttattttgttgccagtgtcaacatccctcaattccacctgcagcatcaaagaattgaagaaaaaatatgatcgggagtataataagatatccatattttgttatttgattagctttgcaatattctgttattaaaaaaaggggtgctctaaaattaactattttggctgttacttgttacttgttacttattattttgatgctgaactatacggtgttgtgtgctgcaaaaaactaaaagaacaaaacgagatgaaaacctgtatagtggctcctcctctaccttgatgtgaatgttgtgcttttatcacctgccaaagcacaagcaagttaagaaaagaaataatagattgcttgttcttataagatacatgagcataaagtataaaccacaaaactcatgcagaacccaaatagcaaatgggcatacctgataaatgcgaccttgaaggttgaccaaagggatgggataagtagtaatccacaatacttgaaggcaaaaataaaacataactacatgtaaacac

SEQ ID NO: 66580 - DNA, 1736 bp, Oryza sativa
cccacggggcggcggcgagggagccggcggtctggtcccgcaggacggcggcgagggtggcgacggcatgggcgtggccgcggtagtgggcggtgggcgcggaggggaagtagaaggggaggcggcgggaagcttccagaagtttccgccggaggatctgcatcgcggcggcggcagccgggagtcggggagttcgcaggtggcgggctggcggcgaggaggcggaggagaatggtgagctgcatgtgcaggttgggctgtgggcgtggactgggccgctcctagaatatgggcttaatttaggcccatgtattctgtgtggacttactttaggcccacgttgaggcacatgtgattacctttttttttcttttcaaaattcacgaatttatcagaaggatttttgctattgatagatacatcgtttattactgaaagaataattagcagtaaatacgagcacacgcgtgtcaagtttaaaactaatccgtgaacaggctgtatcactataaatttaacatattgtgctacgctcaatatatcgttattaacactattgtgtgttatctcattttacactttgaatatctctcccttttcttttgaaattttgaatatctatcccatttgttaagctctctcctaaatcccatccaataaaaaaaaacacaatgaaaagaactgaaaaaaaaaacagtataatgataacaacaggcccatgcagaaacaagagctgaaacaagcgaaaaatcagcccacggtatcagattttttccaaatacagccacgtaggatgattacaacagatcacaaaccaagattagaacgcccgtcggtcgtccatatccaccgtaacaaaccgacctacagccactaacatgcgggccccgccaccccccggtcggcacgcgacgatgccagccaggcgaaccgtcgcgccacacgtggcccaccacaaccactaaccactatagacccgcacggcctcccaaaattagctcatctcgcaaaaaaaaggagaaaaaaagggaaaaaagaaaaacgagcaaatccaaatccaaatccaccaccacccacccttcccgaggagagagagagaggctatgacgcgctgcgccgtcgtcgccgccgtcgcggccgtgctcctcgtcgccggcgcggcggcggcggggggtggggaggaggaggaggccccgtcgacctgcgcgcggaggggcccgggtttcgtcgacgcgctcgcgtcgcgctgcccctgcatccggatcgagccatccccgcctgtagaggtaggtgttccccaatccccacctcctctccggcagatagcttgtcaattcaattatcccatgttgttctagaagcagcgagtatctgcgcgtgttcctcttcgtgtggaatatctacttgtcaaaatgcgggcaaacgacagtggcgtattgtgtgtatccgttatcaaaccaccggatagatgtgcgatttgtggttagaaatatattgcaccattaatttgtgcatatgtgcgtttgtttgttgccaacaattagctgattaacgggggaattgattgagggaaggtaacaaaacaatgattggcagcgcaaacgacattcaaggcgcccaggtgctagcggtagggagggactacatcataggtgaaacgggcgggcaggactcaggagggattttcagtgtcttatgtaagattggaaaggcagacataggaggaagtagctatt

SEQ ID NO: 66581 - DNA, 807 bp, Oryza sativa
cggaatgctggacacgcggcggcgagcgattgggcgcggggaagattccaaagggcgattcggcactgccgggccccacgtgtcatggacggagagaaaccggtcgcgtttccggcaggttcggtgaacctgaagcacaaagttggaacggcgacgttcgccacggcaagcaaaaagcaagaggatgagcgttttcttgcaggaacaggaaccgatttctggcaacttcttgtgtggtgcgatcgctgcacacgactacgagcacgagcacgagcaatgaatgatcatatatacttacagctatacaggacaattagcacattgtctaaacacgttgcgtcctcgtcatcaacagcataagcaaatgaaaactctgattttcgaattttgggggtaagagaaaacgatatcccagtattccgttcatactggtcgcagcagcacgagccagagcgatgaaccgatgaaagtgaaaccaccacaaattcagaaacggcagcagcaaattcagagacggcagcacagcaaattcagagacggcagcatgattaccaacttcaggtcggagcaaaagttaaaatgatgcaacaggaagaaaaacatcaccgcactgaacttaagtggtggtggtagtagtatatggctgtatatcaaaacagccagatcatgatcagaaaattgaaaacaaaatggaaaattaaggatgctctaaaacaaaatgatcaaggctataaagccatatactgaccatgatctataaccgaacacaacgaccctgcacccagtcatcttcagatactttcagga

SEQ ID NO: 66582 - DNA, 2093 bp, Oryza sativa
gtgggggagtggaggcggctgctgcggcggcgcgaagagtgggagaacgagattggagaagggtatttatacgggagggttagcgcagctagggttttgaggtgaggatgcggcgggccaagtgggctgggcctcttcggcccaatatgtagctatttgagttgtttcaggcccatcaagtgcatgggccatggaattggggacgaatggcctttacctagcctgtaagcccattccgaattgccttcgcctagcggcttcctccaccgcgggatcattgggcctgttcggtagtttgtttttgcagctgttatggctgcactggatagtccagttgttcagctgtctatcaagaatgcatctcagccagctcttccgaacaggcccattaccatttgctgagcttgacaagtagcagcagcgtggctccgcttccactcgtgcggatccccactccctagggggtcggcagctctacttgccttccccggcctggccgagccatcctcctcctccttgttgtcgtcaatgtgcaccgctcatctctccgtcggacaccgtccttctcgccaccagctcctctcctatcggccaccgcccttctcctcgtcatccgctgtgccgtcattcctgtcggccattaccctacaggggattggaaagacaagggagggaggagagagaaaatgttagccacttatatggaggggtagtatgggtcccacgttgattcagcttgtcctgtcaactaaaataggatttcgaataatccaaatttgtaaaatgaggaagcccgttatatatagtatttcaatttagggatgaatttcaaactcgaccatgctagtgatccatctttggtgggccaaatggaggcccaaacctgatcggttgggctttaccttaggctgccgatggaagccttgcttctagcgttgggcttgctaataatacagcgtccggcgttcaatgccaacgagccctgatcccgttcctcacctcaccggcggcggcgaaacgcctccgactccgagcaattccacttcgtcggccggcggccggccgattacccacgcccgtttcagcagcgcagcgaccagaccatgtgcagcatcagcaacgacgccaacagcttcgacctcatcgatggtttcctataataaccttttttgccgacgcttgtgtccgcagaatcatggcttctctgttcgagcgtcgccgagatctcggaggagcccatgttccacacgccggaaaacaccagtgaaaccaactgtaatggtggccaatccggttgataacatcatcaacgatcgatagcgacattacaggcaacaataaccatgacacaatgtttagctagatcacacgaaagttcaatgtccaaaacccaaatcaccaatgcagagttttacagacacgacgtctaagtagagcaattagcaaaccatgatccgaaaggagagctctgaatcgtagggggatcatcacgccttcaatggctggaccttgacctgatccagcacggggccgcacagcgagacgccgtcgctcaccttggtgtggtagtacgagctgtagaaggtcaccctggtgcgcacgccggcggcgacgaaccggaagctcgccggcttgaacccgccgtttccgacggactcgaacggcaccttctgcgtcacgttcccggcgaacgcctccaccagcatcgacccgtggcagccgttcttggcgtcgccgacgacgaacgataggttgtaggcgcggttcgccaccgtgcggatcacctgcgcgatggcgctctccctgccggcgacgagctccacggcgtactgccccgccgggacggagaagtgcgccgcgtcgatgaagcggacggccttgagcgactcgatgatccagcccgggagcggcgacgtcgcgtccttctgcttcggcggaaggaggacgcccaccgtcgagttcttgaacacctgcggcccgatctcgaatccctcgttcttgatcaggttgtctgcagccatttgttcgtcagattaattaccagcagcaatccatcgttcagacaatgatgcggtctctcttacctttggttg

SEQ ID NO: 66583 - DNA, 1758 bp, Oryza sativa
ggtgtcggcggtgtcggcgctgtagagcgtgcggacggcgacgtcggcgggcggcgagagcgacggcgcgacggcgacgcggagcgcctcgtcctgggcgcacgtgcgcgtggcggcgaaggtgagcgcgtagagcgcgccggggcgcacggacacgttctgggacgccgacgcgcggccgcccaggcggagagcgtgcacgccgtgcggcaccgcgaagaacatgccgccgggctgcggcccgccggagacgtactcgacgtgcccccgcagcgtccaccccggcagcgagtggcggccgacgatgagtgtcttgttcaccttcctcggcgccgtctcgaagttgccattgatgaggaggcctgggtcaccattaaaaaaatatatcaaaattcacttgtttgcttcaaatgtctacatgattgttgctttctttaggattcaacagctaaatatagcgctgaagactcttaaccaaaatcttgcaaaatgcaaatgcattacagatttacagtaccacaccattctggggaaatggattgagcaacaacaaaaagtcacaaaaccgatggataaaagtgagatgaatataagtgatgcacaagacacgaaaatgcagtgtgccagacacattcttgggctcttgccaagaacatttccacaggtcgaggtagtaatgtgcttgcatgaatgtgatactgaacttgaaacaaaaatgcagaaatgaaactgtaataactgaatctttctttgcttaaaagaaaactgaatctttcttcttagaacatttacatctgcaagaaaatgggatccaagaaaaaaccaagaagatgtgacagagaagagaacacagtgagctgagacctgagagaagaaccataccttcagcatctttaggttgaggaggtgcatgggcaggggcaggagctggaactggaactggaactggagctttgacggcgagtgtggcaccggcggaggaggcggcggcggcgacggcgagcagcaccagcagcagggcaccccgaggaagctccattggtaagctcactctccagcctccactgagttcagctctctttcgctttcactttggctgcttctcgctgacgctgagagttacaaggaagcaagcagccttctattttttttcctcctttattaccaaaaggagtgggaaattgcatacagaacctcccacgctgtcggaattacacatcagagactcattggatagatataattaatctctaaataaatcgtgaatcaatatttagttgggactttttgcaggcttgatgactgcactgtgagaaacaaaaacaaaactaagaaggattactaatagtgaaaaccgttcactctagggctagtgtgtgaatctcacatttacaagaagggttaagattgttgcattattatatctgactgtcccttctgatgcgaatgaatgtatggggggggggggggtgcccacggtcatggttcccgcgttttgtggtgtagttcccgcgcaatgttactgacgcgctctgcaaactagtacagacttgcataggacatgtactgatttactcctatgtgagtactgagtactatatactactactgctagagtgttagatccaccctaatgaatgactgaaactgtgaaattaacatgctaccgcaagcactactccatcatgcattagcactgttactactctactctactgtgttacatttacagaaggcaacagaggctaccagcagatg

SEQ ID NO: 66584 - DNA, 720 bp, Oryza sativa
ctgaagtataatgtcgaagacgagtgccctggatcttgcttcaggattaggagggaagatcagaaaggagcaagtcaaatcggccgtggatcagtactgcacatactttatttacccttctaatacgttaattaattatgcttgaattttatagtgatatagtaacaattaataaatttgagttaagtgcacttacggggcctacaggagattagggggggagagaagaaaatatgttttttttttaattttattatttttatatgaatgacatgtaggctccattaacacgtatgcgtcaacatggcatgtcatatcagtgcacgtagcaggttagactgttagaactcgtttgaatctggatacacctatgataaatttaggaacctatataacatatccatttaagtttagacagaccactggtgtacttcactctaacaggttttgaccaactcgccagtcgtttctcgcttcgtttatgctgccccttgttcaacaatcacacactaaaatgttcaggtgttccatcgtgtcaggtatgagaattatcatgaaatttatggaggtgaagtggaatcaaggacatccaactacgctgatttggtacctttttagctggagtagttgtttttcataataatttgcatatagctcatgtgaaatcgatcaattgaattagcaacgagaattttggaggttataaccaaactaattagt

SEQ ID NO: 66585 - DNA, 843 bp, Oryza sativa
taacatgaaaacttattatcttggtgaattaacttgtacatgtaggttggtgtctacagggagatctgccgagtgctgaaaccagggcagttgttcgcgttggacgagtggtgcatgaccgacaagtatgatccaggcaactcgaggcaccggagctcaaggccgagatcgagctcggcaatggccttccagacatcagaaccaccaaacagtgcatccaggctctcaaagacgcgggctttgaggtgagctctactccaaatactacacatcacaacattaaaaataggagaaactcttttaatttcttgagggaagagatatctccttgtttgttcgaacaacattcaaataatcataaaaaaaatctaaaaaaatggactaacatttgtacaacatgtaactgtgatcgtttagggctagatcttaaatgagacctgaaaagagacgtccctccaaacatttatcttaaatgagatctgaagagagacgtccctccaaacatttattagtgtgagcgtattgaggattgaacacggaaccttagggttgacaccacacatccgttgtcactgcactatcaagtgcatctctttatagctagatcatcaaagatcaagatttatctttgtgatgatgtgtttgaaggttgtatcggtgaaggatctggcagaggattcgccgttgccatggtacctgcctcttgattccagccagttctcactcaatggcttccgtctcacccgtgtcggccgcttcatcactcacatgctggttcgtaacattttactgatataccatgtactccaatctagatttgtagtattatttgtgtcgaattca

SEQ ID NO: 66586 - DNA, 4304 bp, Oryza sativa
  unsure (1)..(4304): unsure at all n locations
cgtcaaagttcttaaggtttgactaaacttatcggaatatatagtaatatatcgaccacaccaaattagtttaatccaatttaacattaaatatgttttgataatatatttgttttgtattgaaaatgttattatatttttctataaatttggttaaatctaaagaagtttaaatgaaaaaaagtcaaacgaattataatatgaagcggagggagtagaattttataggtttataagaattttgtcctaaactataagcttttataaccggaggaagtactcaatttggtgccaaatcgatgtagatttgctcgaaatactgtcacaatatcgaaacctattagattttataaactcgttctaatataaaattagtagttgagattttaaaagtttgattgaaccttgtccttaacgtcaaatatatgtaaaccggaggaagtgctccatttgacgccatgatcatcacaagtccacaaggacagacgtagtgcaaattttatcttttttcaaacaagatatatcttttgaaattttcatcatcttttggtacaaattgatcacgcgaaggcggcaggaagagaagtgtgaggaacgaaactaaaaacgtgcaacataaggtactgtatctacctgtcaaaaggattcatacaaagcacctctttttacaccaagagcaagttgtgaacaaagcatgcatttggatgcttctatactactcataggaaaaaagtgtcaaaagtgattagctttacaactaatcagtagttgacaaatagcatactgtcagatgaatagtatattgataagtagattgagctactggccatttgatacataagtataatttatctcctagagttttggatcaaaatttctatggcaactgaaataactacctcaataaaactaaaaaatttcagccggcattgttggatcatgtacaggacatccaggtacacgcaagttcaggatctgcaagatcctgtagccaatgtccaatgagcacaataaatgaaacagccacatatgccatggcctagtaattgtgctcaccaacactaccatttctgaggctttctgaatagcagttcagatggtccatgagaaaaatttatggatcatgctagttctatgcaaaggtagcagcacacggcgcaatattcgtgaaacgccttcaagactagaagtgtgaactgtgaagtgcaagaaagttgagataaattggccttctttttttaacccaaatttcgctgtcaatggcgtggttaaagtgagactcttcatctaaacgcaagacaaaagaggtaaggtgggttgtaaagtacaccggtgagggtgactgttcattaacattccatctctttgcagcagtaagctagcttgggtgaaggaaagaatggacaattactgcttaacatattaatagtccaattttattaattttctcgaacaatgctggcttattcacacatttcaccaacgaaaagaaaatcactgaaatacaaatgctaaactagctagaaactacttgtagtaagctgtagcgaatatatgcaatgaacaaaaggccgaagttactagcactggatctagcactgaaaaatttacacgatcaaaattaactagccttggcactgagcaaacattctacttctacatatacaaagcaaacaaaggttcattattcagatatttcaatgtgtataatccattaagaaccacagattgcatgtatttcaaatgtgtattgacacgcaagccttttgcatgttcgcgaaaaaaaaaaagataaaaactgcttgggaagaactgaaaattagagtgagaaatgagagagcttgcctatggtgtccccaacatggaaggtcttcttgacagcccagtcagtgtaattgacattgccgaggatggtccagccggaggtgtcgccgaccttgtagaccgccgccgacgatgtcgccgccattgcgagcccgagcatcagcaccagcacactgttcatggccattgccattgccgtgctacctagactgtgtggatggaggagatgaacagaggaggaggaagagatgctaagagcagagaagacgaaaagaatttagtactataaccttgcttgattgcttccaacaatgttatgccaatgaggaggattttatagtgccattgctcactttcagaactgaccattttgcccctgtacatttcctgtctgaaactggtatagctaaagtagatgagctatgtattatttttcatcttcttggatgatctatctattggtccttgagtaaagcaaacttaaaagctggccgtgtatccaagtcttgatcatgaggctggctgttcgatgaatggttaggtcagtgcagtgctcttcgccatgagtgagtggactctgctggtacgagatctcacatagactctcatagactcatacttgtttggagatctctttctttttgtcgaagcaaccaattgccaaacatgtgtgtatgtatgcgttgtttgttagtcgagatcgatcttccagttggtacccacttatctttttctttttcagctttgtttgagatgtgatgcacacacacatatagttttcagagtaatggaacttggggttcaataaaatttgagtttctttatctttctcttacccttttcttctcctttaatttaatcattacgatgtgcttgcagaagtctaatcaatagcaagcacctcgccgaacatgttcagaatttctgattggttgggatgctaatcatcagagctgatctactcaagctcagaacttaggatatctaagtatctaacactcatattgagatccattatctaaaaaaaacactcatattgagataatgctatcagtagttgaacagaaaactatttgtatttgcataaaaggttgtttctatttcgataaaaatcaggcacgtttggtaattaatcaaatgatccttgaaatttaatactacaaaattttatattaaaaaaaaaactttcttccatgtacatgtggattttttgactttttcaaatatgaatatgacaaaaaaatcgcatcgcttaaattggtatgagcattttttttccattaaactttgttatgttgtaagatatctaacattcaactgatttgtttatacatatttaattaaacgaaatttaattggtgtttaacaccacttatattttcttataatcagctgagattttcttatatgtctgccaactacctcggccatcaacctcggccatccgactgaaatcaaatggtcatcacattttcagcgtatgcgaaacgagacaagtcattagtgtatgactaggtgagtattaattattactaacttggaaaaatgatttatttgatattttaaaataacttttacgtagaaagttttcgcacgaaacacgtcggatagtagtntgagaaaagtgctagcanaaccaaagaaaaaaatctacatctcaatcagaaaaaaaaaacaaggctgagcctttggatgaaccacaatcttatctcatcaaactgtcccgacaaacaacaatgtcatgtcgtgcattttgtcatggcttcccaagctaaggtggcaggattatgtcactggtttagggtgagggtggtcaagttagttggtgcagcgggtacgaaggtatgttgtagaggatgcatatcctctacattgctacacgctcactgacacaccagtgagtagtactgcatattgtagaggatctcgacgcatgttataggcaatggtgagagcaatccagtgaggtggaggtagcgccactgtaaccattattcatgaagaaggccagtggtgggtggatagtatcaatgttagggtcaatcgggacaggttacaaggcggcgagaaacaatagtcgatccaatagcgtaagccacaaaaaacggagaggtgaggaagcttattggcttgagcgctcttaaatagagagaaaaaaaaaagaagaaagtttgtcttagagcatgaagaagtttttatgcaccatcaagttgcaaacaaaaccgaccgacaaaagtgaaaatgcatccactatggttcaaatcctagtggttaacaggccatgaatatcacgtacacgtgcacacactttccataaagatttagtggactcggccaagaatatgtcgttagcccccgtcttttcaaacgtgtgttaggggtacactcatattgttatagtgtgatgtccgtgcccgacggtgtgggtacatgtgcgtttcccgtgtaataaaaaaataaaacctaccaagaaaagctaa

SEQ ID NO: 66587 - DNA, 843 bp, Oryza sativa
gggattccgggcccacatgtcagcctctctcggtcctctctatctcaggtcatcaccattcaccagccagccgctagctaggtcatatcgatcgatcgatcaatcatcttccgactactaattaatttcactttttccgtgtgttggaaaaagcgagtgattaatcgacgcaagcagcaggaagagattagctagatcattaattattagattagcttaattaggtcggtgttaaccacgtggtttgtgtacgcttagctagcttgagccgccatccatggatggaacgcacatgcatgatacgtacgtaggcacgcatgaacgtacgtcgacgttaattaattttctcttccgagaaagtaatacacacgcatgaaatgctttcttgtttcttgtttctttttattttcgcggtcaggaagagagatggatcgagtagttgacctgatcagtgatcacatgcaggtaagtgcgtactacactgcatgcatacaaccaagacgtacgacaccggccgctaatgtggattataatttcaggcacattttttgtttgtaggatagagtacagattaatacactcatagtattatatatatatatatatatatatatatcttgtgattggtgaaatcaccacaacagatcttactgtcattcggtatttttcgatggcggagttagaaaaatattaagcccgggtaaacttcattataagtttataaccattatttaatatagaaatttcattatcaattcaattaaaaatattaaaattaaatggagtttctgctagttaacccggacggcgcaggctcccccttcagggatgaatccagaacaa

SEQ ID NO: 66588 - DNA, 3002 bp, Oryza sativa
  unsure (1)..(3002): unsure at all n locations
acggcgagcgcgacgacacggcggcgctggcgagggcgtggagcgccgcctgcgcctcggcggcgccggccgtcgtgctcgtcccggagagcaggagctacctgctccggcaagtcaccctctccggcccctgcgaatccaccatcaagctcatggtaaaaaaaattcaaacagaatattagttgattaatcttccatatccagctgcaattcagcttggaactgaagctgattaagtgattaacacggccattaatattaatctttctgaaattagtgtaattctgacgtgatttttggataatatgcaggtgaaggggacgctggtggcgtcgccggacatgtcgaactggaacgagagcaacaggaggtactggatcgtcgtccgcggcgtcgacgggctcgccgtcggcggcggcggcaccatcgacggcaacggcgaggggtggtgggagaactcctgcaagatcaacagggcactcgtaagtgtacttacagtactgatcaagaaattaaattcaagttcaaatcgctatgaattggcttttctagcacgtagataggtggttaattaataaattataactagttctagtaggcgccgtttttcttgatgtgatggtttacttatgcatggcggctgcttcaaattttcgtttgcacgtcgcatggtccttgactttctactcgtgcatttcgtattcaaatatatattcaattcaatttataatttagtcaattgtgatggccacggatctctctaacctagttcatttttcctctgtacttttcagccatgcaagggagctccaacggtacgtgcatgcatgcgaaatgcaatattttttttctcttctttttccaaatttcatttactcaatttttgtagtaccttttaatttgattcattttgtttgtaattaatacaggcgctgagtttccacacgtgcgacaacctgagcgtgaatggtctgaagatggtgaacagccagcagatccacatgtcagtggaggattgcaccggggtggagctggcccacctgtcaatctctgcgcccggcacgagccccaacacagatggcatccacatcacccacagcaagaacgtccaagtcagcgactgcaccattaagacaggtaatgcaactactccctctattttatattataaatcgttttatttttttagtcaaactagtttataaaaaaattagtactcaattgccaaatatagcatctaaaccatcaaaattagtttcattaaatatagcatttaacataattttgtaatatactccctccatccacaaaagttatacctattatttttatcactaagactaataagaaattaatttgtcttggatgttacaaaatcaagaagtaatgcaagcatgcaaccacatgagtatttagaagtctccttggattctaatcaaacattttatttatttatttatttaagtcttgaatgcataaagattacaaataggtgcaacttatttggaaaagctcaaatgtggaatatgtgtaacttttatggagggagggagtatttattttatgttgaaaatattactattttttaaaataaatttgattaaatttaaaaaaaattaactagaaaaaataagtaaaaactatttataatattaaactgagcgagtaatcaattgccaaattaagcacagaaacatgatcaggccttgtttggaaggcccaataattccctgcccataagcttgaataagcccaaaagggtatgtttttttttaatcttcaaaaggatatgactctgattaggtttttgttgttgatctctgcaggggatgactgtgtgtcgatcgaggatgggacccacggtttacacgtcacgagactggtgtgtgggcccgggcatgggattagcattgggagcttaggagatgacaactccagagctgaggtgtctgacatcttcatcgacaccgtgcacctctatggcaccaccaatggagctcggatcaagacatggcaggtaaatatcctcctctcatcctgcagagatttgtgtgaacttactacgaaattttcatcaaaccttttgtatttcaagtgaatctgagagagatagatgtggattttgtcaaatgcagggagggagtggatacgccaaggatatcgtattccagaacatggtcatgaacagtgtcaagaacccaataatcattgaccaaaactactgcgactcagctaagaaatgcgagacacaggaggtaacaaaaacatcaactctcaaaaaccaatcctttatttaacaccagtgagtaatgctcaacaaaaatcatccaaatcacacaattattgcaaatttgccatgaacatggatctcagggatcagcagtggagattagcaatgtggtcttcaagaacatcgcagggacaacaatttccaagagtgccatcactctgaactgcagcaagaactacccatgctatgacatttccttacaggacatcaacctggaaatggtggatgacaatggtgccacaggaagtacttgccagaatgcaaaatggaggaaatctggaacagttgttccacaaccatgcaccagcacaaattaggaggaactgggcctgataaagttcattactgtataaagtgtgtataaaaaaattcagaaggaatcagtcatatttatgcatacattgtgcatacactcattggggtttctaccaggaacctgcaatgcagtgtgcctacaaggctacagagtgtatttgttaaattgattcaagttatatacatgtaaattctttcatacagagcaacattgatttcatattcccannnnnnnnnnnnnnnnnnnnnnnnnnntttttcagcaaagtagttctactaacttattatcaacagatgaacagcaaggtaccacttactactccttaatacataacaagcattccggcagctaagatcttacagtagactatatagagtcatccactaataacttaca

SEQ ID NO: 66589 - DNA, 724 bp, Oryza sativa
tttttaaataagacgaatggtcaaacatgtgagaaaaagtcaatggcgtcatctattaaaaaacggagggagtatcttggtaggtgatttgttttttcaagaatgatagctgatggagagtgattaggatgggggcaatccctgaataaatgtatgtaatgacactgattggaactttagagttattagtacgtaatccatctctgtcaatacaggctaattttagctggttagcagtagcacttaaatagcagctgttacaatgtgactatttgctcaacatctcaaaatatatatagtacctttatggagtcctagctcctaggatcaaccgatcaagcatgtcacttgtgagttgcgaccctatattaaaaatctgcttcaggagtttatgacattaaacaattgttcatacggagactgaaaatgatgccctgtgtgtttatctgtttagcctctttatcataactggacaaacctgccagggtggctcactgagagaaacagcgaaccatgtgatataacggctttgaattgtgattgtgcccatgactcctctactgttcttacctggtatgcattcctgtgtccaaggctaaagctgacgtgtaatgggtttccttatccccaacttgtagcctgctttgtactttgtcccccatgccctgatgctaaccgatcagcccccatgcatgtatccacgtataattgttcgtatccatct

SEQ ID NO: 66590 - DNA, 2472 bp, Oryza sativa
tgataaaaacgacttaactgcaatatcagtactgtacttacctactactcgtagtactaccgttaaacaaaatgacttaactgtaatatatcagtactgtaagcatggtgtgcactttgcagggtccccttttccaaagctcaccgtaccttaagcactgcctaatcactttccttaaaactttcgttagccggtgcacggaggcacgcgtgcgcccccgccgggatccaatgctgcgaccgccgctcgcgtcgcgcgtgcgagagagagagagaagcgaaaagctcacgcgtccggtcccaccacgtaagatgggacccactggtcagcgggtggggcggtggcacgagtgccggctgctcccacgtgccgggccgcgggtggggggtggggccgtgttgggggaaacggaacgggggcccggccgcggcacagtgggcaggttggtgggggcccacgtgagtggcccgaataaagaaaattaccaaccatacccagggttttgccccccaagaggaggaagaagtcgggtttagccgtttgaaccaccgtgcaatgcgtgcataaacatctaggaacaaactgtgaaagacaaacgtattacggatttgagatggtgagagtcagctatgacagaaaatctaggaagcactacgacgaactgtaatagtcaaagctagatcatgctagctatagatcgtctggcatgaagtccgaaggaaaaaaaagtctcattgacttagattaattaatcttatgccagtgcatattatggataatcttagtataattaatacatttaatgcatgttgtcatgttgatggtgtggacttttctaatgtttaactcttattatcattgtgcgacattacagtcaactgcccattttcttcacaacaacatttatatttattacaaaaattatgtctaactacctattttcttcacaacaacatttccatttattcaaatttaagccggattgcgaaacgaatatgaaggtttcaaatattgacggccaccactcgatgttgtctgatacatgaaaccactcgattaattggtaagttcaaaaaacaaactaatatttataccttatcgtgggaagtggttttcttgagccccaatatattttgtaaaaatttggtggtcactaaagatatagatagtataatctttaaagtatcactcactaatatagatagtgttggattttatatcgcaaaacaacatatttcctcggtttgagaatgtaagtattttctaggtagacacatgtattaataaagtagataaaaatgattagagaatcacaacagaatttaagtatatttttagttggacacggctattaaaaagtatataaaaaatgatcgaagagaaagtaggtaaataaatgaatgagaaaatgattgtgattgattaaaaaaaagagaacagataaagaaataattttattttaaaacaaggtatactaagttagaaatagctgtagtataatttagcattggaacggagtacattattttttgagttaatttcactttgggccatattttattgccaaaattttcactttggactaccatttgtccaatcttttcacgttggactaggtaactttacctttgttgcacaatgaaccaccccaaaacatatcttcagttcttcgatgacttcgagcaaattgttaacgacatgccagtaaactttcataccaatatgcatgccatacatttgtcgaaagagacgctagacatcactagcgaaaagatttatggtggtccattatgcaacaaaggtaaaattatttagtccaacgtgaaaagattgtatacagggtagttcaaagtgaaactatcgcaataaaacatagcccaaagtacaattcactctttttttttttcactaacacagcggctattactccatttcttgagaaaggctttcctcggaccccacaaatcagtgggcgttacccgtggtcctggcgtggaatgcccggtacccgtaataatttgcgaatcatggagggcattttggtccagtccagaagccccaaaaataaagctcgtaatctgcgaaagctgatgaagctgagagagagagagatagagagagtgtgtgtgtgtgtgtgtcttcgcttcactgcccacttggatcctcgtggctgctgctgctgtagcggaagacgacgagccgcccaagaatccagcacccacccatccactgctgctgctgctcctgctgctgcaccccccgcattgtttcgaatttctcaaatcggccctcgggctgcggcggcgcggtcaccggcggcgaggtgagttcgtcggtgaagaggaaggggggggggggggtgtgaagtgaagtgcgatttgaggagggagcggtggcggcgtgaggaggcgagagccgcacatggccaccgcgcgcggcggtggcggcgtggggtggctggtggtggtggtg

SEQ ID NO: 66591 - DNA, 1792 bp, Oryza sativa
tgcacatctcacaccagccagctttcgatcatccctgcctcaagaaccacaccatccaggtaaaccttcagctgcaacaatggcatctacaaacctcaattcgttggattccgcaacaatggcggtgaccatcatcatgctctccgcagatgaggccgaactaccatcccgatggcctgtacgacgaatccaagagcggcggcggcggcgagaagcccatggtccagctctggcaccagggcggcaggtgcccggaggacaccgtcccaatccggcgtacgaagcgggacgacctgctccgggcgagctccatgcgccgctacggcaagaagcggcacccggcgcccaaccccatgtccgtcgaccccaacctgctcaacgagggcggccaccaggtacgtcacaatcacatattcacccaggaatgagagggggtcgccattgatgcgctatgacctccatgcttgcaatgtttgttgttgcactgcgggtaccagcaatggctcatttactgatttgcctgggtgaaaatttatctttctttgttttgcagcatgccatcgcgtacgtccagggcgacaagtactacggcgccaaggcaaccatcaatgtctgggcgcccaagatcgagcagcccaacgagttcagcttgtcccagctctggatcttgggtggctccttcggcgaggacctcaacagcatcgaggctggatggcaggtagcaatccgaaagaaactaatctcatgttcatgttcatgatttcatctcatctcatgcgtgagcttttgcattggcgagtaaatgcggcaccgttcttgcggttgcaataccccctttctgccgcgatgccccgcgtgctgtgtcactcacgagctctgaatctgcttttgtgttttcctttgattttcttcaggttagccccgacctctacggcgacaacaacacgaggctgttcacttactggactgtaagttttgtttgttcattccagaatgaattaaagcctgaagaattggtgaaatgtgcttgtattgatgtctaattcgttgtgtttaaacctgggtttctgcagagcgatgcataccaggcaacagggtgctacaacgtattgtgtgcaggattcgtgcagataaacagtgagatcgccatgggagccagcatcttccccatctcaagctactctggctcccaatacgatatcagtataatgatttggaaggtgagctagaaaattaaactagaaattcagttactcaccacatgcccccgcttagtagtagtagtagtaagttcagagttgtcacaaaacatgcaggccagagaatctctctgcccacttgctgctgtgctcttactcgtgctccttggctgataccctttgggctttgaaaatagtttcctcctcaccctgtgcccctgtggtagtgtggtcataatactttttttttcttcctcaacagcctttcttatccttaatgattactctagtttcattgttttccaaaagaaagaaccattgctacttttcacctcagcaagcaagcaagtgccgagcaaagtgcaagatagaaagcaagctgtttttcatttccattgagcacgagtaatgagtgcaaacatagtttgcttagtacaacatgaatgcgaggcatcctattgtagtactaaatgggcacaatgcctgtgtactgaagtccagatatgtcggtgcaaatgtcttaaatacatctgtatattgataattgaagacatctgtatattgatatattggttttaatgtctaaatacatc

SEQ ID NO: 66592 - DNA, 1848 bp, Oryza sativa
tcttctgaagagaagcaatggcatctggtggtggttgtggtgatggcctacctcctttttcctatatggtagattcacttgtctttctggttatggagcttctctcttgggcttaactaaagggtcagagggccatgctttatttttctcatgtcacctttacctcctttgaatgtcagtggtgtataggaaagaggaattggtaggattcagttactcagcaacttgtatgccattcccatggaggagtatctggtagtaggctataaaaagcacaaaaaataactaaaatgttgtgccatttatctcttctgccaaccatgaaagcatcagacctaaatagtagtatgttgaatattgtgagtactagtattcatggggagcataaatgtcaggtatatttttgtcaattgcagatgaagaaggatttgtaagaggtactgtacattgcattgaccatcttaatgccatcaacagtcatgtgcagatgaacaaaattggttgaggagtgtttctagaggtctggtttgtttgcccttgtttcatagtatatgctccagtttggtgggttggaagagaacccatgctgtttgacaggccaggaccagattcagagacagtttgggggcagagcagcctcaactcaaatgtgcatgtttgtatatgcaggagtttgtatatgtgtcatgtgaagatgcttgaaattttgggccattctgaaactaggtccatgtttgccagtgccataactcctcaggccaacttcttctccttaattgtttctgaatcttagggtgtgttttttttcacgttaaaattggaagtttggttaaaattagaacgatgtgatggaaaagttggaagtttatgtgagtagaaaagtttcggtgtgatggaaaagttagaagtttgaagaaaaagttaggaactaaacaagggcttagcctcatcggtgcgcctaaaaaaacaaaatcaaagctaaaattcaaattttaaacttaactttgaagttgattttaacatattttcaacatagttttttttttcagtattagttaagtcattaaaaacatatatgtatatacatttttttttatctcaataagctgttatggcttataataagcttttggataactaatgaggcactcggtgttggctactggtgatgaatgctcaaatcctgtaggcaatggtagttgtccctttgcttctttgatgtgttttcttttgacttggttcgaagagaactacacaaatgtggatcatcaacatttgcattgtacagtagtactatatttctctgatgaatctgtgttgaattttgaaagctctgaacctccctgaacagaaggatggtgtactcctgatcataggtgaggtcactgagggggtgtttgggagagaggggccccctcagttgtctgttctctgaagaaaaagaaacactggaagtagagatgtgtcactgtccagttccagtcagttattagaccctgtttagatccctggcaaaattttacaccatattacatcaaatgtttggacatatgcatgtagtattaaatatagtcgaaaaataactaattacacagattgcgtgtaaattgcgagacgaatcttttaagcctaattacgctatgatttgacaatgtggtgttacagtaaatatttgctaatgacggattaattaggttaataaattcgtctcacggtttacaggcggattctgtaatttgttactgcgtttaatacttcaaatatatatccgtatatccgacgtgacacgccaaaactttacacccgtaacctaaacacagcctaaattagtcagaagtgagatgatgc

SEQ ID NO: 66593 - DNA, 3389 bp, Oryza sativa
ctccccacaaaatgctcaatttcagcagcctgacgaggcgcctagacagattactgagtctgaaacgaaccaaagataacaacggtcgtaacataccaagcagaattattaacaggagtgagtgacacagcacaatccatcactccaacagaacttaaactgtaacacaagacttatggagaaggtcaaacaactctgcgaatttgatatatatttcaggagaaacagtctaaccatgaatccaggatcatgcccaggcatggcctgcacacggcgttctcttcaacatcaactaggattacaatatttgggattcagtagtaacctatttgaatggccagctggcctcaaatcttcctcccaacttggtgttactgttacaacaattgaggcaccaaaatgcaccatgcaccatacccaacaacctcccatcttctttctcaatcccaaatcatgatagactcatagaccatgcattgctgccttccatcttaagctctctctcttcgttttcatttactttcacttcagtggtgaccaaactccgcggtgcctttaaggtctgagctacaaacttgctagatcaggaatgatctaatatacaactatttcggtcgataggcttagttctagatgacgatttgtttggaacaacgaatgaacaaaaaaaggatggagatacaggggtggtgaaataaggatagtaggagagccggtgatcctccctctctaaattagccgctcagatctgtctagttaatgaatgaaccagcattgtacctaactgtctccagcaaaagtcaaaaaaaattgatcccgctctgtatttctattctgaatcactctcattgcaaagagccttcaatcctctagccctctgcaaaaagtttttccttgaattagcaaccatcaaactaaaatttggacaaggagctaaaaggaaaataacaacaaagctaggtttacctttctagcgcacttcttctctctaacttcatacctctcatgagacaaatcagacagccatgctcctggacttaccatctacaacaagcccaacaatgaaacagaatatggaagggttaaaaaaaagtgagcatgatcacataaaagaacaaaattttgcagtaatctttgtgaaagaagggattacaagcaagcacttctgcatcaactttggcctcttcttcggcctctgtgggagcttgcatcccttcattgccatgaagtcctcttctttctccttgttggataatgaaatgaagaaccttggcagtgctgtggttcccttttcttccattccaccaccaaaatcaaacccatttccctcgaatgggaatggagaacccctagtggagtaatatcgatccttctctggcgagagtgacatggagtgcctgttatcgctcacaaatggctcggttttcctgctctcagacaatcagttaccttatattaggaagaattgctcgatatttccagtcgatgcgagtgtgttctatggcatactgaagctaccttcggttcagcgtgctcgggcgccgcggcgaacgaaacggggcaacatcaccgccaagcgggcgattcactcgtggtatggtgcgcctaagaacatcggtccgcgcaggtgatggcgagccgtcgtccctcgtcttgacacagcggagtcgtttccggctgccccattgcaggaaaagatttggttcgccgggagacctcgatggccttgagtccttcacctctggatccatctatgtcctgattcctgaagcagaaaaggctggaaattttcagcaacaaaatcattgacgggaaatcagtagatagcccaaaaaatggatatttaactacaggggcggatccaacttgggactgaaccaccaaacttttgggtgaacaaataaactgaattaagagaggtttaaggctatcaaattaaggaggaggagaagagcttcttccagatctagaagagaagctagtaggggttcacgaacgcaagcaaattccagtcccggtggggtggaagagagagatgaatcagaaagagagaggacgcggatgctcaccaggatcccctcccctccgctgctctgctctgctcgccagatggagctcgccgcccggcgctcccctgttcagccgcgactcgtcttggcggcggcgcaaggagcggaggagacaacgagagcgagacggcagatttctttttcttctacgcgatactcgactactccgcccttattatagatgcccacaaggtccaagcctgacggcccggcccaaacacggcacggcccgactgggggttgtgcccgtgccggcccggcccgaccgccgggccatgcttgggcttccccaccggcacgctgggccgggatggcacagccaagcctggtacgaagttcaggatacataacggactaattttcaaccatatgtaagacacagtaggagcaaaaatagacgtattatatggcacggccaaaagaatatggacataaaatatatttattttagttatatatatgtcacatcccaaagacccggcccgactgctagtgggtcgtgcctaggcctgaggtgtagcacgtgggccggcacggcccggcacaaagagccgaccgtgtcatgccggcctgattcttctttggccgtgccttgctcgtgcctgggccgggccataccaggagggccaaatggccatctatagcccttatctcaatatttttactattttattaaaagtagttactatttatttatataactggtgatccacgtatcatcaatacttaaaggaaaattaagcgattgtgtcaacaacaaattcctcataccaccaacaaacactaactgtcactctacgcaccaccaccaccactctttctccatgagccatcatcattcctcctcttgcctttacatgcgcagccttaccctctagtaaccgacatgtctttttaccctcccctatcgtgatgcacactattgttatggttgtcgttcaggtcggggaagtcaggcttgcagggactttgggaggcaggagctgacctgacgaagcgcgaaggcgctatatttgggctccttcttgctagatctattggttatccaactgttggagggaaaaagaaaatggagagagagagagagagttaatgtgcagagtcattgctgaatcaccggacttggatagaataaggtggtccaaattgaaatgtaaagttggctattgtgtaaatgaaaagaatggttaaaggataatattatatgaaaacttttaagaatttttaagaatccatagtatgtgctataatttactcccttttgtcccacaaaaaacacgggatgattaattatggttagatagattccgctaaaagatg

SEQ ID NO: 66594 - DNA, 3733 bp, Oryza sativa
agcatgaccagacgtcaagagtaagaaaattgctggatcaataaccacaccacaatggcaatatctaagtgatatttacctgaatcattccaggatggtctctggtattgttaccaggccaaggtgtgccatcttgcataatccatccttcctcaggactttctgtgccttggcgacgagagcattaacacgaactttaaattcttcatattccctctggattttggttttgcaacagacattaatgcgagattacaccaaaaaaaaaacaacaaaaaagtacacacatataaaccaaatttaccttcatggcacgacgatctttaacaaaagaagcctgaactttgtctttcaagtaatcaattttctgtgcaaagtaccactctggagctctgggttctatgctgtactttttacagaacggtacccattttctagcaaattctgaagtctcagcaagcgcatcaaatgttaacattgcagctccatcatcagacacatagcaagataccttatcaacagggtaatccacagcaaggatggagagcacagtattggcagtgacaagaggaggttctttcataggatccacagtactgacaaaaatgtcaacaggagccaattgagatggttcaccttcccggtcatacctgagagtgcaagtgatattttgttattgtcagtaatcagtactacagtgctaacgcaggaatggtgtatcagaggtaaatattgtacatcaccttaaagccagcctatccaggtaagtttcacggttgattggggaccacttggggaactgatccagaatccaggatagagcaaaccaaatctcacatatgacagagagcaaccatagcgggtatgcattacgcacaggatttgtgatacggtagtgcaagaatatacataggacaatcaatcggagcacaataaccatcctgtacggatttattctggatgacgaaattggcactttctcgatagaggttggcgtgtttcatcattcctgtaatacagatagcacaacatttatagtggcaagctatatgataagtccgcattataaggttcagagatgtacaaccatttagaatctgatccattaaatgtgcatattgccttgcttaatagcaaggtatacttgtaaacacaaaataattatatttcgaattatgcaagaatttttcctatgttcttccaagtacaaactagtgcaagttagtacaccagatacaaggaatattaattactggtagaattcatagatgactaacggtggacaaaagcatatcagaactcacagtaaggcgtcctccatgttatagtcagtagatgcatcaatgtcaccaaccccacgaccttctgaaggagcaatgctagtaccattagccatgggaattgcacctttatccttcattttccagccatctactctctctttccatgcaacattgccaaggctaccagaaaactcccttgatgggtttgctgttgagcaacaaagaataattaaattttcccagtcgatgcaacgaaacatgagatcttgatgatagataaacttacgtgaatggttcacatagggaaatggatgcccacgtctgccaatgttcccaacgggagacatcatatgatcaggggacgctccaggaatttcacctgagatctatagaattaatcgagaggaagaaactaaatattagttcaatctttgcacataccctgaagggttaacgacttcacgctatcaacaaaaattctaacaaacctggctgtgagtgagcgatgggatatatatgcgagggatttcaccactgtcatacttgggatgaccaatctcaccactatcatacttagaatggacaatatcatcattcctcccagagttcatgcgccaggtgagcatcctctcggcaatcttgtgcttatggtcctggttgccggatgttggatagttcacatcactagcatcatccgcatcaacatcatcgctttcatccccaagtatcggcgggctccctgaagcaaagattaaatatcttgttaagctcaacaaattcactcacatttgcttctctcaatggaaataacccatacaggaaagaaattatgttgtcactggtcactaccaacttcgaatacagctcactaaagaacaggactctgtgctattaactcagcatattcactaagcatatatatatcttctctactattattgtctaaatgcaatatgcaacaacctgattgggttcacgagatgttcagtccaatgtagctgttcttaaccaaagatgaagtatttaggtgaaatccaagagaaggatgaatggataatgtgcaacttatacccttgtggcgcttgtacttggtcttgcactgcgggcacgcctggctgccgtccttgcgctcgtactcgtagcatggccggcacaccgggaacccgcagacgtcgcaggcggtgaagagctcgccgtccgccgccgtgcccacgccgtcgccgcagatctggcagacatggcattgcttccccgatttcttcgccgcgcatacaacaacaccaaacgaaacaaacaaacaaaggcaaaagcttcagagctcagaccaacccaaacatccacgcaacaaattaaccaatctttgaatctttccccccgaaaatgcgactcaccgcaccgtccatggcgcacgaaccaagaactcacggccaagaaagtgtctccacgaacggactcccgccaattcaccgcattccgcggccgccccgatgaaaccaagaaaccccaactcccccccaccccaagtgaggcaaataatcagtcagacaccaaatcgcctcggattcaaggcgccccccgccaccgccaaagccgacctcgtagctagcagcacaagctggatgaggaggcttgcaagaatcaaacgggacaagaaaaggacgtggcaccagcgaggatgaggaaaccgcaagcgtgagcgtgaagtgaatcgaatccgctcgcgtatcactctactctactccggggtttagcggttgattggtaattaaaacccccgtaaaatttcgagatttttggcgtgcatttgagatgagatggttgggttgttgctggggttttgattactccacggggttcggggagaggagtgaagtgaagtgacggatgaggtgagctgggggtggggcccacctggcagtgacgggcggagtgcgcgtcggctggaccgtggtcgcatgcagacagaaagtgtgaccgggatgggcgtgtggggaccgtggggcctactgtcagtgagaaagggtggacagcttgtgaggttgtgatagacacaaatgccaactgcacgcagcctgtatcgcagtactctgttcttaaaaaggaaaaaacagagcactcctcgcgcatagtaatcccttctaaaaaaacgtttgaacctgaatacaatatagaattgggttttttgacgggtgaagtatatgtatttgtgttttaaaagcaaaattgtgttaaatgtttaaaactttgaccgttagttttgcattaaaacaaatggtttgtaaaatataaggagtttataatgctatgatcgtatttttgaaataaaatttacggcacaccatttttctttcctttaaactataagtattttatatgaaactactccctccgttttaggttataagatatttttgactttggtcaaagtcaaactgttttaagtccgacta

SEQ ID NO: 66595 - DNA, 4721 bp, Oryza sativa
tgattccaccacggtaatcctaatcagtttacactcagcgatagactgcaaatctgtaacaggagcatcaacaaagtagtgctgaaatgacaatctcatgatcatacaccacatacatatggtacgcaaacaacgatagttgtctcctcgacagtttaggatagtgtcccacgcatgcgtccacgagtcctcgacgcaacgttcccgccatccacgcgaccacgcatgcacggggggcgcgcgcggttgatgcactggacgtcgagcggaaaaacgccctgatcgatctggtgtcctgagcccccgaggattcactagctcttgccaattgtatccatggccgccgccacggcggacggacatggcgggaggcggcggctgagggtgttcttcctcccattcttcgcgcgtggccacctcatccccatgaccgacctcgcgtgcctcatggcggcggcgagcactgatgccgtggaggtggaggcgacgatggcggtgacgccggccaacgccgccgccatcgccgccacggtcgccgggaacgccgccgtgcgcgtcgtctgctacccgttccccgacgtcggcctggcccgcggggtcgagtgcctcggcgccgccgccgcgcacgacacctggagggtgtaccgcgccgtcgacctgtcgcggcccgcccatgagtcgctgctccggcaccaccgccccgacgccatcgtcgccgacgtgccgttctggtgggccaccggcgtcgccgccgagctcggcgtcccgcgcctcacgttcaaccccgtcggcgtgttcccgcagctcgccatgaacaacctcgtcgccgtccgccccgacatcgtccggggaggcgccgacggcccgccggtgaccgtgccggggatgcccggtggcagggagatcaccatcccggtgtccgagctcccggacttcctggtccaggacgaccacctctccatgtcgtgggaccgcatcaaggcgtcccagctcgccggcttcggcgtcgtggtcaacaccttcgccgcgctcgaggcgccctactgcgacgagttcagccgcgtcgacgcgcgccgcgcctacttcgtcggccccgtcagccagccatcgcgcgccgccgccgccgccgtgcgccgcggcggcgacggcgacgtggactgccttaggtggctgtccaccaagccgagccagtccgtggtgtacgtctgcttcgggagctgggcccatttctcagtgacacaaactcgcgaactcgcgctggggctcgaggcctcgaaccagccattcctgtgggtgatccgctccgactccggcgacggcggcggcgagcggtgggagccggagggatgggagcggcgcatggaggggcgcggcatggtggtccgcgggtgggccccgcagctggcggtgctggcccacccgtcggtgggcgcgttcgtgacccactgcgggtggaactcggtgctggaggcggcggcggccggcgtgccggcgctgacatggccgctggtgttcgagcaattcatcaacgagcggctggtcaccgaggtggccgcgttcggcgcgcgcgtctgggaggacggcggcgggaagcgcggcgtgagggcgcgcgaggcggagaccgtgcccgccggcgtgatcgcgcgggcggtggccggattcatggcgggcggcggcgggcggagggagagggcggcggccatggcgacggcgctggcggagagcgcgcgcgtggcggtcggcgagaacgggtcgtcgtggagagatatccgccgcctgatccaggatctgacggacgcgactgcatctcagccttgaccatgacttccattccggctcatttcattatcgtcgcaatcactttttgaaaaattttgtagaaaaaaatcgagtgaaaagctatgatgacctttgtatgcttcttccgttctgtatcatcaacatttgtttgtcccatcactcaactatcttaaacttatcgttacatcaaaatattttctcatttagttctaatatatgctaaattacctagaaaatttctattttagaacaaaggattagtgtgtgtatatataagaaactcttttaattcctcaaaagatattcccttatttcttacacgtcatgattattaaaaaataacacgataaaatgaatgtgaagaaatgtgaacaagtgtggtcatctaaatgcgagattagaaatacatatcggggacattcgagattagacatttcaaaccaagtaacacaagtgtgacaacttttgccgggtccggttggctaatctattttgggccacctcaccggcccatgaaaatattctcatttttatcgggccaagaaattctctgtcggacaacgaggcctagcccacggcccgttcctcaagaatctggataaggacatcaagaaatggcccgtttggtaaaatttcaacttcgaatggtcagtttagattggtgtcattttaaactatacaattgcttgttaaaattgataaatttatcactgtatttagtttgttatcaaatattggtaatacatagaaaattttggcacaacatatttattccgttctaccaaaattttggcgatactgccaacttaccaaaaatttggcaatgccaaattttagaaaatctgattttggtagtaatataaacagaccctaaaaatctgattttggtagtaatataaacagaccctaaatttaactataggagttggatatgaagtaaattataaaacagtctaaactcaactcaacttctctatttaattttgtgagagcgcttcagccagtttccgttctattttaagtgaagctaaaactgtttgattagtagcttcagaaatcaaaataaatggagctaaagctgaagccgtgtcaaactagcccctaaaagtggccgtcgccatcaaatcggtctggactccggcggatatgccagcgagaccgaccccgccgcgtggcacccccgccattgttgatgctgacggccgcggctcgcgaggaagaagaagaagatgccatattccctcgtctactcttgccgacgctaatctcccccggttccgttaattatccccggtcaaatcccaccaatctctttcatgcctcctcctcattccctgtatcgaattcatctttaaaaaaaattcaatggcgttatcatgaggaaaagggcgaaacctactgacgtgtagctcagggcgagtgctccctttctccgtctctctctcgaggttgccgtccaacgtccatcagtcatcgtgatgattgagattgacatccaatgtccacacgtagtactcacagtaatcgaattgatttggtaccattgctttgagaaattgagctagattgatccatggagagctgaagaaaaatgaagtgctagtactagtgtcgaactgaatgtttgcaagatttgagcaaacaaaccatttatgccgtatggataatacaagccaggggaaaaacaagggccactctgtgatcacaagcagcagagggcaacagcagcaacagcaaatatacaacttgttttaaaatcttttttacaattaggttctcggatgcgcacagctaagcaaacatcacacgaagaacggcagctagattaatccagcacacaaaaggcactgaaagaaacagagcagcagcagatcgatcaagatcgaaggtttgcagaggctggctgcaggaagctagaagaaggatcgcttggtaggcaccctcccaacagccttcatgaagttggcgagctcgagcaccttggcgagcttgaggcctctcttcgcctccgccgacgccctcttctcctccgccttgcgccgcgccttcgcgatgtcgttctgcgtcctctccagcgccttggcgcgctgctcgtccagctttctctgcgttagttgttcagtcatcaagaacacctacgtgagtaacattttggagtacatagcagttgctgctaagcactattcagtaatcagatatgctttctaaaagataaaactgcactatgcaaaagcatgatttgcagagcatgtaatggagagagaaaaaaaggcttttaaaagctggattctgacaaagaccgctctcctaacgttgcatgattgagtagtggttaactcatctgatgtcgcatgcctacatccaaaaaggatagatagtactagtgctactctgaacattttcttgcaagaacagataccctgctactctgctttgagttaatcaccaagaacaaagttggattccctttgctcggaatcaaaatctatcagctataatttcagatttttgcaaagcctaaacggacaacaagaattagatgaaaaatctgcaaacttgagagtcataaataaattcataatcagttattgagttacctcgatcttcttgagccatgcggatgctttctcgacctgctcggtctcccacccgttgatgacaacctcctccctcttgaaccggttgttgatcttggccacctccgccgtctgccacgccgacaccttcgtctccacctcctccttcttcacctgcctcgcctccaccggcggcgccggcgatggccctgccgcggggacaacctccagctgggacgccctgctcctggccggcgtggcgatcgggtggctgtccggcacaattgccagcgggttggtctcctccagctcgtcctcgccgatgctggtgagctggtcaccgcc

SEQ ID NO: 66596 - DNA, 9385 bp, Oryza sativa
  unsure (1)..(9385): unsure at all n locations
gcatggagggggggaagcgatggggccgggtgtggttttgtccattggcgccaagggggtgacacgtacttgtctcgcggtgcggtgcgttcgccattggcgccaggttaaagctggtgcatgcactgcgcctgcgcgatgtgggctttggtcaaggcgagagcgagtgttttggtgcacctggagatcggcgaatttgcaagttggggcgcttgtttaatccaacaggatgggttggggaatgtttcttttggttgattaattgattggcaaatggcacagcgtggcctcgtaaatggagtacgttgtattagtgttttattagtgtgtgtagtcttcagaaaaaaaagcagcagttagtaacttatgtagtactactcgtgtagctcagcaaaaagatggttttgatctgtgcttgatcagctcgagcctgaaggtctagttgttatcccttataaaaagttttttcgtagcatttcacatgcattacgccagtgcaaatcatcttatcacgttacgcggagagctagcaagctttgcaaaggcagtttagtacatgttcagatgagtgcttccatacgcaaaagatactactactactggacaacacaaaatcccagtatacgtccaatccgaagactccaaacacgtacgaaggcaagggtttgtgaaccaaactaccaatgaccacaggttgcgatcgattgcgccctcaataatctcaaatccaatatcctcacgtcttaacctctaccggtctctttacggtcgaacgggtcatccagtgcagtacaggacaattgccagaagtcgacacgacgaattactacctgtacagtagttcgtcatctgaactggcgatgttactattggctggtcatcggtttaattcgcgagcaagtatgctctgctcatcgtcgacgtgttcatcgtgcaggacgtggaagtcccgggttggggatggacagctaagagtgggtggtggtggcgacgcgtcgctttcacccggataagagcctgtccgcttcctccgcctcaagctgatcaagctagcacacatcagcaaaagaaaagaggagtacatgcaatccgcgcccaaacccaacccgcgccgcgcacctgtccccgcctgccgctttcgcccacgtcttctcttccccccctccatatttcatatcgtctcattcccctcgcgcgcgcggacgggcagcgcggcgcatacacagacacaatacagggcgcgaggccgagtcgcgcggcgacgtgacgtgcctttcgttgcgtggctttgcgcaccgttatctgcgcggcacgtgtgcgcggcgtcggattcacggcttctggagtacgatcttttttctttttcctacccgcaggcgcaggcggcgacgggggcgcagcggggcaaatttgcggcacgggtggatgactggatggtgaacaagaatactaaaaggcacgcgaggagatgggccgtggaatgcgttatgcgtagcgcgttgaggtgaagagtatcgccagcggaacgtgattcaatctatgttattacaatacaacttccaaatctagataagtcttacaatatgaaacagaagaattagctactttagaatgaaatagaagggttctatttacttaatttattatattttggatcgagtttaaattttatgtaagtgtttaaatttatacggagagatacacactaacacacgtagtgaaaataaaaggctatagctaaagttttatttttaccggttcctagacaccaccctcgtacgtatacgctctccgtccgtccgatgtgttgcgctccaagaaagtgacccctcctttcgccatcgatcgatcgatagaattgtttacgttaaaggttggtttcaaccagcctgttccaaagaaatttactactccttgtaacttggaagcaagagattatatagtagtatatcgtttggtaggctttgtaatcacgcttgatgggtttgtcaaaatcaaactcaaatcctatttatgttgtgtggaggaaataaaatcttatcccttctcgtacatgcatgttagtaatatgtatgagtggctagtgcagaggatcagagtccacgttatataagtttatacctcacagtcagctaaccagcatgggtctgagaaaccgatgttacatacacagccaccttcattttcctctctagcaagtcataccagctacttgtaggtcctaatcatgcacgtcgtcttggagctactgatgaggtagcatgtttacaactaacccgactcccaactattgtactactcaattagctaattaattcattctagaaacttggggtcattagtactagtacccatcaattaactttatcaatactcttttttttgtgtgtggtttgtgatctatatatatagtggctgactagggagcgccactaattaggagaaagaaaactaaattaaaaaataaacaagattgatggggatgaagatgcatggccattggaagtgcaaccatgcatggcaaatcagacagccggttagtgctaggcagctactatatcacttcactttgtagctttcccggattttagcaagataatcaactctggccacctactagaaaaataaagaaggttagttaagcactgtgtgtgtgcttgctcaactcaattaatcgctgggatggtatgagtggatttgcagaatcctcgctatcacgatgtgcttcgctttctcttttctttttttcttttcttctttgtcataatacactttctttagctttatgtctccatctctctggctggaccaagtattgttattttactcattttcgtccatgtcataccgaacttgacaaaattgttttgttaatttggtcctacagagacacgcgtgattggaacaactggagctaatataattaattaactagcaccagaactctcatgtgtacagtagtgttatcttttccatttctcccaagatgatatagtaccagttttaaccatatacatgaggtgtccgtgtcccctccgattgcggatcgctgcctccgtcggtcggacaaatcgccgtacgttgaagcaaacgagccaaccggtgagcccctttataggcaaaattcctctgttaattcctccgttctcaaataattcagtgtaggttatctgagatcggaggcagctcagcattaggcttattagtttgattgttttgcttcgatattcagggaaactattctaactttcatgaacattcactagttatttacatatcaactaaatgatttatactacctccttttttaatagataacgctattgactttttctcacatgtttgaccattcgtcttattcaaaaaatttacgtaattataatttattttgttatgagttgttttatcactcatattactttaagtgtgatttatatcttatacatttacataaaattttttaataagacgaatggtcaaacatgtgagaaaaaatcaacggcgtcatctattaaaaaacggaggtagtaattttttttaacaagatagattaatactcctatgtgataaattaaatcattccacaaacttgtaaagttttaacgaaaaaaaaaatcaaggattctgaaattttcagggctgcagagattcgtgtcaatagatcgatagagaggatttggaaatttttcaaggctgcagattttcgcatagccagaatgggcaaatgcaaagatggcccaggagaactagggctgatgccatatggatttggaatttattcgggccttcaatcacacacaagcttctactaatgtcagtccgattagtagcatttagccaattcaaaaacagcagagcaccctttacaagcgactgaagatgcgttgcttcagctcagagagtcgtgtcgccaactactgtaagatctcaattgaatgctctaaaactaaccaacaatttcgtgcgcctcgatcaaattgagacaaatattgcagaaatttaaactatctacagcttgaatcgcagcctaaaattccgcagcagcttcctcaggcaactcctcgccttcgtctcgcggcacttggctcctcctccgccgccgccgccgccgtcgccggagaagattgctcggagccggcccagatgccgcgggctcctcccctcgtacgccgccgcctccggattctcctgaaaccgccaaaacaaacgatcgaggtaagaacagctcaccgagaagaagacattcgcgattcggaaggatgcagcaatggcggcgcaccagtatgtagttcttccagtcggcctgcttggcgacgaccacgcggcggcgagggtcgtagctgaaccgggggtggttcttgatccggctcgccgcctcgaactcccgccggaactcgcccagccgccgctggagctcctccacggggaagccggacccggtggcggcgttcagctcggcgcggatggatgaccagtcctcgccggtgagctcgcccacgttcctcgcgccgccgccgccgcccgtgtggcgcagcagcaggtcgaggaacttggcgtcgtgctggctcgtccacgcgtccacctgcagccgcgacaggatcttgcggagcgcgcgccgcgacaccggcttcctcttgatcgccttctcctcgtcgtcggcggcgacatggacatgcaactgctgctgctgctgctgatgcatttcttgcttcgccgtcgccgtctccggctgcatcaaccgcacattatgcatctccgtcctgccatagatcgatcgatcgatcggttcgtcaaaacaaaatcgtaagaatgctcgccgtcgtcgttgtgaaatttgcacgtactgataggcgtcggtggcgaggcggaggctgaggaagacgacggagtcgtgacgcacgccgtagtccgcgagcgtgcggtggtcgtcgtcgaggcaccggccggcgaagaacagccgctgcatggccaccgcgatgcgctcccgggccatgaccatgcccttgacctgcgccaccgtcgtcgtggcgccgtccacgtcgagcgccacccggtccccgcgcagcgtgcgcaccatgatcctcatcgtccccgacaacgtacacaccgagctcaccctcagctcaggcgacaggtctcatccggattcccgtgcgagaaaagatagcgaggaagaggaagaagttgttaggttgagatgagaaaaataatggagatctagcgcgaagaagaagggattggctggcatggcaatggcatgcatgcacgatggctacgagagggaataaagcggtttggatcgatgatgatgacgacctttgggcgccaacgtgaaggaaagtattttcttcttcggagcgctgacctgtgtacccaactgtccatgcagttcaggcgttggaagatctgggccgagacagctaatgggctgcttgtgggcaatgtcagaacctggcctggcccagggatggcctgtgcaacccaatggaaaagaacaaaagttttaatcagctttcaacaattcgtagggttaaaatgatctttttatagcactgaacggagtgctgttaatgaaaatctaatgacgatgatatttatggaacaaagacgattgtacaatgacatttttaggaatatatgttcatcgatggcatttcttgaatttggatgtttatcggtggtattttctggattttctcatatgataaagttgtgtttttgagcttttgactctcaaattattctctaggttgtacaactatagattcacaaactatgggcaggaatttataatgtttaaaatagttggagatcattcaaaaagggcatgcggactagtatagttgttggaaaaaaaatgcagatgacaaaaaattgtggcaaggggcattatggtttgatattcccttttggatatacggattgaatgcaacataaagatcaagtgaactgaatgcacaatcacatggacctcgcaggcgacgcatggcgtttagccgctcgccatccggtcgattcaatacgcgcctgcagagttgttcagcttgccggaaatggcgacgagcatggtaaagtcgcgggaaagcattcaggcgcatcaccaacctccttgacctcccccacctacaaaaatggccgccattgccaacctcgagctcagcactcacacacacactcacacgcaacgcgtttgttcaatcgatcggccgtcaccgcgagcgcacgatggcgagcgctcgtcgcagccgcggcgtggcggcggtggggatcgcggtgtttgtggctgtcgtggtggtggcggcgggcgccgggggcgcggcggcggtgtcgtgcggcgacgcggtgagcgcgctggcgccgtgcgggccgttcctgctgggcggcgcggcgcggccgggcgatcgggtgctgcgcggcggagggcgctgcgcgggatggcgggcacggcggaggcgcggcgcgcgctgtgcaggtgcctggagcagtccgggccgtcgttcggcgtgctccccgaccgcgcgcggcgcctcccggcgctctgcaagctcggactcgccatccccgtcggcgccgccaccgactgcagcaagtaataattaaaaaaaagttgattagattggtctcatggcgcattagtttgcatttactgaattgtttgttcatctcggttcgatccattgcaggatatcctaagtggcagcggggcgacgacgacgccgctacatggcgtgagttcgtcgcgatcggtgcatgatcgaacatgcatggtgttgacgcgggagaagagtgatttggcttttgcgcatggtgtaatctgatctgatctaatccgtgcatgaataagtactagacatgcttgtaataactcatgagctaaatatcactcagatgagatctcagatttgagattttcttagccactgtttaactgttacagagttactcctacatacataacatccactgagcagagctgatgcaagtttggatcgcaaacttgggccttcatgggccgctcgaacatttcacggttggatcatcaatgtccggcccagatagcaatttatctgatcattttgcacatcttggagataaactggttcagatatttcatctagaacagcgaatgagaatcgatagcaaccaccatatatataggtcatcatcaggaattcaggacaagacaaagccaaagccaaggaggcgcatcagcagtggaaatttcttggtttgttctcttcagaggtcagagatctgacctcacctgagactcctgtggctctgagctagtatatcgtcttcttctagagtgaacagttcatgaaccaatggatgcatgcatgcatcagcatcttaatttgtatagtttcaccatcctgtggtctagaagattgaaaatgcagctaacatgtttgtattcctgcgcccttcaattttctcctgggagaagaatatgcaacctgcacgccggtttcagtttgccgtcagagaatataatggtgacaccgccaacaacaaaaaaaaagaaaagaaagaaaaactggtttcagtgctagtagagctggtacaatagcagactattagccaactataaatatattttaatgagataaaagatgagagagaagagcagcgggctgcaacacggactctaagacgcaatgtgtgtataacaggtgggaccatatattaatagtatagtaagcaactattgtatgaattggctattagatcggctatagatgaattggagctagtagtgggctgtactattaaacttgctcgtagtagaaaagagggaaaaaaagattcttatgaattttatgcgatgtgtcttatgatttatggtagaacccaattttttttaaaaaaaaataaaaggagggattaggagattaaaattccgacccccttcacctgtttttttccttcactacttcagtgcatgtttctctctcagccacatccacacatctctcttctcattctcatgcattcacaacgaacctaacatgggcacacatgctgaactaatcgattgattgttcagaacagtccttttcattttccatgttcattctctgaaatctcaacatgtttctgctaacgaagtgcaaacagtttatgagccatttggtacatgcagcaccaccatttttcggtttagaagattgaaatgcagcatgctggtatgccggtttcagttttgccgtcaaaagatagaacggtgacacctccaagaaaaatataaaatggaagttccagttttagctgctaggtacttctctttccgatcggcacctcttcttttggggggataatttgatcgataaccaccttagaaacaaaagttcagtcctttttccttgttcattctcggagatctcaacattttctttccaatcaagcataattaggattaccatgcatgcgtgcaaacattcatttctgaagccgaagccggagagcagagctctggtcatatccaaagggggtcggagttttgaactccgatccccttcgacctctttctttctcacgctcctgtgatctagaagcttaaaatgcagcatgttggtaatgcctgcgcctgtgctttactgcttttcttctgaaagaggaatatatgaatcagttttcagtttgccgacagaaaacataacaatgacaccgccaacaaaaggaaaaacaatagtttcagacttttaagtgctagtagaaaggataaaaggaacatttgtatgaattttatataacattcttatgatttatttattcctttatggcagtagaacccagcatacaaaaaagaaaaagtaaacttcagagaggggttcggagagttaaatttcggtgcatgtctctcgctcagccacacccacacacctctctctgtctcttctcctttgtcgtgcatgctttgatgcacacacggtgaactactcgatcgatcaacagttgagcttcaggaccttaagaagaaaaatgcagtccttgattccctgaaatgtcaacatttttctgccgacgaagcgtaaaaaaacatgcaatgcttgcgaggcaaacatcgtttttctgaaggcgaagacagagagcagccgagccgttgtcagatgcagaaggggtcggaaattaacccctttgatttcgtttttgctcgctttctgctcaatctgcatggttatcttattctccacaaggtttaggacgtaagtggcgtcgaagctgctgtgtcacttgggtggcaagcttgataacgataacatatgtaggctgttgtgttgtctcaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66597 - DNA, 8702 bp, Oryza sativa
  unsure (1)..(8702): unsure at all n locations
gtcgctgtcgtcatcgtcatccgacgaggacgaggaggaggaagggaaaggggagtacataggttcgacttcgacgaactcctgaggcgggaggaggaggaggcggcgcgggtggccttgcaggcgaggggagaggaggcggggcatggcttggacggggacgaaggggatgcagaggaacgcggcgaggcgggcgaggaggtggagcggcgcgcagcagagcagcccgaggacctggtcggcggggagcgtctccgggttgcacgccacgcgctgccacgccgccgccgacgcccgcgccaccgccaccgcccaccccggccgcaccgccattaacacgatgccccaaaatccaaaatccgaattcccctcctcctaggatgaacctaggggtgtcgtgacgaggaaggcacgagcgcgcgagcgcgcgtggggcctcaccggccgccgggccgccgcgaggatctcgccggcggggctcggattcggccgcggcggcggatttccgtcgttggatcgatcgatcacggtggctgggttggcgtggcgaggtagccaactttatctactcggatgcgcacgtggactaggggggaggttgactcgacggccgacggcgacgggtggaccccacatgtcggtgggatattccttcttccgggcggaacgctcggatctccgcgatggctctgcggagaaaatatctttcattccattttttacgggaattttgtgaaaattaaactatttcctgcaaaatatctgtaaaatccttgcgttagtaaaggagtcctaaagcattctagctgagattactgcataatgaaccctagctaatattagggagtaattggtaattgaaattggtttaaaccatgtgctacttgtcactgcgctattaagtacatctcaagagcacctatatatccatattcaaatcttgaagttgtttttttccttttaataggagtagaagggcatgtttggattgctatcataccaaattgttggtagtgtcaaattttagacaagttttgacattaccaatattttggcaaagatttctattgatttggcaagttttggcatcaatccaaacatcacacaagtactatttaggctaccaaaaaatttggtagggcaagatttggcactaaaccaaaacagcccgaagttattttagctcttatggatttcaacaggccaagagctctattacgctctcattactattctagatcgtgccggagtatatttgacaaccaaaagctgatactttcatggacttgaacaagctgagagctctaatgctattttaggggtttacaaaaccgcgcggtaaccttttcagtttttgaaaccacggatgtctcgtggttaccgtggtaaccgacttaccgcgggggtgcggtaaccgcgccaaaaataataagaggaaccctaactcgttaggaagaacaagccggaagctctattactatactagctcgtgctcgtcaattgtcataaccagtagctgctcaaatgaaaggctgcaaaatcatccatgacatatgcaaaataatactctctccatttttatctcattttacattataaggcatattaacttttttatttaagtcaaaattgtttaagtttggctaagtttataaaagtatagcagtacctttgacaccaaacaaatatattatcaaaatatttttcatgttagatttaatgaaactaatttggtgttgtaagagattatacattttttttatattagaaaaaaagtcaaagcgtattataatatgaaacagtgggtgtagttgtaaacataaagcaattctttgctcaggtgaagcacaatatacatgaataatcgctcaaatgcgactctgcacaaacaaccatgaccaagaaccatggcataatcaaaacaataggtggtaaaacaaaagccattctgagcaaacaacagacattcttctcatgtgaagcacaatacatgaagaatttacgacaatgatgtaaaagaaaaattgttgctgttaaattaacatatttgaaaaggatgcgaagtaatcagtgacgaccaatgcatcacacacgaatatatatgaaaatggaacttcaaaatgagagacagtatcatgagtcatccactgcattttatttgatgcattgtggtgggaaaaaacagcagggcctatcaagataagacttcagggaagggtcctctggtgaaggggaagggctcccagttcttcacgctctaatctctccttcttcacctgcaacaagggggggaaagggcatttagactagcacaagcttcaaatgaaaattagctgcacgtcataaatggctaatgggtaatggcaaaccataaaattaaggcctaggaatttcttaggtagttatttcagttgttttttctatgtacaactaattgaatgcagtgggtattgcatggttagattgcatacaacccctgaggagttagaaggatactagaaaataatagtcacaacccatgactgcaaattttatagggatcacgcttcttgtaacccagtaatactaaaagcgaccatgcccagcaagataataaacaagaaaaaaaaggtgatcgatattcatgccgacatgcaccctcgaggatactcaagaacaaaagcaaatttataaacacacaatatcttcagcttagagtggcgtcaagaggaaaaccctttttacatgaatttaatagactgccatttcaaactaatctgaatacattttacccagcacaagagaaaattacaaggctatagattacattatggcatgctaatgtataaccaaatgcaacaagacctcatactaagaattataagggtaatgcttaatgtaacttggcattcaattagagcgtttgtgcaatgaacaagtgcaatgacaaagagcatcttcagatacacttaccagatccatcatgtcactcaaatagcctctgaatggtgtctgttgcgcctgtgcaaatagagagaatgtttcagaagcacatcagtttaccgggttagtacagataatgacaaatgtaatggtaatcactggctcactgctaaagatgaaagatggcctaattgtgtattcaggttcttaggtaagaaattttacaagaatacatgtgtaacaagctgtaactccgaaatcaagaattcgtaggacgaatatacaccctcttcacaaacaaggaacaagttttgtaacatatgttaacccgaatcatgcatccacaaccttccggcctaaaagaatcatcaacatcatactatacccaaaatgagtgcatcgatcccctttgctctacactcatttcactttacaggcaataatcgggataacctataatttacgtatttgttgcgtgggctctcaaaaaacacaaacctagaaacccggccaccctaatctgcacaccatcgccgcaaaaactagatcagggcaggagggaaatgaacggacctggtcgttttcggagaggtactggtgcttcatggagaggtccatggcgcgcttgaggcgctggtggcgggcgtcgaccacctccctgggaagcctctcgagcgcctccttgatgtccagatcatgcttcgggtcgtacagatcgtcgtacctcaggcctaacaacggatcaatcacacatacagaataacaagaacaaaatcccatcaaatttccagatcaagaaagccccccaccccccccgaatcgagacacccagatccaggcgagacagcaaaccctaccgtatttccggaggcgcgaggagatcgcctgcatgtggaggcgggcgagcgggttgcggcgcgggttcacgaaccactgcgagaacgcggacagcatcgacgacatcgtggcggcggcgggcggcgatccggcgatctctccctctcttccttctctgcggcggcggcggcctccttcgcgtcctcgcttttgtgggggaaagagagaggagaccagtctcgggcccaagtcgtagggaggattcggaaaaatgagccagatttgtgaattgtaataggccaaatgggccgacgaaggaggagggcccatatagttaaattttctctttctatattgtacaagtagggttttgttatttgagcgacaccttttctttttcttttttgacatgatgaacatcagttttagatctatggctttaataagccataaaatatgcataaagaaaggaaaaataatttatgggtaaaaacttttgtatttatattagtaatggtttaaaagctaatactggaaaatagacaaccatgaacaaacctcaaaatcaactctaaagattatgttccaagattttaattttggtgtggaggataggctaacaagagcacgctagggaacttttaagatgcaattttgagttagggtagcacctgcagaatgatttaggatttaggcaggaattaattttgtttattctatgttcttccttttgaagtcctcaaattcttagtagctagattttttcaattgtagaccaaactgttggtgttaggattatttcatatagaatacttgccaataagcactgcattggttcaagaatagtactagttttgacattgatgtgcagtattatatggtacagaacctttataattttgcctttatataaacatatccttccaagttattttcttatgggcactatgaacacgtgtgggagtgggaaggaattggccagacacaatacatccaaaaacacaattgaacctataaaaaataaatcagcaaaaaaacagggagagaaaaatacgtgctaccaaacttcataccattaggtaaggcatcagagcatctgtatatacaaatacattaaactcaacctcactcgcattcacatcaaccaaaggtgacatttcaacctcactcacaaagccacaagacagaaacatcaatacacacaagaaaggcatataaacatctgcctattttgtccttctattttttttgccccttcaatcttgatgccattgaaatcatgctgttctatacagaggtaatggccgagtaaacggcaaaatcacagaaaattcatagctgccatcatccttgctctgttcttcaagaaccctagagcttcagcttcatcagagctgggtgacggtgcgaatccaccaatatggaccatagaacatgcacatcctcatcctggcaagacttgacatccttgtacagaatgtgcattcccctccctgccaagaaagcatcaagcacagcaatgtcagggccataacaacgttagaaggaagaaacaagtcgatttcaccgcgtaaaatgatcaatgaaaatggctttgcaatcgcggaaatcaccaagaggagttgatgcatgttgaaagaatgagttctcagaaacaacttacggtttcgacgtgcggaatgcgcacgaacccagagcttcctcagaggggagaagagggagtggagccaccccatgaggaagccctgctgagacctccggctatggcctcatagagaggaggtgaaaggaggaatggagcaagctatgcaaaagaaaagaaataaaaggatgggtagttagagaggaagtaaccatcaggtttgcttttggcacgaggtgaagtttagtgcactgtacccttcttctgccacattgtgcttccttgcaacccaatcatagtgctttcagaaattttattccggtatcttgtccctttccacttcttactcttcctacctcttttctccatttaaaagagggcatttttacacccccccccccaaaaacaaacctacagaataattcaaggtacatgacaaccatagcatccatagcatttcttgtttgtatcttctgagtgctgccaagcttaagattttcacaccaaatttgagggacattttttttaattcaacctgcatccgcttgtgtgttttgtgcatcgcaaagcgtgcgttcccttttttaaacaaaatgggtttctcttcggcctttgggtccagttggatatataatgcaggaaaagacattttcagacagagagagagagagagagagagagagagagagagagagagagagagagagagagagagaggaaatgcatttggtcttaatgatatcatgaaaacatagcatgaaaatacatttttcacagattttaactgcaaactcacatgtatcacatgaactaattatgctaaacttatagtagattttgcttggacatttgggtatagcactaactcaatgttcttagcttttcgtacaggaaagctgttgctgatttggatggtttttaagactataggtagtcaaaacaaacattatcttgcctgctttttggatggtttttaagactataggtagtcagcacaaacattatcttgcctgcttttacgaacaccattacaaatttgtagtgttatatttacattcaccannnnngattcaagtaactggccatcataacaaagcatatgtgtgttaacacgaatccagcttcaaagtaaacatgtaacttttgaatatattatgctctgcgacaagaaccataccttttctgctactgtctgacctgctgttgatatgtcgtatgccgcccttgtcaataaggatagacatctttgactcggtttcttccaccagcaaaatgagaaggttgtattcaactatgacatgcaacaattcgttgagtagaagattggagaaaacatgtgaaaatcaggaagcacgagcagtcgagcaccaaccaggtaaatttttcatcaactaaaacaatagaaataaaataggcatccctacctgttgatgcctattcaggctctatgctgccacaaggcaaatgccaatcctggcccagcccatgttgcactcacaaatgcttaaaattttgatgttcgtactctcctaacatggaccactaacttgataaacctgtcaattatctgaattgctccttcttagaggatacagtaatatgaaaggtggaagttatggatatcgtttgtaatatgtatataaccaaagaaataaagaatctgcatggcctacaaatccaatatttggagtttatctacaataatctacatagacttcttctaaaaataaggcagcaagatgatggagacgatgacaataaatggtacatctactgcatactgttactgattatgcaatgtcttccatttagatagatcaacatcctttttctttcctttccatttcttcttctagttggaacaggatatcatctatttttggttggaagagaatttatactcctaaataagattactgtaccaaacaggcaaacaccacatggtcactttccattgtattcatatgctattaagccacagtaagattactgccgtactaaagtcatccctccatattactgtacctgactaagaaaagttggaacagttccttgttaaactagcaccgcaatccggtaggtagtagtcagtacttatagtgacagaaaattccattcatatgatgtagctatcaatggacaatcactagaatcagttgtgaggttcttctcaaatgtcactgttaaaggactatgtttgcattgaccagaaatgcaatcttgtgtattgctccaaacagtagctacaagaaattactgaatgaatggacaggaactaacagacagaatgctgtctgtctgtgtgaaactagtgaaaaccaactgtcagagagctgaatattactcccaaaatatcatatatgaaatgcttccaataatgtaggaaggctaattaaatttaccaacaatgaatcaatgaagactacaagattgatttaaggaagcaaagtaagccggctttgcaacccaatttacgttgagcaaaacaagttctactgaagtatatcttggatggcctgtatatttgggggtctagcaaggccgtaagaccctaaggagtactttggatcttaactcagctcaaggcaagaaatttccagttccatttggtaattttggttgcaaaccaagagcttttctgattttaacgatagttcagtctgttcctttgtactactcacaaaataagttgatggataaaaatgccaacttacagcatggttaaagaaaggacttgttcagttaaccacttaaccaatgataccatgattaaaataatataatattagcccatttcatagattcatgatttgatcagagtttagacattgttgtgtactgttaatgatgaatttccacgatcttctgttcaaagggaagcatcaatggaattagatacactcactagagttaaaagattatataagcaatacaaatggtgtacctttcaggaaaaaaaaagagatttaaattcatcatagatgacaagataatgtcctatttaatgtttaaaacgtcaaagctgatgtggtccaacagttcggaaagctacaggctgtttaatttgattgttcatcattgctaatgtcaatgcgatctcctaaataaagcacactagagctaagccaaccagcttcctggttagccaatggccattgaggcacctcacttcagtttgtttttttttctttttgaaacccacctcacttcaggtgataagaacagcaacaataacggtagatcatcactttagtagatgtatagaacgaaattacacagaatttgaagtctcttcactgag

SEQ ID NO: 66598 - DNA, 1056 bp, Oryza sativa
tgcgccgcgccctttccggcgctcgacgacgacgacgacgcgtccgcgatctggacgccgctctccccgaagcaggaagggaagtccctcatgctcgcttgctcgcgcctttcaccgaacacctggcggccgccgcagcagcagcacagcgagaagctccgctccgccgcctcaccgcatcaacaagcgacccggcggcgagctcgcctcccccgcaatgccggcaacgaggagaagccgcggggagatcgctcgctacctcgagtggccgcgagatcccccaacctttcaccccaataaagcagcaccaagaaccgcccaaaaagcaagcaagcgagcggaggcgattgatcccgcaagcaagattccttcacgaagccgacctcttccaacgcaatcaatcaagatttgccgcgaaaccagcagcaaagcagcaatctttcccccggagatttcttcagaagtttccccaagaccaccaccattaaagcaaaaatgatggaagcttcaggtgcttcttcacccaagataagcctttgaagactttgaagaagaagaagaagaagaagaagaagaagaagaagttccaagatgtggaggaggattcaacactacactacaccactctactctccctaaaagcatcaagcaacaagagaggcaatgagagaagctagcaaacaagcaaagaactgaagtagagtgggggagagagaggaggggaaaaggagacaagaggtttggggctacagcctactacaggccacagccatacaagagatactcctcctctcctaccactacaccacacacactactgtcactcactcacccaactcaaggagggcagggcagtagtggcagcagcaagcagaggagggggagcagttgctgtggctaactgctgccattactactgttaccataccactagctgttctttcttcattcatgcaatgaatggagtggtttctaccatttcttctttgcaagcttttaaaaaaaagagtgagggcgtgtttagttcatgctaaaattaaaagttttgttaaaatt

SEQ ID NO: 66599 - DNA, 1587 bp, Oryza sativa
agggggttagctgccttgtatcacaaggtttcgtaatttatctttgtcagtggtggttcacgatgcgttttgtcatgtcatgacatcatacccaatttcctcacttacaacagatgaaatgaaggtgactctgcagtactttgatggccgacctatgtctgcatcagtgcctccacgcgtgacttgcacggttgttgaagcacaacctcattcaaaagggataactgcacagcctcagtgagtctcacatgatcattttcgtttctatttttactgtaatgtttgtttcaatgttcttatgacttttgggttaactgttgctcttactaccttttacgactttgatactagattgttttgatatgctgatgctggtcactgttcacagtttgtggatcaaaatagccattttgcgaaattcagagataaggctagtattatatactaaaaggtttttctttgctattcacagtttatgcctgatggattaggtcattagggtgttaagacttaatttggcatggcttgaggcctattgtttatgagctgcgcaatgaatactgatatcatggggtaggcctttggcattttagtaggcctttttatataaccgacgagctatttgctgttacatgtatatgtatagctttgtagttaccttctagcattgatccattagattgcaaggtccatttgtccaatacttgtgagctgtctcattaagggacgggcttaggtccatttgtccaatacttgtgagctgtctcattaagggacgggctttgaaggaggcttggcttagctcagctcatttaacaactgagccaagctggttcacagcttgtaaggctcaggcttgtttccccagcactatctgtgacatgcgaggctgcggaactgtatctgtcattctatgcactacacacaaagactttttttttttgctattatgagcttcataatctttcgtcaccagatgtttgaggctatgttatgcgggtaactaagctcattttgcactgcagatataaaagggtattgctggataatggtcttacagtgcttgtaagttgatgcgccatttcctagattttattgacctatccttttatataaatgttgaagtacatctaagaatggttgctgtatgtgctatcactttgatatccttttatttgtggcaatgtgtggaaaatggcatttgcagcatacatatgtctctgattgagttactgaaaatcaactctgttttgttctacatctgacttactcaaaagttgggatacacgtgccactactgaaatcaaccttgcttttgccgtgaaataatttactggttacatatagattagtactgaaaattagaaaacattgatgagtctgctgctttgaaatagttcttacttcctgttgcccttctgcgattatcttaggtaccaccctttgtagaagccggtgagaaaattgttgttagtactgcagatgattcatatatgacgaggtaagttctgagagcatcatttgcatattttggcatttcagttacataaactatatacttcggtatttgtttttttttatgaatct

SEQ ID NO: 66600 - DNA, 1111 bp, Oryza sativa
  unsure (1)..(1111): unsure at all n locations
attctcaatcatacagcaaccagcgtaagagagaaatccaactccaatgcaaaatacaagagtatttggggatacaaattgagataatagaagtatagacttgaagaagcactttttttagataatgagacttgaagaagcatgggtttgggggctagagaattagagttttcagtgggaggtagaatggatgatgggattaggctgatgcagtctcttcatggatgcctttggctgttgcttgacttcttttatttttagacaaggaaaatgattgtatccccggcctggcctctgcatgtataacgcacacacatggccataaagtttcgagttttggctgctgatttatagctgcatccctgaaccaactaggccaagagacagccaaacggtgcagtctaaagcccctcctgagcccaggttcatgacaaattcctagcaacagcaacacatcacagatttcctggatggacgcatcatttgtcagcatggacataatcctggaaatagaaggtcttctcgatgaagttggcgagccagcgggaggcggcgaagctctctggacacccgacatcaccgccgtctccttgccggcggcgaggaacccgacgacggcgaccgccgccacctgcaaggtgatctccagagccctcatccccttcagtgcagctctacaactggtgcactgcatgacatgcgaccaatacctgttgtttgtggtatccaaacaagtattcatgttagatgatcactgagagttctctccaagagctgaagattgattgcgtgaagatcagtagacagcttgtttacctctccaagagctgatctctggtaggagtttgtggcagctgctgtttaactgttggatttgggtttgcccagccaatctgatggttgcagtactttctaaaccagtttctgtaggcgatgaccaagttgtcagatgatgttggcacatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66601 - DNA, 854 bp, Oryza sativa
tggtacatctcgagctggtaaaaagagaccaagaggttcaaagtccccaagtaagaagcagcaaccaaagcctaagaaccgtttcacagatgccactgagaaaattagcaacacaatggaccatttggtggatcagcttggtaatcctcctcctccacctccagtgccacagttttgtgacccttatgcttcattgtggaagaggattgatgcattgcccattagtactaatgataaggttgtcgttggaaattatttgggacgccaagagaatgagggggtgcggggatttcttgcttcttctgctgacacgactgtggagacttgggtgtaccagttcatgtgcgatcgagatggtgcgtaggaaaaatgaatctaactgtcaacatttggatatgttgttgaccttttgctcagttagaatagctgtactaatcagctatattaaaaccttgtgaaatatgtttatgtccaagcaaatagttacttttgggaaaacactatactagatgtgggagcactaattaggttatcttggatcatgtcaatatgtcaggttcaagctggtagcttcttttggtttctagaactgtcattatatagtgatgatgcaaaagtacgaactttctgcttcagtgtgctatgtaaatttctctagtgattgagtattgttgcccatctgtgatatatttcgaagctaaagttaattatgtggtttgtatatttatgtgaaagttgagtgttgccctccaatgatattttcatatacgcttctgcatgcacttctgtagtggctattgtctggtagtattttgatttatctcacttaaatgttgttgtctaatttgccaatt

SEQ ID NO: 66602 - DNA, 717 bp, Oryza sativa
gctagctactagttaatcattgcttaatcgatcatgtcgcgtggcagggaggcggcggcgtggtgttgccggcggcggaggcgatcgggcgttcgtcgtcgtcgtcggactactcgctggggaagctagtggacaacttcggggtggcgctggaggagacgttcccggcgcagccgcagcagccggcgacgacgatggcgatgacggccgtcgtcgacactacggcggtggcggcggcggcaggtggcttctgccggccgctcaagacgctggacctcttccccggcggcctcaaggaagagcagcatgacgtcgtctagccctaattagctactactactactgctcttaattactttattaattaacatgcatgatggatggatgggtcgatccattattatatattaattaaccatttctctgtctccacaaatttctgcttaattcagaattcagagttactcctagctagctataacttcttttttttccctttttttgagaaagacttcttgtttgctagtgttaatgcatgcttaatttctttctctctcgatctctaaatttactttttttttctctatagttaattatagctagcgttagattgtacgtgtactaggtgatacgaacgtgagcacgtacgtcaagctagcatgcagaggatcaaatcgaggtcggttgtgcacttgcattgactaattaagtagtact

SEQ ID NO: 66603 - DNA, 2624 bp, Oryza sativa
tcaaccaaactttcaattttaatatgaactaaacacagcctcaatggaatatactaaatgaaattgaaattttatagtcctcccagtctcccatgctactgacgcaagatgtcaaagcacctttctgtctcaaagtgctgagtctgttcctgacacttccaaatccacagctccatcgagctgtctgattcccatgtcgtcggaaggaacagttgccaatgatatcccaccgtccgattcgtgccacgtgtcgtacgcttcatgtatacttgtacatcagactgtatattcatgttagcatgtatgatgtatacgtatctctatgccattcatgccttgcttgaagtatggaccaaggtttgcaacagcagatcagcagagcagagagaaaagaactggtctgaaaaattttgcctttttgccatgaacaatgatgctgtctcatgacactgtattagtactccaagatgcataatcttttttgcctttttttagatcttggtgaaatggtgatcggtgagtgctgtactactactagtctctggaaggaagaacacatcatcaacctggcattgacaagagtgattatctatcagtgacactgaagagagaggcagaactggcaatggcgtgcgtggtgactataatcatatcccatgcatgtgtagtgttgcctgcgccttcttgatgatggccattcgttttcagttcatcatcgatctagtgcttcacccatgtcctttgctttgacacatctttgtgcacaatggtattgtttatctcaacaacttgggggattgcagaaggtcaattgattaaattaactgttgctacttggtatctgttctgaattctgactgaaaacaggtattgctcttctcttgtctctccgtttcagggagggtgcagcaatttatgaaattgagatgagagaaataacaacagagaatgttgtagcttactcttctgtttctgttttccaatatacttttacagggggagaagggatagatctcattactctgcttaaagatatgtaggcctgaatcattctgaataacagtgctacctgattatttcctacctgaactttcagaaagtccctctatgtaatgtagcacttgacccctgcatatcacacacaatagaatcatcaatgaaacacaagcacacatgtacacaatgcaatagtgttcatgtccaccctataaatatattgacaaatgacagctgatctaagcacctggaaatgctgtcttgcacaacagaaattacttcattgattgatatccccagtctgaataaactaaaccagatcaaaatgctgataaatctagctcttattcctgctgtttttgagattcattttacttttagtccatgcatgaaaaaaaggcatgctacagagacctgttactttcagacttcagtgctggaaattacttaaaaggtgtaccagacttttgtctgtcctgatagctgctcatgcttaatgtttctttcctgcaattgtgcagtactactgctagctattgctcgctggcctaccattaattagtatactgtcctatcccctaactaagccaaataagcaaaggtttataagtagtgttcattgttaatagtcagcgtggttctcggtatacgcaccggcttatggtaattagtacttaaccacaagtgtcaatcatgtcaatccctgctcaattgttccataagcctaccatattttacagatcaatattactctgcaccatcacacagtgttgttgattgcacttgcatgaactgcacaaagttattacacacacaacattacaagctaatgcaaattccacgcaactacgtttaattaactgcacatgttgaataacaatcctgtcattcaatggatcaaaactagcatgacaatgacagtgctctgcttctataacctctcttgtttacttaagctcaaagattcagacagttcaggcagtttgcagaaggccacaaaatttgaccatggttaatcaatcaatcagttaattacacaattactcacatgtatgcatgggccgaccaggatggcattggcattggcatgcatccatgagcagcaatgcagcatcattggaggggatgcagccaccatcatgacaacacataattctcacagcctaaatcgcaacacctttccttgcaaccaaagccaaccttctagctagctagctaatctaagctatagtgtgttgttgtgaagtggagtactagctagctaccactctatcttcttcttcttctacctcctcctttatatcttgcccctcacatgcacgcatgcctctccatctccattgccgtcctagctagctagctaagctagtacactagctaggccatggcatggtggtgatcaagaaagcgagagaggtggagcggcaatggcgggcgggtgcaaggcggcgatcgggtgcgtggacgcgcgtgtgccggtgagggcgagctacgtgagcctgtacaagtggccggagtcggacgcggagttcgtcaggtcggtggccatggcgcggcgccacggcggcgaggcggcggcggcagcgccaacgacggagagccccgtgtgctgcaccactactactaca

SEQ ID NO: 66604 - DNA, 1049 bp, Oryza sativa
agaaaatccgccatagaagaaatgagcaaataccacgatttcgtgtgtgtcgggggtcgggaatgcttcgccgaacgccggtcgccacccgataatctccttcgctgggagaacgccgtgcgccaccatctccttcagattatcttctgtcacatcggagggcgcccactgactctcgaagctttctctttcttccgccatgaatgtgaactggatggtttaatttggtctgagatatggctggagaggaatggggaatcggagcggtggacgcggggagaaatttcgcgaagtttttgagggtgggttggagcagattgatgaaccctagcttcgtcggcgtggttctatactgtagcacggagtggggaatggcgagagtctcggcggggaagacgaaacgacgtttggacttcggtgtttttagggtatcggaagtactaatgggcctgggcctatacagtacttcagcccaattatgttttcagcgtggcccattgtgatccctagggacttaggcgctttttgctttggcaatatgtgctcataatgatgtggcccgatgctattaaaatcctttttaacgcgattcaataattctttggaattattatgatgcatatgaaaaggtgcccgatagaaaggtgttataccatttttgtaagcttttttaggctgcaaaagctgtttgggttgatttgagatgactgatttattaatagccattcttttagcatgttatatgcttattttggttatggtaagggtcacagcctaggctattagagtcattaattaccatgattttctatcatgtttggtggatcattttatgagatttttactcagatttctatcgaacatgtctatttctggacctttgagtgtttatcactcggcccttcttgtattttttgtccttgataagttcaagttgagaaacagtcggctgggtatcttactaagtaccatgcgggcttcgctataaaaccactcggttcttgactatatgtttagtttttcaactaatcacatagtcgggggctaca

SEQ ID NO: 66605 - DNA, 701 bp, Oryza sativa
ggctgtgcgcgcaaggtacaggccggccgccagatgcacgcctcatccacgcgtcgcacatctgactcgggtacgcacggattgaggtttgcatccggtatgcaccaaatttttttccgatggttacgccggcggctggccgcactcgccggctggggctgacccgccccgccggtgtgggaaggcggctcgccggagtagaggagcggatgtcttctcttcgcatcgccatcgccatcgcttgatgtactctctcctcctcgtccgcgaggagcggcggcagcggcggaaggaggtggtggagtcggggacagggagggcggggacggccgcggcggtgaggaggaggagcggcgacggcggggcagctcagcgaggaggaggagcggcggcggcggctcggtgaggaggagcgacgcgcgatgggaacggacgggagaaaaaaaagaacgaagcgaaatgtttttttctaatggcaaaggtgggtaatttttttttccaaaagcaggtgaaagcgtagggtagagattattttgatttatactacaccaaaaactggcttggagcaaaagcagctgtggcttttgggtcctttggttggcttttggcttttgcaaaagcaaaagcaggttgaaaagcctaacgaaacacactctaaaatcatgtttatgaaagaaatgaaatgacagtgtttaatacta

SEQ ID NO: 66606 - DNA, 1844 bp, Oryza sativa
aatgactaccgattaattaataataattagtgattaattatcatgattaacagtaattaaggctgtcggtctcactggttgaggatgcgagaccgctgctcggtctcgctggatgggtatgcaagaccgctcagtctcacagctcgagactacaatatcaacgatatatttgtgcgaataatttgtacctgaatatttctaagagcaaaaaaataaatagtatattttcaaattttatgagggacctaagtaaattattcctgtggatgaaacgtccatacacagttcatattgtcggccaggtggggcccaggcccatgactgagctctccacgtcagcacaccacgcaagaacactggacaataaacgtgcgtctacttaccattaactatgtctaaatacgtgctgcattattaattgtgttatccaaattgtagacagtactaggactagtagtatattagtagtagtagaaatttaaaacacagtacgcatatatatgtacagtactatagatcactggctaacaataattaattccttctagacaacataagacaaattaattatctagtctcagctcatgccaaaataaccttatatctatattttaatgaaattaaacatttatttgtttttatagattcactctatccaaaaatcttaaaaatatttctttttttttcaaatgtccaaaagtcttaagtatattatttcatttttctcaaatgatataatatttttttatttgcttatggcctgacgaacaactcatgggtctctgccatccgcggtgccctcactgtcccggtcatctcccagtttctccttatttgggatgcgatgcttcacgtacagctctcgccgggggtcgaggatcgtctccttattagatgattcttttttctaaatgtttctaaaatcatgctctatcatattgttgtgttcttactgctattattttggccattttttcatgtgactttgttttatcaattaaaaatttgaatttcaaaacttcaaataatattctgaagcagtaattgatttcagctgaaaaagtcatcaacaaaaaagttgtataactcatcgagatctataacttttattttggtcatttcttcatacgacaaagtgatagtaatattttcacaaaatttacatagtttataaaactatataagagatatgttcattttgtgaacaatcttacaaatcactttatcggatgaagaaaactcttttcgtctaatatattgacgtgcaatccttttgcgcgttcgtgaaaaaaataatatttttattctgtagtacaaaattaaattgttcggtacaacctgagcagcagctgagggagtatagaaatactagtatatgcatcgtcgtacatgagtacttcatacgcgcgtgttagttggatttgtcccactgaaatactcccttcgtctctaaatatttgacgctgttaacttttttaaacatatttgactgctcatcttattgaaaaacttttatgaaatatgtaaaactatatatatacataaaaatatatttaacaatgaatcaaatgataggaaaataattaataattacttaaattttttaaataagacgaatggtcaaacatgttttaaaaaattaacaacgtcaaatatttagtgacggaggtatggtatacgcggatcctatacgcagataagcacagtagcaacagtaatgcaatatatatgtgcgctacagtacagggccattttgcactgcaactaatttactgtaccggtactgtttatctgtatttctattggccggatagctatatggattgcatatactctcctaaaga

SEQ ID NO: 66607 - DNA, 1438 bp, Oryza sativa
ttcctgcagcccccctggaagttcgtggtgaactgctagcacaaatcctcccaagagtggaccgacgcgggtggcaagttcattagccaaccccacgcctgacccttcagggccatggggaagaaattcgccatgaccctgtcgtcatccccggcggcctcgatcccggtcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacacggggggccggcccccgtgcccggaccgaagtggtgctccgaacgaggaagcgccctccgttgcgtgggcggcgcgacgagtgtcgcgccggcgctcgatgtcgaggcaggcatccggccccccacgcacatctccttgggtcggaggcgttgacgagggaatggcggacgaacggcgggtaacggccgccgcttgccgcgccctccgcctcgacgacatggagccggcggcggcagcgccagaggtctcggtggcggaggaccgcccgccggcgcctaggcgctgctgcgccgtcatgaccaagtcggccacatcatccagccaacgtcgggctggagtctctggatcggggacgacgggcgggtgacgcaggagcgcgcccgcagcctggagcgcgccctggggcgtgccgccatcgccgtagacgaggcggcgacgcgccccgtctcgccgtcctcccccgtcgcccgcgggcggcgaagtcgcggatcctccggcctccccgagcgcctccccccgcccaagatttcggcgagagggggacggtagggtgcgagcccgacggcgcgggttctgctccccgtcgtcaccgctagcgttcggagagagcctgtgcgccactgcccgctcggccattgggctgagcgggagaagcttggcgcacacgaaagaggacgagggcttcaaaagacacgcgcgccccctacctggcgcgccagatgacggagcgtggggctcctcaccgggagaccgcgcaggccctcctttgccggttcggccgggggcgctaagtgaggttcttcgccctcgatctgaggaacgtcagcgagaaaagaaatgcgcaagacacgggcgacgtagacaggttcgggccgctgagaagcgtaacaccctactcctgtgttctggtggatctgtgtgtgaaggaatccagagggcggagagcgagagagagttcaggctctaggaaccattcgccagagtcccaactccccctcctttcttttcccccctcttcttttcttaggcctgggcctcctttttatctggtcaggggtcaccacatgggcctctagctgcctaagaagggaaacatgctttttacaatcagggctgggctgcaggaa

SEQ ID NO: 66608 - DNA, 1357 bp, Oryza sativa
tcctgcagcccccaagcagaaattgaaaaggtcattgaaaagatagtcgagagaactagcttatcggaggccaaaggaagcagcacctggaaaaatgcaccctctagaacaagagtgccactccggctattcctctttccagccaagaaaaagaagccgtcactattggcatgtgtaaacccggctcttcagaaacagcatagtgacatggtattcttcactaaatgaattaggtactcctgtctatctgtctaatgcaaaagtgataaaatttcagctatgttcttatgagttggtggaatactggactaacccgctccctgttttgatgatcaggccttctggatgtaaccagattcgtcatcgagctaattaggtgcatagcaggtcagaaaacaagacttaaaaatgatcaaatgatgacatgttgtagccaaatgccatagacggctccgttcacattgttagtgtttactaaacacatgcctgtattccatggggattactataagatgtactttaaggtgtatttaagtacatttttgacaagaaagtatatttgtcagtagaacattgcagattgtgagatcattcagaagatatattcatagttaattctttcaacaaaacaaaatcgtttcaggatataattctttttcggcgggccaattgcattgggatttagcttgtgctgttgggtaagaataaaccgttctgtgttgggagtttataggcacgcacctgacacttgcgaggcaagcattccgtcgagcaggtatcgagcattgccgtcgacacgaatagcccacccatcccccaagccccggccgggatgatcaactcttcaccatccaacgcaggggatggaggaacgaagcagtagcacaagaggggaaacgggatcgccagcggccggcggccaccgcgcgccatgaatccctcgctccctctctctctctctccgcctctccccagtttgagccgcgaacgagcgtgacagatgggccctgcagaaacgggcctcaagtagatgggccgagaataaggcccacacggtccccacctcccctgccacgtggcggcgcgtcgtcgtttgcacgcagctcgacgtgacgggaatatatctatccatccataagagcaggtacaatagcaggctataataagccagctataaatatattttaaacatataaatgagaagagagaaggacaacgggctatagatttatagacagctgtagcacggactctaagacacagtgtgtgtatgatatgtgggaccatatatcaatagtgtggtatgtaactattgtatgaatgagctattagattggctatagatgaattaaagcta

SEQ ID NO: 66609 - DNA, 4716 bp, Oryza sativa
  unsure (1)..(4716): unsure at all n locations
catcgtagtttcggcttgtttcctggtgaaataatctggtagtatatgaatcaagttggcaacacttctctaaaaagaaaatcaagctggcaaccattctctcgtgtgttgagatatgattagttattagttgtcacgcgttgaatgccttgtttctgttcaagtatttgcacgttagtcatgttctagagtcagaattttgcaacgaggattggtatggtaggtacaactacttttatatttcccagtaggatatggctaagatcggagctgtctttcggtactatatagatgcctccacgctgttcattgcacaacatcaatggttggttttctgatgagagtggatcgtttcatgtattggaaatatcaaagatttatttcatgccatctcattccaatttcaagaattcagtttgctcataccatgatcatcctactttgtttcagatagcttagcttgattggggtgggtgacaatgggaggtggcaaggacaagcatgacgagagcgacaaggggctcttctctaacatgatgcacggcgttgccggcggccatgggtatcctcctcaccagggataccctcctcagggctacccgccgccgccgggagcgtacccgcctcctccgggggcttatccccctcctcctggggcttaccctccaccacctggggcataccctccacagcatgggtaccctcagcctggtggctaccctccacctggtggttacccccaacatggtggctaccctcctgcgggctaccccggatcatctgggcaccagggtatgtaattcttgttcacttatgtgctattaaggttctgttcttgtcatttttgtacaattcttgttgaacttttaagcaaattcagtattgagttgaattgtggtaattccctcctgttggaccatgcatgatatatgatgctgatcatgctgtatcacctatgccgtgatatgtgaagtttttatctttattgcaatcatttgcgctcatgatgccaactccattcttaccacttcgtcttagttgaatgcatgatgtttcttctccaattattagatgccattatgtgtgtttttaatctacatcgtactgcaattcctgctgaactcgagtaaacacctctgcattttgcacatattctgaattttaggattgatttggattactctagttcccttctgttgtaccataccacatacaactcttgatgcttcatctacactttagatgccatactatgcgtattttttgttaccatcattgaactgtttcagcaaaatggtgtgactctgttctcagcgttctatccttagagagtttctaatgtaatgttgcaggcggccatgggagtagcggtggaggacacatgggagcaatgctggctggaggcgccgctgcggctgctgcagcctatggggcacacaagatctcttctcatggccatggtggacacatgggctatggaggccatggaggctttggtggttacggccatggctacggcggtcaccacggcggcaagttcaagcatggcaagcacggccaccatggcaagttcaagcatggcaagcatgggcacggcatgttcggtggtggcaagttcaagaagtggaagtaatgcgcatgatctgatcatgctggaactctgtttaggctttaactgaagtgcttgcgcttggctggttaaaagcctaaaaaaagcctctcgaatgtatctaagcaggatggagctntgctcagttgctgctcccatccttcctctatgatttggtactctagtatgtggctcaatgacaatatggcttgctaataattaattaaataccttctgacgcttatgcacatctgtgttctaatgttctatagcctgatagatatgatgtgttgaaaccttctttgctgcttttctttcttctgtgaaagtttatgttaccatttattggtaactgctgtctcctgggacataattgttggtttctgattgtgaatttataaatttttaaaattttggatgtgcaatgcaacattagactggggagatccagatttttttcagagatctgagctcttctcgacttctcctagcctcctgatatagttataaaagtggtcagaactaataagatagataagttgtcatatatgttgacaaattgtcattgtatccctataatttggatggaggtatattcttctttgcggagttgattgataagtaccctttatgtaattgtggttatgaattaaagtttgttttagtctggtgttgactagtactctctctgtttcatattataagattttcgtattgtccacattcatatagatgttaatgaatcttaaacacatatgctagaaagtcttgtaatataaaatggggggagtagtttttaatttcttgtgtcaattaaaactatacatttacataagcataaaatcaagaaaaggttttgttttaaaaaaaagattagccatgtcattctaaagggacaatgttacaacaataattttgatcaaagattaagctattttgactgcacaaattagaaaggaacattctttttgtgattaaacgtactactccgccgtttctgctcaaaacttaccgacaacgacacacagatttccggcgcatctaattcccccactatgataagataagcaaaagcaagggctatgattttacacggcagagttcaagattctcacaattaaataaggaacataaaaaagcatgctttatttatcgccaaaataaaccttactaatttctttccataagccaaacaaaccaaataggacctcaccattatgacctttaccaaaatctaataaagttccaaaaccaaatagcactttcacactaataaccttatgatctttctgctttacaacatattggtaagatttattttagcaacaaagtaaacatgccataaatgaacaattagaacaaccagtgcaagtctccttctccaataaacatctccttccatacataaacaccaccaagtcaaaaatcagcacgtcactacggctatatatatagtacacgtgaagaacaatcaggtcgcaatttagcttttactattctaatcagcaactccaaccgatccactaattacacgtcagcttgcttagccgcgtcgcgctgctctgcttgatcatcatcaccttctccgatcgatcctcctcgacgccgcccacaaatataaatcccacacgcgtcctcctcctcctaataaactcctccaattcctcgacgaatcagttttctcctctgattttccaccacaagatctctagtttctttgatttcttgatcagacgacgatgggagggagcaaggatgagcagcaagacagggggctcttctccaacctgatgcacggcgtcgccggcggcggcggcggccatggctatccgtaccctcctcagcaggggtactacccgccgccgcccaccgcgtatcctcctcctcctccggcggggtacggcggcggctatggctaccctcctgcaggttaccccggctcgtccgcgccattccaacacggtacgcgtctcgttcttgttcctgttcgattctgttgtgaacttgtgatgattatatatagtcgcttaattggaattgtgattttgttcctgttcggctcgattcgtcgaattgatcggtagtagtattaggttggatcaatttgctgtttctatttcatagattttgcattgataggatctatccccaatttagacccttttttgatcttattccctgttacatcggtcacatcggatgtttaacactaattaaaaatattaaacataaactaataataaaaaacatttcataacccttaaccaatttacgagacgaatctatttagtctaattaatctatgattagcctatgtgatactccagtaaacatgtgctaattgtagattaattaggcttaaaaatttatcttgcaaattagctctcaattatgcttagttttattgttagtctatgttaatatttctaattaatatttaaacatccgatgtgacaggtactaaaatttagtctcttatccaaacaccaccttagctgccataatttgcaaacctttgtaacctttctttggcctgatttagttcctaactttttcttcaaacttttaactttttcatcatatcattccaatttcaatcaaactttcaattttagcgtgaaaaacacacggtttgaatcctctgtttttggtgattcagacaaagaacggtggaattctgttcgtacaattttaatcgttttgaggactccctgattggttttgcaggtaaccatggcggaggaaacatggggatgctagctgcaggtgcagccgctgccgcggcggcgtacggcgcgcacaagctttcccacggtcatggccatggaggctacggctacggtggccaccacggcggcctcttcggcggtcaccatggccaccacggcggcttgtttggaggccatcacggacaccacggcggcggcctcttcggcggccaccacggccaccatggcggcttgtttggcggtcaccacggcttcggtggccaccacggacaccatggccaccattgatggtgatcaccatatcgtgttgcacggcgtgttcaatcagtgcgagtgataagatgatcatgagttggtttgattatactactataaact

SEQ ID NO: 66610 - DNA, 9752 bp, Oryza sativa
ttcctgcagcccttattatcaatggccggtgaaaattgaaatagttgaaatcataccggatttacttttacaaaatctaaagaagtgctacaatattatcgcgtttgtgggaggatagcgaaaatctgtcaaatctaaggtagattaggtgagatgactagcaaaactttcttttgtgggactatcggttctttttatcagcttattttactctattattaaaataaatgatttatttcacgtttcaaataaaattctagcaaagcaccgtgcactgtacagcgccacgcctacgcccaagcagcatacaacagttgtctattatatatgaaatgaattatttacttactccacgcttctataccgtgcactgtacagcgctgcacctgcgcccaggcagtatacaacggttgcgtcggtgatgaaacagaacaaaatttaccctgatcctatgcatactaattatctaattgttaactgatatattaattaaaattaaaatgatataaattagttataattagataatttacatgggttcttgtgactttgagaaaaacaacgtaggaaataggaagctacatagtgctgcgagcatatatgcactaaggctataatattataaatgttatgcaacgctatatagtgtagccgagcatgctctaaggctataatattacacacccgtaatcaaataataaatatgtagcaaccgatattaaatgtatagtactattacacatttatattaaaaaaagatatttggagggaggatgttcctccaaacatttttttaagaagtaattgtgagcgtgttagagattaaatacgggatcttggggttgaaaccgtgcacccttgccactacactattaagtgcatctcattattgcccacttatgaaaatcaaaaacagtagaatggattcgattcattgtccatgaatttgatatcttccaaatggaacttattttgataatcaaatagagtggtttcgaccatctagcactctcccctgtaactatgtttatgttttgtcgtttatttataaaaataagggacatattctcaagactccatattggacaatgtccacgaccaagaatgagacatcagtaactataatttagactataccgaaaattggaataattaactttttaccgcaacaagtgtgagtggaaaagaatttttccactttacgagatgatgttacgagattaactaaatgtattattggcactatatagttaggttagaacccattcactttggattcgagtatgagactcgatacggatattcttgtttaccactaaggccctgttagtttctcctactaggagaggataaaattttggattagtgtggcatgcttttcaaactgctaaacgatgtgtttcgtgcgaaaaatttctatatgaaagttgttctaaaatatcagattaatctatttttgaagtttctaataattaaaactttaattaatcacatgttattaccacctcgttttacgtggaacacttaatctttatcttcatcttcatcttcaagagattcaaacaccaccgtattcttttagtgactaaaaaatatacccgtgcgttgcaacaggtaaatgatattttaattttattgttgttatatggtttagctagagtaaattcacagtaggattcgcttggatatttttttagaaaatcataagttgtaattaggaatcattatttcattccaaattagcatgcgagtttttttaaagagattttttatataacttcttttgtatttctaaaagcaagttagcttaaaatccaacttaaacaaggatttgtatttctaaaaacgaataaatttaaaaaccgactcaaacacagatgacgtaccaaaataccggcaaaaaaatcttcaatttttataatagtagaagtaggtggcatgcctatcaatagtaagttaattatgatgattttatcaagagtaaaatgcagtagcgtgtcggcgcgaccatcctcctcccctagtcgccgccgtccccctccctcccatcagtgccgccgtcctcctccccaagtcaccgccgtcccctccctcctgtcagtgccgctgtcctccctcccgttgcgcgcttgcctctggcacggctgctcggcgaaaccgcggcagtggcggcgctcatggcgtgcggtggttcagcatcgccaccgctgtcctccccccatcaacgccgccccgcgctctcgccgccctccttccaccgtgccggttggccggcgcctcgccaagcaccaccgcgacggcccctcccctcgtgccgcctcttaccaccgagaaaaaagaaggaagaaagagaaaaaagaaggaagaagggagaaaaaaaatttcatgtcatcgtccacgtgacatgctacttaggcaagaccacggtcaaacgcggctttggaccgggatgatacatacaataaactaagtttagagacctcgatgtgcgctttacaagttcgtgaatctaagtgaaacctcctgataagtttaagaatcgctggtgcattttactcttttatcaatctcgttttgtatttgaaggtagggggtaaaatatgtctacttacattctagaaatacttacgtgtaataaagtgtgtctttaaaagaaaaaaaaaggttaaatgcattcctcccctaccacatggacgacgcggtccggtcgcctatggcccacatggcagtgacgtggagcacaaatgacacgcttcatcccgcccaccattccgggtaataatcaggttgctaatcctccatccatcgcgtcgccttgcttagccgcgtcgccatctccctccatcaccttctccgatcgatcctccccgacgccctccacgcgccaccgccatcgcgttcgctatatataccccacacacgcgaacacatcttcttcatcttcctcagctcgatcacttcgatttctcctctaacttcccgcgacaaagctctagtttctttctcgatcagaccacgtacgacaatggaaaaggacaaggggctcgtctccaacctcatgcacggcgtcgccggcggcggccatgcctatccgtaccctcctcagcagggctactaccctccgccgcccaccgcatatcctcctccggctggctatgctgcgccataccagggtatgtactcgatcgtcaactgattctagctttctgttcgattctgtgctgcagatcttgttctgttcttacgattcatctttcaaaagagattctgttcgatcgtcgtgacgaattcatcgccaagatttcatggtggttgttgtttttttttttcaggttatggaggtagccatggtggaggagggcacatggctccgatgcttggagcgggtgcagccgtcgccgccgcggcgtacggtgcacacaagctttcttcccatggcggccatggaggctacggttacggttacggcggtcaccatggcggtggcggcttctttggcggcgatcaccatggccacggcggccatcacggcgaatactatggaggccatcacggacacgacgaccaccatggcggcttctatggcggtcatcacggacacgacggccaccacggcggcttctatggcggtcaccacggcggtcaccatggtggccaccattaatactgctctcagcttctcaccatgcctgctcaataagtgagagtgatagatgttggcttggcgacatatatatatatagtttgatcatgctaaactcaaatatgtggataggtcttaatttctagaggtgaagtgtggtttggagaagcttttctccatactttgatttcatttactctgcttgtgtgtctgagtgatgacaatatatatatgtggtatgctaattactaattaagtgcttatgagtgtttataccctgtgtttactgtactgatagtgatactcaaggcagtcctgccgttggcatgtctggaagcttaccagcggagaggcatcggtcaggtgtggcggaggccatgtgccgcctggcctctggtgttcggatggtggttttggattgggagatataccacggcggtagggttgtgagggttccaagcgaaagcttagcccaatgtttcattgggccaacagtggctactgtttcgggcgtggtaaccctcctaagggcactgttgaggtacccccttcttcctcggcaagaaactctgggtgaaagccttgtccagttctttggatggacgacgacggtgtctttcagtgtcgtgatcttcttgggggtgtcgttttttagagtcttcgctccgtggtgatgttgtaggcccagtggcgaccggtttcgtatagcgacggctggttcggtgctcgctttccctttctgtagcttgtgtttgggtggttggcacatggttttgggcgtatgctctagtgcacatctttccttgacacttcgaaaatcagctattgatgaaaaactttcttgtaacattttcttcctatctaaattacattggatgacctccttcggtcatcccgacaaaaaaccctatcagagaaaatttgtttttatctgggttccaccagctcatgctcttccttatgccggtatttcctaattttgtatttacaatagtttctggtttatgtaggacaacgtccatgaacatgaatgagattgaagcatatagcatttctgctaaattacaatatgaaagataagaaaatgtgccagcaattataacttgggagtttcataatttggacatgccccctgaaagtgatattctacaacatatttgagatgagcaaccaaaaagaaatcctggtgagagaggtgatcataagaggttatgggtgtttaacattcaggagatcttttggcccaactgagacagaggaatggactgagataaaattgtaatagagaacactgagctgagtagaaaccaagataagttggtatggggattaacagcaaataagagatatactagctctatgtatagtacaatgacctttagaggggtagtggataataacatgcaaaaggtctggaagtccaccttttttgtttagagagggtttttctttacccggcctctaaatctagagaagggtaaattaaatttttttacctggcctcgcaaataccccaatctaatcaaatatatgcagccatttaaattgaaaacttagccccgcaaataactcaatctaaaaattcgctcatacgaagatttgaatccaagaccttgaaatgctactcaggtcactacaaccactaagctataagcctttttgcacatggagatcgaattcagtcaactgagcagctaaaaaagaaaggttgggaggggtgatgtttactgtctcctatgtggagaaactaaaactactaaccatatagtgtttagatgtcctatggcaagttttgtttggtgttggtctagagatgttttgggttgggcaaatactcctagaaatttagatgatttttttttctcctgtgcaatatcagaactaatcccatcaaggaaagaatcaagcttacagtgctggctgccgtttgctggtgattgtggcttactagagataacatggtctttatgaatgcgttggttttatgttatactctgcctttccaaatcatttctatgttgctgcagtggaagaagctgcttcgctctgatgaggagagcacgctgatggtgctgactcaaaggatgaaagagatggtggcaagactaaaaccgacgagaacaggagttggttgattccctgcttagtctgttgttatttttcaatagtttgatcttcagtgttaagttgtcgattaggcaggacttcactatagttatcttttgtgttggtattggaagcacgcgtataattttttcttaagaattttttgtgatatttgctaattgtacggaaagctcgtgtacatataatacgtttccatcttatttgatacatgttgctgctccatctcgaagaccataacaaactcctacaactgaaacctgtgtgatggagatcagatcagctttttgggatcagctgaaagtctgtccaagatatgctaatcccaacccaaatcaaatcagagacaatttattatggagaaaattaacctcaagacatacactctagtttctcttttatcctactaactactccactaattgatttactacttagtactaagtactccctccgtcctaaaatatagtaatttttagctataaatctgtccagatttataattaaaaattgctatattttagaacggatggagtagtaattaatcaaaatgctccactaatttgtatttttgaggataacttcggtacctgttgctataccttgaagaccataaaagaagtcctacaactgaaaccatatgtgatggagatctgctaatcccagcccaaattagagacagaatcaagtcatcaacacatgatttattatggaagaagaaattaacctcaagacatacacactcttactttctctctcgtcctactaagtaagtactcaacaactaattactactactactaatcactaagcagtaatccataatgaatcaaaatgcaaggtgttgtggaagagggaagattagtcggcggcgaagacggcgtcgttgagctggaaggcgccggtgaagaaggccggccagcagaggtaggtggagaggatgctgctgacggtggaagcgcccatgagcatgttcatcaccacgatctgcagctggatggcctccagcggcgacgcgccgcccatgatgaggccggtcatggcgcccggcagcgcgatcagccccaccgtcttggcgttgtcgatcaccggcgacagcgcgatcaccagcgacctcctcacctgccgcgccgtcgcctgccgcggcgtcgcgcccagcgccagcgccgtctccaccacccctcgctgcatccccacgtcctccctcagcttcttcatcgtcaccccggtcaccgtcatcgcgttcccgaccatcatcccggccaccgggatgatgtaccgcggcgtgaacgggaacacccggagcgccacgaggagggccatggtgacggaggtgccggcgaggatggagacggcggcgatgtgcttcccccgcgggacgtggcgggcgcgctgccccgcggtgtagccggcgacggtgaccatgaagaggtaggcgaggaggatccaggcggcgctcttctgggtgaagatgaactggaggacgaagccgatgacggagagctggaggaacgcccgcgccatggcgtacagcatctcgccctcgagccccagccgctgcgtgaagctcagcgccaccgccatcgccaccaccgccgtcgccgccaccggcttcagcatgcccaccaagaactcccgccagaaccccggcgcgcccgggtccacctgattcaccaccaccagcagacgctgcagcagcgccgccatgctcgccatcatgcgttccagagcgaggcgaggcgaccgagcgcgttgatgaagacgaggaggagttggtggtggtgagcgagcggaagcgggggaggcggcgagcgagggaggcgactacgccttcttcttcggctttcgcggtgtttctctctgcttccttggcggcgtcggcgtggcgtttgggtgctacgtggggaaggcacgctggatggtggggcccacgctgcagtggcactacagtatttgtgttttttttaatcttgtcagttgatgaagaactacagtgcccgcctctcttttccatcttttattaaaaaaaattaatatcgtcagttgatgaagagttgaaggatgctgtctgctcatgtcctgaatttcctcgtccctatgtgagaaaaaaaaatgaaaatgatcttgtactacccttcaacctcaattcctcaaaataaattcatttttcacaagtctcacacatattgatatagaacccaaaaaactataataccctcctttatcaaattccaatgtaattattctcattttaaaaacacatttatctttgatttttcataaactcagatacaataattacttttataacttattttaagttaaccaagagaaacaaaaataaacttattctacaaagtatttgcacgagagaaaaattcagcagatgctggaatcctttgctttgctcggtgctgactgatgtgtaatgcagtaatggatcgcacgatgcaaaggttgatgggtctcttatgctgaagataaaaaggcagaaagaagaaagatgaaagagagataggagctgcaggatttcagacacagattgtgagagaaacaacaaatccatggattccatactccaccttctctcctcctttttctgccctttatttgttgacaattgctcacccattgatgagaagaaacttgtcctatgaaatctctcatcacacactacttatcaaggggaaaaaaaagcttgtaattggtcattaccattggagcctgcacaaccaatattttttcaattattctcagctttggacatccaacaaaacaaaccaaagccagtgacactgacagtgactgcggccggtttcagaggtccagcctcagatgggaactggaaattgcacacgcaaatagtaatactatgataaaaagggccagaagtcaaacaaagctaaaaaatgcatccgtcaaaatcttggtataagcataaattaatgataatgattaatgaagccgaggaaaagaaaatgactccttaaacagtcctgaatcatggcacttgtactagtagtaagatttttaaacatgcacatccatacttgtagatcatgtccaactgcttgaataatccttacccaagtatatgttcaacgaacctgctgtacacgactggtgatcttgaacgagcaaggataatagagtagaaagattttccattacttagcgtaaacccaaactaaaaacgattagacggctgtactgaacatgatggagtccttcagtttttgctaccgccaggcttcttgtaagactcttcaacttcctttgctttccccatccaatccctcataagtttcttcatgtttgggacgtcatagttctgcgcaatgtagataccacacccgatgccgacacacactgagaaagtgttttgcaggaaacccattggagctaatctgcagaaaaataaagagaacattgtgaacatatgctcagaaaccatgaaccagctagctggtgggtctatccaacctgtagctgcacttgaaggttgtatgcacatgccaatagtaaattgataagtaaaatatattgcacatgcagggatgtttgttttggggaatcacatggggagaactgaattatattagtccaagaataaattagcatgacaagtgtaaacaaccaaccctttcttattttgcttgtaattgacgatttgcaacaactagcaatttaatagttgaacagcagcaaggatctcagaattacacatgaaaacctgaaaagctcatagccacatagaaacaacaatacagctcaagcattgacaaggctacacgactgctttctctgattatcccgttgagttgcaaagccaataacaagtcttgactcttgactatagccgtatacaagaaatgacatatataaacagaagaacttagcactataattactggcttactgatccacaggcatggaaatccagatagaataaacaaaaaccatgcaaaaggtcacctgatcccaa

SEQ ID NO: 66611 - DNA, 729 bp, Oryza sativa
cctcatctcatcttcttacatctcccactgtctctctctttcatgtcttcctcctatctcatcttccagtggcttgtcaatagggatgaaaacggagcggatagtttccgtccgctctggacaaaaacggatacggatacctttcggatcggataattctcggatatttcggatacggatacgaatatggatattttctcccggatacgaatacgaatatggtatcaaggtttccgtcggatacggataataattcggatatccggtgaacagtgctattcggatatccgcaggacccatgagacataccccatttctttctaactctataaccttcaatatacctttatagattttaatagtagtttatctcttaatactagtccatactattaatattatttaaattttaaaaaatatttataaattatacctcattttatataaaataagctaattatatatgttgatatttatttctattagaagttgagttggttttcgtgttccgagaaaaatttgtttccgtattcgtgtccgatcatattcgattcttattcgtatttgagataatccgtatttgtttccatattcgttttcgtatccggtaaaaaatataaaaacgaatatggtatgagcattatccgtccgtatccgctccgttttcatccctacttgtcagcgagcaagttccttcccacccgcgtcgcggtcagcgacccccccccc

SEQ ID NO: 66612 - DNA, 4975 bp, Oryza sativa
cccagagaaaatatagggagggaagaggtgggaaagaagacgatacaaggtggaagttgctaacatatgggtcccacatattgtttcaacaagtcaaccgcgatcaaactgccatgttggtagaaaccacttttcaaaaaaccatcgaaggggagttgatttgcattggtttttgaagacgaggagacattataccggttttgcggttgaggggcacgattcaacatgagcgtgagagggagataaaatagacgtattccaaaattaaaagtctaaaagataagcagtattttctgggccgactaaagtatgggccgtggtccgatggcactcgccgttacatatcatttgcattactgacaagtgggggttagcgttaggtgggacccaacacgtcagcatcagaagagagttaataattcggtcacgcccgtacgaataccactatgtactcctaattaagaaaaacaaagtactctatagtcacaaaaaggttaatgataatttgttagttggagtgggcttgtcttgtccgtgtttagtcttcctcctccagtctcttccttttggttgggagaccgccggtgggccccactcagatcgatcggccgtcggattcacgcaacacaacgcatgcatccatgcaaagaagcaaaggtcaattagagcagatacagtagcgggctataagccagctataaacatatttttaaataataaaagaagaaagagaaaaacagcgggctacaaatctgtagccagttgcagcacagactttaagatgtaacgagtgtatgacatatatgcccgggtattaatagtatagtaagcaactattgtatgaattggctattacactggctctagataatttgtagctaatagttggctatagtattaaacttgctcttactcgactatagtccactccacgtagtatgcacaatcaagccgagtaattgatatccatgctaattttatactagcccaatttaattaattaatgaagcaacgtcgccgtcgacatggagtatataaataaattttgggttatttatatagtacaagaagtacactatagagcactattttctaggcaagcaaagctccatcaccaccgacgccgtaaatatatacttcttggagtatatgtatggagtatgtaccgattgagataaggtgtagttatacttgcaattgcaagataccactgcacataattttgaccgtccgtttgtaactttgtatgattaatggttcagatcaaatgctacagtaatcatgcgaataatactccgtgctgtactgtatgcgtcgtacagtatataatctagacttttcgatttgcatccaacaacatgcacttttactgcttaagttggagtcataatagtgactgcagctgatccgaatccagtagctacatcctactagatttttgttttgtttagattactgggaaaaaacatatgatctatttaatcgtataggtaaattaaatataaaaataaacttaacaaatagcttaaaacaattgatctaaataatataacagaaaaatatatttttagtatgtattttttaaaacacatagaaaataatctacttttaataacccgataaataagctaagtcattccaccccataactcattttgttataaatacctacccctattcagttttgtcgcaaaaaccacttcaatgcgcttgtgtttaacccgaataacatgtttttcataaactgtgagcgtcaatatgatctttattaaattaaatatttcaaagatatcttaacatttttcttggagatcccacaaacaaaattgttgattagagcttaaacattgtcgaactgagttttcgctatatgcacacaaaaaatcaatgaaacataaagaatagtttaagtctaatacaagtatttggataagattgactcgactagcttagcctatgatggttttacatgggtggtaatagactgcttcggttaagcatgtgtgtattgggatggtttttgtaataagatggaatagaaaggtggcaataaaataacttatgaagtgaagtgttaaactttaaataacttatagggcaatttttgcataagctaaaaagaataacatggcgtagctaatcgcagtcatggagtcactttctcatctgcatgaaaaccatcgtaagccgtaggaacatgggcttctttggttaggtttaggtttattggcttaaacttttaagtcaacttattggcttatatgatttataagttgatggatttactgtcctaagtttaatgatggagtcatatatctatcgtacataagtaaaaaccttctccatctaacttttagcttaataatgtttggtttatggcttaaaaaaaccaaacgaaaaaactaggttagacttttcgacttataagctaacttataaatcttgaccaagagggcctatattcaacacatattagtatatgatatatacgggttctggttagcgaataagccaatgtatcagtgtcaaggaggttggttaatcactctatccatctgcctgtaaatttctaacaccaatgagttcatatctctttattttataaaactaaaatggtataaagctatagcttctggcttattcttaattttcagtatgtaatcaatattcaatcgatttttttaaaaaaaaggtccagctacttcatatatatgtatgtaaattaattactgtgtacagtactaggtacattctctagctacatgcatgcaaatgtgggccatacacaataatataatcgcacatgtcaccactgatcagtgttagttacgctatggtgtttatactaccctggcatacagtactttatatgcccatctgtccccataattatttctacctcattatctttgctttgaaaccatgcttaattaattcttgatcatatccggcccaattaattaattaattaattaagtaatttatgccttgcataatgcatcacatgacattatggtagtggtacgtgtatatagagctggcgtcatcatgcaattaaataattaattaagcaggtactagtacatacagttatatactactgatggtgaatgctattactcgcgtgtgtgcatagtttacgtacattctgtttcgttgtcaaattaaagaggaattttctttgctaccaagcacacaactcgtacaagtactccacttgtactgtcgattgatcttccttacaagttttgtttggttggcagtcacagcttgcaaagcgtgatgcgtcgcaattgtgtgatcattaaccttaaattatgttcaaaattaagttgatattgctttgcttttgaaacttatttattttataaagccttggtgatactacatttatatttttcctctacacgaaagataactgcacacatatcgttctacacgcacgacttacatgcacccccggacacacgtttaaagatacggatatcaaccatccatgatttcactgaatttctatcaaaagcgcactcgtgtgtacatagtattcgacgacatcaaaatttttatctttgatagattaagtcatgcacccacgactgcactataataccagcggtgctttctctcatttttttcaaatccaccatgatgaaaaccttacatttctaactctattttttatggtatttaccggattgtgagagcgtacataatggctttctttagcttgtgtcaattgtattataatatagatttattctacctccgtcccaagaaaattgcatttctagctctaaggctttgtcccataaaaattgtatttctagccatgtgggtcctaacaaattgattcatctagataagtttccttaagttctctcagcttgtaattaaagtatgctaattatatgggttaattctctcaaacttccttttaatcatttatatatatggaatgtgtgtatgcaatgggttcattaaataaggtcattgtggtcatttttcaatcctattgttttgtcctaaattagctagaaatgtaatttttatgggatggagggagtaaattctctactatacacaaaccccagtatttatatagatatggttgatcaaccttacctcacttagccaaatgcctccaaagatcagtccaaatggtttcccaccatcttaattaaagaaaaagaagaagagttgagagtccaaacagtgccactactcactagtactactactgcttgtttctacttaccaccacagttccataataatcaatttaatcatgcatacaatggtttggtgggcaatgctaattgctatggcatcgggatgcaatcaccatcagtaggtgaagggagttgatccatgattagcactcaccagctagcttagctaatcgctcgccgctgccgctgccgctgctggtggtggccgtgacggtggcgctggtggtggtggtagcatcatccatcatctttgtctttggcatgtgcctccttttgcctttggctccctcctctccttccttccttcccttgtttgccttttgcctttgcagcctttttcgcaagggagcccacgcctccctctcgcttcttctcctcctcctccttctttgaagagcgaagagtgaagtgtgaagagttctctcttcttcttcttcctcagccatgtccacaatgctgccctccaaatccaggtgtgttcttggtagttctctctttgtgtgtgtatggattggttgatgttggtttgtttggttgggggatttgttttttgttgccttgtgttcttggcagatctaaaccggtcactgcgttcactcagatttgtttttattttttttccctcgcgctgttcgttccaattgagtactggattgtgctcgctctcggaatctggaaaatgtggcatcttgaacgaattggataggtttcagttggaacggcttcttgatccgctcgattcctct

SEQ ID NO: 66613 - DNA, 1752 bp, Oryza sativa
attggagctttccgtgaatcgccattaatggcggtgacattgacagatctgggccgaacgagtcccccatcagcagggggcggccgagcacgccgtcgtccaaccaccggccatccacgccgtcctccatccaccgcccctccactcccggcgccaccaggaggagcatcggcggcacgccgtccacgccgcgctcccgcaacaacggcgtcggcggcggcggcggcggcccgttcaagtccgagcccaactcgccgccgtcggccaccgcccgcccccgcctctccttcgaccgctcgccgagatccgtcgactccaagcccgtcgtcgagcgccgggttcccaagatcggcactccacctgatgtaagtgcattcatatatgcaagcattgttgtgtgagttgttgatgctaattgtgtgaattttttgttgtgtgagttgttgatgctaattgagtgaaatttttgttgtgtgagttgttgatggtgattgtgtgaaatttttgttgtgtgagttgttgatggtgattgtgtgaaatttggtggaatgcagaagcagccgaggaaggaggcggagctgcaggcgcggctcgagtccgcgcaggaggatctcaagaaggccaaggatcagctggccttcgccgttggcgagagggatcgccttgtcggggagctgaatgaggcgaagagggttgctgatgagacgcatgagaagctccaggatgcgctcatggcgaagaggtgggccgaggaggcaacggagatcgagaagttccgggcggatgagctcgagcaggcgggcatcgatgaggcgcagaagcgggaggaggagtggcagagggagatcgagtgcgtgcgtggccagcacgccgccgatttggagacgttggtcactacgacggaggagctggagagattcaggcgtgagcttgcgatggcgaatgaggccaagaaagctgcacttggccacgcagacgatgccatgaagatcgctgaggtcaatgcggagaaggtggagatcctctccagtgaagttgtccgcttgaaaggactgcttgattcgactgcagagagcgaggagagtaaaaaccgtgaaaccgaggagcttgttaagaatctggagtccgaggtttcagttctgaagggcaaactagaggaagccagaattattgaggagaggttagccgagacggaaaaactgattgaggagcttaaatcagaggttgctgatgcgaagaaggccgaatcagaagcccgtcagctattcgaagaatggaagcacaaggcaggattgcttgaaatggaattggaggcagttactctctcagataagttcaaaggtgaatcgcttgcctccacaacagaagaattgggtaagatccagtctgcattacaagatagagaatctgaaattgaagtgctcaaaggaaagacaactgccttggaaattgaggtagcaaggcttttagcagatgtcaacgaatccaacgagcaatttgatgcatctcagcaagaggtgtttgggctacagacgactatagatgttctgagaaacaagcttgaggctgctgaagaagcagcttcagaggccttaaacaatgagaaggccgcgaatgtaaagattgaaggcctgaccgaggagaatgtgaagctaataagcgagttgaacgagactagggatagagaagagaaggagaaaagagcagtggaagatcttactgctgcattgagtgaggaatctgacaaagcaa

SEQ ID NO: 66614 - DNA, 4636 bp, Oryza sativa
tgttagattaccagtaattaattgcttccacgatgcttattatggaaggattagtggaaacaaagatgcaaacgtatatacggtcctatcaagaacgtcgtttggttgagtagaacaaaagcaaccagcaaaatgtccctatcgttggtgcctgcctgaatgcaactcccaaccaatattcaccaaactcaacgggtaatgatgttgagacaggaaatactcaccaaactgaaattttacgttgtgcatgtttgaagcgtttttttcatggataattgagacggatttttttacttgattagcatggtaaattgatatttttcagaaataaactttacaaatacttcagaataattggctaaacaatgcagtagaagaattttcttttctaagaaattgtatctttagaagcatgggcaaataatccatgaaaaaattagagagaaaaaaaaagctgagcagaacaagacctagtatatcggagtaatagaaactaagtacacaggaaaaaaaaacaatatttgattatcttaaaaattgagaaaaattaaaacatggtgttaatttcaatcttgcggcaagtggtgacttggggtatttttgatatgacagaaccagaagaagatacaagcaagcaaccttgcatgtccatctatcaaagtcttttgaataaatgggttacttatctatctctatctatctccgtactgttctttcttgcgtccagactcttgacgacgtgtgacaccatggtcttcttgttagacttgtgcaagaaacaaatttttagagatgcagacaaagatggaacccggcaatttttccaaagtctgcacctggggccttaatttctctgtctatatactacctagctacctggccttgctctgtctaaaaacctagccatcaaccaatcttttatgacatacctctctctcctctcgcgtcgtcctccccgggcgactcggaaggcgacgacgccgccgcctcttcgtcttcagcgcctcctcccccgcctcgccgccgcctgggcgggcactggcaaagccgtgcgcccgcaaggacggagcggcggggcctctctccccttgcacccggcggctggggacgccgctcgtcggcgtcggtggtgcccagatccgccatggctggccggatctgggggagcggcagtcggcggcggggaatgaaggtggcggcggtggacgacgtggagcgggaggtggcggctggggacgccgctcgacggtggcgatgcccagatccgtgcggtgctagctggatctgggggagcggcagccggcggcggggaaggaaggtggcggcggtggacgacgcggcggcgctggagttggcggtggcggctggtggcgactgtggctggctggcgttcgcgtcggtgactgcggttgtcgacggtggcggctgactgctggcgaggaggcggctggtggcgaggcggtggctgctatggtgactgctgaagcggtgacggtggcggcggctactgatgcaccggctggcgacgaggcggcgactggcgagctgtggcggcggccggatggctactgtggtggcagctggcgaggcagtgccgcggcagtggcggccgtgtctggcagcggcgactgccgacggtggcggatgcggcggcggggaaggcgcggagaagtaggcatggcggcggggaaagatgcggcgacgggggtacgaacgcggtgtcgacgaccggaaacgggcgttgatgaccgcgaaagggcggcggtggcggtggaaggaggcatggcggcctcagacggctagtcgagggtgtggcagacggctgcatttggccggcgcggcaatggttggaggagggtcggagaccggcttggcgcagagaggcgcagccgatggtagcggaggccggctcggcgcgagaggcgcgggcggcggagatggaggccagcttggcgcgagaggcgcggccggtggagggaggccggattgacgcgaggcgcgtccggtggaggaggccggcttagcgtgagaggcgcggccggcagtggaggaggcgaccttggtgcgaggaggagctgccggtggatgtggcgcggtcttcggcgcatgaaggctggccggcgggggcgccggtgcagtggtcccacatgtcggcagaggttgagtggtggtggagcatctgtgcatgagccgtggattcgcacgtattgagcagcaggtgaaaacctagcccggccttggccgggccggcaacgagggttaattccccctcctgagggcgttgtcgtgctgtctcatccctcacgggtggttgctgggcgaaagcccagtcttggctcctttaagccccgacggacggcggcggcggttttccgtcgtttctcttcttgaagacgtcgttttggcatcccttagccgaagcctctcgatcggtgcaagcatgctctaggagttggctttgtgttggttctgagggtgttcttttgggcgatctcgtctgtattcctttgtcatctagcggcggttagtccggtgttagccttctcccgattatatgtcttggcgctgttggtgtgtgggtggcagtatatttttttctttttcctggttacgaccctccagggttgtaatcttataatttttttcctgctctatcaatacaacttcgcaccgtcttgtgcgagtcgttcaaaaaatcaaccaatcttttcttgtgaagaaattctggagattatttggaggcacgataagtgccgcttgctgattcttcctggaaaaggatgtggcagaattttgttcttgttgcattgccggggacaaataaaaaatacagaagttttcaataattgtaggacccccttaaatatatatgcaaaatggcgcagcgataaaaaagtactccctctatatcagttatatcaggttataacatgttataagtcgttttgactttggttaaagtaaaactactttaaatttgactaagtttatagacgaatttaataatatttataataccaaattactttaatcaatgattgaatatattttcataataaatttgtttgggttaaaaatgttactattttttttataaatttaaaatagtttgattttgaccaaagtcaaaacgacttataaacgtaaaacggacggagtacatgctaatgttcttctatatacgagaggagctgcctcggagctagatgtattaattgtttgattagatcgcattaaggatacacatataaaattaagttttactcacaaattaatttttatagttaataagccgttacggtttataggacacgctcaaaggtagcttgggatggacatttattcaccctatgtcggaaaaaggacttctccatacaaaggactatcaattaaaacatgctaattaaaatattgtgtgatgtgtgtaaagatcggatataaaaatatactctctctgtctcaaaataaatcaacttttaaaatttaaactttatcctaaaataaatcaacttatacattcttatctactttcggttcgcaaaccgaaaaattctattcctttgatatccattatccacctattcactgatactaatttgctatcaataagacgtgttttggactttatctatattgtttgaaatgaatgaactgttagttttttttaattattgagggaagcattattatacatgctgaaatcatctatagttgaagcgatgcaacagtggtggtaaatctgtcacccacaaactctcaataactaccctgaagtcatttaattagtataataaaatattgcttctagagttaatgtcttcttccttctctgcaatataagtttatcatactaaaattcgatggtgaagtcacatactcacatacatatgtagttcaaatgctattttaataattagagtacgtgcatagaattaaaaaaaatctaacagttcattcatttcaaacaatatagctcatgtagcagtgctcgtttttcgtagcaaagctcaaacatttagctagtgatgacgaaaagtatcaatgggagcttgatttgcatatatcagcattttttcattagcacgcacaatatcattcacattacacacacatttatataagggagaatttactatttgccatatataagaggtagctggtctgtgattactttgtacaacaaaagtttcatccttcagagaccagataatacatagaggattaattaaacatacatacataattaagagcagtctacttataaacaccaaacgcctaatatgtaattagtactacttgactgtacaatagttaagtccatctcttgagtccacaactccacaacagccaaagaccacctgaccgaagcctaattaagggcatgtttagctggaaaaagaaaatccctgatgtgatatatgcagacacatatttgaagtattaaacgtagtctaataataaaataaattacagattccaccagaaaactgcgagacgaatttattaagcccaattaatccgccattagcaaatgtttactgtagcaacacattttcaaatcatggtgtaattagacttgaaagattcgtcttgcaatttcctggcgaattgtgcaattggtttttttgtctacatt

SEQ ID NO: 66615 - DNA, 1760 bp, Oryza sativa
cagcgagaggagagctcggagaggatggagatggagctccggcaatggctgcaggaggaggaggaggatgattgatcccccacgcagcggtggcattaattctgacgccattgatgcctagctcagctcccagcttgtcgacccagcttgtcgcagatcaaggtcttcttccttcacctcgatctccacctccaggcttggaatggtgaccaccaccgacagctcagcttcccggcgaggattcagcgccgccatcttagggcatgtttagttcgcgaacgaaaattgttgacgtgtcacattagatacatggacacacattcgaagtattgaacgtagactaataacaaaacaaaatatagattccgcttgaaaactacgagacgaatttattaagcctaactaatccgtcattagcaaatatttactgtagcaccacattatcaaatcatggagcaattaggcttaaatgattcatttcgcaatttacacgtaatctgtataattagttttttttcctatatttaataattcatgtatgtgtataaacattcgatgtgatatggtgaaaagtttttctttgggaaggccttagctggtagatgcatcttgcatgcattgaggcactggttgggattaaatacggatcggtaaaatagtaaagttattagtgtataattaattaaattttaattattataaattgaaaaaacgaatttatttgatattttagataaattgctatataaagtatttttgcatgaaacaccatttagctatttgaaaaatgggttaatggaaacaaagataaaatctgcatgttaataaaaaaagagttgtgcctgagagaagctatgatgtccacagtagctagaatgttttcgcacgaaacatcgtttagttgttccggagggctgaagttcttgaactgcaattcaaaaactttggagagctgatacattgaaggttctttttttctaattaagatgtggattgtaccttagttttcattagcactagcacgtttttttaaaatgctaaacaatgtgtatcataaaaaaaactttctatataaaagttgctttaaaatatcaaataaatataatttttaaatttgtaataattaaaactcaactataattgcgctaatgactttctcgttttgtgtgctaactttcgtttgatgatgtaaaatgaagttagtgcacacaaagcgaaaagtaagaaagtaaattttataactcatatccactattttgtcatataattctctcgcaaaaacttgcggggttcttatctagttaatacatgatgaggtgatcgagattagaaataagtatgggaagggtgcaggtctcagagggctgatgcgatgatggggcctatcagagttagtaatggaataaaactcatcttttttagctatatttatgacaaaatttacacctaaaatagctacattctatattctgtgaggaatttggtatgcaactttttaacttttgataccattaatattattgaaatttacatccaatagatttaaaatgtcaaaatggatttgatatataactcttagcttctttttccattgacacaattgtattttctatacaatagttttccaaagtgtttcacagatacaatgatgagaaaattccctatgtaacatcagaaaaaagttgctcttccctctatagcacccaaacttcaaaagttcccttccctatgtagcactttcattagtttttacacttgac

SEQ ID NO: 66616 - DNA, 5000 bp, Oryza sativa
  unsure (1)..(5000): unsure at all n locations
tacttgttagacttgtacaagaaacaaatttttagagaacccggcaattgttccaaagtctccagctggggcctttctttgtccatctacctagctactactccatcaatcaatcttttcttgtgcagaaattctggagattatttgaagcatgataggtgatgcttattgattcttcttggaaaaggatgtgcaagaattttgtgcctgttgcattgccgggggcaagtcaaatttacaatagtttttgataattttaggacccccttctcaaatgtacatgcaaatgttctatgtatccgaggagctagttgtttgattaaattgctaagaacatgtatataaaagtttaatccaataatcttttctggagaatatttgaaagcgtgatggtgctgcttgctgattcttggaaaaggatgtggcagaattttgtgcttgttgcattgccggggacaaatcaaaattacaaattttgttttgatgatttgaggaacacccttctttcgcaaatagaaaccccttctcaaatgtacatgcaaatgttcttctatatccaagaagctatacataatattaattatttgattatatatgtgtgaaattgccggtaattggaaaaaaaatcctaatgtgaaattgtaaaaatagagagtaaaaagtacacgtattcagaaattcagataacataggatatgcatactatgagcttttgattagactctacccaattaccaatagttttgtcatcacttctacaagttgtaattgttttgaagatactagtactagtagtagtacgttttgaatacacaaatacaaacatatccatgcattgcttgaacaggactactgaaataatatattgtcaagtttaactaaggtctattgcgtcaaggaaagcttttccaccaataattcgaggcaggtgacattctccttgatagtgtcactattagttaattaagcactgaaagctctgactttgctagatgagcctatttataatgtccaaaatatttcacaaatggggggtttcattttctcaaatccagctagccctctgtaagtctgtatacatccaccattcaccatcaagcaataaagaacataaaactgctggtccctcaaaagaaaatcaaaagaaaaaggaacaaaaaaataattatcattgtgcccatatttctttttcttttaaaaaaattcctgttccatatcccacgtgtcaagcacccattggccaagatgacgaagtggagaaaagtcagaagaagaaaaaaaagacattagaaatggtattcactgtagcgcctttctgtgcaccctccaacaagatggcgcactagccctatggtacacacctttggtgtgtccttgtctgtggggcccacatggaaatcctggaggtggggcccacatgtaaaggtgtgggagcaaggcaggtcaaggcaagaaggcaacaactctggggtcaattccggagtgtgctttacaatgatgtgtgattagtgattactactacaacggcagcaggattgttgaagacgtcagcttctgtaattaaacatgcagatgcaggaggaggaaggatccatgcagtttcttgcgttttattattgcaatttgcaaccagttcaaggaggcatatggacaaaaataatgagaaacctcggcgtttggatgcgcatattcgtagccacacgctggtttatttttacataacaattcgttatctatcccacgctctagtactacgctatagtcctgcatcgtttttaacacgtgcgtttttcaaactgctaaatggtgtgttttttttaaaaaaattctatacgaaagttgcttaaaaaatcatattaattcattttttaaaaaaatagtaaatacttaattaatcacgcgctaatcgctactctgtttcccgtgccaccctcactcccgaacgcaaccctaatggttgattctaaataatgatcattttctcgtgcttttcaatgctagttttggttatattcttttacaattttgtacgggctatgtgctaacaaatatagtattgtgaaaaaaataattcgatgacaaaattactgagatttatgttgcgaatatctaatctagatggtttcaattaaatcaacggtcaaataataaaagagaaatgatatacattttttttcttatgaactctcttaaaaagttgatgtagtaaaatgtgattgcatcttggctttttttttcgcggggaacaagaactttgattactcagctaaattgtcctcccacacaaggtgagaaatggaattacaacttccatgcggccagagtccgtaagggactcacacctggctttattagctagagtatgaccagctaagaaatgtgattgcatcttggcttttaataactaaacaaaatggttaagaaatgtagtgcatatatagcactactcactatttcacttagggcctctttaaatcgcaggattgagaaaacgtaaaaataggaaaaacgtaggattttaattggaatgtaagtgtaaaacagaggattgcaaaacgcaggaaaaacacaggaatgaccgtttaattgaaccgcaagaaaaacgtaggaattggacgagagagatagactcaaaggaaaaataccaagaggttaaagctccgctaaatttcctccaaaatctctataggattgtccattccatagaaatttcaaaggattggatatgatcaaatcctttgttttaaagagcttcataggaaattttcctataggattgaaatcctccaaaattcctatgtttttctccaaattaaagagaaacaacataagaagtaggagtacataatcagctttacacgtgtttactatttcctaccgtttgcctttcttgatacagacaaattgtatgggttaattagcagaatatccatgaacctctattgatatatgcaaaacagaagaggaaaataaatcgttcaatcttggtgtacaagcacaaactgcgcgtggaaaagacgccaaccaaaaaaaaaacaatccagggagctgcatgaatgaatgaatggatggtcatggaagtagtatgatatgattccattggagtggaaaagagtggacaaatcatagaaaaagcaaacccaaaccaaagcaaaatcactgcctttttcgttcctcaattccgtagtcctccaactctactcgccttcacctagcacatcagataggtataggtgcgtgcgtgccacttggctgctgtacagtgttaacaatttttaccggtccggcatttcgaaccatgtcacgatcataaattgctccgtttttcgaccaagtctaaaaaaatgaaactaaaattttagttttttataagatttatctagatttcacccatttggatccnaacgaaatgangaatatncgtgaggggcggtttttctggtgtttcttcgtacacactaaaaatttatctattctgaatgtaaaacatgatagttattatagtatattaattaagtataagcttaaaaaaattaatatgatgtttttaagtaaatttttataaatttattttggaaaagtaatgtttaacagtttaaattaaggtcaacaaagagataggagcgaggtttacgttaccgctggtaaccgcgcggttaccgggcttaccgcggagtacagtaatataaatacgtggtaaccttcttagattcaaataaatttaaaaaataatttaaatgtttgataaattttacacggttttgtatgatttcacggttaccgtggtaatcgtgtctaccgctggggcgcggtagcctcggccccaggcggttttgggaaaccctggtaggagctgagaaggatgcgaaaccaacggtgctggctgctctgaacgctgttggttgctgctgccccgtggcgacgacacctcaccggaggcaacacaacgcaacgcatcgaaatcgaaccgcagcgatccagcgagcggttgagtgttgccgcatcaccgagtcaccgagacatttttccttttttctttttttgtaattgcagccgcctcgcgaagcttcgtgccaccttcctcccgtcgccactgcgtcaccttccctcttttcaactctctccctctcacacaccgcattgcagatttcatttgctgcaccgccctcccctcccctgcaaatactactagtagcacaagagccccgcatgccgttcacacctgcccaccaccaccactcgtagcccccaccgcaaccacccacacccacaccactctcgatccttcttccccgactccggccggcattggcggtggtggaggaggaggaggaggggaggactctgggctgtgtctctgtcttgcgcggcggcggcgcgagagggagagattggttgtgattttgggagtcccgacgtcgcacgcgcgcgcgtgtggagtggaggaagaagagatcgcgtctcttcgcccgaggatttctcgggatatttttatttgttagttagtatttataaagacgccgcggcggcgagggcgaggtccccgattcagtttggtttttcttctcgccgacgcgcagatcgatcgcgtcgtggactgggaattcttccccccgcattgttgtttgaggtgaggtggtggtggtggtgatcacgatgggcgaggccgggcaggacgcgccgccgccgccggagaagggcgtcgaggtggaggtgttcccggcgtgggcgcggggcgtggaggagtgcgaggcgcggctgggggtctcggcgtcgcggggcttgtcgtcgcgggaggcggcggcacggctgcgggcgcatggccccaacgagctcgccgagcacccgggacccacgctgctgcagctcgtcgcgcagcagttcgacgacacgctcgtccgcatcctcctcgccgccgccgccgtctccttcgcgctcgcgctctcctcctccgccggcgccgtcacgctctccgccttcgtcgagccgctcgtcatctt

SEQ ID NO: 66617 - DNA, 3091 bp, Oryza sativa
cgacatccaggccaaggagtgtatggtcttcgccggcaccaccgtcgtcaatggcagcgcaatctgcctcgtcgtgcacactgggatggccactgagatcggcaaaatccacgcgcagatccacgaggccgcgcaggaggacgacgacaccccgctcaagaagaagctcaacgaattcggcgaggcgctcaccaagatcatcggcctcatttgcgctttggtgtggctcatcaatgtcaagtacttcttgacgtttgagctcgatgggtggatgccgaggaacatccgcttctctttcgagaagtgcacatactacttcgagatcgctgtggcgctcgctgtcgctgccataccggaaggacttcctgccgtgatcaccacgtgccttgcacttggtacaaggaagatggccgccaagaatgctcttgtcaggaagcttccaagtgtggagaccttgggatgcaccaccgtgatttgctctgacaagaccgggacgctgacaacgaaccagatgtccgtggcgaaacttgtggcgatcggagatgctgaagggaaggtcaggagcttcaaggtcgatgggacgacatatgatccccgggatggtagaattcacgattggcctgcagggaggatggatgcaaaccttcagacgatcgcaaagatttctgctgtgtgcaatgatgccagtgtggcacattcttcacatcagtatactgcaactggaatgccgacagaggcagctttaaaggtgagaatcgataaactgtatgatattctcattctgttaaaatgctccagtttttggtccaagaatatggtgcatagtttgttaatccactagttgcacatttttcaatcatgatttgagcagtctaggaacattgcctactgaaagtaacgttctggcatgtgttggttctaattcagataatgctgcttgatgtttggaaacattctgttgtaaagctctgatataacttttctttattggtttcttctaggtcttggttgagaaaatgggaatacctgaaggaatgaacggattgtccttggatccatctgaaacattaggtaagctagaaatgccttttcggcttagcttagtattacctatcagtttcaactacgtgcttcttaattaggatattcttctaatcacgcactgagctgattatgaaattgtttgctaacaggctgctgccaatggtggagcaatgttgccaagaggattgctactcttgagtttgaccgtacaaggaaatcaatgggagtaattgttaagtccaaatcaggaaggaatgctctacttgtgaaggtgttaattctttatttcttgctatatagtcatctcttactgatctgctggacatgtattgttcactgcatctttttagtatgttccagtggttggcgttgtcattagtgcctgattttgtgttcttaataacagggagctgttgaaaacttgctggagaggagtagccacattcaactgcaggatggttcagttgtgccgttagatgaaaaatcaaggaaagctattttggaaaacctccatgaaatgtcaattaaagctctgcgctgccttggttttgcatacaaagaggatctagcagaatttgcaagttacgatggtgaaaaccaccccgctcacaagcttttgctggatccagtcaattatgcagcaattgagaccaatttgatattcactggtcttgctggcctaagggtaagatgatgcttctcatgatatgttttcaaccagattgtttccttttttttttaactccaatcaaggaaaattcctgtttcttcttggttcaacaaaatatgcatagtaagcacggttatggacttcaaggcatataaggtctaaataagatatacttgactaggagataacagaaaaggctaagcatgaattctgtatagctaggataagctaatccaaacaagtacagtcatcaattatacagaaagtgatttgctggggaccagtatttaagatcaatgatcatcttgtgtaattttcttttcttggcaacctatcttcttacagtattaatgtatctttctcattgatgttttaaatatgacaggatcctccaagggaagaggtttttgatgctattgaagattgcagagctgcaggcatccgtgttatggtgataacaggagacaacaaagaaactgctgaagcaatatgccgtgaaattggtgtgttttcacatgacgaggacattaccttaaagagtcttacaggaaaggagttcatggcacttgaggacaagaagacactgctgcgaaggaaaggtggcctactgttctctagggcagagcctaggcacaaacaagagattgtgagactgctcaaagaagatggtgaagttgttgctatgactggagatggagttaatgacgcccctgcgctaaagctggctgacattggagtagcaatgggtattacaggcactgaggtatgtacttatttcagcaccataggttgttttcagccagtgctttctttctttaatttcctgtgcagaaatatacaggccttaaaattttcatgacatttccctttcagtccttttttggttgttagccctttgtacttgtctgccaatatttcagctaatcatctatactgttctgagttaatttgaacaacattggttagagataacatgaatttataggtcttttattgtcccaaaagtactgatatctgtgacataatttgaattggtatctcacttatttttcttttgttcaggttgcaaaagaggcctctgacatggttcttgctgatgacaattttagtaccattgttgcggcagttggtgaaggaaggtctatttacaacaacatgaaagctttcatcaggttagtgatctcagagcctgtttttgttgttgttctcactttttgcttcaacacttgcttttgtcacttctattttggcagaaacaaacagactaatgctgcagtaaaacattgtttcatctacatttgcacctcatagttgtgcaagttatcgtgtttttttgtctgttctgaggattctagctgtctttcttcactgctgcag

SEQ ID NO: 66618 - DNA, 709 bp, Oryza sativa
cataataaggtaggcagaaatgtgtataatttgatctaaatatttcatctatatataataattcacagaagcaaaatgttgccaacagaacaatgctgctgcctgctggtttgctgtgagctcagtatagtaccatttaggacaaggaataaaagaacagcaaaggttatcaacttcccaaagagtgatgacctgttttgagaaaatctctttcctgaactttcttgtattggacatatttctattgaataaacatcatttggtgatcattgttacttgatcacaacaaattcagtgacttttgttactgatgagtctgaagaatcactgttagcattttactcgcccttctgcttcctggttcgcctcttggggcctgatgagcttgtacaccttccgacaaacttgagaacctcgtcgatgagcaccaccgggagtgcaacaagcaacaccagcagccactcgttcaagctgagcggcacgatgccaaacacttgcgcgaggaacggcacgtagaggatcaagaaatggagcccgaacgacactgacatggcgaggagcagccatgggtttacccaaggaggcatcctcaggaggctagtgtcttcggagagggcgttgagtgagttgaacatctcaatcgccaccaggacagacagcgagagcgttgtcgccttcactttgccaccatggaagtactcgcatggat

SEQ ID NO: 66619 - DNA, 723 bp, Oryza sativa
attttaggtttgaatttgtaatttcaccactggtacaccccttatttctgcatgttacaaatatattgtgcctgctcagaactgcttgccacggccagggcttcgatctctactgtgacatctagtagagctctttaatttgtgtaggcagcaggtttgagtaggcccattgtgtctctgtattggcatgatctatagaatacaactctgtatagtcgctgatttattagtatacaaattttttgatttttaaaaatattattgttattttttgttggtactcaatcaaaaatatttaaacatatttgacacttaaaatttaaaagtttaactaggcatactatttatctggtattaattgttgagcaccgagatacatatattatatatatatatatatatatgaaaatggttctatacacctgggagtatgtacacctgttctcatccaccgttgatctatgattagcttcgatggaacctgatatcggattaacgagcggacccgtttaactttttgacgagaaaaaaattacgtactccttaattagccacggaaaccggaatgacctgagtacaattcctcgttcccaccagtgcatcggatccgaaaatcaggtcactaggagagaccgcgatataccagaactcggagaaggcggcgccgattcatcgtcgatccatggctgcgttgcaggtgacggcgtgatcccggcgcggcgg

SEQ ID NO: 66620 - DNA, 10568 bp, Oryza sativa
aattgggctgggctctgggcctgctcggcccaccattcagtgactcggtgaacgttggtgtgaagcatagaaggcgtgaacgtgcacgtgccccgcgccgccgagaggaaacacgacaactcaaaccaatcctgtccgtccattcatcccgtagacaatctgacccgtccatccagatctgcgacgccgaataaatagccctcctcctcccacatcccgagctccgcccttctgacagccgccgcatccgcgccgcccccgacctaggatttcgccgccattctcctccaaggttcgagatcctcctccccgagctccggatttttttttctcaatttttctctcgctgttgttcgattccgttcctgcacgcgcgcgcgcgcgcgctcgccgtaggttcgtttgtttcatcgattatagcaacctagtgtggggaaggaagggataggagcgaaatcggaatcgaacatgtcagatttggaggccatcgaccatggctgccccatcgatcgccggcgcgggtttgtagagcttcgcgtcgcctgtgtgccgctcgcagagaggatttggtcatgttgcatctgattggatttacttttcgccgagggcaacaagtaacaagctctagataatttttgacctgaaatcagaaagctcaagtaaaaagggtaaagctgtgaagcctcttaaacccatatgtttaaacccccacccttgtgcttaaacccctcttatgtataggtttatgtgagtattaatgatagcatagactgttggtgacgcgctgctttctttgtaagtggacattgatgattctatcatatagtgcaagcgccccagtttttagtctctgctatgtgttaattagttcatgcaacctaagatgctacaattgctcatattgtgattctttgtagttacattgaattgtttgcaggcacgtcaagtagatttatttcatgttagtcctaagattacaggttcttataggggatgctatggctagacttgccttaactgattctttgtgaactttaatggctgcatctatgcctgttgatcttgtgtatgctgctctgggcggcaaggcctatctaatcatgccatagctcatcctctaatgtgattacttgctaggccccctaaatatgagtctattctgtagtgaaatggatgttgtaattatcaaaaacttctattccgttagtttttcctgcataaaaaagcatccactaactgtagatcttcatttgtaccagtattcatcctccttccaatcattcattagattttgaatagtactgatgtatttttgctgttgtcttcaggagatgccgcgctatgatgatcgttatggaagcacgcgcttgtatgttggtagactgtcttcccgcactcgttctcgtgacctagaataccatttcagcagatatggaaggtacggacagaaccatggtccttaagattttatttctctgaagcgcagattttttgcagaagtttatggattttttttctgttaaatttgtaataagctgcattttctgtgtataaatgtaaaacactattactatgataacacttgctaaacagttgatattacaacaacttggtacgttcaaatttcactgtagaaatttaattatttcccattaaaattgtaacctttccaaattgtgtgcgagtcttctgtgctgagcatagactagtaagcactggatccttcctaccctttccaatgggccagctcatagcagttgttgggttcagtggtaccactcttttttcagctactttgtggacgagttccttgaagccttttggtgtggcattttctattaattcttaaagtatgctgtagaagtacccccccgggtcttgtgtgtttgacttgaatgatcttgttgaaggtttttcggttttttacacaaaccgggaggtctgtgatggtctggtggaaggggtgcccttggtggaattggtggccattcttccaaagtttgtcgaggactttgttgaagggcgcccttggtgtaatgttattgactgttttagtggacgttgcaagtcggtgatgcatttgagtacttgaatcatgatggcttactgtttggcaaccattggtgcagaatacgtgaagtggagttgaagcgcgactacgcatttattgtatgtgaattattcttccctcatttttttctctcttttctaaattgtaccttttagttcacaagtccaacatttttcggatgtctcttttaccaaacaggagttcagtgatccccgtgatgctgaggaagcaaggtacaaccttgatggcagggatgttgatggaaaccccattcttggtgagtttgctaaaggggtatgctgttcttcggttgcttctctaagcacatcctgattctattttttttctttaatatgaagctgctgctgaattgatctgtattttttgttgactgatgctcttttcaacaaattgagcatgcaggttccacgtggtcctggtggttcacgtgaatatatggggagaggacctcctcctggaacaggtcggtgttttaactgtgggattgatggtcactgggcaagagactgcaaggctggtgactggaagaacaaatgttaccgctgtggggagagaggtcacatagaaagaaactgtcaaaacagcccaagaaatctcaggtattgattgataagttgatctgataaagagcagcacttgcaattgttccgaggtactgtatttgaataatttaacttagatttctccaatgcatacttctttttttttcaggcgtgagagaagttattcatgctctccatcgccacgccgtggacgtggtcgcagtcggagctatagccggagccggagccggagccgcagttacaggtatgcttcaaacgccacatgttcaaattataatacaccatgctgtctgtccaaatcacagatatgttatgttgacctcaccctgcttcttttacattctttatatcagccggtctaggtccagatccctgtctggatctcccagggcacgcagagagcttgaaagatcaaggagtcttagttacagcaggagtcccaggcgatccatctccccagcagcaaatgaaaagaagcgcagccccacccctgatggtagccgtagtccaaggagtccacaggaccaggtgagcccaccacccaaggataatgctgagcgtaatggctcagatcacggtgacagcccccggggcagggagaacagcaggagcccgtctgatggctaccgtagccctgcagctgccaacgggcgcagcccaagcccaaggaacaatggaagccctagcccaatggacaacggtagccgaagtcctagggatggaaatggtgacggtggtagccgtggtggctcacgctcacctagaccgagcgagtctcctgaagcctgaaatttaatcgcagtctatggcgttcgtcatgctatggttgtaatggttacattcccggtttaagacgagatgagtgtatttgctcttttctcaaaaacgacagcgtattttgttactttgtgaatgtcatgctatggttgtaatagtcacagtcctgttttaagacgagataagtgtatttggttcttttctcaaaacgacagcgtattttgctattggtgtacgatggatggtccgttgaacttccaaatcacattgtttttgcagatagatttgtatcttcagattgaaaattttgttgctttgcgcgctgaacgacgtcgatggcagttaccttttatctttgaagtgctaaatgttgttgtagacctcagaagctgctttggaagtttgtggtggctcaggtgttctcgacttctcgtcttcgtactctgaatctcatctcatgtcagctcgtggcaacaaatgtgtgcagctagtagctactgtaaacagctacatttgtcttgtactcttgtctcgtgtttctgttggtcagaaacatgcttggaattaatgcccataaagagagcataaggaaggattaccccagttactaacgctaacacgctttgcagctgtcaagattaccccagttaccccataaagagaccatcactaacacgctttgcagcgggcatttggagtagcacttaacaagcagagcctaaaagcagtaaagcacgcagtaatcggaataagggcatgtttggttggacaccagacgtaagcctgagaccagccgggaccttgtttggttggtgtcctgaccttagtttctccttccctggcctgagctcttttggagccttattagcctgagtcaggcgagctccagggcggcgcagctacgctcattaatcctaattaccgcttataataatgtagtataggtactgtaaattgtagaagcaaccgaccatacaaatatattttatttgtgctttcaaggagggatacaacacatccaaatattttatttttttgctaacactttataacaaccgtaataattaaaagcttaatcacgtttagttttcacaggcgcggaagaacaaccaaacagacaagtgagacaagtgttcaggctgcctgagcaggcaaaatttatcatcctatcaggtagctctcaggcacccaaatttttcaggcatgttggtgagggcatcaaccaaataggccctaagtgtgcgtacgactgcacctgttcgacctgcatatcactgtacataagctcaagttttaaatcgttttgacaggtccaagtgaatgcttatgaactccgtgattgattggttcagcgcagttgtatgagagttggatgtatagcactactccacagtaatatgaacgccagtggtcatatatggatgtatatatacgacgccagtgttcgactgatggccgacttcattacggcatcacctgcgcgtgtcagattctattacagaatgagacatttgccgtctgagcctttcattgtggctatggtcatactctcttcgtcccatttaatgtacaatcatgcttttccgtactaaattttgttcattcgttttatttattttttaaaaaaaatcatacctaaaatattatttatgttttatcatcccataacaataaaatactaattaaaaaaaattaaacaacatggacgatcaaatttaaacacgaaaatttatggttgcacttagaatagtatggaggacacaatagctggacaacaaggttgtaccggcacgtatatcattttcgccgtaatatagctctcttgtactactgacgtgccgaatcggtctcggtctatagagccccgaccgagccggactcgtccgaccgagtcggactccacctcggactaatcgatcccatttaaatcgccatcactccgcgcgctctcccatccatccatcatccaagtcaacaagacaagcccgagttttgtgccactctacacaacacacacatggcgatcctccccggcgactgcgtcgtgctcgacatcgacgacgccgccgcccaatccacgccggtgccgtacgccctcacgttcaccgacctctcctacaccgtcggcagccgccgcgccggcctgctgccgccgttgccgacggacgcgccgccggccaaggcgctgctcgacggcatctccggcgaggcgcgcgacggcgaggtcctggccgtcatgggcgccagcgggtccggaaagtcgacgctgctcgatgcgctcgccgggcgcatcgcgcgggggagcctccgcggcagggtggagctcaacggcgaggcgctccacggccgccgcgtccgggcgatctccgcgtacgtcatgcaggacgacgtgctgtacccgatgctcacggtgcgggagacgctgctgttcgccgccgagttccgcctcccgcgcgcgctctcgccggacaagaagcgcgcccgcgtcgacgcgctcatcgaccagctcggcctcgcgcgcgccgcggacaccatcatcggcgacgaggcccaccgcggcgtgtccggcggggagcgccgccgcgtgtccatcggcacggacatcgtccacgaccccatcctgctgttcctcgacgagcccacctccgggctggactcggcgagcgcgttcatggtggtgcaggtgctccgccgcatcgcgcagagcggcagcgtcgtcatcatgaccatccaccagcccagcgcgcgcatcctcaacatcctcgaccgcctcctcctcctctcccgcggccgcaccgtctacgccggcacgccggtggggctcaagcccttcttctccgagttcggcgaccccatcccggacaacgagaacccggccgagttcgcgctcgacaccatccgcgagctcgagcaccagcccgacggcgccgccccgctcgccgacttcaacgtcaagtggcagtccatgcacgccgcactcccggcagctgacagcaaggacagcaagcgatgcaccatgccactcgagctcgccatcacggagagcgtgtcgagggggaagctcgtcgccggcagcggctcggggacggcgtcgtcgacctcggtgccgacgttcgcgaacccgctgtccgtcgaggtgtgggtgctgatgaagcgatccttcacgaacacggggcgcatgccggagctgttcgtgatgcggctcggcacgatcatggtgacggggttcatcctcgccaccatcttctggcgcctcgacgacacgcccaagggagtccaggagcgtctcggcttcttcgccatggcgatgtccaccatgttctacgtctgcgccgacgcgctgccggtgttcgtccaggagcgccacatctacctccgagagacagcgcacaacgcgtaccggagactctcctacgtgttcgccaacgccgtcgtcgcgttcccgccgctggtgttcctgtcgctggcgttcgcggtgaccaccttcttcgccgtcggcctcgccggcggcggcggttcgttcctgttcttcgtgctgatcatcctggcgtcgttctgggcggggagcgggttcgtgacgttcctgtccgcggtggtgccgcacgtcatgctgggatacacggtggtcgtcgccatcctcgcctacttcctgctcttctccggcttcttcatcaaccgcgaccgcatcccgagctactggatctggttccactacctgtcgctcgtcaagtacccgtaccaggcggtgctccagaacgagttccgcgacgcggcgcggtgcttctcccgcggcgtcgagatgttcgacgggacgccgatcggcgccatgtccaaggccgtcaagctcaaggtgctcgacgccatcggcgccacgctcggcgcgccattgacggcggagacgtgcgtggtgaccggcgccgacgtgctggcgcagcaggctgtcacggacatcggcaggtggaagtgcttgctggtcaccgtggcgtttggtttctttttccggtttctgttctatatcgtgctgcactttggcagcaagaacaagaggcgctaagccctttggtatgtatgtgtcaagtgcatgtttgtaatacttcattttttaaaaattttgtattcatacttgaaagccatgtaaaattctttgatcagatttgatgataataaagaattgaggaaatgttcaattcatattaggtcttgtttggcacaattacagttctcatatccacattggatttgaagtttgtatgtttatttatagtggttcaaaattctatatttcacctaaaatgaaaataaaatgattaattcaaatgttatcaatttaattatagttccaggtccatggatagaggttgaaatacccagctctaagaaatcttggatctagagctatgccaaacactcctttaatatctgatatatgagttcaccaatatgcaagttcatattcggtctgcataagttctaaaaaaacaacaaattaaattttaactaagaacggcaaaacatacttttttttagaagaacgacggcataagttctgctggaatttaaattagggaaaaggccgaagcctagcaaagagtttacagggactgtaatagagatgaaatacagcttaagaagcaaagtaaatcagggggggcttaaaagctagtttgcgcaaatccaaatcttgcttgataagatgtgctacttcatttactgagaagtaaaaattttgaaaaaatcttctgtttctttcttgcaagatgttccaccaagtagtaagtagcgagcctctgataatccgtatttgagctttgcttcccacatggttggttccattccaccaagtttcaacgtcagggggatgggacgaggttataggggtcaggttttggaactggtagattagaactacaaaacatactatcgagggattaaaagagtttccctctaaactttgtaaacttgttctgttgtaaaggtgggtgacgatggttccgtcgtacgcatatgctatacttatgcagaaataatagtttgacccattcttacaacacaacaaaaaaaaagtataacaatcgaaaaggggattgaattaatttgaagcataaggttatgcaaattttcattaactttagattgagactcatcaatacgagtgcttcttaaataatgatgtatcttcttttgtgttggtgtgatttatgagtgggttatcagcatgccatttcatcttctgcctcttaccggctggtgcattgcttcgctcgatcgatgaatatgatcgagagggccagtcttcggtaatgaatggttacatttttatgcaaagttaaaatgatggaaagcacaggagtggaatatctaattctgaataagatgacaagatggaaacacaggaagctgctatcgtacaaatatggagtaagcggcagtaaaccagattttgctaccgttctcttgggtggacgatttccctctatcaactagtcaaagctgaaatcagaaagcaaaatggattaattaattaacgttgttcttttttttaagaaaaagaattgtatatctgtggagattatggttaccccatatctacatagcggttatattccagctggatatacggtaccaaatatagatagaatatctttatgaggactcgggttagattctaaacttgtatgtcaagaaaatacccgggatcctagtcggttacgattgtattttatctgtaatcccatattccgttaggatatggactgtactttgtaatacggatcccttcccctatataaggagaggtccgggttcctcttgggacgattcttttttctcccaatcatacaatcaataacacacttggcggaattatccccggacaggagtagggtattacttcttgaataagaaggcctgaacctgtataaaattccttatctctaaacccatccactttcctagcttgatagccacccccttttattattgccgaaatcttgtttcgacagttggcgcgccaggtaggggtccgtcaagttctcgccgactaagtgcgatgggtttcatttctggcatcgacgacttcgccttcccccccgggcaggcgtttcagttcggcagcctcaacttcatcaccaacgacttcggcaagatctctctccttgactcggattcaaaccagtcggggagagaccaggtccccgtgcccttcggtattccgaactcggccgaggcctactccaagatcatctctcccgagtcggcttcaaaccactcgggcgagatccaatctactcttccgcgaccagatcaagacgatgggtcctatccctcaatcctgatgaaacttcctgatgatttggccgctgtcttcactgccaagacatctcccattcgaagatctaggcgagctccggcttcggccccgatccaatctagatccagagaggttggcgttatactccaacctcttgggacagtctcgacgaaagagttggatggttaccttagctcccccggcgttagttctcgactaaccgagatcctcgactacgacgatttcggctaccactacgaccacggcgacctcgacaacttcgacgacagctatgaggataactacatgcccctcttcttcggcgtattcatggctgacaatgaaacggaggaacaacgccaagcccgagaagtagaccaagatcgtgcacgccaagaagctgaacgtcgccgactggaggaagagcgacagcgacaggagcgagaacgactacaacgtgagcagcaagatcacgaacggattgcaaaggaggctgaagatcgacggcaacgcgccttggaatctgggcgccgagcgagagaactcattgggcaacaagacgtcgatggaacagcggtctttcgcaccccccagcagaacgtggttgcagcaatcactctcctcgacaccctcctcaaggaagacgcactcaaccaagctgatcatgttgtcaacatcttgaaccagacgaagaccatgatcgctgcctcggttccagccaactccgcaagcacccgcaccctgactggtagccgaatccttcacttccgatctcatgattattatcagccaagcctcagcatcaccggcacaggttctagtcgca

SEQ ID NO: 66621 - DNA, 2141 bp, Oryza sativa
cccacgagactactctcgcccgcgaagagatccgactggctgcgaccacggcaagcgaaggagaagtgcctgcaaccaagctgacgaagaccgaagaaagtgatgccaagacgaaaaagattcccttagatccctccgatcctgataagactgctgtaataggcgctgagttagattgtaaataggaaagcgcgctcatcacctttcttcagaataataaagacatttttgcgtagaaaccatccgatatgcctggtatccccagagaggtgattgagcactctttacatgttaaggaagacgccaaacccatcaagcaatgactccgccgttttgcacaggacaggaaggatgcgatcaaggaggaattaaccaagctattagcagcaggcttcattaaggaagtccttcatcccgactggctggctaacccagtcctggttcggaaaaagacggggcaatggcgcatgtgtgtcgattataccgacctcaacaaatcttgtcccaaagacccttttcggttacctcgcattgaccaggtggtcgattcaacggccggctgtgagttactcagcttcttggactgttactcgggatatcatcagatccgactaaaagaatccgactgcttgaagacttcgtttattacgccctttggggcctactgctacatcaccatgccctttggattgaagaacgcaggagcaacctatcaacgcatgattcaaagatgtttttcaactcagatcggtcgcaatgttgaagcctatgttgatgatgtagttgtcaagaccaagcagaaggatgacctgattgcggatttagaagaaacttttacaagcattcgtgctttcaagatgaactaaacccggaaaagtgcatcttcggagtaccgtcagggaagttgctcggatttatggtatctcaaagaggcatacaggccaacccggagaaaatcaacgccatcctcaacatgaaaccgccaagctcccaaaaagacgtccaaaagctgactggttgcatggcggcgctcagccggttcgtctcacgactcggcgagcgggggatgctcttcttcaagctgctgaagaaaactgacaatttccagtggggacccgaagcacaaaaagcctttgaagacttcaagagacttctcactactccaccagttttggcctcgccgcatccacaagagccgctactgttatatgtgtcagcgacctctcaggttgtgagcacggtcctggttgttgagcgtgaagaggaaggccatattcaaaaagtccaatgaccaatttattttgttagcgaggttttagccgactccaagaccagatatcctcaggttcaaaagttattatatggtgtcttaaataccgtcaggaaattatctcactactttcaaagtcactcggtcacggtggtcacatcatttccactcggagatatacttcataatcgcgaagcaaatggacggattgcgaagtgggccttatagttgatgtctttggacatatcattcaagccacgaacttcgatcaagtctcaagctttagctgatttccttgccgagtggaccgagtgccaagaaaacatgctagagaaaaagatggaatattggactatgcattttgatgggtcaaagaggcttacaggcactggagctggggtcgtcttgatttccccgactggagaaagattgagctacgtattgtggatacatttttctgcgtcccataacgtggcggaatatgaggcgctacttcatggactaaggattgcattatctctaggtattcgccgactaatcgtccgtggagactctcagttggttgtcaatcaagtcatgaaagagtggtcatgcctagatgataatatgaccgcttatcgacaagaggtacacaagttggaaaataaatttgatggacttgagctcacccatgttctccgacataataatgaagcagccgacagactggccaattttggttcaaaacgggaagcagctccttcaaatgtgtttgtcgaacacctttacgaaccaaccgtgcccagaaaagagacagtcgaagccatggatactcaaggcataagcatgatcgaagccgactagagagaaccgtttataaagggctgcagga

SEQ ID NO: 66622 - DNA, 1664 bp, Oryza sativa
tttttggtttattgtgcagaagcaatgttgccgagtgaagtggaatttgaatcactacgatttcggaacttcaacgaggagggctatgaagagggccgagtagacgacatcaatcgactagaagaagctcgagaagcagctttaattcagtcgactcgatatttgtaagggttgcgccgttatcataatcagaatgttcgatcgcgagcctttttagtcggcgacctggttctgaggaaaattcaaacaacacaggatcggcataaattatctcccttatgggaaggaccgttcataattgctgaagttactcggccaggttcttatcgactcaagcgcgaagacggtactctcatcaacaattcttggaatattgaacaccttcgtcgattttatgcttaggcatttcgtttgtatctttcctctttgactgctaacttcaagttttttccttgaagttttcagtcagggggctactatgataataatggagtgtgatttttatgaattcaatttgcttacttgatgtatcattgccctgtttgatttcttggcttagtcaatgaggactgaaagttttttaacaacttttgcgggttttaggctcaacaaggtttgacaaaaacttttaagaaatcaggaactaagttaagatatcaagcacaacataaattcatcagtattgtacaaattgtgcctccatcatcattattcatcaaaatcattggtacattagttagtcagtcttttcatcatcagaattatcaggaccagtcggtcgatgatcggtgtcctagaatctctcaactacatcagcagcaatcttgtcagtggctttctgcgcatcgctgatgaggtcaagagcagcttcttcgctcgtcccatctgcaaagccatcaatggcatcaacgtcaaccctcggataaagagatttggtcattgccaacgctagacttgctcctatacttccagcttctttgatgttcttgaaatatatatccggagcaactctcagcttgtcgaaaatttcagaagcatcaagtgcactcgggccgttgttattgaagaacatcgcttgaacaattggggcagcagcgttagcaacctcatcccaggctccttcaagttttttgatcttgccaaccaggacgtcgaattgagcttgagacttgatcttgcggtctgcatcaacagattcacattcataagtcagcatatggaggataatggcttttgaagtattgattgtcgataccttcaacttcctttaaagccaagtctttttgtcttgccagttctgccttgtcattttccagaatttgaatctgcttctccaactgagatatcttggcagcttgcactacattaaccccggttaatcatgattacaaagacaacggcacaagttagttgggcagagtttgtgcgtaccttttgatgagccactcagttcaaaattggattcctgaagctcagcaattcgatccctcagatcatgctcatttttcctggcaagctcttttgtttcgtacagctgactcctggtggcttcgagggtcccgagatgagggactagcctctctaaggttgccgttttagcttcgttcctaagatgaatcctctgcaagacagtttaattagcgcctagattaaatagcaaacga

SEQ ID NO: 66623 - DNA, 1986 bp, Oryza sativa
ctagtctcatgtgtcgccgtcacgacaggtatttgaccacagatatatgtacatacatgtcgtgtacaagaaaactacggttgcatttcagctgccttatactataacattttttttaaaaaaagattaaaactcagcctctacatccaaagtggatcgatgtatacagtcgaatctgccaatagtacttaactattacttctgggttaacaatcttatgaaacatttttgggtttttcttactgtcagaaaaggtgtctgaaacatgtacatccataatccattgcatgatttcagcaacatggaactccatggtaagtttcttgaattagtaatgcatgttcaacttgacaagacagatgtttctactagcacaagagccctagtatttggcaaagttgagaagttaagtttgcaccaacctgcttcagaagaaaaaggaagtttggaaatacaagtctctgaagacagtgtaacagctggttgtacacatgtaccatatcagaagaatttgagctgaagtgtctgaaactttaagccgccatttcatactgaccaaataagctagtaggacagacgtctccctctgacccatctgctgacctgaacctgaagattgagcaagtaaatcatgtgtggtgcaaccttttcaatactacaaatttaaactgtttggcagaactaaccatccgaatgatgatagaaaaccatgcctttttggcagcaccaattcaacaaaaggatcaatgcaaccgaacatcttttaatttcagtttccttgaggaaacccaaatgtgcaacaacttgttgcatccttgtcattatcatttagccaggagcaaggcaccagctaaaaacagatagaggaaggaaatatatgattattaaaacagagttaggtagcatacgtcaaatggtacaaaattcagtataccatgcctttttttttttacttttgatattttcaatgctgcccatcttcttaactgtgtgacatatttattgttgataataactattaactaataacagtgtaactctcagttgtacacaacatatacaactgcacatttctttatcgtagctgtgaaatatagtttcttactattgaacatatactgttacagaacatatagttttgcacatttgttcaaaaagagctactcattttttaacatctgtttatcattgatcaactctcttcttctatagtgaaatgcaggagctccttgccgttcccttgaaaaaataataatagtagaaggcataaaaataaaatcagagagagcctcagaacagaagggtcattgagaaacagtatatcaacatgtaattctgtatgttttagtgtataacagccagtaaaactgaacacattcacatacatgaactgcatcttcaacaaaatgagaaaattacacaaacaaatacactactagcatatcacacatttcttgctgtcattaattcagacatcatatcagctgaacatgatcggcccctctctctctacctcctcttgttcttgctgccgacgagcaagacgacgtagaagagagcccggaagaagaacccccacgccacggtgaccagcaggcacttccacttgccaatgtcagtgacggcctgctgcgccagcacgtcggcgccggtggtgacgcaggtgttcgccgtcatgttggtgccgagcgtcttgctgatggcatcgagcaccttgagcttgacggccctggacatggcgccgatcggcgtcccgtcgaacatctcgacgccgcgggagaagcaccgcgtcgcgtcgcggaactcgttctggagcaccgcctggtacgggtacttgacgagcgacaggtagtggaaccagatccagtagctcgggatgcggtcgcggttgatgaagaagccggagaagagcaggaagtaggcgaggatggcgacgaccaccgtgtatcccagcatgacgtgcggcaccaccgcggacaggaacgt

SEQ ID NO: 66624 - DNA, 1585 bp, Oryza sativa
atgaaccccgtcaccatgatcgtgccgagccgcatcacgaacagctccggcatgcgcctcgtgttggtgaacgccctcttcatcagcacccacacctccacgtaccacgggttcgcgtacgtcggcaccgacgtcgatgacaatgtccccgagccgctgccggcgacgagcttccccctcgacacgctctccgcgatggcgagctcgagcggcatggtgcatcgctgactgcggtccttgtcgtccttggtgtccaggagagcgccgagcgatgattgccatcttgagctgaacttgacgagcatggcggcgccgtcgggctggtgctcgagctcgcggatggtgtcgagtgcgaactcgacgaggttctcgttgtccgggatggggtagccgaacacggagaagaagggcttgagccccgacggcgagccggcgtagacggtgcggccgcgggagaggaggaggaggcggtcgaggatgttgaggatgcgcgcgctgggctggtggatggtcatgacgatgacgctgccgctctgcgcgatgcggcggagcacctgcaccaccatgaacgcgctcgccgagtccagcccggaggtgggctcgtcgaggaacagcaggatggggtcgtggacgatgtccgtgccgatggagacgcggcggcgctcgccgccggacacgccgcggtgggcctcgtcgccgacgatggtgtccgcggcgcgcgcgaggccgagctggtcgatgagcgcgtcgacgcgggcgcgcttcttgtccggcgagagcgcgcgcgggaggcggaactcggcggcgaacagcagcgtctcccgcacggtgagcatcgggtacagcaggtcgtcctgcatgacgtacgcggagatggcgcggaggcggcgcccatggagcggctcgccgttgagctcgacggcgccgcggaggctctcccgcgcgatgcggccggcgagcgcgtcgaccagcgtggacttgccggacccgctggcccccatgacggcgaacagctcgccgtcccgcgcctcgccggagatgccgtcgagcagcgccttggtgggcgcgtcgggcggcgccggcgcgtccgcggacgccaggcggttgctgtggcggcggcggcggctcgacggcaggcacgacaggaccccgccgccgcccttcctgacgctgtacgagaggtcggtgaaggacagcaggtacggcaccggcgggccggccgccgcggtcgccgcgccgccgccggagtcgacgtcgagcaccgtgtgggcggaggtcgccatgcagaacggatcacttgcagaatggatcacaccgcggtgttagtttgcggtgcggtgcgtgttggtcgcggcctttatataggagcgtgtttggttggctcgatttgggttcagacttgaagactcgtgtcaggctaaacaatcgactgtgcaaatttatttactcatcacgataaagtcagcaatgtgtaatcaagaatgtaaggtatggatcaagtgcgcaatcaattgcttttcttacaactgttctatatacggagaattacggaaattatagtgtgagattttaaatttgtagcgta

SEQ ID NO: 66625 - DNA, 839 bp, Oryza sativa
  unsure (1)..(839): unsure at all n locations
nnnnnnnnnnnnnnnnnnnnnnnnnnnnnnnnnnnnnnnnnnnnnnnnnnnccgcaggcacaccgaacacacacttatcggggttcagctttatgcgggcggagcggagactttcgaaagtttccgctagatccgagagtaaggtctcttggttgcgcgtcttcacaaccaagtcatcaacataggcctcaacattgcgtcctatctggctacctaaagaaattcgagtagtacgttgaaaagtaggacctgcattctttaacccgaagggcattgtggtgtaacaataagttcctatgggagtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttccggggcctgtcgccgcactttctgccggaccggccttgcgcccggccgcacggcgagacggtgctcaatcagccaaacttttgaccgcgcggcagtccgcgaggtcgtggagggaggtgttgtgcacggtacaccacttgccggttgggcgctccctgctgggagcgccggcctccttctttgtgtcgctcgcaggcctcccctttcggggggcccgcgaagcgccctc

SEQ ID NO: 66626 - DNA, 34813 bp, Oryza sativa
ccaccagcccatgacaccaggcggctttccttcagggtcacgcaaacgccacaactcacctttgacagcttcctgaaaacaacagtaaactgatcaaactaacctgtagacatttaccccaaaaaaggaatagaacaattttctatttctaacctgaagaataccctttgttgtgaaatcaaatgcagcacaaagtcctccagtgctatccatccaattgataattctctgcctgtgtttatctgctaaaaaataattgttcagtttatggaaaaaaaatatacgccaaatgtccatatcaaagtaaagcaaggagcatttttcatggttgagaaaactgtttcgaaatttgtatatggtctaaaccatatgctaactacacagactcaatctaatgtaactgtcatgcattcacaaaagatatctaagtcccttgcttcatctcgacaatagcacaaggagtagaaagcaacaaaagaggaaaccatgacagtggttaataattcaaaaatcacaaaacttcacacgggcagtactgtaaattacagaagtaaaaaaaatcagcatgctagtgttcacagttgtcaatcaaggaacatacgcttaggctagatacagcatcactatggcataagcaatcagtagcaatgtcattacaaatctcttaccctgattgtagttcaaacggtaatcaggggggctatattcacagctatcccagtattcccccaccgcaaaaagaggctttgattgctcaatgtattctttcacaaacttcgctgcataactgcactaaacagaaaattgtggctgatcagcatgttttaacaaagcaatttggaggtcccctatcacagatgatgttaacctatcgagttgactatttaccctttcgtgaaatcaaagcggaaatcttgaaaaccaatgctttctcgaagccagatcaaccagtcaataatatccttccgtacaaatggctgtgtatggtctatgttgggaaccccatcgaagttatcaccggtactttcgttgccctggtaataaagttgtagagacattgataatagtttattaacaaaacatggccattaagatacgatgcaattatgaggctgagaacaataggattacattgcataaaaacaagtcgattacctttccaccagaacaagatgtaacagcatgttcatcccatgatactgggataccatcataacgattatacatcccattcgatccttgagtagtcccaactcgatggttaataacaacatctgccatagctcttacattgtgttctttcattttccgaagcaatgcttgtaggtcatggagggaaccataacaagagtcgaggcagtacaggttctgcggcagatagcctgtcagaataaagggaccagatattcagaccacttgtttctgtaactagctacgagtgacacaatacattgttgactagcttaccttctggagataatgactgtgttggtggaggcagccacgctgatgtaaaccccgattgtgctaggtcaacaactttttcctccaaattgctccaccagttgtgcttatgggattcccagttaaaagcctgacagagtgagcgaaaataacaacataatcagaattgttcattccttttttgggttagggaaggcattagtcaggtagtccaatgatctacagaacaagaccagaagataaacaagccttaccaaactccacctggattatgagttatgacaatacataaataacaactccgcaataattgcacaagtcagttgacaaactactagtatgtatgtggtttccttctgtgcttgcagaacacatatatggtgattccacaatctaatttgtcagctccggcaaatttgatccatagcatgaaagcaaaaggtgtgcctagacagattttcacctggaacaggatttcccttccgtgcttgataattccacctgtcgaggaaatgccacattagaaaaccacatttctatcagatattcagataatcgactgaaatagtagggtgcaactttgtaactttgtaagtagaaacgaggaactaggcaactgagaattggtaggtaaagatgtgagccctgcgtatttaccattacgagcggcctgctcttcaaaattttcatccgaaacctgcaccgtttgtcatttcagggaaatcagaacaaagctcaaactcatcagtaaagaacagcacacacaatatgatctcaggaaacccactccgccgaactcaccatctggcccattcaaaaccacacaaccaaagccaacgcgcgacgacgcgagcgacgaaagcgccctagtagcaagcggctacataagtagctgaacggccgccgccgccgccgggagcgcgagggcacgcggagcgaggcgccgccgatgcctgccagaccagtgggcgcgcgcgcccaccggcatccgccccgcaaaaccagacggccgccgccccgcgcgcgtggcggcaaaaagaggaggtggtctcgcccacgccgatcggataggatagggttccggccaccagccgcgctacccaccccctcccctagggtgagggccccccgccgccggtggattggatggtggggattccgacgagcgaatcggcggcgatttgctgcttcctctcgtttcttcaggcgagaatttgttcttcccggtcgttgccttgatcttggctgcggagcctgcgtggagtgggagtgggaggaaggaatcgaattgctcagcttcttctcctgcaatcgcccatggagatttctggaatttgttctctcgggaacgacgagagagaccaccagagaggaaatgggccgtgacaatacgggccagatgccggcccacagtagtttatatgggcctttttccattgtgcatccatcacaaaattcggtttttttttgtgctacaaatcggttcaagtcagaccgcttgaacttcagtgtgtgaaacacacaatgcgaactactccagctcacaatttcccaatcaacccttgtaaatccaattcataattttcaatgaacagaaaattgaaaaggaccctaaacgtataccacaggaacactcatggtctcctccttgctcctttactggttttccgttaatcttccttgtatcaatggcgttcgacagcgacaggtgaccttcatggcttcaagtgttctaaacttcgaatttgtgattgtttgtgtgcgctttttaacctaagccttgaagctttcggaaaggtgaagtgaaggagaaaataaagcagaaagtaaagagaaagatagtagtgcagttgccgaatgccaatggcaacatccacaatactcctacaaaattcttactactaacaaagctctcaaccatttgattctagttggaagttatagaaaagctagattcaatcttaatatgccacatcagcattaataagaagtttgtaactttttttttggtacgtgtagctttttccttgcatggatatactcatataccttcgttaacctcagcgaattgggcctggtttaccttcctatgggtgccaggtttgtcatggtccatcagttgcaaacatgcttgcgctagtagtttcttactgacaacttctctttttcgtttctattctttttccatttttatggtttatttaacagcattggaatttggacagcaaacagcagcctcatgccaaacttctccaaatgcgtgtgtgttttatccgtttaggagaccgtgaagctttcagaaagggaaagtgagttgagagaagctaaagatattgcaatcctggacaagaggcactgttcacttgtaacttgttcagtcaacacagtagcagcaaaagatggagccaggagatctcggccggaccaatggcagcacgcatgcatgcacagcttttgcacctttttttccggaagctgaccaaagctatacccactggccagcaatggcgtcccggctgctcgctctagggccactcagccactgccaccggcaacaatggcatccatccttgaacccatccatggccatgggaccctctacacttttgcctcctcctcctccacttgctagctgtatagctttacactacatggtggacacctttagcttcacctgcaaaaactctctccatcatcaaatagaggaattgaaaaaaagggagagagcgagaagaattgagttccttccatccaaaatggatccgtctatccatactactgatgccaacaaagcacaaaggtgacactgatatgatattctcatctgtctagatacaacacacatctccatcatcgccctcactaagattgatagtactactagctagtagctgcctgcgtagtataggtaggtagatagaaaggttcgagcagcaaaacagcacaggttagccaaaggcaatgtgtaaagataaagaagaccaccatggatacatatgatgcggtttcatttccctgtggtggtggatggtgaccggtgtggccggcatgcacctctccgccctccggcgcatcgatcaatatatattcagtaattcagatatctgtagcttttcagtgggggcatatgcatgatcgaaagcatccacaaggttggaaaaagacgcatggaatcatggaagggatgagatcgatcgatcgatccgtctcagacacactcacggatatatatttatcgatcgatcacacagtctctcgcttttagcagcagcgagccagcgacttttggcctcaaacgcaggatttgttgccattttttttttgggggtcagaggagtcgagtcatggtgtgcagtgtgctccaccacgacacagagaggttctcggttctcctctcttttttttatctttttttttccctttggatgcatgtcgagttctcatctcatctcattcatagcatcgcatgtcatggcatgaaagatgcgggagagagagacctaaataaagatcacatcaggaaacgcgcttttttcttcaggctttgtcaagcaagtggagcgttgctagtagcagtatgtggcgcgcacagtttggtcctaaaactcccactcgtgttgcatccaccatcattgtgcatttgattcgtggcgtgctgtccggactcgttggacgtcgtggagtagctcgatgcataattgcatatgaatgcctcaatacttgtagaaaaaaaaactactccattcatcccaaaataagtactttctccatcctaaaatatatcaagttttgtttggatgagtactagaatacatctcatccaaacaaaagttattatattttgggacgaagggagtatatactcctaaaaattagagagagtgcatttattttggagcgagagtagctagtaatgatctctactactccatcttttcatacgtttgatctttttttagtcaaatcttgttaacttgatcaagtttatagaaaaattttagcaacatctcaaatatcaatctagtttcactaaatctaacatagaatatattttggtaatattttgttttgtgttaaaaatactactatatttttctataaacttagtccaacttaaagaaatttgactagaaaaaaacttaaacgacttataatataaaatagaggaaatgcttaggaggctttatctgtaacggttcaaaataaaattcagtaaagttttgttgatggttttttgcgctggtcacgacgacaatgaaataatcggtgcgtgcatagtcactaaccgtattaatcttgagagacttttaatcaaggggatattaacttggctggcaggaccgatttagattaatttggggtaaaatgtgaataaaacggaaggtttccaaaacaaaacaatgaacggattctaattcatgaaggacggacgatttacagcataaaccaatgaagatgcactaactcgggctaaaactagagcaaaatatactagtatgaaaaaaaagaacaattcgatcgatttattatgtgtgggttgattggttgccattataaagggtttgggcttgcaacactgagcctctccaccttctagtggtttagaactcaattatgactaaaaaaacctcattccaatggtttacaaaaaaaatgactaagagcctaagttaaaaaatatagaaattgctttaattatactatgagacgaagtctgcggctgatatcacgcgatctatgccagttagagcaggtacaatagcaggctataaactagctataaccacatatcaagaagaaaaaagaagagagagaagaaagtgggctacagatttgtagccagctacaacacggactccaatacgttatatgtgtataagaggtgggaccaaatattaatggtgtagtatattttatagttaactattgtataaatgggctattagattagttatagatgatttagagctagtagttggctatattattaaacttgctcacagaccgccatgcagtttatttatcaaaccggccatcatgtctgattggtctgcttggtcagaccgatcccatactgacggtcctcaaaattgtacatgttatagtataaattaatttatctcaatatcaaatttggtcgcaacatgttcaaaaaaattgctactccttataagtcgtttgactttttttttcctactcaaatctctatagtttggccaagtttataaaaaaaaaattagcaccatctacaacacgaaattagtttcagccaaactaatatttcatatattttgataatatgttcattttgtgtaaaaaaaatattgcttgattttttttctataaatttaatcaaatctaaataagtttaactatgaaaaaaagtgaaaacgactcataaaattaaatagaggaagtattcaaatggtcgaatattgttgattaaccacatttcgtaacttagtttatcaacgttcaaatcctaatgtacataaatatggttttatacatcatttgttggtgcatagggtcggaagtttatagttttgttttctagaatttaaccacaattcacaatggcaaccgtttaattagggaactcgaaaccgtttcaaactcacatgctaggcaaaactcaaaacgtttttattgagaccgtcttagggcagtcacaaccctccatttaggatggtgtctatggcattaactatattgtcatgtaggacttttagcttatgtggcactatattaattaagagagagagtgaagagaggaagaaactgggtctcatgcaagacacagcttcaacacaagaaactatacactagacactatcaagttttgcattgggagataatggtgtcttcataatagatgaagaataaatatgattggtaaagaagagagatgatgtatttattaatggtccactttaagaaaccatgggttgtagagtgtagtttctattgtgtgtcttattgatatggcaccatagacactaattatggacactatgggttgggactgcccttattagggatgaagcgtttcgtgtttgggacatccatttctgtagcggggggattcttctagaatcagagaatgcgcgtactcgtgatcatgcagaagttcccaaagcctcttcccaatgcctgtattccactttccatcgccacctttggagatctcaacatgattctgattccatccacttatatttatttttttagagaaggatccacttatatttattacccagactcttcctttttttcccccacctgatcgagcaatacaatcatggattcccctccccatgaaagttacgccaattcgcttcccgccgcgacacgatcgatcgattccaatcggataatccatcagccatcatcgcccaggacgcagacggattcgccatttctgccggtgaaaaccgaaagtgaaggggggcaacaaaaagaaaaaaaaacgccactcacgcctcgctcgccgccgctgcttttcgcggccgaccagacaagctcgatcgaccgatcctctctcgcgctataggccctgtttgaatacaaggatatttttttttagcccttccttaaatagtccaaatagtccaaaaggatctaaaagaatgagttatttggaaataacccaccaaaaaaactattacacccaagaggtgctaattggagctatttcgggtggagctgaaaaagtgtcttttctcttcctctttcttcatgggaagctgcattaaaggccgaatagatctcaaaataactctgggatccaaacaaataagagctattttattgaagggctattttcttgtgctaaaaaatagcttttaaaataattcttgactagttctccaaacatggtcatgagcttagctgcaatgatcatggttgaaacgcaaggaatcgtcgaggccatcatcacaagttggcgtgagaacaatctcatgtggtttctatcactgggaaaaaggggaagagggaaaaaagcgcacggacgattctgctcctgcggatcgtgttcttgcctagaattcggccatatcgccagcgaatagcaggcgactttttcacgaggaagcaaacgagcttttcttttttcacgggagaaaatatgtcccgatgactcgacgagagcaaccccccaaaaaaagcacggatcgacgcaggtggatgctttgataggatggatagcacacgcaaaatttttcaacggcccatcaagaatcccaaccaaggaattgtgcgaggcccacattccaagcacttttcctcctcttttctttgcggggaaaagcgtgcacaacctctttttccaggcactgcatttctgggattcttcaggacgacctccaactagagtactctattcgttgcttccgcacaagtttttttacacctctttttaggttgtcatcagtgcctaatccctgattaatcccactgtctaacaaaaggttgctactgctgataatagtctcccataatgggcactagctaattatagctgctatattctattctactccaccttctttagtttagtactctgtagtacagtttggtgttttattgtgtgatctctaggtaaagctaggggagatgcaaattgtgttgtgcatccaaattccaatgatgtggacttcacaagattgtactactaataacatattcccatcatgccttttcttttttccaagtccactgtaggctttcttccaataaaacaacatacggtccacttcagagaaagagtatcagtagcaactaaaataacattggagatggagctggcaacttgggttagattaagctagagggaaccatatcttaagatcgaatctattgtcacgtgtttgctcagcgtaactacaaaggtgacaaggcaacaaagtgctcgggtttataattgactactcctttgataggactattatatctggattcttggacgcattagtgagtccatatcttacaggttggagatccactaccctgcctaaaacgtaattgaacacagatggcctgcgtgaaagtagggaaaagcaggaacttagtggaattcttcggtacaatcaaaaacatgtgaattggtgaaaatatatgatataatgtgggagtatccgttaacttcagcgagaaagaaaagcggaactgcactgatccttcaaaggaaatttcggcaagaggcttgtaaccacatttttactccagttttcacattcggggccaaagggagtttccattagtttacgtgaaagaacagcagtgaccagtgacaactgcggcgacaaaaggcagtacgcaaaagagaaccacaggcagtggccagtgatgacaaagttcagtgcaggcgaacaaaagaaggcaaaaacaatagagcgggccggccagaagatctcgtttgctcgatgactgtacccgatcgagttgtgagctgggtgcgtactgcacagttaatgcccgtcgtgcgcgaaaatcggcgtagagataagctaaaacttttttaagctcatgtttagacgctaatttagaatattaaatatagactaataaaaaaactaattttataaatgagagctaatccgtgagacgaattttttaagcctaattaatccataattatcaaaagtttattgtagcatcacattttcaaaatcatagcgtaattagacttaaaagattcgtctcacgaattagtccaaggttatagaatgagttttgtaattaggtggtgtttggatccagggacttaactttagtccctctatttagacattaatttagagtattaaatatagactacttacaaaactaattacataaatgaaacctaattcgcgtgacaaattttttaagcctaattaatctataattagagaatgtttactgtagcatcacataggctaatcatgtattaattaggctcaatagattcgtatcgcgaattagtccaagattatggatgggttttattaatagtctacgtttaatatttataattaatttccaaacatccgatgtgatagggacttaaaagttttagtcccatctaaacagggtcttagtgtatctttaatacttcaaattaatatcaaacatccgatttaacagggacttgatccgatttaacagggacttgaaataagtataggaagaaagctactcctactcctcctagtagtagtagtactagcagcgtgtatgaccagtaggagtacgtgatacacgtcatagactagcgtagcagtagccgaaagggcgaaaagctactcctactagtaggagtgtacgactgctgcggctagagtagcttgcgagccgatagcgtcgatcccgtcccaagtttccaaggtgtacatacgttgaacgtttcttgccgctgctgccttgatgcgtcacgcatcacaagggacaagatgcaaaagcaaatgcaaaggatggaaaagctagcaaagcgaagcaaagctatagcccagctccgacttccaaagacgttcttgaaggtctcgctttccatctctctacccctctcatccccgtcgtcagttctggaatcgtacatgttttatttacataaacccctcttgtcactgatctactagtgcgatcagtacacgtaactttctccgaaaacgccagggcttggcttaagcgacggcagagaaaggttagtagatcgagtaatgcagaggagagtaggcaggcgtagacagagataaggcttaaaagtactccaaacaagtctatcttctcgtcatgtggaggcaactgctacccgtaatctagtctaatctaatccctcatctgctgccgtttcacgcgcaactactacgacagcctgcaactgcaaaacgaaagttgcatgcccaggcgcgcacacacaaaggatgccatatgctgctttcagctctcgtctctttcgctctcgctggcagcgcggcaggcgcgttcggcgttccacgcacacatcagacgcgacgcgacgcagtcacccacttgtgctcgtttcagttccgcgaccaagcatcatgcgtgcacacacgtgatcgctaggcctcaaactttctcaaaatctcgacatctcaccataatccctgttaccacaagtaaaagcgaccacggatcgaattagccacacggtaaaatttgccaccgtttccgtcgagtccgtcacatggggagcttccggacaaagtcaaatttgtaccgacagagatttgtaccacatgtacctgcatgccatttatgcgctgtgggcaagcagtggccgtgcatgcagctgcagtgcacagtacaacgaacaggttgtgtttatttcagtgtgtaaagtttagattttggttgaaattgaagatgatgtgaaaaaagactaaagtttagatcaaactttggattaaacacagcccaagtaatccctcacgcatatacggatcacccgggttcggccgatgcgatcacacgatgccgaggcgcccagtatttacgtggggtgggggcacacagcgcaagactagtcaagatcacggctcaaccacaagcacggcatgacaacattggcgctgcaccgcagcagtgcagctaccactactagtatgatatcttctacaccggggcgctgtacgagtagatttttgtgcgacagtaatattctcggcttgcagcatcttttcacatggaaaaggaatagtgcaaaccagccaaaaaggtacacacaagattggagtgctacagtacagtgtcgacactgcttttcttttaaggctagacctggtgcatgcatgtatttcatcgagaatacaatcgggggttttctttaccacaaaaaagttggggctaatcatgtagaagggggtgaagggttatggacagcaaagtagggttagctgattacattgacaggtaaacctacaggtaataacaaaagaggatttaacctaaactagatgcaactttgtgggtgacttctactggcgtgcaacaaaagctcagtgtccgccaagatcacatgggtggggtgacgcacgtgccgtgccgccgtggcgcgccagagcggccgagaggttgggggaagacgacgacgacgacgaggagcttggccacgcgcgacgcgggccaggctggctctcaggacagcaggacatggagcgaggcgttcttggtggccgcgcacaccgggcaggcgtcgacggcggcctcgcagccgcggcacaggcagaggtgccggcacgggagcagcagcatggacgcctcgccggcgccgcacgccttgcagagcgcggcggcgggggtcttggacgccgcgtcatccgcgccggcgttgtcgccaccgcacggggtctcgtagcagcaggactgcgcgtcctcggcgtcgccctcggcgccaccggcgccggccgcgccggcaacggcaagggcggcgcagggtgactggaggagctgatccagggtggcgcggagccccgcggcgacggcctcgtggctcttggcgacgctgagccacgcctgcccctcggcggtcatctggcgcagcctctcctcgagctccatgttgcggcaccgcgcgcgctcgagctcggcctccgcggcacggagacgcccggccgcggcgcgctcgacggtggacaccaccgcccgtacgtgacgccggcgagcctcctcgagccccgcacgcatccgctcgctctgcatagccaacatagacgtcgatcgagtcagacacccgcgcatcacggcgaaccgatcgaacgctcgatcaaaatctcgaacaaggccgtacctcgagtcgcacgagcgcgtcgatctcgacaccctgatgatagagctgagacaggagcccctgcgagaggccggcggcattgccagccctcccgctggtggacgcggcgccgcaacccaccgccctgctctgcacatccccgggaaagacaaggccatggggcggaagaaccatgcgctgctgctgcgccgccgccgccgccatcaacgccccggccgactcatccgcatccaggcgcgccctcttcctcggcacgaatccgtatcccgcgccgttattgtcgttgcaggtaagctcgctccggggaaggtcgctcagcaccgtgtgccctatcccagccgcggccgccgccggagtcgccggcgcgcacccgccgtggtcgtccaagaacaaagaacccgccgccgtcgcaccctccagagccctgcacaggccacaccaatatcagaccacgccatcgatcaaaaccaaccgaggtgtcgatcgatcgaacgaagcgtttacctgaggccatagaggtcgtgggggaaggaggcgtgggagaggtactgcgcctgcacggccatggaagagagagggagcggtggaaggagggaaggaatggcgatggtgagttgggtggggggaggagtggaaatggaaaacggatggagtcgtggaggcagatgggttagggggagggagggttatatttatacggcggtgaggcgtggatggaagacacgttgggaggtggggtggcctgcgaggggacaaaagctgtctgcctcgttttattttggacgtgggggaggcaagcagcagcaagcaacccaacggatggatggctatggcccccactctggcctatcgctttctctctctcttttttcctcggcttcaataatggtcatcgtttacggtggaaatcttttggctcttttccctttctttttccctgttcggtttttgttgcctggtgcgggggtggtgattgattcgtccggtgtgacgtgagatgtggagagtggggctgctgctgctcgctgccttgtggtggtggtggtggtccctctcggtggagtactattaaaggtggcccactcgcctctgggaggttgacgctactctattttccgcttttctttatttatgctcgctatcttcagcgcctaggctgttgggggaggtaatttatgaaccacccaagtcctaaccgatcgatttatatccggttcaacgtgtattgtggggataaactagacgtcctaggaagaaatcatgccatcccagaaagatctagtctaccactgcatttataaatttttatattgtttggtgtttacctgaaccaattattaatgcaagattgtctacttgagcagtggactaaagcataggaaccgtatattactctcttttctccagattcgatgcagtttcagcggcccaagccaaggagatgccgagaggcacagcacagcagacgtccccacgcacacacaacctaacctaacccatctcatccatcgtgggcagaccattgattgccgggccgcatcgtccatgcttgctcggcgcccgggtttgaatacgtctcccgaaacgccaagtgcgtgatcacgatggccccccggacccggatctggactagtttggccgcaccaacgtgacatcaactcattactccccgaagcaaagggcgttggctcacaaatgatactccttttatcaatgtacggttacacgctactttatcgtcgtacggttacgctacagccctcaagggggccttttgattccgtttcaaccgggcggtttgtttactggagaggctttctttttaagatccgcgagtcgtacggacgtttaaatattgttactactacaaccaccgaggttaataaaaaccgtcaccataggcttcctcggtcaccggcacaggcaggatgcgtgcgtacggcgtcatttacgtcggcccccctgcgcggctgcgccctctttggtccgtctcgcacggtgcggtctcgtttgtcctcgcacgcttgatggctcgtaccgaccgtgctgcaccatcgcgctcgctcaggccggacggacgggcagggcaggtcatggaccacggccgtggcaccgcacgcacgtgatgcggttggttcagctcggcgcgcgcggatgccaccaccctgtacacatgaccgtctctctctctctctctctccacaccaccgccaccaccgcgcccgcgcattaacgtcgccaaacgggaacagcgtgacgagcggcaggccgcagggcggggaacgtagtactgcctcctcctggccactgtcgctcgccggctggccaccagtagaagcagtacgtgccaccgggcgcgtcgggcgcgcggccggtggcccgggcctcctctgccctaccgcgacaccgccgcaacaatcacgagctcagaaagcggcattaaacagccgtgcactgcacacaacatgcgtccaccgccaggcgcgcgccagctgctcgcgtcaggtaaaactgctcctacgggcactacatagccgtggacgattaaaatggatcgagtccacgcaactcaatgtgcatgtatcggcgctcctcctctccactcataagtggctgatcgcatcgcgtgcatgcatgcatgcatcgcagggcccccccgaccggtcgcgatcccgcccataatgccgcaccatccttaataagagcactgatgcgttaggactagcgctagtatggataccagcagcagcagtaccattgctggtgccggacctccgggcagcctcggaaagcattgagccacacccagccacccatccatccgtcccggccgtatggatctcgcagtatcaatcaatatgttacgatatgatggatggctcgtacggggcgcgtaaatgggaacagtagtagtcgtagcatggtggatggtctccgtactgcaaccacgtctgttcgaggcgtaaggtcgccatgatcaagattcgtgtgcagctaagcgagaagaagggcccgcgtcgccagagacacgtagcgctggtgcacgcacgttaatgctacgctacggtactgatctctcgggccgtgggaacagtgcgattccccgttccttccttatcgcctgctcccatgccgggcacagttgtccagccggcggacgggtcacacgcacccacatccacatgcgtgcctgcctctgcatacttacgcatgacgcgcccgatccagcctacagtgcgtctactcgctcatgctatcactactgctgcacacagtgggttaaattgacacgtcccatcaatacacctccctgctccgtttcggggcgcgtacgttcgttacgttgtggcgcgtgacaccgccgcgcgctcgatggtagtatagtgtggaccttgcgagccgggcgcgcaacgctacgcaaccatcaccaccatgggatgctacgagttgttgctacggccaaggatgagtaccaccaccgccaccagcagcagctgaagtctgggccagagcctatacgcgcggtacgcgagctggtgtagctagtgggaggcgctgcacggtgcgcggcgccggtgggcgcggtactagcgccacggcgcggcgtctgcgcgctctcctgtgtgcttgtgtcgcgtggtccacggccggggccactggctcgcctgtgggaaataaggtgggtgcagttcacagaataacatgccacggtgcggtgctggacggttgcgactgcgacgagtccggcactgtgcggtgtcgaacgggcctactagcaggagcgcattgaaagtccctgtgtaccgtcaaagcggtacggcaacagtgtgctgatgatctgataaagttgcgcactgtgtttatagatgaagtcgctgaatcagggtgtgtttagttcacgataaaattgaaagcttagttgaaattggaacgatgtgatagaaaagtttgaagtttatgtatgtagaaaagttttgatgtgataaaaaagttaaaagtttcaaaaaaaagtttggaactaaacaagcccttagatcagcccacaatactccatgcaagatgagcagcctatgacaattattgctttgtcaaataaaaataactataaacacctgatgtgataacaaagttaggatctctttgaatcatatgaatgaaaaaacagagaaatgagaaaaaatgttggattaaataggaatgcgggtgaaaaacagaggattgcaaaacgcagaaaaaacacatgaatgaccgtttgattgaatcgtaggaaaaacgcgggaatcggatgagagggatagactcaaagaaaagtttccaagaggttgaagtttttgctaaatttcctttaaaatctctataggattatccattacatacgaatttcaaatgataggataggattaagtccttttgtttcaaaaggcttgaatggaaatttttttataggattgtaatcctccaaatttctatgttttttccccaaaatctactgagcccttaaggagaagagaaggaaattcaaaggaatcgggtctcatacaaaatctacctcatgcacaactccaaaatggtagatccagccaaaaatacaataggacaggctacaattttcttgtcatgggctcctgtacaccgtgacctcaatgtagcataaattttttttcctcgtctatttaaatatatgtataactggccttccaaggtttcgaataatcgatacaatgtggctttggagtgaacaaacatagatagatttgtaacatagccaatcctgaatttatatttttttcgtacaaaaagatattacgaaatgtagtacttttaaagggaaaagaatcaaacgattggcttggtgagagaatagagaactggaattattctatactccctccgtactcacaaaggaagtcgtttaggacaatgtttaagtcaaaccttgtgaatataaatcatgaataactctcaagttgttaagtttgaatatgtaaaaattatatgaatagatttgtcttgaaaaatactttcataaaagtatacatatatcacctttcaatgaatatttttatagaaacaataagtcaaagttgtattttgtagaccgtatcgatgtcctaaacgacttcctttgtgagtatggagggagtactaattagtgagggcagcataagcatatactagtattactccctccgtttatttgccttttcactttgatcaattttctaggtgatacttctccactacagttactaacggtgacgtttttattttgcccttcgaggtacaataataagatttaagcatatgcaataaaaacctctagaatatttttttcaaacaataaaatcagcgtatccaaccctaagggcattttgagtgaaaaaagatagaaacaatctcaggggactaaaacttccggtctcaagtaactgaggttcaagactgctttctctgtctgaaaacaacgaaagtggacctgaagttcccgtgcttacgacttgtaatttcagtagatttgacttcgatgctaatgatttcaagtaacgcctattcatccttctctatgcgatattaagctcctttcaagagcgagtataacgtattgtcacaggcacagatatccagattgcgagacagtaattaacgagcttccactagtaatggtgtagtgtgatcatctcgagattgaagtcgagctctcacacctcgagcactatcttgaggtggctttatgaggacgatggccttgtggggttgtgcaccatttgtggcggccactgtggccgccatatcaagaacattattagcaatgagcgcagggacgccattgaaggagtgcaaacaaagacgagaaatacaggtgtggatagcactcaaagacaccatgcggtagatagagatagaggcagaagaagataggaggataaatgtctgacatgtgggcccaaatagatttatttcaatctattatgcaatattgatgattggatgtacacacggctaaaatgacttaagatgacataggacaaaatcacatactatgtttcatccggaggcaattcgctcggttttaggggtgtttggatatggggctaaaattttttagtccctgtcacatcggatgtgtaggacactaatttggagtattaaacatagactaagaaaaactaactaatttcataaatgagtgctaatccgcgagatgatttttttaagcttaattaatacataattagcaaatgttaactgtagcatcacatatgctaatcataaattaattagactcaatatattcatcttgtcaattagtccaaggttatggaatgagttttataattaatctatgtttaatactctaaattaacatctaaacatctaatgtgatagggactaaaatttagtccctatgaaccaaacagggccttagaagtttagtggtatcaaatatcttatagtattaggggctgatcggtttagctgggctatggttgcacagccgcaacgctgcagcccttctagcctaatttcgcttgctgactcctgcagagctgctactgcctgtttcgaacgaacccttagagttaagagaggtaaggctgcgttcgtttatgttagataagttgaggaaacaactcgtttttcgcgcgcacgcttcccaaactactaaatgatgtgttttttgtaaaaaattttctataggaaagttgcttaaaaaatcatattaatccatttttgaaatttaaaatagtttatactcaattaatcatgcgctaatgactcacctcgttttacgtatcttctcaatcccctatctctcaaactcacccaaatcatgcttttatgataatttagacggaaaatccgattgaaccatttatttattaagcatatgcttaatagtacgttatgcaaaacttattaagcatatctttgatgtttagcattaacaaccctaatgagtgtactgtgtacaacgcagtataagtgcacctagccggtctccccacacagccctttcggtaggatcgtccgtacatggcacagcactttttaggatgctgcatgctgtgcaagcaactgcaaatctctgcaattattgcagcgttacactgtactacaccaccactgaccacccccatatcccaatccatccatccagcaaccagcattactgctctccctgtcactttggcagacgagatccacagcatgatgagatagccatgcaatgcatgaacttgtaccacgacgtgtgtgtgtatatcgatcgttgtttgctgctttgttgcgtgtcgtttggtcgaggtagcgatagtagcgctgctccttctctcctctcctccgtcctcgttgctcttgctggtggcagtggcaggttgccaactttctcgcttttgcctgcgactgcgaggcgagggctcgcagttttttgcagggagtatagagaggtggagggaggagtagcagcagcgtgcagcagggcccaggattgtgggggaacagtcagccttggtcagaccatgcatcagatgctgctgtttctgctgcagctgctgggattgatggctccatggggcaggcacaggcgcacagctactagtcgcaacaagttttgcgctgtacgagcgtgctctactactagtagtagtactgcttctccttacgcatcatatgcatgcatgctaacgctgtgctgttccacggcaagcacggtactagtactactaccactcctgtccacaggggcagtgagaggcggtatgggcttgcttgcgtagtcgcgccaggcatgagctgactcggctttatatactacagtatgtatgctgtagagatctggatcgtgcctgcccggacccgacgcattccggcaagacccgttaatcatgctcgggtcagtgtctgccatgagccgtatggctagcatcttgttagctggatactaactatgcctcaagataaaaataccttcccctttaatcgtagaaataaaaaaactaaggaataagaaaaaatataggattaattagggcctctttgaatcgcatgaacaagaaaacgtaggaatagtaaaaacgtaggattttgataggaatgtaagtgtaaaatagaggattgcaaaacacaggaaaaacacaggaatgaccgtttgattggaccgcaggaaaaacacatgaattagaaaagagataaagactcaaaggaaagttttcatgagcttctacctcatgttagaattccttcaaaacttgcattgcattaggtattccataggaatttcataggattccataagatccattccttagattcaaagggctatataggaaaaattactataggaatgaaatcctctaaaattcctatgaatttcctttgaatcaaagggggctttagtgtgtaatgagtcgcatatttgaattttaagcattaaggtacaatgggctgtaactttataaaatgtatagataagggacattttagtcttttcttaatttttaaaggattgtttggttgccacccatattttgtcataatttttcacgcctaatatttagcaaatttaactaacttagataagtgtttggctccaaccataattatgtaaaggtcttcttctggcaaattactagtaggtcccatgcatgcagtaacaaaagatgcgcactgtacgttggcctttctgcaggcgattttgccaccgtttcccggagcacgggagcacggcgttcaccaccgttcgttcagccaggccatgcctgtcgcgcacagctacagacatgtttcatccacactactgttccccgatgctctccccggccggtgcacgcatcatgtggcggtgggtggatgatgcccgatcgatctgatcgatgagatgagattgcaggggcgcgatggatgttactgatcgatcggatcgagctagctagagattcgtcgctacgctactcgtcgcgcgcgatcgaagagagcaacgggcaccatcttagcggtggtggtgggagctagcagccgatcgagtgccggcacgccgcgctatcgggtagtcagggtcaaacgaacacacaagggctataggataggataggagagggacacatcacgcactcgtcgcgcgtgcatggggccggtatagcgcgcgccgtgcctccgccgcagcgtggccgccgcgctccccgtagcaacagtggactagtagctcgctggtggagtggtggtgactggcgagtgacagccactggtgtgccgtgccggccagccgtgcagattgctcgccgagggaggcatgcactggcacgcgccacgtacgggcccaggcccagcgaccgcatatgctggtgtgtcaccacgggcttaaccaaccagagcagtataagcatgggtatgatacgtacagatccgtttatgatggttgcatttccccgggaggtaaaaaccgcggggttcatcggcgttgcctgcccagcgctacctttctcgcatagtcgtatgacgctgtgctgctcgcgtcagggctaaagataacgctggcaggcagtagtacacgttaaacatctggaacacgaagagaagagtattaataatctgaaaaggggaccagagaaaaaaaaaacccacgcaggtttttgagactcggcaatgacaaacacaatatttttttctccggaaattaatgatttgctagtggtacctgccaacttcatccatgtataatctttttttttaacgactcgcactagacggtgcgaggttatattgatagagcagaaaaaaattacaagattacaaccctgtaaggtcgtaaccaggaaaaaagaaaattataccaccacccacacaccgacagcgccaacacacagatccaggagaaggctagcaccggaccggctgccgctaagcgtgaccgaccatcgctaggccaacaacagaacactgccgagatcatccaaaacccgacccatacaatcaacacaaagccaactctatccaagacttcaggattcagggagagagggtgagagagaagatggaacacctctcccccctaggcccttcgacgtggccaacttgtagaaactaggacgccgccataagaggatgagaatctagagtgtgcttgcaccaattgctcagggggtttcggcaaggggacgcctagacgacgtctccaacgagagaagcgacggaacaccgccaccgtcatctgtcaaggtttcaaagagagccgaaactgagctttcgctcggcagccatccttgaggggcgagacggcacgacaacgccctcaggaggggaatgacgctcgaacgtcatcgatgcttgtccggccaaggccgggctgggttttcacctgccatccaccacctgtcgatctaccacacatgtaccattgctccatcgccatccaaaacctccgccggagcgtgggcaccactgcaccggcaccccccgccggccagtctctgcgcgctgccatcagtcgcgcctaccgggccactggcctctcctcccaccgcaccggccactgcctccacgcgcgggcagcctcgtcgcgccgcaccggcacctcgaccgcacctccacgcaccacggtcgcctccgctgccaccggccgagcctcacttgcctctgctctcgccagtcgcacctcctgcacgcgctgcctccgccgccgccggccgaccagccagccagccgacgctcctcctcccgccagcgccgtaccagccggctcattcccgcgcctccacctcagcgcctgcgcctccgctttcgcacagctgcgccaccgtctccgcacggccatgccatgccgcctttgcctccgtacggccacgccacagcctcgccctcgccagctctgcacagccgcaccccgccgcctcgccgcctgggggtcggggctcggcctcctactctggatccggatagaaggggaccggatctgggcaccccgccgcccccgcgcgcgccgccgccggctcggggcagccctcgcgccagatccgcgcagcagactccggatccggcagcgccgcctcgccatgtcgtttgcgctcgccgtcgcccaacgccgctgtcatcgccccgaagataggtcagggctgagggctaacgccgcgacctcgggggagaaggccccgccaccgccgtccttgcggccgcggcacggtttccggcggcccgctcgggcagcggcgaggcagaaggagggcagcgaggggtggtgctgcggcggcggctgagtcgcctcccatgtcgcccctgccctgggtccagttgcaaaactgacattcgaaattgcagttccacatccctgtataatctaagtcacttacgtaataggggacattgccaatatcattaacatcgaagacttatatgcaaaattttttttgaaaatgatctacttttatttaaaaagatatttaaaattagatcctcagtgcgagtattattggtgccaagggtctatttgtaaatacaatttgttataaataggttatttttttaaaaaaaatatgtccacggtgctaaagttattggcgtcatcatgttagaccatggcttaataatgttggcgcggcgaaaatgattatttttcaaataactttttctatatctgtctataaaataagttttttaaatggtctaaaatataaaaaatcgtgtgagatggtaacagtaatttcgggcggcccggaacgacaatgaggctttctgaatttttatactggagtagtatttaagtcctataggcatttttttttctccgatcctttacaacaaactatcgacgggttataccttcccacggtatttatagagtatatggaacgttagaatcaagatatacacaagattgtatcaagtagacaagagacaaaaagttatatcgattcaaatctcaagatgacttgcagtttatatgtattgctagcaggattcacatggattacaatgaaggacaaagaagcgacttgatctaatccatcgactagaacccaccgaggacgactcagcaagatttaatcggtgactaagactccccgagaacgactcagaaagatttaatcggcgactaggacttcggcttcctccgaattgtatctcaatgtggctctggttatggctgtaattcgatgctcttctccacgagggaggtcttatatttatagcgatgatcattttttttccaagtagaatccgaagaattaggccaaaatatagactaagaagatcttatctaataggattctaacgcatttttccgagaatacagttttcttctaaatttacagtgttgctttaattaaaagataacttctcgtatatcattagatatataatacttttatatagtacgataaagtatctgaaatatctttcgtataaaatataagggtatgtcttatcggtatatttcgagcttatgcgatgactttgtgaccatggtatagcagtacatccaaatattactccatctatcacgttgacgtgcaggtgcaacaggcacagcttgacgatgcgacatgaagcgtacgctagcgacacggagcatatcacgtttcggaccccaaatagtattcggcgttgtacgcgtggtttccgacgccgtacgtgccggaacctatcgctagcttgtacagtactactccagtacatttaccggctactcgtactgccacggagtaatactgagtttgtatctaaacttcagtactttttcatcatattatctttaattttaaccaaaatctaaactgtactttttcatcatattatctttaattttaaccaaaatctaaactttacgttgaactgaacacagatgaagcaaaggaaagaaaagatcgtgcctagtttaatctagaaggcgagagggagtgaattaaagcaacaacatgtgttaatcattttcttaatatgtcagtttaaggtgactaattaatccaaccgggacggccgggtcgaagagttaattattaccagtactagtagcagaagagagcagatggacgtgtcgatcatgtgataagtggtgatgtatcctcgcggcgaaagtgatcggcgaacaaagcgtacgtgacgcgtgcgaccgcggaaaattcgtcacgtcgttttcggcgggcgtcgctacctgccgctctccgctggtcgctgtatgtttttgcttgtccggtgccatttatgccccgtaggtggtggctgcttaagcttgcagataacaacaaaaatggcttctatccttgacaccgaggttgatcggtcgcttccttcgcttctagtggcccgaatcttgcgtttcagctacaacagcgactcttcaaagagctactggaaagaagaaaaacatcgcgtcgatggacgattctcctacttaataaaatagataaatagcaagaaggcaacataaaaaaagaaagctactactctttgtctctaaaataagaggccacaaaaatatcataacctttatgaatgcataaacaaaacggaaaggatatatagtaatggttggatggctaaattgagaaaagaaaagaaaataaaatggtattaacaagtttaatagaccgtacatattaaaacacactatttgtgggataaatctaaaagttatagacacttttttaatgagggaataggatattgttgattgagacaaacaaaagcatgtgaaattacatagtacactttatcttccaaaataaaaaaatgtaaagctgtgggatcagtagtacaaaggcagttggtgtatgccaagaccccgcagtaattttctgaccgtgcaggaaataaatttggtccctgtaaagtcccagccaaaaattactcccctactgtatcccaagccagccatggcctggccattggccaacccccacctcatcgtgtcgtgttgcggtgtggccgtagccatttccaacaaccttttcgcttgtccgaaagcacaagtgggggcgggcgcaggccgtgggcccccagcttggctcccatttcccggtactgattcctgaaagccaccacacacgcgcacctgcacgccgcatcgccatctctccctttcccccgtggacaaacccctccggtgggcccccaacccggatccggccgtgcgacgcgcgcgagaggatattatcgttgggcccacacgacaccctgtattatctctctctctctctctcccgatttccccatacgaaggccaaaaccgtaacgattcatttctgatgtggtcgttccggttacacgtagggtgcatgcaaaatcgcaatccatggtttgtgtattttttccgtctcaaaatataacaattttaactctcaagatttatcctaaaatataacttctccaccaacattctcttttcaaccaatcacaactctccaccactcacttttcctacctatctccactactcaatctatcacaactctccaccattcacttttatctacttttttaataaccgtgtctaactttaaaacttcttatattctaagacggatggaatattatatttcctggttgaaatgaacctgataatgggtggaaataattgtactccgtagtaattcttgttgttcccctgcagtaaaaagaaaaaaaaaatctttgtctattgtttttcctactcacgtatacgttcacgtaagaaggggacattgccgtgtgtatctcgctggccgtagagcacgacgagatggtattaaatgcgtcctgatcccgtacgttcagaagcggacataggcatccggatcctttagctggtgacacatggattcgcggctcctctgctttgttcttgagcgagagtccccggccggcccacggctcgctcaacttgcaaggtcgcacaactcacaagcgttgcctgcgcagctaccgttgttgctaataagatactactcctacgactccatgtctccatatgtgtagacggctactagaattatcaatcgtgtcttgcttatcctaacagaagttgctttgccaactctctctgaaaaatctcttcagagatcagaaagctgtatgatcgaatatgttgtactctgtttttagttgcaataaatttctggttctaaaaaaaaatcgtggcctagccgacgacgatgcactgtgcgcgcggcaaacaaaagcgtacgggtgggggcatggggagatcgatcgatcgacctgctgcggactgcactgcagtgcacgtcatcacgtgggtaagctggtccttggacagtggccgctgtttgcatgatgtgcacatgccgtcgttcccgagttgtttgctaatcacggagcggttaggatctaatcagaaccactacaacgccatgataaagtggacgaattgattagcatgcgtgatgtagatcctacgtacataccggccccaccacacactcgtagagtaatcaaaatctggtagtagtaacagtcaaggtatcacaaaggttttgcatgggtgacaattctgatgaaaaatactcgatgaagacaagatccatccacccatcaatatgcctgccaagccaaggcaggattgatagttgtactagtcgtttgatagggcaacttgcggggtgcaatcgtgcatgccaccttatagtacgtgacaccaaccgtacgtttgttgcgtccgatcgagccaaaccagcagcacatatccctgcacaatgacgatgccagcccggccaccacgatcgatcgatcgagtcagatcactcatcgacgacaccgatgcccgcccgccgcgcggatctatcgagccttgtcgtacgcggcccaagtggccgggtcgccaaccacgccgcacgcgacgcgcgcggccaacgcctacatgggcctgaaaacgtacagcgacacgcgcgtacgcgtacgatcggtgccgacgccgactcctcacgacgacgcgcgcgcggagacgccacgacgtgcacggatcgaatcgcgcgcgcttcagaattttttttttcactgtgcgctggcgccgaacacagtgtcgatgaatggcttcacctacattttcaaccaatcaaccatgcatgaatatccatgatttgggcttctcctagctatcaggaacaccgagttgtggaggaatctgaactctgaatgctgtactagcgaacactgtacaagatcacgaattacgcaccgaacatgcatcagaccctgcctgctgtccatgcatgtgattggccatcggtcggaaggcaaagaccgaccacgtgctgcaaacagtccaaaggccggcttctctctcgatctcattgcatgcttgcatgcatgattcctgcaactttcgcttctctctttttctttttccttcctgtaacaatgatggagtaaacagtaacacagtcccgaccggagtcacgtttctgctgggagggagggaaagagatcgacaaagcagtgactggcggcttggcttcacgtcgatcgaccgatcgcatctccatctgttcagtgttctctcttctcatgcaaacctgtaaagcaggagagcagctagcagcggctagctataggcgactggcgagcagcagcttacgtaccctttgcgttgattgaattgagtcggtggccagcaatgaacgcttagcgcgcgtccgtttctctagcgtagtacagtctacagttttgcccgtgccgatcgatcgatggatgcaaaagcttagctctcgccaagatcgccgtactaatgctgcttgctgtgcgcctgtgcgtgcatgtgtgttgctactgcaaatcaaaagggaccgcaccactacgtactgcatgatgaatgatgatccatgcatgcgagtcatgcgacaatgtctatcgtcgacaattaggctgctttgagtactgatgacactgaatacctatcgatcaatcgatccagatgtttccatctctctgatttcacgagcctcgctaacatgacgacagtctgtatccaggagtagtatttggctatttgcagctcgccatgagtgtgtgtttgcagcacgtacagttctctgatgataatggaagcggttgaaggatatgataacttcgcatgcgtacgtcctgacgtgtcatgtgatgggcagggttttttggtcgttggtccattaccgttttcttatggtgtaatacaagtcaatgtagtattgtacaccctgtctgtgccatgatatccctgatatggacggtaccactggacagctccattactcatctcgatcaccacacgtttctcattttcagcccatccatcatgcaactctactccagctagtactagtagctactagcatatggagtatatgatatgatccactgctgagtgctcgttatttttagccttggaccacttcgtacaaggaaagttaattcagcatcatgtgaaagtgccccggcaggccagcattgtccacacactgtagtactaaacattgcaagtagtgtctagtgcatgcatgagtgcacccttctcaatcagcgatccacatatctctcgacacgtccagctaagatctgagatatatcatcttctcatttcagggccaccccaccatcaatccaaactccattcaatatgcagagtttgtccctatgcaggggcataggagaaatagccaaaccattatatttgattagtccagccttgcctttttaggtgcccccatatgtgtatgcgtctccatctcgcaaatttgcatagtaatcaaaatggtccaggaccaacaaaatggtccaaccaagcaagcaagcgatcgagtaagcagggaacaaccagcccatgtgtgccacagattctatcaactagtgccggccttgaagatccgtacggctttcgacgttgagattgaatgaaagtatgatacaacttgtccccgcaataacttaatctgggagcaccgatcatgtgcgtgcaattccctatgccacaagctaagctgatgcttaatcgtatttgtgttagtagcggtattattgtattatgtgtttattttagagtattttacggtacaatatactgctagtatatactgaaagtatatatgatctaacagtgtacattgatttgatttttttaaattagattgcagtgtaaagtttgaaagggtaattttgtcttttcttcgttattctattatcaaatcgtgctatcgtcacgtgctttgtcatcaaatgactctcagaatgctcctcccttagtgcacgataagatttagaaccaggtactcctaattagattcaatttaaaccaaaaattactaaagtgttattttatttcctataaaattcctaacatgctcttctacatactgccagtatatactgatagtatattgtaccgtaaaaattctcttattttattcttatagcgtgctgatggagacaacgactgcagttacgccaatggatcaagcaggccaaaatagacgtgcccctaatcatgttttagggcctgtacggtttagagaaattttaactcataggaataaaaaagtgaagaaatacaaagatatgtacacattaattcatagatatttttcaaaagatttaagtggatgaaaattttcctttgtgttttctcaatacaacttataaggaaaggaaaaaatcctttagtttttacatactacctctgtcccataaaaaataaatttttaggaaattaagaatatattagtgggatagataaataactacaataaccctatttaataagcacagtacatgcacatattccatatataaacttgattaaaagttatgtcaagacaatgagttagagatgggatgaaagaaaagaagattacaagaaaatataatcagtttattggatcccatattaagtagaaatacaaattttattggataaatgttcaaaggtagaaattcaatttttatgggacagaggtagtacttcattcctacaaatcaaatgacatttatagaaattaattcttaataatacaaatcctttatttttcccttcagaccgaataaaccgcatattattctccctgtagtactatgattaacaagtgaccccgatgcaaattgcgatggcggcaaattgagcagagcatccatggtggcgtgcatgcatttgactgggaacacatgggttctcaatttctctctggttttgcgagacctgcactagctacaaaattcgtggctgctccgtcatctaacaaacgtaactctccaattaatcgtagtgctattggcgtacttggtaatatatatcaactaccactagacaattcatctggattaacaaccacaaatagctaaattaaatggtttaaaacatgttttcagatttgtttcggtagcgttaattttcggtaggcttgacagcgaagattctcccagtaacaaccgtttgtttttagaaactggtaaatttttttcgcgaacgcttaaaaagattgcacgttggtatattagaggaaatcaaagtttttgttacgcaacacaattggccggacggtcattgcctgaggacaaggaacaaagagaaaaacaaaaagactgctaaggtaaaagaaaaactactactaaaatgttgtttctataaagagggaaggtggtggcgaagccccactacactctcaacaagccctcaaaagtagcggtgctaatagaagactacagacgacctttctaaatgatggactcttaaaccttgtaaaatatttatgggcttatgttgaccctgtttatacgcaaatgtaatgagatcaatttgtgtggtccatatgtttgtgatgccttatgacttgaataaagtagccacgctagtagtttaccggcgatattaaagaagagtacgctttggttgactgcttgtgcagttgtgcatacgaatgtacggaagatatgatgaatctttttaattgtaagggcaagtgggcaaaaccacaaggcccggaatggattgagatttggttagcttatctttgggggtataattaatttcataatatattgccgaaattctgggtaaactcataaaaaattgtgtcaagagcgcgggttgacgggtgttgatgcttacgccgctctctgcagcccatgatgcctcgacatgtcagcttagttcttgagggattaattgtgtctataatgcgagtagtgacaagtgatacggcatcatcatttggctgaataagccaaactgtatataataaaactttagcgatctaaaaataaaagctgaaaataaatttagatgaaaaaaactctaaaatcaacttcaaatttaaggataaaaaatttaatttttagctgataagtataattaatataagtgaaaaaatgaggctgtataaatctttagattattgtgggtatcattgagcgtgggtaacatgtgtcatcacaatattgcagctcgctggtggtgagcctagatacctgtctgagatagcgggattgaagtctattgtgtacatcctgaacatgataattttaaagtaaattgcgcccgcggtacataaacttgtaaggtgggtgcaatttagtgtaaaaacttaaaaaactctcatttcggtacacaaacttgcgtagtgcgtgcgacccaaggccaagacatgacttcatcaccaatcttattgagttggcttgagattaggatgccacatcagcgcatacacacgttatgggggcgcgagctggctacacatatttgcaaataacccctcatacatctttcaattcctccgaatcttcttttgtgttgtagcccacgatgatgcccatgctagagatcagtttcacgatagcctacctccaattgagttagcaacaaaaggagataaatcaggagattgatatttggatcaaggtggaaggctgcgaattggatccaggcggtagggcttttctgggagacaacacaccggccacgtttagggcagcggtggcaggacgttgccgccggcgctgaggcaacatggtgccagggctgcgaagtgaaggtgcacgatctcatgtatacagtgagtactttagtttatcaggtcaaaaatgagattgtctttctcaattccaatttttgtagagatttcttcctcttattgtcgatttattaggtattgcaaacaagaaggactattagttgttttaatttatgccaggagctagttcatggtacacaaaagctgtaatttttgttgacatttatggtatagaagtgatcacgacaaatttgtatttttggagagcaatttgatcattaatgtactgctagtttctgttgttaactatgctttcttcctggatatacccttaaacatggatatacccttaaacatctgaacctaaagtaaactgttctgacgatgaataattatctgtacacaacatatgtagattacgaagatgaagaattcagcattgagatgcaccacggaggcttttttatgggaaatggtgtaaaccgggcttatgttgatggtagagtaaactggtttgaccattgtgagtcagattcttggtcactgttgtgggttgatgatttcattgaagaactaggatatgagaaatctgata

SEQ ID NO: 66627 - DNA, 879 bp, Oryza sativa
agtcaaatgcttagtggtaagggaatatatagagaagcacacctgctctaaacagtgggagatcaaggccgtcacagctaagtatcttgcaaaaaggtacattgaagaatttagagataatgacaaaatgacactgatgagctttgctaagaaaattcagaaggaactccacttaacaccatctaggcacaagctaggtagagctagaaggatggctatgagggccatatatggagatgaaatatctcagtacaaccaattatgggactatggacaagaattgagaacctctaacccagggagctcattctacctgaacctacattttggttgcttccatactttgtatatgtcattcgatgcttgcaagagagggtttatgtttgggtgtagacctatcatttgtcttgatggatgccatattaaaacaaaatttggtggccatatcctaactgctgttggtatggacccaaatgactgtatttttcccattgcaattgcagtagttgaagttgagagcttgaaaagctggagttggtttcttgacactctaaaaaaggaccttggcattgagaatacatctgcatggacagtgatgactgataggcagaaggtatgactttgtctgatttttttcataatatacataactcacattttagttcctaactataattctttataattcgtttccaggggcttgttccagctgtgagaagggagttttctgatgctgaacaaagattctgtgtgaggcatctatatcaaaattttcaagtgttacataaaggggagacactaaagaaccaactttgggctattgcaagatctagcactgtgcccgagtggaatgccaatatggaaaagatgaaggcatta

SEQ ID NO: 66628 - DNA, 3302 bp, Oryza sativa
  unsure (1)..(3302): unsure at all n locations
atnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaagtttgtgcttcccataatcccactccccttatcatcgccatgttgcttaccatggctaggtaatcttcacatgacattccatattgcgatggacacataacataataaagctgttaattatctgtgattaggagatgtccgcatgacagattgacaatcttggtggttgtagcaagcaaagcacaatcatgttactagaagaatttccatgctcttttcactggaccttatagtctcctattttgcctcgggcacttgaaatggtgaccatgagggaagaaaatattactagagggaatgattattcttctaaggacaaatatgtgtgggctagtgtgctttccgcttaaggacaaatgttgcaattttccttgcagaaaatgtgtacttctcttataaaatcaagccatccctgatagttgattctgggtgagttgcaaagctaccactgccaagttagcaatgagcagctttgaacaatgcatgttggtacatgtctctctatttgtacaagaaacagagtactaagcttattctaaataggagtaatttgcgtaacgaatgtgagtttcaagatcttaagtatcatgaatgaaatttttgataaaaatggatttgtagctgaggaatacacattagcaatgcagactaaaaaaataaaatagatttaaatgtgatgtgtatatataaactaagagcagaagataaaacatgaaaattgcttacgactaagcttggcaattcaattgattaagaccaattaccaccatagaaaatgtttgtaccaacttggctttgattaagatttcagaactatcaattgatgccatcgttccctgattttttttttataaaactgaagccctgccagagtgtcacttttcagggaatatatagttaattgcatgatctacagaattcagaatggtatagccgttgttattacagatttcatatgctctccacactagaaagaagttcactatgtaatgatggtacaatagttacagtatagatttactaactccactgtgtgctatgagctttggaaacagaacgtgcaatagatatgcatttttatcaccacaatcaaaagtgcatacaaattaataattacacaccactctttataattaaatacgggttctcatattaggccccatacaaacattacattgtttacacacaacaaagcacacattaaagtagtagtgttctacagaaaacagatactccaatcatatctggaagcaaacttaatttcacacatgacaaactggtttagctatcactagatggctggccaacagactggtctccataatcaaggaagctaaccttttatttaaacattctatgtgtgtgtgtgtgtgtgtgtgtgtgtgtgtgtgtgtgtgtgtgtgtgtgtgtgtgtgtgtataagcagatcaacactgacgaaagaactcatatattagtactaatatgcagaaaagttttcttattttcttttttttttcaatatacatggatggaagcagtggatgggcattgtgaaatatgtatggattgatgggcggtataatataatggtatgtggcatatgtatggtactagaatgggtgtaggtggaatactgtcaagtaaggtaagttttttttgttgttgtagtgaatcaaggtaggtgtttagctagcacatggtgaatatatggcagatgagctagctagcagagggcattgccaaaatggcaagagaagtcacgtggcatgtcatggatgcatgaaagctgagaatggattgatgagctcggccatgattcacctgaggtagctcatcaccgtggcgcgctcgttgaaggaggcaaacggcaggggaagcttggatttatagctggcgctgtgcatggtggagtcgtcgtcccagatgagcttccgccaccatgccctctccccgctcacctccaccgcctggcttgaatgttcttggcggaggagcgggagacggcgtaggctccagcacccgcggacatggagctccttccacgccggtgcggatatggcggcgttgacatcatcgcggaggtgctgcagtagtggcaactcctgaggcgcatcctttggaggatagggagctgatagttgatgggttgctcacaaggatgttggtagaagattgtcttgaggttgtagcagaataggatgtcgagtgtcgtgaggcttggtagtgcagactcacgtggcacgatgcgctctagtcttgggcagtactccaggtgcaggtgcttcagggaatcgaagttcgaagtatcattgtactccaaaggtttgtagaaatgaattagactttggagctgagacactcgaacattttgtagagattgccccatggaatatgcatattctaaaacatgcttcatgtgatggcatgagcgaagcttgcagtcctccaacttgtcaaaggagctcagtttagtaaggcaggagacataaatatcatctatcaaagaaatcgatttggcaacttgtagaagagaatataaaccatggggataccgattcgttgcagacatctccacatgacgcttggtttggcgaatgggaggcgcaatggcaaccactgaaaattccttcgccatataacgacggtacacatcaccatatggtgatttcttatttgctagttctgtcaacttgtcggccatcatgtcttgttcatcctccaacctcctaatattggtcttgcattgggcaatttgaacatagaaatcttggaaaaactctccatattctactagccttctggtgtttatgttgaaactgtaaaacaatctagaatcttctatgcaaacatgagcaatattttttttgatatttgcaacttgatcatcataattattaccatttccttgtgcacaacaatccaagcaaaacatatcagggaatctttgtagcttatgccaaggaaaccgactcaaggatgaaacacccatgagaagcaatcgcctaa

SEQ ID NO: 66629 - DNA, 5794 bp, Oryza sativa
aatgagcttgagtaactgaagctgttgcatttctataaacatccaatctggaagtgatgtcaattttgtccctgagatttcaagggttagcaagctagataaagcagatatggaacgaggcaattcctcaaggttggagcacatggaaagcaagagctcttccagttttatcatatcttggaaaagatcacagggaaaaatgtttatgttgagctgagtgagatcaagatagagcaagttgttcacatggcatttgtcatttggtgacagagtgttgccacgattggagaaattgcataggcttttgaggttagtacatcctctgagagaaagcaacctgagattaaatagatgccaaactgaaggagggagtgattctagtggtgtataagaaaggtcaagaatagaaagacaagagagtttaggcaagatgttgtcaattaggttaagcaagcttggtttgtgtgagaaatgacttagaagaagtgcggttgtgccactagatacttccttgttggttatgcattttccacttatgtgccatttctgatcctccgttgtctgctcacaaaccaacttgatccatcccatgttctgcaaacactgctcctcatgaaacatttcgtcttcagtgagatggtttataacgagaccgtgatatgctaagaagtgtgcagcagtgtcagtaggctcatcaactttagttgctggagcaaatggtagctttagtaatgaatactccagaaacgtttggaggatgatgttcccaacttgatatacatcatcatggtgcctgatgcccacattgtggatgttgtcttgaactgctcttggtggtttgctagcagtaaggaagccttgggcagcccagtgacgaataagctcttctttggtaacattaataccattgttgttatctgcattaggtggcgcatgacattgtggaaagagaagcagggcatagtgaaaacaccggagggcaacgcggtgccagtgctccacgtcatcctcctgccccactgccttggagatgtccttggctgattggtgcagcgcaaagaggataagaaccatgatatcagcaccagagaatgactcatacacgtcatcaccttcggacttgctcttgctacagacttctcgggaggtggcggataccacccattcagagcccgaccatgcattagcaggaggaagccgcaactcggttgtgaaagcactggtcgtgatgggcttgtacaggttctcaaccaccagcaggtacctcttactgtccagtgtggcgttgatccgaggagccatttcccaaaacaagtactcacgcatttcattatcccccgacacaccccaggagaaatagtttgtctcctccatcctttgcttgagcctgtggtattcttggtcgagcagccccagctcctgtgccaccgcggcgaccagctgcgcctccaatctcatgacgaagctgcttcctcctcccactcgtttttcctctggattgatcggcgacaccttgattacttgatcaaactgtatgttacggggaaacacatccagagcgagccttgatatggcccgcgtgaaggaagctgccggcccaaccccaacattccaatgcacgttattatcccggtaaattttatacgcaagttttgaatattcgtcagtgtcacggtagccacctagcctggtgagatagaggcgagttaattaattagtactgtgcaatttagtatagttgatttattagtgctgaacgatatttactgttttctatccacatatatgcatgcgtgcggccggctgcaggccagatatgattcagcaatatatatatccagtgcatgcatatatatatatatatatatatgcaaagcaccgtacgtccgttggcccgtttcgtgcatgtgtgctcgcttagcagccttgtctacgtaaacaaaataataataactaggtaacccgcgcatatttgcacaactagcattattatattttttttctcatataatagcttaaagaatttcatattttattatagaacatattaaaatggcaatataattttaaattatgtactaacttgactctacacttttttttccaatactcctcatttttttaattcctaatttcagttatttataaattgtattcctatatagactctagactcttctcccaatcttgttttttcaaaaaaaaataaattttagttatttataaattatatttctatatggactctaaactctacttataatttttattattctttaactccaactttcaattaattgtaaattcctatatggactctactcttccaatttttcttatttttaattctaaattctattatttctaattgtatttttatatggatgctaaactcatcttcaatattccttatttttagttccgaactttagttatttataaattatattctatatggagtatagacttatctgtcaacattcttttttttaatttccaattgtaattatttctaaattgtatggactctaatcttctcttcgaatatttctttttttaattccgaattttttctattttaaattgtatttctatattgactctatttttccctttttcttcgattaatgtgagaatttttaggccgtaagagcgaacatggtgacttctttttctaataataataataataataataataataataataataataataataataataatagtggtagtagtagtagtagtagtaataaggagccagctactcaaattctacattctacaaatatacagtagaacctctcatagcattttttatgcccaaaataattatgatgagtccaagataaactgtaatatgtgttttacgtgcatatataaaaaaactaactcgcgcgcttatacggccaaaagacaacactatgtacaagctcggattttcactagcgttgattttgggacaaccaacgaaaaataatccatccgatcttgttctgcatcggcatatttgcaaacgaaaaataatttatgaataaaacttttatatacgtattcttagaggctaaaaaataaacttcgataaaaaaaaaccctaaaaccaactccaaatttaatgtcgaaaatttaaattttgactgataagcataaatataagcgaaaagatgaggccctttgacaaggtatacttatttgaatttgaaacaagaacatatatactcccttcgtcccaaatcgcgtccccttttatgaaaatcaaactcagtagcttttgattaataatcatactaactatattcatgctaagtattatacatgttatattattatatttatattttgaagtactttaatgtgatactaatttcatattagttaaaaacataacatagaataaattatatattgatcaaagtatgttattgaaaatcgtataaaaaattataatttaggacggagggagtgtacttaatgatgagcctatatgtataaatatcggtgggtagatttcaagcattgaatcaaaagatctttgcactcgggcgcatctcacatgaatacattatagttttgcccatttgccgtccaattgcagtgagcaggggcggattcaggaaaaaaaaataggggctcagttacacagtttcttcaatctacaactatttaaggacctttagtttatcattcatggtgaaaaatcgaaggggttgttccgggggtatccatgggtcttgtgggtgtagaggggacttgagttcccctgcacccacattggatccgcccctggtagtgagtattatttattacaaacttataataaagaaagcttgtgaggctaattagttgtgcctactgcctgcctaatataaaaatcctctaaaattttaccatcagttcaaaatactaccgagatatgttagataaactatatgaagattcatattattagattcacaattgattgtagttctataatatttattgtagtttttttacattatagttgtcaatgttatatataggagtataataacttgattcctaaaaatgaatgtaggacactgaaatgacaaatcgctgaaatggtgacgattttttttcttaaaatcaaggtacgggaattgggaagctttgtttagtcactcaagtttcaaccgggtcaatttggtccctaatgttattatatttaacacgaaaagctttttttttaaaaaaaaaacatcatgtgaacccacggggcctcgcttggctattggctatatattaagttcgggcctgtttactttgataccattttcaatcttaccaaattttggtaaagttgctaaaaaaatagctatatttagtttgctactaaattaaagtgtacatgccctttattttggcccagtcaggcggtcataaatgacaatatgtttcttgtgatttaggaaagatctttgaactaaaatcatctatgtaaaaataatctttgacttgcgacaagtttttacaaaaaaaaaatggcaatatgaagatcaatttttctgtacagtttgatttgcataatctaattaactcccatgaacttaccttctgtgtccgcattgtagtaggaaaaatagttgcattaggcccttcacagtgctcctatgtggagggggtgctatgtctacgtggagggaaaacaaggtgggacccatagctacggtgggttcttcgcttctcaacaaaggaacgaggtgctcggccaaaaagccaggcgcagggcccactcgacgacgaaaaaagaacgacgcagctcatgcgtcgacggatgccgccgcgagcagatcagccgctgccaccaccatcgctcggaacccgacgccgtcggggagctcgtagctgcgccgccagggagagccggaggctgccgccggggagctctcggccgcgccgccggggaagcctgagggcgccgttgccgctccacgtcgcgacgaccctgccgctgctcccgtcttcgtccgacatcggtggtcgagggcgccgccgcacggccgtcttcccggcgccgccgcacagccgtcttcccgccaccgccgtcttccagatccgcgccgcgccgccgtcttcaagggcgccgccgcacggcccggaggacgccgccgccgccgcccggcccggaggagaggagagccggcgctggcagagggaggaggggagccggcgtcggcgaagggaggaggggatttgggggaggagaaatttggggatttgccggtttgggggtagttggggatttgtgggtcccactagcagatatttgtgggtcccactcagtgcttgcactgtgaagagagggtcttcatcctagctgtcaggtgggtgcttgcactgagaaaggccttttagaattaaccagtaatagctttgaaaatgcagtttaggctagcagagtaaaaaacaagaagatatcataatagctcatcacattataaaatattaacgtttcgccgcttgattcatactcattcgatgcttctctaaaatagagaaggagagaatttaatgataacatctcgagaaggtatatatgtacatacaagaaagttacataccagaatttttcatgcttcaaacgctcacaccatttgtggaagaaaggtgttcccattagatacaattatttatggtagaaaaccacggtatccacaagacctgtatgcaccaaaagttatttgaattagtcgcgggaagtgattacaacatatttttgcattggaagatatagacacttttcttatatgtagaaccctctttcattttg

SEQ ID NO: 66630 - DNA, 1395 bp, Oryza sativa
cctgctctaatggaaatttaagagagagatcactccgctaagtaaacgagacagaagattcggataaatatgtcgtatcctatttaaaatagaggcaacgaaccgattcaggtatgtcataccctatttaaaatagaggcaacgaaccaccaatccattagagcttatttaatatttaatagtatatttaatagtatatccaacaactcgctccaattaatttatagccaccaatccatttgagcaagtttaatagtatatccaacaactcgttatccaatcatttatacaatagttatttataagcatatattacaccattaatatatagtcctactttttatatacacacaacatattaacgtccgtgctgcaacataagtcgttatttataagcatatattatattatttatggtattaatatatgatcctacttctcatatatacacaacacattaacgtccgtgctgtagctggctataaatctatatatatacacaacacattaacgtccgtgttgtagctgactataaatctatagcccgctttcatgatattgaagtctgttcttagcccgcttccgctttctagttgcccgcttttctctctattctgacgctagtcgaaaaccaacgctttaagacgctatcggagactagcgatttctattgctgcgatgcttaatatgcccgcaacttctattgctgcaatgatgattggaaattgcaagtggtagtaacttacacagcaaaagaataggaaatgcagcaaagataataactagcttgcactgaacctcacacttctgaaagagactcttgatgtttcaactatctacgagaaaataatcactaggtgatcaagaaagtgattatatgtcaggcacagcacacaaataaacccaacatgactaacttctactgtccgtgaagttctaaccatttaagcaggggtaccaaatcatcatctgcagggagcataggcgacatgaatctcctattatacactcaaaaaacataaaagcccaagttctcgaaaaaggaaaaaagcagccgccaaaatggccgcgataagacgtcaaaatcaaaggcttatgttgtgtctcatgtctcccttcgggacctccggcgtggggcagcagctccatccttctcttcctcttccttctcgtcctccttgccaccgctgcttccagctgcttcggactcggtagactttggttttttgacctcggctacgggcttcacaggagcctagggaatgcaaatcttacgatcagccattgttgtttaactaccaaacgaggagagcggaagcatatgtatgttgtgagagtaacttaccgctggcttcttgccgccgaacaggatcctgaagagcacagtcacaaaga

SEQ ID NO: 66631 - DNA, 778 bp, Oryza sativa
tcttctgcaatgtgcatggcaactcagttactcacaacatgaagccagtatattctacatgttgatggataaactaacaaacatacagcagaggaatattggaagaatatattacctggaactcagaaagaccatcacctgctgccgctgctgcctcctcagccttctccttctccttctctacttcgtacttgggcttccaagacttctccaggatagaagtggcaaccttctcatcatcagcgatcaaaatgttgtcaaacaggatgccatcttgcatcgtccagatctcaatcccaatagcggcaatcggatcagagtcaggcttgtcaagctcgaagtactcagggttggggatctcttggggcttccagattcctttgtagttggggttgtcgataagaggcgcatgccacttgcccttgtaagcagggttctgcttcatcggcctcttccactcaccacaaccaggagcctcttcacacttggggttgtcaatctttggtgcttcccattctccatcctcctcatcatcccagtcttcaggcttgttagcctccggatcatcaatttcctctggctcatcatccagccacccctctggctttgtggcctcttcgtcctcaatttccatgggggcatcctcatcccagtcatcaggcttcacagcatctggatcagggattttagctctctcatcccagtcttctggctttttgtcatcaggatcaggaatggtcttggatgggataagtgatggctcaaaatcatcagcaga

SEQ ID NO: 66632 - DNA, 2268 bp, Oryza sativa
tgtaattataattattaagcgtgcttacttgttttccaatcagtcttgtgcgcaggaattcctttgctgtgcgagcaaattgttcagaggatttgttctcctctgaaggcttttcaaacttggggggtctgatgcttgaaagattaactcggcgttctgctgaaggactgccataaggttcagcgtcatcagcgatgactaggcagtacccgttcacaacctctatcacctggaaaattaaacaaccattcacagggtcagctgtgttgctgtgctgcagaatctgatattttctttcttatagttataaggtagatgtagttgaataggagtaattggtacatataaaaaactgcaaataaaagtaattatatattatggatcatcatgctgaagtgcaagctgctacaaggtactgcagcaagagatgggaagtgattttaataagttatagggcatgtgacatgttttgttcccatgtgattcaatattaatggttcctgaaaattttgactaacataatgctacagattattgtatcacatatcttctcataaacatgtaaggtcaaattcaattcacaatgtattgtgagaaacagaagtgataaaactaattactaggcggccatattttttcatgtactctagagagaacttgagctttcacgtttccatagtaataaatgacaccataatatatgtgttcaattgaatttaagagaaaaatgagcaattgaaatttgaaaatcattagtgtccaaaaatggaagaaaatggatggtcaagaccactcacttttcctgtgaacttttggttgtgaattggctttgtgtttgtcaccgggggcttaaatccagtccagattcttaactgttccttcttaacctgaagatcagcattcctcaactttgtcttaagttgaggatcaagcacatttgcactccattcaacatactttgcgagtccctatacaatgtgacaagaacattggtaagtggagtgaaaggaaaatttgagtggtacgacatggagaaacaatattcgtcatacattttgaaccagatcaagtgccaagtcctttacaacatccccatcagaataataaactgaaccaaatatgttgttgaaattgtctgtaccctccatcacaatccgcacctaaaggcaaatggaaaaaaagatagtgatcagaaattatatcttttacaatatgtttacactaataaacccccacaaattagcatggtattgacagtaacaatacatatgaaaactgaaaaaaaataataacttacttctctgttaagcacccgtgtctcggtgaagtgcttagcttcttgtccaaacctgtctggtgggacttcagaataaatgtcagctgatgccaatagtttctgtgctgctgccattggtgctggagtagtggaagcttctccatttgctgcgccattgccaactccagcttgagcatttgggggaggagttgctcgtcttcccatggatggggcctggatcatagtacaaaatcaaagttcgtcatccaagcagttaacattaacagattcatgtatatttacatgtttatatataataatgctcaagatgtacaaacattaaaaggatctataaaagaatatatataactcaaacttactatcaacaaattgtgttatactacttgctaaagtaactgtcataataattattatatcatacagactagtgagaacaaagactgattagaagcatgcaatcaatacacagttcaaatcttgaaaacataaataaaacgaatggagaaaatgcatgtgattaataaataatatacacctcatatttagtgttggttgataaaactttaatcaggttgccatggtcctaattatcctcaactagcattcatccatggtagcatatacgattacatataatgtatataaaaggggctacacatcagctccatacctggacgccagcaacgtaaacttggacataaaggaaactgggaatcaagtgcacacgaatagtacttccatcgcgaacatgctctacaatggcttccaagctcttccctttgttttcagcaacgaaacccttggcatcgaaagatctgccatctccaattgtcgatggtggcagatctcttattgacgactcaagagcgccaggaagctggaagtaaaacgagatagatatatgcatcagtgatatgatcatagatatgatggtgcggcagcgcatgttgtgtcgtcgtaagacaaaacgg

SEQ ID NO: 66633 - DNA, 5838 bp, Oryza sativa
cgagaggcgtcaatgggcttcggcatactttcttctacgagaaattttataggaagattacactggaaattttggtactacctccaagtacttatttgtagtactagaggtaaccataatttctagaataaaatttggtatctcagtagctcgaggtaccaaaaaatttcattaagaatggtaaaattacccttcttttaatgtttgagcttttacccaatcatcaaaattgagatgttcttgtccattaacattattactcctatgaattctaatatgactaaactaccatgggcaggtaattctaatgagatttactccggtccaacaaaaagtacctcgaggtaccggtacctcacggtactaaattatttctaatcgttagatcttgttgggcgggatgggtattgttagatccaacgatcggaaacgatttggtaccatgaggtaccagtaccttgaggtactttttgttggaccggagaaaatcttaaattctaatatgtttttgaagttgtattttcttcaaacgtacacacacatatatataagattgataatttgaagttgtattttcttcaaacatacacacacatatatataagattgataatttgaagttgtattttcttcaaacgtacagatatatataagattgacgaaataccctccttggcgatcgatcgatcagagatcttaccaggttgggcgcgatgatgcacgacagcgtgacggacatctccggcggcgggatgacctcctccgccttggatgtgtccatgatcaccaccgtatctcccgacgggacggacttcactttccccttccacaccggcgccgccgccggcacggcgccaccggtcaccatggtaagaagctagtagctagattaggctccctgcaacgagataagaattcgttaattagcaaactaaagaacaaggtaaaaaaaaaaaagaaggcattcatgcaagcattatgtttgcgtgatcgatcgatcgatcgatcgatcacgcagatcacagcgattctagaggtgttatgaggctgcactcaatcgattaaatttcaacttatcaaattgcactatacattggtaccaatcaatcgattaattacgtacaaagatcaagttatcaaatctgatcgatctggaccaaattaaacacgtacgtatatagatgtggatcaagggaagattttatatatggtaatcgatcaaaagaacccaatcaagaccaaattaaaagaagggcatgcatatgcatgtaagtctctaaaacctaattaactaatccaaggagaaagaaaaaactcaccggccgaactagatgcgacgtcggcggatctcgcgagtgcctcgtactgtcgtcgagggttttgggtgtctttgcgagagaaaaacaaaacgggtaggggtaggatatatcggttgggcggacgtacgtacgccctatttgtaatgagattacggttgtgtggcgctgttggggaggaagttggagtcgtgtccagagtccagagatccgcggcttcgttggcactcgtatgcgttttgatcacgtccgtcccctgtatggttttgatgactttcgtccggggctctgagccctgattttttttttcttttgcacatgccaaggcattttcagtttgttgacactttcaatcttattaaatattggcattgctaaattttgataagacaataaagtatacacacttcaaccattattatctcactaaattttagcagttgtagaagcttcttcttttaaaactctaccaaaatttgccaaaggtatcgacacaaataaagccaacactgtcaaattttggtaatgccaaaatatgctaaagttttattacccaaatgtgaaatggtttatttgggcaacaaagtgaactagcccttagtcctttttgaaagcttgttttacaaatagacctctaaaaaaacttattctgaaattagactttttttcgcgacagtaacatcattagcatcgtggtctaacatgacggcgtccctagccaccccatggaagctaaaccactcatatcatatatgaagcctatgatgttggcaccgcgaaaaaggttcattattgggataagttttacaaaagatccatttgtgaaataagttttcaaaagggaccaaaaagtgaaaaaaaaatctaggctctctatcaccgatcgatccatcggcccgcagctccacaccgcatctctccaggctcgccccctagcgatcaatctctctagcgcacatgactcgcactcgcactgccacccccactcaatcgatctgggcacgctaactagcacacgaatcacccgagagtgaaggaggaggagagagcgctggtggaggacaagcacgccggcgtcatcgcgtcggcgtgtgtcctagctggctcagtactagattttttttttttgcaagcggtctaaaatgatcttccgaggcaaacggctaatccacctgtaggcaaaagcctgcgagcatcaagaggaggaagagctcgtcggtgttcaagaagctagctagttcgtcgtcctctttcgcaggaagtgcacatcgaggccctaccggccgtagctctttcaacactccgcacatcggcctaatcaaagtccgcatgaagtctagggccgttttgtatactttatcttgaccatggagaacgcagatggaattatctggaggagtgcttcatttagtactacctccttctctaaatgtttgccgctgtttagtttaattttgagctaaccaacaataaaaataaattgagggtattatacagtaataaatgcatatgaacatgcatgagaaaaataatggtactactatagtactccactacaaacaaaccaccacgatttcaatttttcatttagattggtaataaaaaaaaggcccaactagctttgacataaaggaatcccatttaaggaccaactagttctcttgaacaattattaaacaattaatagtgactaaattatatatgagaggaaataaatagaccttctcacacagctagctacaacaactatatagtaagagatttaaaaccttggtgctcactttagtccagtgatgagtccttcaatgcaccaccccaatgcgcggcatggatcccagccacaactgatcgacgtcccaccgcccccaccgctgaattgcgttgatcgtcaagcctatctgcaagctcgcagttagtgtcctaaatatgggacacccaatacttatgcattaagctcagcagggtacaccatatatatactaagtgttatacgggatcaagccacatacatgaaaggtgttttggataaggaacaagaaatagagtatcatttgggcgctacaaggtctatttggatcgtatccatacttcggttttgagagatataacctgaccagggtacgttccgaattcccctccagatcagaaccctcatcatcccaatcttcatcaagacattgctgctgtggatattccggcgaaggatacttcgatgatttcggatctgggagacatgacctgaccagagtgcattcccttatagattggaaccattgtcatccaacaatttgattcgttaagatcaacaaagcacgttgccgctgtggaaagcaacaatttagtattgtcgacggtgaggccttcgcgtagatcgactagtttcgaactaacatacgccgccaaaaaaatccgatccgtctgacaattgtgccaaagtcttcagatctttgttgcaatattgcttactactacgagaacccatagacaaatcgaatcaccaagccatagccacaaaccacactgataaatagctaggaggagatcaatcgctattcgtcgacatcaaatcgccagattgatcgtagttagcgggttagaaattagaataactaatatgctcccctattgtaatgcgtgtggtgaatgccaaagatatatacatataaagtagagtaggattattactcatcttaagacccaaaccactattaaaatccttgtcccctatctacttaatgtactatctcacgtataccttatatcttcatattctataaatattgttgtcatatacaatcatttcgaccttttttccaacttctactctcttggtttaaccagacatacacttccaaattgttacatattattttttatgaaaaaatcccatataaaatttattttagaaagtcatattaattatttttaattttttatttagttaatatataactaattatagattaataacttaactcattttctgtcctaaaagttcagtttaaaaggaataagttattaggcatgtttgagctggagctagaacttaggcaaatagtttcagctccacctataattggaatggagttagattaagcactcttacaaaataaactaaagaggtggagctaggtttacatagcttcacaactctgctacactcgactcctgatactaaattagctctaacctaatcttccaacacagggctcgttgacatggccctagtggggttggttgggtgggctgtgtacgcggaagagaccgaaccaaataaaccgcaccgcagccgtactcctccacgaaaaggcgaaaacgaaaccgctcaaccgctgctccattcccctccttcgttcccccaacgaaattgagacggaggtagtactaaaaatattgagaatttgagataagagggtggaaatctctcccgtctcgttcgtctcctccgcttcgctcctttgcgccaagacgcgtcgcggggctgaacagggagagaggggcggcgatctccatttgccgagcagagcagagcagcggaggggatcctggtgagcatccatccacatcctctttctttctgattcatctcgctcccaccgggactacttttgtcttggaatttgcttgcgttcggttcgttcgttaaccctagctttctcttctagatctggaagaagctctcctcttaatttcagagccttaaccttaatactactactactgcaagtaacagtttgtttgttcccccctcaaaaagtttgggggttcaactgaacccccccatgtcccaagttggatcatccgccccctggttttgactaatgagatatccgttcgattccctgataaataaaccctattgtgcatactgaatcacggactaggtggatatgtctaattgagagccgtcgtaagtccacatggacgagtagttttgaattggtcctcctgagctatgtaaatgtgggttggtgttcctcaaactttgctgccaggtgatggtctaagtggctcatatgagttcaagtacttctctgctctagaaaatggattttgtactctttagcttggtgatatgtgttaatctctacaattatcatgactctggagaacacagatggaattatccgggaaagtttcattcagtgtggtggtcattaatgcatatgaacatgcatgagaagaaaaaaatgttacgatctataataaggctgcgttcgataggatgggttgggaacccatcccctccgcacggaaaacggagctgtccattagcgcgtgattaattaagtattagctttttttttttcaaaaatggtttaatttgattttttaagcaactttcgtaaagaaactttttgcaaaacacgcaccgtttagcatattgaaaagcgtgcgcgcagaaaacgagggagagaggttgggaaccttgaggttcgaacgcagcctaagcagttattgtcagtaaacctgaatatgctttaatttatatcgtagtaatgtgggttctattcaaaatatt

SEQ ID NO: 66634 - DNA, 8657 bp, Oryza sativa
cagttgtttgttgtcttgtagttccgtgcactatcagaccagctatatcgatcacccgattatcacaagcatgttcgaaaggaaatagtgaagcaggtacagcagatcaccttctggaattaccggtctttagtttatattactgtgctcatatgtttaaactgcaatatctttatcagatgccgtaacacaatgaatctgtcattctctgctctagttattgcatttttttttctccaggtgatgaatgaagaaacaaaatttcatcaatatattgtagttatatgctgataaactcctgttagagatacatgcattcttacccatgctgtttttctacttgtctagctcaaggcatgtaactctttgtatgaaggttatgttccaatgaaatataaacattattgcaagaagatgaaaaagtatgtacttctgaggctgacctagcttcctcaattaaaacagttcctgaaccttttgccttctgtaatgatggcactgaaattttgcctattccagatctggtgaatggggcgaccatgtcacattgcaagctgctgctgataaggttagttattttctttgccatcatcctttttctcgtctaaattcttactcagctccctgcagtccaacaaaagttacagtaacatttgtacataattggtactatttgttgcattttactgttgtacagaactgaagatgtccgttcttttgtttataacaggatattcaaatataatgttaatcatttattgactgatcattctatgattatcactctctttgtacagcacttgacattttacatcgtgttcactaaaatttatactttggcaacttcaaactaccgccatagttttatgaacccttaaagaagcctaatgtttttccttcttttggcagtttgctgcaaaaatatgccttctaacatcattcagagacacatgttttgttgaaattgttccacagtatcaggcaccacagagaggtaaggttcaaatccttgtctctactagtaacaaaaactttatgcatatgtacatggagaatactaattacagtcagtgccattttgcataatgcagttttctagcttatatacccctgcatgtggatttgttgcacatatgcttatacacatcccctgattactgcaaacttactcattgcataactggaaacataactaaaaggataaaatcagcttgttgctaacccctgaagcttcgtgtttttcagaaatttggctaagtttctggtcggaagttcactataactcgctatatgatgctcgaggtgagaaaaaataaatatttctcatttcttatagtgcgctatcagatttggtgccttgtactgttatacatccctttccctaataagaggaaaatacccattactttgcagatctccctagcaaatacaagcctaggaagaagcactggttattgttttagtaaccacgcgggagctttgctttggacatggattttattgcttggccttttggcccctcctgatagttggagcttggaaccctgaagagtggaatcctctgtggttctcttccttgaagcgctgaatgggtttgccggatgcactcctcaccacagtacatacagcattagttatactataatactgagagaatttgagattgcttccttgtgaatatatacccatagggaaattactgacatccatgttgattgtaaaccatatttgttcattggtatattctgtatacattttataggctgctaggtctcttatcattttattcattccattttccccggacaattcatctgatttcaatttacatactgaatgtcttttgtcagtatctagtaattcaattcatacgccttgtattatgtgccgagtatatttttgaccgatccttatgcatggatgcaatgcaagattagtagttgaaccaactaaaccaaagcaatgaacagagccccggcattgaagtgagtaaggccctgtttgattcagcttaggattattataatctagattattagaaataagctgaaaaaaatagatagcttattatgatagattattataatctagtaatccactctaaatgtgcttattttagattattgggtggctaacagctaacaaacagcttataatccagagaaacaaatagctcacagcttattttatatcggtttattataattcactttacagtaatttggttcaataatctatattacaataatctcaaagagagcctaaatctctgtgagccttgtgtttagaatttgctttagggggagcttcgcaaatgtctattgaagtaggttgttgaatgatctgaacgatgctaaccgcacaactagactaaactgagatcgtgggctgtctgtagcacatcctaagttcaaacttgcaagtatttcgctctcaccctgttcgttttggtgaggaattattctggactcaaagttggtcgcttttgtgcaagaaattctcactggtattgttgcttccccgatagcaacttgagatgaatatagccgggtcggaaaggaatcgagcatgggatcctgtttgggacgttttgatcctggtgatggtgtagcttgtgtgaggtaaaaaataataataataataataaactcgaagcacatctgcagttagtaatgctagccttttgtgagtgggaaagctagaaaaacttgcaagcatagcccatgggctatggcctatggcccatatcatatggctgcatgtcagcatccaaatcaagtcacaaatacaagccctcgcaatttgcaaagcatatgcatgcgtagctacccctttatatactacacacttgtaattaatcttgtacgcagtattatcatcccatatatatatatatgaatatatctacatcatacaataacgacataggacaaaacaaaaggaaaatgaaaaacagcgatcctactcatactctggtagtagcaccaaacaattccggtgtcaaagctaaagccaagcgcaccttgtcgtcaagacctcgacgaaaaaccaggcccatcatcccagagtcacgcacgcagatgcgcgcagtcacgtagtcagcaactccggccccggccaacggcagccaaaccactttaatttccattccaccgcacatacaggggatacagcacggtcgccctccccttcccccacgcgttcggctttcgcgcctctatcggcgtcttcggccggccggcacccaccacacgcaccgtcgtcacatgctgttttacatctctgcaggcaggacgaccactgcgcgcactgcgtcgcatggcagcgccatccgcgctccacgcgtggaaggcgaacgcgacagccgaagtggccacacacgcgcacacccctgatgatcacatctcagaccgtgcgtgtgtttctcggtcaaaacacgcggttcatcgtgcggatccgtggactccgggaggcagggagggagggtggccgccggcgagcgatcgatccgcgacttggcgtgccgggcgggtgggcgggtgttggtcaaagcgtaacacggtcatcagtcatcacgaaccaccactggtaaagcttggggtttggggggccaacgcaacctccgtgctgccgcatttgaggaacgacgagaagacgcacgtaatccagaagtagtggtacagtcatccagttgcttggtctcaacatgggcataacaattattggagcacaggatcggtattatttcagctaagagagttggatcttgtggtaattggagacttggagtatatgtactccaaggcaaatccaattgctttggatggtgtccactggaaatccagccggagggccgcgtcagaatcgccgtagtacgtcaattgagtttttaccgatcaggtttacccttccatgtatcacacatttaaacggaccaacacatccacatgttcttttttttttcttaccgtattttttttttaggaaactctagcggaaagaaaacaaaaactaagaaaaggtacagctaccgccgttcaagtgaccacgctgatggcatccccatcctgcaaacttgcaaagattctaattcgaatgtcaaatacaatccaaatcagcgttgccaacttgaacacggaagtgaccaaactatcttctcatctatatcttgttcatcaacccttttacaatctctcagacaagagcttaaagaacgaaacatgatggggtgtactgagtagcacgtgcacacgaaacagtactaaaatgctccacgagaaaattcattcttgactaacgcaatcatgcacggaaagatggacagatcaagacgaaacctaacgcaagtaacgtgaaacccagggatgccacagatgttcaaagctccgagtgtacagcgtgcataaaacgtcaaatagtcacttgatcagataagaatcgtcattctttttaattaaaaagaaacaattcctgctgattgaaggaccgcaggatcacacatcgctacatgaattggaacaaaaactttgaccaattttacaagacaatctttctaattatgcctttgatcaaggcattttcgatgttccatgcgcaaaaaatctcctgctgttcttgtacaggatcctcgcacaactcgacccctaatcgttagtgcgcctctacactccctttctgcactccaaagcaaagcagagttttgacccaaaccaatttatgttcagaataacttcgatggtggccgacacagccgaagcagatttctgaaacgccgcactttcgaccatcatgcgtggagctttgggttgcagcggccatcatcagctgctgtcatttctcatttgtatagcatctcgtctgactgtaactgtaactgtaaccccctttgttgtctctgttcatctcaagaacaacacctccatcacttcacagttcacaccacacctctgaagataattaatctgccagctgaaccgtgtaaccccggacaacggcgacaagtgaaccagtgcatttatacgccggtgccaaactgccaattatggacagggattgtgttcgtagaagtaggtccattttagactgccccccacttgctgccaaatcttttgaagcaacggtacctgcggcagatgagatcgatcggcaatcaaaccattcaatccaccgcaccgaacactgttgcttccaccgacaaaaactcgcgtggcccggagatcaccgatgcactgaaccgtggcatgaattttccatgtaacttgggacaggatgattgttgttagctttgcttgacgccggatggtcggtttcggtctcgccatagctgtggttcgtgtgacttcaggagaggaggacatggacggaggcgttcttggtggcggcgcagacggggcaagcgtcggcggcggcctcgcaggcgccgcacaggcacaggtggcggcacgggagcagcagcacggacgcctccgcgacacggcatgccttgcacgacgtcgccgtggagaccgcgacatcggcggcggcggcgggggtctcgaagcagcacgagtgggcgtcctcggcgtcgccttcccccgcggaggcggcggcggcggcggcggcgcagggggactggaggaggagctggtcgagcgtggcgcggaggccggcggcgacggcctcgtggctcttggcgacgcccatccacgcctgcccctccgcgctcacctggcggagcttctcctccagctccgcgttgcggcagcgcgcgcgctccagctcggcctccgccgcacgcaccctccccgtcgtggcgcgcgccgcggccgccaccagcgcccggacgtgccgccgctgcgcctcctccagccccgcgcgcatccgctcggcctgcacgaacatccaccaaacaccgacgccgatcaaacaccactcaccaaacacaaacaggggagtccacggttaacggagaagccttcttcccatacctcgagccgaacgagcgcgtcgatctccacgccatggtggtagagctgcgaaagaaggccctgcgagattccgcccgcaccgtccatcctcctcccgctggtggacgccgcgccggcgcacgccgccctgcccgccacatccccgaagggcaagatcccctgcagcggcgccgccatcgcgtgcgccaggaccgcgcgctggtcctccaacagacccgccgccacgcgcggccgcttcctctccacgaacccgtactcgccgttgtcgccgccgaacaccaccgcgcccccgatcccttccaccgccgccatgggcggcgcgcactcgccggcgagctcgtccaggaacagggcgccgccgctcgccgccgcgtggaggtcgtaagggaaagcctgggcgaggcgctgcgcctgcacggccatggccagcgacacgatgcgtgagcgcgagctttccttgatgagatgagagggcggagaaggcaaggaatggcgcgcgcgagttgggtgagaagcagtggagtcagtggaagggatgcgtggaaacgaatggcgaacggcggcgagcgttttatatgtacccgctcctacggttggggaagcagtggctcactggcctgtgaagagaggcgttgtgggtaagacacgtattacacgctcctgggaaggacaaagccacaaaaggcgtgacaaaaattcaatatgtgaaaatactagtactacggtaaggactactccctccgtcccacgataaaagggattttaagtttttatttgtactttttgatcgcttgtcttgtttaaaaaaaattaaaattattgtttttttacttgctttattatccaaagtaatttaagcacaacttttcgttttttatatttacacaaatttttttgaataagacgagtggttaagtagtgcaaacaaaaactaaaaatcccttatattatgggacggagggagtaacttggtataaaaccacggtagtacaaactaaaaaaaaacctattttattaaattctaatgaaattattttttactttacctacttccaatatgattattagctgatttcacaatctccaatgcaatgattactaaaagatgaatttattttgagacaaataaaggcatgtaaagactattgtttcaggcttgttttgacacggtttcaaatgcaaattttttttgaaagggatatttctaactttacaaatttgtaaatctagatatgtgattacattaatagtatctgaatgattttttttattttgaaagaaatataaaattttcgagcactttaatttaatttacaaagtatttatccgatttaggatatgtgtgttggaagagtgtgtactggtggttatatacttatgtacgtgtggcgtttgtcttgtgtaatgaaaacgtctcaggaaaaagaaatagtgtatcctgcctgttatcttggtataatacgccttacctactagcagtatgtgtgttcttttttttcttttgagatccagtacatatgtacgtgttcttgttagccgatcagagtacgctcggtaggaaacaggtgagcggtgaaaatgccgctttctccctggaagtccatggcatagcgcccgccccagacactttctaggcgcgcgaggtcgacgcgatcgaagcgcttcattcaaccggcagcgccgtaagccacggagatgcgcagtttaaggacttgtttgtttggagagctactagctattataacttctctcggaatctgaagctccctaaacagcctatcttttgattcagattttgagaagttatagttttagattttagaaaataacttctctggattctgaaactaaggcctacgctgcgcagcactgtgcagcgtcttcccagcccccacacctcacggctcgcaaattaatcaacggaatcatggccagggaggagtggaccgtggaattcaatggatgggcacgttgcgtttgcattataaccggatctagcgttgtctgatgagcgatctcttaactcgtcgtgaccccggaaatatttagtggttaaccacatctctgtgctgcccgtgccaatacagctttttgattaattacctttggcggattgggtttactactagttcaggcgcgtgcatacctcattacagtagtaccttgccccccttgtctcccacatgtaggtctgacggttgacggatccgtcgaagatctagctagcacatctccagatctagaactacaagaacggtgatcgattaatttccgtaacagagctgaactagcagcatatatagtactcctatacgtaccccgagcaagcagccgtacgtacagttgcagtgcaaaacgatccaaagacaatctgcccaccgtgacagcagcagcagcggcagctatacgtacgtacatcgcacgtacagcgcgcgctgcggcgtacgcagtccgtgcttgtcttggcaccgatgaagcttagcgagatactccgatccaccacgcacgtacactgcaccgcgcgcgcagctgcagcttgttgttgtacgtcgtcgccacgcgcgccattatattgatggctcgcaccgaccgccgaccggccggcacggccctgaccgtcgagccggccgccggggaggactggctggtggaccgcgcgcccgcgcgagctgcagctgctgtacccaacta

SEQ ID NO: 66635 - DNA, 3829 bp, Oryza sativa
ctgttccaactgcgacatgcgtagtgcagtgataggactaggagtattacatactgtgtgtactcttctcagtattttttaatactagtacagagaaaaaaaccttgctctagggatctttgcgctggtaaactccaaagaaaagtcacaaaatactccatacggaccgggaatcccaggtacgccgtacgcgcacacgacggtctgcacatttcataaagtggagtgagtgcacatttcataaaaatacagctactagtagctaacagtgcttaattgtttcatgacaaaagctatacacgaagccggtcgcggaccacagcatcacgtcctgacagcgaacctcgtttcctagtaaatcaatacactattaacttatcggcagcgggacatctgcaacctgtggtcctccagtgcttggagtggcatctagctaccgggacctgcgttgcacgtttcctggcgcgccatgaaccatgccggccacaccaaacacgcacggatggatatataaacaactggggccgcacacacacgctctgtctctgtctctctctctgtctctctctctctaatttcttgcacgatagtataaaaacggacggtaacttgtgggggccatgtgagcatgcgacgggctgaatcagcgctgcatcaaagacgacgacgacgacaacaacgtcaagggggggcacggcgagcgacgacagctagcctagcagcactaccggataatggagttggaatctgggcgccggccggcacaggcaggcaggcaggcgtgcgtctccggtcatcacccgtagtgatggatggagtagatgatggtcagggtcaaaagccgcattgagatcgagagacagatgcacgcttgctcatgcacggcacgataaatcataagacccccgctccgctgatgagtgttaggctagctgcacggcctgccgccccccacgcagtgcgcgtccaccagcgcgcgcgtcaggaaagccaccatgtagtagtatgggtttggtggcgtgtgccccgtgccgtgcgctgcgcggtggggcgtcgagccctgagcgcgcgcgcgcgctcgaggccacacgccgcgggtgccagccttttcggtggcgcaggcagctaccaccccgtgatcatccacgatcaaaattgttcactcaccctcacccgtgccgttccacaaatagtagtgctccggtatccgtatattcacaattacaccttgttcgattaattctcttgagagaaggattggatgggatttatttcacacatcaatcctctcaatccctccaaaccgaacaagcccttacagtgaaatctgcttcggattttacataatccggactatttagaccggatcaaaacacaaaccccaaatttcaatctaatctagggttcttcagttgtatctgtagcgcctagttaaaaaccactcgaattttcaagttaaatttttaaaaatcaaactaaattttaatttttaacaaaatttatccaaaattcattggttttattggtttacaacagatcccgtggaatccgatgaaaccactcatgagcggattctaatccaacatagggattgtgaatactatgtatagtccagttattcagtattactccaatattggctactctctttatctcaaaataagctaatttttcatgcatctcacacatatctctactgttacaaaaagagatgtgcttctatacttttttaaaaaaagttgcacgaaaatcaaagcacatcagtggctgagattaagagggattaatactctattcctcattagcgaggggtattttcgtccatggaattttgagccccgtccaactctgcagcaataccaagggcctgtttggtacagctcaaactcctaaatataacttcaggagctaagtctggagtggagttgtggagctgcctaaacctagctccacaactctagtacattttgtgagagagctccacctaactccactcctagttctggtggagctgaaactgtttggctgagctccagctccaggaggggtggagctggagctggagctgtgccaaacaggccccgaattaccaatggcgacgccgattcctccacgaccacgaccacgaccatgaccgctagtctgggatgctctctccttgggtagcgccgctcctcagcctcgcaagcaccgcccgcgcttcccttgcctcgccgcctcccctccctcttcctcccctcgcagcccggccggcttcctcttgcaaacagcgccgccgctctgccctcttcttcctctcatcacgcggtgcagcacgacgctccatgcattttgtccatctcacaactagccagtactcataaacaagtacagtatatatctacatgcatgtctcccccgttcattaatttacacagctcaccaccatcacaagtcacatcaaacttgctgttgcagctactttggttcaattgattggagacagaaaaaggattattttgtgttatttcttctgtttaaactttggttcaatcgaattgcgacttggccttaaatgagtggtagatcatggcaccggatcgagaagctgctgcagctgtcgttggggtggcctgactactgccgtcacggtggtgtgctcgatgtggcggtggtggccttcacgttgctatatatatagtccacgtgctcgaggctgatcttgttgagcatggcggcgacgatcttcattgtggcccggggcagcatattattcactggagctcccgctagctcatcgtgttgcgagcgaactgccgactcaaatcaccacgaatcgatcaatccatcgatgggatctaattagggtgttctagcggggtagggaggggaagcgcgcgggtggcgcttacgctgcagaggaaaccagcgggtagcaacgctgcctgacgaggagacaacgatatcgtcgtgggctggaatttctatggacgaagacgaaagtacccctcactaatgaggattagactgttaacccacttttaatctcagccacttatgtgctttgattttcgtgcaatttttttttaagaagtatagaagcacatctcttataaaaattgaagatatttttattaatactttggtacatcattcgtgtatgaatcggtttttaagttcgtttgatttaaaaatacatatttgtatttaagtcgggttttaaattcgtttgcttttggaaatacggaaagagttgtataagatactagtatctctttaaaaatatcgcatgctaacttgattgagatgatcggactcctaattgcagctcatgattttttagaaaaaatatatatccaagcgaatttctacagtgaatatcatcttaactcaacctaccatataacaataataacattaaaataacattcacccgttgtaacgcacgggcatttttttcctagtcaatacaaagctaaaagactaaaacaatcgtactttatcaaatcgcacaataattatttctttcatttatctctgacttttaaaaaatctgattaaatgattgctaaagaaaatagatttatatgaaaaacaaacgggaaacgaaaaaaataatcttattctcaaatggaggaagtatgcagcagcgagctaggtgacaggtaaactgtagacttaatagtggaatactaacacttatcggtatagttaagtaaaagggacataatgaaaagatttggcccgggaggcccgaattgcccataagggccttgaagtggtcattgcaacgatcgacttgattctctctcaatctctgttcatgcgatcaattcgatggttgctgcaa

SEQ ID NO: 66636 - DNA, 1796 bp, Oryza sativa
taatatatcaaactaaaacatgaagttgcgaatcgtagagcacaagagcaccacaataaggaacgacgaatccttaaattttctatatatattttttaatgaaaatttgagtaattgttataatgaacctttttagtatatttttaactagcatggtggcccgcgcagattgcgcggctagcatcattatattttctctcatataatagtatatatgttttctcattatattattcaaatatattaaaatgacaacataattttaaattttgcaataactttacaaaactactaatgtgtaatattcatattatattttatatatgtgttagttattaattatttttaatattaaattttagttatttgtaaattatatatattcctatatggactctagactcgtcttttaatatttttttaattccgaaatttctgtaaattgtatttctatatagactctatgctcttcttccaatattatttattttatttctgaatttttattatttctaattgtatttctatgtggactctaaattcatcttttaatattctttaatttttaatttcgaatttcagttacttctaaattgtattctatattgaccttaaactcttcttcacatgtttttcttaatttcgaattttagttatttgtaaattgtatttttatacggactctaaactctacttttaattttattatgtttattctaaattttagttaattttaaattcctgtatggactctatactctacttctaatattccttatttttaattttaaatttatattatttcctaattgtatttctatatggactctatactctacttctaatatttcatatttttaattctaaatttcagttatttcctaattgtatttcaatatggactctatactctatttctaatattcattatttttaatttcgaatttcagttatttcctaattgtatttctatatggactctatactctacttctaatattccttatttttaatttcgattttcagttatttcataattgtatttctatattaactctatactcgacttctaatattccttatttttaattccgaatttcaactatttcctaattgtatttctatatggactctagtcttctcttctaatattccttattttttaattccgaatttcagttatttcttaattgtatttctatatggactctagtctcctcttctaatattccttattttttaattccgaattttaactatttctaaattgtatttctatatggactctagtctcctcttctaatatttcttatttttttaatttcgaatttcagctatttcctaattgtatttctatatggactctgctttttctttttctccgattaatgtgagaatttctagaccatgagagcgaacgtggaggctcctttttctatttctttaataatataatagattgttagattcaaccttgtcctacttttcagttaaagtaaacatcctgaaaaaatttagtttggttaaccatcgtaagatgaaggtattcgaatttaattttaagttttaagacattcacttctcaatcaatcacaatctcttcacatttaattctacctactctaaaacttattttttagatggaggtagtacatttcataaccgaaagcatgaaaacagtctacccaaaatttattcaaccttgaactatcaagacctttttatttaaactttaccttgtacaatattaaacttctggacaacatggttttctttgtaacggtttttacaacctg

SEQ ID NO: 66637 - DNA, 3777 bp, Oryza sativa
agcgacgtgagccgatcgatcgaccgcgagcgcgaggctttgtactcttgccactgtggtgtggtccgccactccgccgtatggagaatagtaacatttgatctgttagttttcaatagggtgatgtatttcatttgttttcgcaaaaggaaaaagaaattgtttttcactagcttgtttcttctcgacaagtgtggaaagtatctatgtctcgatgtgcaacccaacattgtgaaaatgtttctttttctagataactattcaaatcgtaaaataggttattattactgctgtttttttattattactactattattattatacttatcgtgccaagatagatatgccaaactttataatttctggccaagattaaaatttatgttgtcacaactctaccggtggaaatatgatacacgagttttatatcactcccggttcaatatttaaaatattacaccgtacaaatcaacgcgggaaaaaaatctacaggttagtttagtttagaaaaacttgaaaagtagcatttcacggttattaaggggtgtttagattcaggggtgtaaagttttgacgtgtcatatcggatattatataggatgccgtatagggtgtttaggcactaataaaaaaataattatagaatctgtcagtaaaccgcgagacaaatttattaagcctaattaatccatcattagcaaatgtttactgtagcatcacattgtcaaatcatggagcaattaggtttaaaagattcgtctcacaaattagtcgtaatctgtgtaattagctatattttagcctatatttaatactttatttaggtgtttaaacgtttgatgtgacagcgtgtaaaatttcaaggcgggatttaaacagaccctaaatttgtatttttggctttttaggctatttgggtcgaagctggcttgcttggtcgggctaggctgctctttaacgggcctagtgcctctactccgtcccaaataagcacagttttacaccgttcatatcaaacgtttgactgatcgtcttatttgaaaattttttacgattgatattttaattgttattagatgataaaatatgaatagtaatttgtgtatgactaattatttttattttttttaaataagatgaacggtcaaacattaaacacgaatatcacagctatacttattttagtacggtggtactgctaaccttcattcattcttcgccgggaaactgttcgttcattaattcacgatcttcagttgcggacgatgttctacagccttgtggctttccatcaccaaggtgaaaatggactgttgttttctctgtataatactgttggtttttgttttgtcagagtgctcaatcaaattgaggtactgtacgtagtactatactccactcctccgtccgtggagtagtcagctgggctcatgcagctgtgcgtactgccacgtactgacgacgctgtcgacgtgtctggcccggtcgttggatcgctggcacggacgcacgcaattatctgccctgcaacgggcaccggtgtagtactactacctgccgtgtggaccagaaattaacaacgatttcgatgccgtctcagctagtatgcggatctggcaccgcagcagccgcagcagcagcaagcggcgccccaacgcgacaaaacaaacaagctagctgcgcgtcacatgtgccgctgctatctaatccgtgccgacaccatcatggaattaatgccccggcagttccctgctcaatccatggatggatgcgcgtggcccgaatcgctcccgcgaactggaaactgttttaatcattcaatcactcgaatagatgtttatccgagtaattagaatccatttcccctacatctacgtactccctccgtcttactacccgttccaaaatacttgttacttttaagttttttttatcattcatcttattaaaaaatatataattattatttattctatttgtaacttgctttattataaaaacactttatgtatgacttatattttatatttgcactaatttttcaaataaaacgaatggtcaaacgttgcgaaaaaaaaagtcaaagcgacaactaatttgagacaaacgtagttttaaaatataagggattttagatgaataggagtatgaatagggattttaaaataccaaaaatctaaacagactctaaaatactattattaagatatgtcatatcctttaaaatactccatacgtacttacgtagtattaagctattatggaacatggggagtactacgtacgtatgatgttgcatcgccgattccggggaccatatgcacgcgtgtatgcgaagtcactcccgtttacccgtgcgtgcacagggcaattgaatggtactcctatcttttggagaggggaaaagaaagggacgcttgatgaatgcactatgcaaccgtcgacttgaaattgttgcttttgaggccatctcacgcattacgtcgcatctggcctgcaggccgtgatgatggaccgagcgtacgtaccgacgctgcgatcgacgcacgcgtgcacgtacatttcatcaacacagccggaagtcccccgagcgaaatttccggcgaggcacacgtgagcaagctagctagatcccgcaccggccggccgacgggagcgtacgtgcaaaacagtgccgttttatgagatcgcggcacgcagcagcgtcacgggtgtacgtacgacgccttctcacatcgataaataaacttaacctccgtgtcctttcgagctagccgtatatctcatgatgggaattgtcagggtcgatccatttatccactgaacctatccgtaaatttgttctaacggatttatagggtcgctctaaaaatataaatggatcaaacggatcaaaccattagaacctaaggttcaagagattcgatccaaaatgacttcacatgtataaatgttataaaaatttatacaaagttgcttcgctatataataattcattcctacaaaattcaactaaatttaacaagtttttatagtgtgaacgcgagtttaaaaattttggatccgagttttacatgtaactagaatttttgggtcttagcaacgcatcgtgggccccacatgtatgaagggctcaaaatttacacaaagttgcttctctgtgcaataaattattccaccaaaattcgactgaattcgataagtttttatagtgtgaacgcgagtttaaaaattttgggtccgagttttacacacatataactagaatttttgggtcctagtaatgcatcgtgggccccacttgtataaagggctcaaattttatacaaagttgcttctctgtgcaataaattatcccaccaaaattcaactgaattcgataagtttttaaagtgtgaacgcgagtttaaaaattttaggtccgagttttacccaaatgtaataagagtagccgatccatttggatatccatagataacctattgatataatggactcatggtggaccgaccctattaaaccatggatcaacgaactcacttaaaacggtttaggttcaatccatatcctaaccattcccatcctgatgtatatctacataggagtatactgtggtgtcttttcttctaaaaatgaagattaagtttttttagcaaaacgatgtgatattaacgtttgattgattgggttttaattattaaaacttgaaaaatatattaagatgatattttagagcaactttcatataaaatattttcgcacgaaacgtaccgttt

SEQ ID NO: 66638 - DNA, 2062 bp, Oryza sativa
tccattaaattattactttttttaaatactctactctcatgttctctaattctattggatgcatgtattgtatttattaggatgattcaaattataagatgataataattttttcttagttttggattaaggtggttataccttatattttggaattgagggagtaattaattgggactgtgttttggagctactcctagccaccattccaggtcaaaagtccaatgatatatggcctacatttcccgcatctatggtgcatataggacggataaatgacgcgcatacgacgagtatgataatcggtgctactactcctaatttatgtggttaaattacgagaaatgctatatgatggtatttcattcggatgtataggatgatactatctggtaggtatgctgatattccgttcgaacgtacgggtaatgcctctgagatatcgtttgatagtcatctaatttattatcccgtccaaacaggatatcgtcgtgtaacattttcctaaattattcatgacaatatagtgtccgggtgtactgttgatggttgaaagcttgaggctaggagtgtctctaccctcttgcgagagggacaactaatctttttatgatttttaaggattgtcgagagatgaatgcagtgcttgaagcaaaagccagaacgaatttatgcttgtttcttaattaatttaaacaagtgatctggatgctgatccaactcagaatttacaattcatctctgtttatgcatccatagttgttctagctagtagtggcatctcgtatatgccaatattgaatatcacacgatagctggtcaaaacatggattggaatttattttataaacatataggagtaatataaacaagcatgccgttggtttgtcatagtactgtccaaatattgtactacacagtacaaatttaagacacctgctaaagggaatcaatcatttcatccattcaacactgtcaccagatctgagatctcttctttcgcatggcacctcaatgcaaatcaaaatcaatatccttgtctccatatggtggcaggagaacaggtatagcttgtgtactcagccttcctcttttgtccaggcttaattcaatcattatatgtacatatctttgtccacactattttccaatgaatgaatgaaacgatccaaacaaattaattgacccaacaattcatgtcagtgtcactgaccatcttagctagcaggaccgtgcgttttgctatgcgcctatgccatgatataaaaataaaactttaaatgattcaatcgacactttttagataaaagagatttcaccaagcaaataaaaatattaggtttctacaacaaagtgtaccactacttaaaaaaaaaggaacgtacatgtcggcactatagatgccagaagtgctaaaaccgacacttataaaccttttcccacctgcacgggttgaaataaccaaaaaccgagagaaaataagtatcagttctaaagaaaaaccacctataatttattataggtgccagtttataaaaccggcacccatcttaagcggagccgagccgagccgagccacacctaccacacttaaatttgccttatctatctactgagcggccgagcccatctctctcgcaacttcatctctctctctctctctctctctctctctcccaatcgaggaggcggatgcaggcggcaaggcgatgccactactctcggaggcgagccacggggtggctggatccggcgtcggcggcaggcggggtggccggatccggcatcagcagcagacgggggtggctggatccggcgtcggcagcaggcggggtggccggatccgacgtcagcatctgttcccgcggcggatccgcgttgacagcgggaatggtacagcggcagcgtaggtgggcgccctcctcagcaagctaccgtggcagcggcgggcgccatccccggtgagctacgatagcagcggggctcgcacgtgcatgggtggatccggtgacgacaggcgccatcctcggtgagctacagtggcgggcagggctgcaggaat

SEQ ID NO: 66639 - DNA, 8072 bp, Oryza sativa
ttgtggttctgttgttgatcttcaatctagatgtgttgattgtttggggattattcattgtatttcatgtatgcatgagtttgggggtttggagcttgggatctatcgaggatatgcttgctcgatgcattggctcgattcgatgcatcgagccgttttctttttttttgcttatgtgcgtctcaaaggtaccagttgtggaatcgtcaccaataacctagggtcatcagtgccacctccgtcgtgccggttggtacattcggcacctatgagggtttctgactggcaccaacagtactttctgcagtagtgtactcgctagtaacacaatctcacgggcaaaagatctaactatgccacaagctaaagaatatggtccccacatcgactgtatcatgttcaggcctaatcttaaattaacactaattgcaccactaaattaagttaaggcccaacaaacttagtccactccaccaatgcaatggtttcttatctttaaactatgctgatcacatatggatcagagacgtcgacttattcacggtcagagaaaacaaccacaaattagagaagtacagttggaacattgctccacccagtgccttcaaatcccatattgctaggaatttttcgaggcttatgaaaaacaaaaataaataaagaaacggtttcatattattttgcaaattatgcgtgtataacatgttagagttttgtgcttggtacaaatgaaaattccaaataaagtaccaaatgatctggccggctcacgcatgacaagtgagaggtcgcttgatgttaatacttcctcagtattttaatgtaagacgtcattgattttttaagatacgattgaccattcgtcttacttaaaaaaatgtaattattatttattttattataacttgatttatcatcaaatattctatttaatatttttatatttgcaaaataaactgaataagacgaatggataaacgttgataaaaagtcaatgtcgtcatacattaaaatacagagatagtaccgtactactccgtaaaaagaattaatcctagcaatgaatgaggattggtcttttttaggatggagaggtatcctctcttattataatgttataacccactaactgttccggttgggaataaggatgcccgaacacagccttagcatcttcatccactttattcgtggcaaattatgtgatgagacgaatcaattaagcttatggtatgtgccttttgcgatactagctcgatcgcttcatgcatgctttagcagaatcgcttcatgcaagatgtcttcatgcatgtcttgattcatccgcttcaattctgccattgtcttgattactactcgtcactcccatatgaggaattaaataatcacataagtgctaacatttcctacataaacaaagcaatattatgtgcattggatttgaaagcacaccatgcatgtgtgcacacatttggacttgaaagcacaccatgcatcgcaacagtgctgtcggcagaaggttccatatcttctatttgggcaaaaatttgtaatgtaacggcactaaataatagtttcagactttcagtcaatccatacggtcatacggcagacttcaatatatatacacgccaattttcagttgttggtcagtcggtcatcttcaagggggttgagctgtatacttgatccgtcctgtatatgcgcccgatgactgaagactcaactagtagttaactaattttaagcatcagatagaaattgaaatagcaacaatcaaacagactgacgcctgcaaccacccaaatggaaatggttaactcgttagcatcatacacgtaatcaccacatgcccacatgatcattccacaagcctgtaccttcccttgcatgatactactataccaaatgaagttttagattctgacatggagagccaactgatgagtatttaaaaaggctaatattcttttcagcttctgacttcttactcattagctcagtctcgattttcagatagtccgatgtaaattatatctgccagaagctctctaagcaggaagctatcatgcacgcttcactgccgctgcttaatcttagacggaagcaagtgccaaaccatatcgatcatcagtaacaacttgttgggggcagaactattctgcaagctactcctggtagcttggctaacttggtttgcaaaccggtcccagctatcaaatagcactcgccatgtgaggctagcctacactttaggagagcccaatcagtcgccagatctatttaattagaaattcgagaccatttctttaagatgagacaacggattgatagtgctacccaagctcacaccactgctctacagcccccttgatctcgacctctccaggggaactgaaaatcttcaagcactctcagtttttatatatctcgaggcggccatcatgcacagggaaattggacgacgacgagacaagatatccagcccactagtggcaccagttctcgtcgacatttcacgttaaaaagatggtatgccggattgctaatggcgatggatcggtgcgtacgtactatccggccggccgggttgctgtcgactgcgtcgggtcgccgtcgtgcccatgcaatgctgctcctcttaggctgtttagttcacgggtgaaaagattttacgtgtcacattaaatatatggacacacatctgaaatattaaacatagtctaataacaaaacaaattacatattccgcttataaatcacaagacaaatttattaagcctaattaatctgtcattagaaattatttattgtagcaccacattgtcaaatcatggcacaattaggattaaaaaattcgtctcgtaatttacacaaaatctgtgtaagtagtttttttttctgtatttaatacttcatgtatgtgtctaaacattcgatgtaacagggtaaaaagtttttgtttgggaactaaacatcaccttagggcttagggcatgtttagatcccctggcaaaattttacaacatgtcatatcgaatgtttggacacatatgagaattaaatataaacgaaaaaaataactaattacacagattgcgtataaattgcaagacgaaacttctaagcctacttgcgctatgatttgacaatgtggtgctacagtagacatttgcaaatgacggattaattatgcttaataaattcatcttgcggtttacaggcggattctgtaatttgttttgttattagactacgtttaatacttcaaatgtgtgtctgtttattcgatgtgacacgccaaaactttacacccctgcatcttaaacacagccttaggccttgtttagtttcttttttttccctaaaaacgtcacatcgaatatttagatatatgtatggaacattaaatatagataaaatgaaaaaactaattgcacggtttgcatggaaatcgtgagacgaatctttttagcgtaattagtcaatgattagccataaatactacggtaacccacatgtgacacctacaaattttcttttcgcgaactaaataaggccatatctttttttttccttggcaatggcgtaacagtacaagtacgtagggagtaccagcctagctagctacctatggcgtggaccttctgccccgggctggcacgttggatcgatgcgtggttcacttaatttgttctggtgcgtgtacacaagtacaggcacaggcgcggcaaaccgtacgagtggtggtggtcggagaagtcgtgattagccacgctgaagtggagccatcggaacagcgggcgcagctagctagctgcaggcctgtagctcagtcgtcgtcgccgccggcgtgcagatgcagcagcgagagaggcactggggtatacgtactgcgcgttactgtgcccatccagtgcgcccgggctgatttgattagcctgaaaatggatcggtgtcctgtgccatcaaatctctatcaaaaattcaaaatccgcttgaaaaaactctcttgattaattagtgtcaaagactcaaagttgatgtgtcgatcatgaaaacaatgttgattgacctctcttctctctgccatcgcgattctcagactgtagctagcatcctgtagcaccgtcaacccgtggtaccatacagggagaggatcgatcgatccgtccctgcgtgtattcgccgggctgtagacttctagggccactctgggccgtacgatcgcgacatatatggatggccacggttcatcgttgatcgctcagcacaaccttactaggcggaaacaaaaatcttgggcaatgtttttcccgtgctgatcttgtacgaatgggtccttcatattagatatttactccctccgtcccataatgggatgagacccatcctaggactacgaatctggatcccatcctaggttgcaacattatgggacggagggagtagatgtctactgcacgtctgttgttccatcgtacaaatgtatgacgttaattaggatatgcatatctagttcagtacggagtagatgcttagatactccagctgtctaatggaaggataagatcatctctgtttatgatccttaactttaaaagaagcaactatatattctagaggggccgttgctcccaaatttttttatatctttttcgtcgctcctatataaaaacgatatttttacagctgtaaaatacatttgcaaaggtggtttggccaacctcctgtaacaaaaaataaatgaaaatggcgcattttcataggcgggcaataaatcatctatgccatgtggaaataactttcatatgcgaccagcttaacatcactatttttagaaacaattttctcgtgcaaccttcttatttaacatgatcatatgtaaaaactatttcacagttgggtgacctaagttaacgtatgaaaaatacctacttctaaagacacccatattttttttaagggaatgccattcagctagctttattgatcattacacattggtacatcgtttgtcaaagtgcatagaatataagcaggaggttcatcaacccaagtacaatactctttcctactaaaagctaccctggccaattcatgagcaactttgttttgcttctctattacaatgttcaatagatatgctatcaaaacctctccatattagattacattctccatattagataacatatctaaagacgtccatctaatactactacatgtggaaatggggttacttccaaatacaaatgttttaaatcatctgcctcttagatatttgtttgtatagacagccagtgtcggtgtgtaaccctaagaatactgcgatggcggatttcattgtgaactgcccatacagtctaaaggggtatcaatgaaaattatttttttgttgtagtatgtacacctggcctagctagggttgtactactacgtaatcaagtgcagtgtgcacgatcataaggccgtgtttagtttctcccctattcccaactttccatcacatcatatcacatcaaaaactttcatacacacataaactttcaactttttttttcacactcccaactttcttcaaactttcaacttttttcaggaattgaacacaccattagtactttgctaatttgggccctccaattttacatttaatccaagacaacgttctaacttctaagtaataaaattaagaacattcttatccttttttttccacaaaaagaaaatctccctccttcaatgagatctagctaaaacatgcttgtttaattttcatggccctgaaaataacacccacctaaaagacccatgaaagttagtaaattataagttagtatcagggtctcaaattattagatattgcctagcccagtccaggatttcccaaaccgccggggccggggttaccacgtcccggcggtaagcacggttaccgcgcggtaaccgtgaaaaactatacgaaaccgtacaaaattcatcaaaaattcaaattactttttaatttatttaaatttaaggaggttaccgcggtttttctattaccgtaccccgcggtaatgtaaaccttcccgtcctatgcttcctcaaacaactacatgcttagataatttccatttatctattgctcgtcgagtcgttgtacatggccttgattagccagcaagtgcatcggccctatatcccggaatcacactctttgaaaaaaaaatgagtaaattgcgcccacggtacacaaacttgttaggtaggtgcaatttagtgtaaaaacttgcaaaactctcgttttggtgcacaaacttgtataggtgcgtgcagactatgactaaatagaatagcaaatctaattttgctgagttggatgatgagtagaccgccaactaagcattcacgtaagaaggacatgtttgcctgctcgtaagcaatggccctattttatcagaaaaccccttctattgtttggtatttcgatcatgtataatttttaagtgaaacgaatctgagaggtgttcatagcggcggggagctgggaaggtcgaatccgcggtggctgtagtgatgggagtcgagcctgacagctacgccgtggggggagtcgagtccgacggtggctacaacgggtaggtcaagtctgacgacagtagctgcaacagtattgccgagactgactatagtgacagatggcgaggaggtcaagtttagtaggagagcttagaagttgatgctgcggtaggcatttgagtgccttgctttaggccaacatcagttatctcagactctgacaattcatatagcaactttgaagcctagctccaatgcttcagtgcagacatggaagcagcaaggaattaagccattgtgccgtcagattaacagcatgaacattaagtccactgaagcagcaaggaatgtaatgcttaattgtacacattgtgacaaaatctgaacacaatgaaacacgtgagtgcatattttgaacagaaactgagatcctgaataaaattcagtgaataacttgaatgaaaactaaatgcataacttggcatgaatttgattgtgcactagtaatgtatctcaaaatcgataacatggaaccaactttatgaatgcatagtataaactactgtttctttttcttgggagagtttttcttcttgggtgctgcacttctcttcctcaatgtggccctcccttgtttggttatgtggttagtggtggttgaaccccttctctcctattagtagcaatgaaagcagactctggcaccctttcttgatgtttgctagcagcctgtaaaagattatgtactaattttatgatggttgctattagctgacaaaatgctagcttaatgaaggattgttttttctttgagaacttaatgaaggactgtcacctccttataaaagcttccaccacagatgaactcagatagttagaatttttttggggtatgctgagcaggtgcatttcctgaaacaaatatatgttctgtttaaattcccttgttagtgcagctaaatatatacacaagcaaaatgagcatcaatagtacctgagtgatgacaggttcctgaaacaaatatacaatgagtttaaaattcatagttagtggagataaacaaataaacaagcaaaataagtataaatattacccaagtgatgacaagctcttcttcatcaacaattgatgaagtcgccatttgctgtataggttgcttctgaagttttaagtcagccttcctctttttacaactagttttgttgtgaccaccatttttgcagtagctacaatgcatctctactccatgctttgaaattttagtcccaccctctagttcttggggctgttttctcctagttttctttggcctccccactttcttctcatatactggtggcttcacctctataccctgcatcttctcccagtggatactatctctcagtggcattatgttgtagctataagcttgttcatagcacctggttgaatagcaaaatgacactacatcctctggcttgatcctttcatgtcttagacaggaaatggcatggttacaaggaat

SEQ ID NO: 66640 - DNA, 1351 bp, Oryza sativa
ttaaataaaacgatttgcatattataattgttcgtttaatggtaaatctagtaacatcaaatttacatgattgatattttttatttttttgctattaatagtcaaaattaatttaaaaagtttgacttgtcactatttaaaaatgcttatattttgggacagagggagtagtattgatattatttatttctttgctattaatagtcaaaattaatttaaaaagtttgacttgtcactattctaaaaatgcttatattttgggacggagagagtaggtatgttttaatttctacatggaaatgaagcgcaataatgtctctatttttttttggaaatttaactcacatattcctttttaatttatatattctgattttttatattttatatttcttatttaccataattcaaatttaattcagccctaaaattattgtttggaacaaatcttttttatgttcattaaatttatatttataatattgcctaaagtctaccatgcaggatccataactataatgtatatttatatataattagataatgaacaaaaacctagtatttaaattaggctactttagtcgcttaacttaaaagaaatcgttccatattatcttgcaaaaactaatttttattcccacaacctagctagcatcgcaatatgtacatacttacaatttacaatcaaccaactaaattagggctgccatccttttgttctgtaatttggtttggacactttcggatgcagcactgcaggtacatggtcatgaccttaataacaattcaacagtagatatatactagtatatgatatatagtgtagaaactaaatctataccgtagttcaacaggaactcttcccttcttttatggctagaaactaaatctatacagtagagttgaacatttatagaatagagttgaaaatttatagaattttctatttatgtgggaattaagctttcttttacccactaatatgttgggccgttgggctctttatagctgttttttttcatccattaggattaatgttgggctctcctaggagagccttcaatcagtataattaaaattgttttcattttctaagaattttgaatgactttgcagattgagatcaacacagttgatagaactggaacattcttaggttccttatgggaatctaatatcaatgtggcttcggttcttttggaggctggtcttgctaagatcagctcatttgcagtggataagatgccagatgctcaggttctcttaaagactgaaaaaattgcaaagcaaaagaaattgaaggttagacacatctatttttaataggttaaataaatttcttctaatgctg

SEQ ID NO: 66641 - DNA, 5803 bp, Oryza sativa
ccatggtaatcttttacttttttttcttacatatatataaaatcatgttgcatccattcatgtaagtatggcattattataacataatatgaacacctactcttttacagattataggtgagtgtcagggagttgaaggacctgagtttgaagtattttacattgactatggaaaccaagaacttgttcctcacagttgcctgagacctatcaatctatccatttcctctattcctccccttgcaaactgtgcagccttgcctttgtgaaggtgcccagtctaaatgactatcttgggcaagaggcagctatgtatctgaacagtatcttgcttgacaatgggagagaatttgaggctattgtcgaagagcgagatgctgcttcgggagggaaattgcagggtcagggaaccggagaaatcctcggcgtgactctactcgatagtgagaccgacaatagcatcaatgctgagatgctagaggtatgcaattctagacagagttttcacttaaatggtatttatatattgaagttagttaattagttctagtggttgttttcacccctatcgacctttagcttataagcacacagaaaaaaaaaactttattgtagacctgatttggggtttttccattgcaatttatttttcaatattttcttttcaatcacgaataacctcttataataagtatatattgttaaattacgttacatttggaattcactaactttagcatataagattgtaggttgtgttcactaacatctgttccttgacatactcaaactcctgaaatacatgtctaagattttgtgttgctgacttattttagatttcttttgaaaaaaaaatcatgtgataaccattgtgtatctctccatttgcagagagggtatggtcaacttgagaggaggagatgggactcgagggagaggagggcagccatcaagaagcttgaggaattccaggaggtagcaaggaaggagcagctaggcgtctggtgcccaaagaatgcaaggaagcagggcatggatgaaaacgagtaccctgtcctggccagagcaccacctcccccaaagaagggatatgacctgatcaagttcattgcgtcccggtccgactaagaaaaaaaaaaaagccttgtgtgtttgtgttgaagatgtcatgcatggagacagaacaatttccttaaatccaatttcgtttttgttggtgcatctcttgtgatgtcaaactttgagatactacctttcaacctttgtaaataaaactcactattggacctaaataacctagctatgttgtttctatggacttctcagttattggtggttcatatatgcttgtttgtttttgtaatttgtacttcagtttggttagctcactttcaagttgaaactcatagcacaaatgaaatgtctacaggaaaaaaaagaaagtgatattaaatcctctgctggctgtgcatgtcatttgtatatttttttctttttagagatgggtatttttacccggccactacatccaaccgaatatatgcagcctttttaaattgagatcttagcctaacctaatctgaaattctctcatatatagatttgatctcaggaccatagggtgctactcaggtcactgcaaccactaggctacatgccctttcacgcatgtcatttgtatatgatagaccatgaggaccttcatctaaattaataatgagcttaatgtaacatgctttaattatcaagcgggactatgcccattaagtttatgcaggggaaaatgcaagatctacaacctcatcttgtactccagattttgggccaccgcaatcatgtgtaaacaatctacactctatttttctttagaggtaaactcattgttatgttctaaatttgcacctgctggccagcgcaaccaggtgcgaacaatgagccactcacttctatggagtcatcaatttcgttctgctctgtgaatagctacaaaatcactacaaccagaaatgatagtgatatgatgtaaggatatgttacatccaaccaaaatcccatatatttaaggacggatggagtaacaaatatatgattatgtaatgcacaattacatcatatcactcatctatccaaattcgttatactaggatatgtcacatccaatcaaaatctcttatatttaagggcggagggtgcagtaactttcccgattcatgttgtgaagctcgggatgctcactcaagaaaatatgcatgtttctttggctcctccaaaacagttctgttgctttgtccaaaaaaaaacacttgtattggcctaaaacatctgtgtgttcaacttttagccttaacatcaataaacactccaattggttttaaattaagaatttgctaaattacagtcggcagaaaattaggactaaaatcttgcatatttctctttctggtgactggcagaagaggcaggtgacatcggcatctcacatggtgggctggtgttggtagcgggggtaatgtagactgagtgattaggaggtaggggtgtctctggtggcggggatccctgaagaggtctggtgggcctcaatcgcgtggtgcagtggggtggcggcaatggaaagacctaatatgcgcctaggcacacgctccccctacccgcgcgtgcggagagagggaggtggaacggcgtaggagaagagtgcaggtttctttttttttgtttctctttgtttttttttcagttttttatatgtacatataccagctttgtatccacatgtacttttttatacgtcaatttttttatacatagagtttatatatatacgttgtatatatatgtctgtatatactttgtatacatacatataaactttatattatgcaatacaaagtttatacatataagttggtaatttaaaataagggccttaaaataaatcatatgtagagcataggagagaaatatgaaaaagagacaaggttgacatgtggattgcagtattttctttttttattattaattttggttttgtttattattattttgtagtatttttttgataactcatgcatttattcaaaggccaaacggataacatggtacaggagtagatacagtgctcaaagaagcccctcaagactgggcaaaatactctctccgtccaaaaaaaactcaacttctagagtttaaaatttgtcccacgaaaaaccaacttttaccatcctacctactctcagcacgtaaaacgagaagttttatcccttcaatattctttacctaccttctctcttactactttttttaattattaagggcattttagtcattaagggaattttttgtgggacggagggagtacactgtaagacaacattttgcagaagaggacctaacaagaaactggaaaatcaatcaagtccttttcctttgtttgccttcgctgtcgatgaaatcctaaagcgcaactctggtggagagtagatccagataagccgcagatgattaagctaccacgtaatcccaaaaggggcctcacacacatgcaggtttggatggtggcaaaccatggtatgaattccaacagagcacaagaagataatcggctaaaaggaatttcttccaaagatgacaaacgaatccactagaccagcgaaaaaacaaaggaaaacatagcaatctgcagcagaaaccaagaggcaaacctatacgaggcctccgcacaaaggaggttgaaactatctcggtggagcttgaaaacctcagacgtcttgagagagagattcgccgcatgttgagaagaaggccgccatcgttggaaggaggacaccggagaaagaaagtaagaccggtattacttttgactccggaggattggatgaacccacagtgaaggcgcgtagtagacacccagctccaatggcgagtgtcaccggatctgaaatcggcggaactcaccgtgatactaggacgagggaaactgaatgccgacaaccacttcgggaaccaaaagacaacaaacaacgacatgggaaccacgaccatacgcccatacgggaagacccgactagaattacaactaatagtagggtagatgggttggacctctctccatcccttccagggcggtgagacaccggagaagaagagagagagagaggggccggaggaaagaaaagagcactatagaggggatgcagaagaactctcgagaggagagaagcatggtgaatagcatctctttataatacttcctccatcccaaaaaacatgacgtttcaccgccccagcatcattttgtagtatgttgatgttatcactattagctaacgtggactccacataagcattgtcatcgaaaattagtttgtactcatggatgaaatgtagaaatttgtaacaaatagtgaacaattttataattgagtgcccaaaattgaaccaagttaacggagcaaatttaatctttccttgaaagaataactcaaaaggaaaaaaaacatagtaacaacctcattttttggcttaagcttatggttatcagccaaaatttaaattttcaaccttaaatttgagttgattttggggaattttcatcgaagtttattttccagcctttgcttttagatcgctaagaacacgtatataaaagtcttattcacaaattatttttcgtttacaaatatgccgtttagcttatttttttgaacttcggctaattaatccctctatcttatatggatgtggagacttgggtcatatgtttcttttctattttcttgaaatttttaaataaaaattcaccctcttttaatttatttatgcataacagtacagttagtgccattacaatctatgtcgtggtgcggtaaaaagtttgaaattttgtaacttgttgtagatttgtagggtttattttttaaaacgttaaaaatgaaatattaaaaagccaataaatatttctaatgaaataatcctttttctttttatatactcctatatacatattcgacgattttagcgttcttttttcgggtcgtgagcacagcgtggtggtactggcactcctatatcggagtagtagttcttttttccttccgagatcttccatagtcacagccggttgaagcccccatccgacgtggcgtcccctctggcccaggcgtcaccagtcccacgtggcgccaccccattggccgccaccacgtcgcgcaccttctcattggccggaacaagtcacgccacgcccgtttcctcggtcgcccccccgccccgacggcccgatcgacggatccccgccgtccgctaccccctccccctcatcctggccgtccatccgctccagttccgcctcttcttataccctctccccccctctcttcatcccccaagccgcggagagagagagagagagagagagagagagagagacgcagctctgttcttcttctcctctctggaaatttctggatctcgcgagagatcgggaggacgatggtgggtgggcgcgcgctcctgccgctgcttctgctctccgcgctgctcgtccagatccgcgcctccgatccggtaagcggcgagttcttttttggtttccttggtggagaatttgcttggagtggtggtttggggggtgagatttgtgatgcttttttttgtgttggatttctgtgtgtgcttgcagctgttctatgagccgttcgacgagagcttcgaggggaggtgggttctctccgggaaggacgactacaaaggtatgcttaccgccgcatcgagatctgtgggtttagcgggtgtgcttgggggg

SEQ ID NO: 66642 - DNA, 768 bp, Oryza sativa
catgcgattgcggcgtcacgatatgctggtctgtgtcgtggaccctgtgagcgtctgttttttttcccttaggtagtactagtacacacaacgctaataatcaactagccgttgcgatgtggcttactttaattttgttcctgctcttataggattatcgtaaatatgctttaactaaattgcatttaaagtttgtagtatatgttgatcctgtggacgttgccagcttatttatatatgagtagcctcactacctgttcctcgtgtgaacatatcgtaatggcatccgcgtgctcccctggacagcattttgtgtaattccttctgtattgacctgatggtacatgaggttatttgaattttgaaatgaagaaagctgtcatgtatgctgttgccacttgtggcgttttgttctttcatctttacttcaaaaattctccatatgctaagtcgtgaaattgaaaggcatgtctagcttgtacagtttgcagtaaacatatctacttttcattttatctgccagtgtaagattacgctaattttctacctcaattaaaaatttatgttttttcaatcggttctttatagcgcacataagatggcttaaatggtgatgtacttactgtggtttgcaggtgtatggaagcacgaaaagagtgatggacatgaagactatggcctgcttgttagtgagaaggccaagaaatatgccataatcaaggagcttgatgagcctgttactttgaaggatgggactgttgtcctgca

SEQ ID NO: 66643 - DNA, 7533 bp, Oryza sativa
  unsure (1)..(7533): unsure at all n locations
tatattatgaaacatctagaaaaaaagttgtattatattatggaatggagggagtaacaactaacaagcaagttgttatgatttccaactagtagcttttattcatttaatcgagcaaaaaaaactgcataaaagaaacaacttaattccaatgttttttatcaactgcagtttaattaggctggtcaaatccgccataattaacttcgattgtttcgcagttaagcatctgcctaagttagttatttcaccacaccaactttatgatccattcgttaggtccatggtttgtcctcctactgaaaacctcacttgtaaaggattttgacctctacctgtatacgggccagcaaaagtcaagcaaaccaatacaaggtcatggcttcctcccgccaggtcaaagctggcaaccgaaatcaaccacgggaaagcgccgtcctggacgagattaacgtctctgtctcattcttcagaggaagaaaatgacataacccaaagaattagtaattaattaaatacgatcatggataaaaatgagccttacacatcagttagtaattaattaattacggtcatcagtttactactccctgaaacggtcatcagtttactactccctccgtttcaggttataagacgttttgaccttggtcaaagtcaaactatttcaagtttgactaaatttatatataaatatagtaatgtttataatactaaattagtttcatcaaatcaataattgaatatatttttataataaatttgtattgggttaaaaacgttactacttttttctacaaacttgttcaaacttaaagcagtttgactttgacaaaatttaaaacgttttgtaacctgaaacaaagggagtaattaattagccaaggaattaaactgatgtgttaggctcttgatgatgattcgtttgctgtcgtcgattgattatggaagaggtaaagtgtcattatcagtttggtaggggggaggggggggggggggnnngnttcntnnnncncnnggccngccncgaaggcgcctgatggcacacacatgtggtctacgtctaccgggatatgatacgcattattggtctccctactgctccaaccttcatgtcatcgtccttctaataattaaaataattactacactatgcgaaattgaattaggatacgctaacctagtagtatatatatggaccaccaaatatggctggattttacttcacccatttcaatatgaagccgacccggagtaaattgttctataattactaccccaactgattcaaagtttgaaattcaagatagaaataatttcaacattaggctacgatcagttgagccactgttggcaacatgtagaaaaaccaacaaaatattaaaaaaatatttatggctaaaatttttacatatctaatatgagtagtttaaatgccaaggttgtgctcgggaggagaggttagcaacctctccccatacacggaaaacgtggttacttattaacatatggttaattaagtattatattaaaaacttaaaaatatattaatatgattttgtacaacaactttcccatatatcttttttattaaaaaacaatgtttaacacttcaggaagcatgcacgtagaaaacaaaagaatagaagttggtactccctcgatcttaaaatataagcaatatggattgattaggacacaccttattactacgaatctggatgtaggaagtaacttatagacattagtaactgaagaatagattatgagaacaaatataaaaaaactcataagttctctttttatttaaattttaaagttttttttagttcatacttgtaccatgtgtctgctcgtggtgaatttcgtggtgttttttttttactggttggtttcacctgtcagtggcagtgccagcttcgagcagtgcaacggaaaagggcaaaaaagtcagcaggcggaaaaaagcagcagcgagaggagagaggagaggggggcgcaggcgcaaaaagcaagctaccaccgcagcccagctcgaggccaccaccaccaccaccaccacggcacggcgaaaggggaagaagaagaggaaaggaaaaaaaaaaaattccgcagctgctacctctcgccgccttcgccgccgccgccgcgagaaacccagcggcgtcccgggaaaccctagccccatcccccaccccgccgcgcgccctcatggggcgtccgcgtcggcgccagtagtagacaggagcggggggcccgccccgtcgccgacgaggggcatccaacgatggcgcggatacggcgcgcgagctccggacgaggttagtgtggcccgatctgagctgagctctccctcccgcgcttgctttgctgctggctttagctaggtggtgtcgtgtggtctcggtgttcgcgctatagctaagcgtagagagcaatccgagggtttagctttcgcggcacggcggcggcggctcgtgcctgtgcggcgaggtgatgcggcgaggggttgggcttgaggggagaaggtgcgtgatgtcggctaatcaactactgtggtggcggtgggggggttggcgggtttgttccaggatcttagtcgtcgccgcttgttcggtagctcaactctcaggccgtgagaatttgggtttggtgtcgcgggaatggtggtcatactactatgtaggattcagtgctctctgctgccgtggcgatactggatatctggaatctgatcgaagaagtggggcttagcttaggttatcaattatacaaatccatgccttggatagctcttggttctcttgtattgagcttttctatgttgattacttaaagctgtaaggcggttttctaccacagaagcactatacattttctggactttccatgtcaaattgcaccagttcggagataacaaccattgctatacagaacaagtactttttagtctagttcatctaggatttgtatcgaccaaaaatatacgatgagcagctggatgtccctagttcagcatacattgggttttaaaatagtcaaaattgacattagtctgtatttgttgtagcctctgatctaagtttgagtcactacaaatggatttgtgatattgattatcaaattcaggccaatggatcctcctttacaagaaaatggtcattactgaactcttgttactggaatgatgagaattcctgcattgctgggtttgcggaaagtatctactttatgcagagaaaataggcaacatcatgtttaccatgtttggccttttctgggaaagttattataagttttaatttgtgtttatggcttcttatggaaggaagctctttcgttttcttgcaataacttgtctttctagaactaattagctcaagtcaaaaaaatgtttaatccaccaccatagccatgttaattagattatgctttcatgcagggtaataaacatcattataggttgaacatataccatcactgtctctgctgagtttatcaactggagataaacactttgaaaatagctgtcatactatttctggttctttatagctaaataatggtggtttatcgaaatatttacatggtctgtaaaatctttaactacacatgccatgaggtcttatgaaatcctctttgctattgatttacactatctttacttatacttggaaacatctgtgaatgcatataaatatatgcttgtgaacttttgttcaactactccctttgattccaattataagtcgctttagacttgtggacacaaagtaagaaaacagctcaaatgacttagttgacttcattggaaaagatgagccatttatttgtgagaggggtatcatttatttagcaagggcaaattgggaagaataactgcagaaagtgcctagaagttccataacttcttacatttaggaaagagttgagaatgctaaagcgacttatatttggaattggagggaatatttgatttatgtgttagagtgactatcttgaaaggtgattctgtacatcttttgagtgttcatattcattagttgcacctgaccagtgtcaatgtacatacatattctttaaggcgttgacttgttgattcttcattgtactgtttcttggcagggcttttggaagatgctcgaaggaaaaccttcttaaattttttggctgtggtatttactctggaattgattaccagaatcaatttgattgcccaaacatcagctctaaatgtggttgcccctgctatatctccatctcaaagttggagaccagttcgctccatgttgtcaaaagctaaagttgacattagtatttcagtcagcgaacaaagacgaaagaagctatattcatcaccagctactctatctgtgcaccctccaatgtcagcgccaagctatagctccatttctggtgattctgatctctccttttattcttcagacatgtcagataatttggtgcagcataacagacgctcagaagcagaaatttctactcatgtagatgctgcgcctcctgatgcagcctcaaatactagtgcagctccttctggattagtacaacctccagtatctcctcacaatggtatgtttgattgttagagccttggaatcatctaatttatatgattttcattattcaagcatgacttgaaattatatggtgtaaatacaatgcgtaaagggccatctggttattcgagtagatacacaaaatgatgcctgtgtggttatttctgatttgcctttccaagaatttgttctttgattgcacctcaaccgtaggcatttgagtaaattgtgcaattcttttaccaatcaaccaagtgatatcaacataaattattcaattgcaatttgcttattaatagttaattagaaatgttaactctattgtgcatatccacattcacattggaatgtacaaagcttttacttagatctgtgtggtatcatggtgcaccttgatgattcggatcaacattttggagatcaatgctttggatgtttctatgatcgcaaacgccggcaacagaaaacgcgcaaagaaccagaattaagctgaggggataaagctccatcattatcttgcttaagttttgttggtcattatcttttaagttagtcgtcatctttagttcactatctcaagattgttagccatttatctccaagtttgttaggcgtgtcaaatcccttgatctagaaaagggtatccgggtgtaaggaataattaagtaagattaatctaatcaagtttaggcatgtttagagcctctcgctctcgggggaagagccctgcctcccgccagaggatgatcgcgagtttcgcccctaccccctccaaaatcatccactcgagcattcactgctctgacagccgctgcaacaccatcaccatcgtgcgcgtatcactgcatacttgaagcatactgaaatgctcagtgcctgcgatccttttggccaaatccaattctctgaatactggtgtcagatgtgaaactggctggttgttttgtaacctgtttggttggcattgtaccagcttcaataaaggcttgcagcgagcacatggaactttgcaaagtccatgtatgcggtctaagccaatttataagctaggtctcgcttgtgctatttgtcactctgctttttcctgtcatgtgagctattgctattgacttgaacaactggcttctgtgattaagcttactctcattgatcttaacttttactgctcctaattttggcttatctgcctgatcacttgagaactctatagtatgtccagcttatgtggcctaaccacaacccttttttatgctcacattaaacaataagatacaaaatacatgtggtaagtaaacattggtatttttgttgttatcttgtgtaaaataattaatgaattatgtgaagagtgttatatgaaattatagtatggataatatcttctacaataatctgttttatttgaaacatgatagtattctgttgttatcctatttgcagtttattctgacttgcttattgaacatggcccccaaatattgtgggacttcagcttagttttcttcatcccttagtaatactgaagtacacattattgttgtgctgtctgcctaagaaacgtttatgctacaatatggcatcttttctctctcagttatttccagctctctaagatagctcagtgagatttaaccttactgttttccccatttattttgcatttggaattttctcatgtccttggttttggcctatttgatccaaatattttagtcacagatttgttgttaaccattatttgatttgtagtattctctaacagctatagatatgctgttactcacattataatttaccttctgttttaccagcatgttgttcacataacatggtacaaaagagagggagccaagattgccattgtgtttacccagtaagagttgagctttttctccgaaatgtttcactgacgtcaaattggagcgatgaatttctgggggaacttgcttctcaactcagtctgagggttactcagtttgagattgtaaatttctatgttgttggggcttctgggctaaacatcacaatgtatatagctccccatacaggaattagtttctcagccgaccaagttaccgcaatgaattattcacttagtcagcatacagttcagatcaaccctgtactagttggtgactacaatcttcttaatttaacctggttcaggccactggttctagctcctggtaatgctaactgatcttgactttgctctatatattacaatgccgcagtttattttagtgttaaggtagagaacactgtaagactacttcagtttttttttgcttctttaatctctattgtctactgtactagagaaactgaagaatatatatagtatgtggtaatactgctcatatgtttgtgattatcaaataagcagatgattataaaaaaatcactgtgggttggcatattccattctatagaatcaattagcaactatatgccaaagaaaaaacagaaaagaaaagtaagataaaattacaatattcagttccttacatttcttattctgtttttgttctgctcctctatacccttcatgcatacatagagtgcatcttttaatttgcatccagttctactgagatacatatatcttatactacatatgctttgagtttagcactggttgatctagtactctagtgcaaactttgtacacactacacagtttcttatacatattccggtcattaattcttggtgtatcaacttggttatacagttaatgtgctattttctttggtgaacttggctgtgcttcctttgttgatgatgtgacagaaaaggatgtttggtgatatcaatatgatacttcctatgaatgatataaacattatttctttatatttacagccctgtatgctgtccagctatggtttttcttttaacaaatctcctttcctaatattgtgatctttcatttctatttcagctccaacattca

SEQ ID NO: 66644 - DNA, 2938 bp, Oryza sativa
atgcggtttctgcagtggactcacttcctcgcccaacaagtacaaggttccttgcatatgatgaactgaaagaagcaaccaacaactttgatccgtcaagtatgcttggagaaggaggttttggccgtgtctttaaaggggtactaactgatggcactgccgttgctataaagaagcttactagtggagggcaccaaggagataaggaatttctagttgaagtggagatgctgagcaggttgcaccaccgaaaccttgtgaaactcattggttactatagtaaccgtgagtcatcacagaacctactgtgctatgagcttgttcctaatggaagcctagaggcttggcttcatggtatggccaattgagtcaactatttctccttctgaaattgctgcataagttccactcagttgcagttgaatgtggtccttcattgtttaattaattagtggtgatcatgtaatcatgatacaccttgactcttgagtctctgactacttacatttttttcaggtacattgggagctagccgccccttggactgggacactagaatgaggatagcactagatgctgccaggggattggcataccttcatgaggattctcagccttgcgtaatccacagggatttcaaggcttctaatatattgcttgaggatgactttcatgctaaagtgtctgattttggtttggccaaacaggcaccggaaggttgcacaaattatctctcaacacgtgttatgggaacattcgggtaagcaggttgaccaccttgaagtactccccagatgtttctgctctgcttttgcttcatatagctgtcgtgctttcaggtatgtagcaccagagtatgcaatgacaggacacttgcttgtaaaaagcgatgtatatagctatggagttgttctacttgaactacttactgggaggaggcctgtggatatgtcacaaccttctggccaggaaaatctagtgacatgggttagatttctttctgctcttatcttcagctgttattgtattacctttttatatctgaacatggatcctttagtatgataattgtcatctgaagttcactagccatgcatgttagatatttatcgatatatctcgacaaggcaaacaaacaaatggacttagagcaatattactactaatctgtttcctttttcgaaaaaagagagacattttttatgttcctctctattcatatgcattgtgtacatccttgggtggaaagcagatttatgtgtgagtaaatttacacttcaacatttttttatgcctgttgtgccaaagcgccatctatctgtttgtttctttttgtgcctatgtttatgagcttacacaaatgtttcctgatctttccactaaaagccttgtgtcacatcaacctttgctggccaatttgtcaggtttgttcattaggtttttgaaagccaactctcaaacgtcaacgtatttcttgtagacagtaccaaattcttatccctgcataggtgtagagatacttatttgctcaattttgactacgcaggcacgaccaattttacgagataaagatacgctagaagaactagctgatcccaagcttggtggccagtatccaaaagatgattttgtgcgagtatgcacaattgcagccgcctgtgtttcaccggaggcaagccaaaggccaacaatgggcgaggtggtgcagtcactgaagatggtccaacgctctgagttccaggaatccataccaacacctccagcacgacccaatgttaggcagtcctcaaccacctatgaatctgatggcacttcatccatgttctcttctggacccttttcaggcctcagcccctttgagactgagaacatatcgagaacggctttctctgaagatcttcacgaagggcggtaacagtggtggtttgtgaagctgttttgggtagagcctcagagtctctgaccacccatttgaaggctggtggtgcaagtgacctaaccagttttattgggaggtaaatcctgtaaattccatttttattcaccacctgcgaaagaccaaattgttacaagaacattcggtggctttgtatgatggaaatgattttgttccaagttcttttttgctcctatagctcctgtctcatttactgtatggatcatagacatttaattaggtgatgtggttgtattcttcagtgacaaattgtggtactgtagctcgtgtcctgattgaacagcagagagctgcgctggtgaccctacacgtgtcatgcccatggcgagtgcccctctcctctcgtggacccggcaagcgctcccagtcgctgacacgtgtcaccccgctaatactgtttccctcagcctcctcgttttgctcctctcccctcgtcatctcgattgctgtgtgcgcctcacactgtcttctccctaccctctgtttgtctcctccctctccctctgctcatggctggtagggttcggtgctcgccggcggtggcgctggcgctcgtcgtggcggcggcggccgcggccgcggcgacggcgaagctgtacagcccggcggacaggatcctggtgaactgcgggtcgacgacggacgggctggacgcggaggggcgcaggtgggtggcggacgcgacgaacgacacgtggctgacggactccggcaagtcttcgatcatggcggccgccgacgagctggagacgatgctgccgtcgtccatcccctacatgacggcgcgggtgtttaccatggacacggtgtacaacttcacggtgaacccgcgcgaccgccactggatccggctccacttctacccgtcgtcgtacaacgggctggagccccaggacttccggttctccgtcttcaccaccacgggatacacgctgctccacaacttcagcgtctacttcaccaccaaggcgctcacccagg

SEQ ID NO: 66645 - DNA, 7533 bp, Oryza sativa
attcctgcagcccaccaccaaggcgctcacccaggcgtacctcatcagggagtactcgctgccgcgtgtcccggagggccacttcggcgtcaccttctcgccgtcgcccatgatgaacgtcacctacgccttcgtcaacggcatcgaggtgatctccatgccggacatgttcaacaacccggccaccatggtcggcttcgccgaccagaccgccgacgtctccgccgccgcgttccagaccatgtaccgcctcaacgtcggcggcgcctacatcccgccgtccaacgactccggcctcacgcggccgtggtacgacgacacgccgttcgtccagggccccctgcgcggcctcgtctacaacgccggcccgcacttccacatcaagtaccccagcgacgccgccgagtacgccgcgccgccggaggtgtacctcggcggccgctccatgggcagggaccagcgcctcaaccagaactccaacctcacctggagcctccacgtggagtgcaacttcacctacgtcgtgcgcctccatttctgcgagctccagctcatccacggcaaccagcgggtgttcgacatctacatcaacaaccggacggcgcagacggacgtggacgtgctggagatggcgacggagcgcggcgtgccggtgtacaaggactacgcggtgaggctgagcaacgacaccgccgacgagcatctgtgggtggcggtgcacccctcggtgatgctccgcccgcagttctacgacgccatcctcaacggcctcgaggtgttcaaggtgaacaacaccggcggcagcctggcgtcgccggaccccgtcccgtacaagctgctcgcggagaaggagctcggctggggcgggccgccggagttctccaccgacaacccggccaacatggcgtcggtgatgggcggcacggcgggcggcgcggcggcggccgggatcgtggcggccatctgcgtggtggtgtacagcaacaagaggagcaagaagctgggcggcggcggcgccgactcgcacacctccgcgtggctgccgctgtaccactcccacaccagcggcaagtcgtcggggcacatcacggcgaacatcgccggcatgtgccgccacttctcgttcgcggagatcaaggcggcgaccaagaacttctccaacgacctggccatcggcgtgggcgggttcggcgtggtgtaccgcggcgtggtggacggcgacgtgaaggtggcggtgaagcggtccaacccgtcgtcggagcaaggcataaccgagttccagacggaggtggagatgctctccaagctccgccaccgccacctcgtctccctcatcggcttctgcgaggaggacggcgagatggtgctcgtctacgactacatggagcacggcaccctgcgcgagcacctctaccacaacggcggcaagcccacgctgtcgtggcgccaccgcctcgacatctgcatcggcgccgcccgcggcctccactacctccacaccggcgccaagtacaccatcatccaccgcgacgtcaagaccaccaacatcctcgtcgacgacaactgggtcgccaaggtctccgacttcggcctctccaagtccggccccaccacgctcaaccagtcgcacgtcagcaccgtcgtcaagggcagcttcggctacctcgacccggagtactaccgccggcagcagctcaccgacaagtccgacgtctactccttcggcgtcgtgctgttcgaggtgctcatggcgcgcccggcgctcgacccggcgctgccgcgcgaccaggtcagcctcgccgactacgcgctcgcctgcaagcgcggcggcgcgctgccggacgtcgtcgacccggcgatcagggaccagatcgcgcccgagtgcctcgccaagttcgccgacacggcggagaagtgcctctccgagaacggcaccgagcgccccaccatgggcgacgtgctctggaacctcgagagcgcgatgcacttccaggacgcgttcgacgccgccgccggccgccccgtccccgcgctcgacgccgccgccggcagcagcagccacctcgacgacgggagcacggccagcatcaacacgctggccacgtcgtccacgtcgcacccgcacgagccgtgcgtcgacgttgtcttggagcccgacgacgtcgtcgcggagcgcgccaccttctcgcagctcgtccagcccaccggccggtgacagtgacaccactacggcactaccacaagtgaaccatgcacatagatccaaagtttaattagttccgactttttttttatttctttcgaggaaattagttctaattaatgccaaagtttgattagttccgagtttttcttttgtgttaattaatgctaaatctcggtttttggtttatatccctattccggaccagattcattcgtttccgagacctaaatcgagttcatcccaagtccaattccgaaacctctccgaattttcttcctctatcttaagcaacatttggaaaaaaactctccgaattataccattataaatttccagtcacccatgtaacgtgtgttcaacttgcaacgaagctaacccaaacgattaactccgcctcgaccgggagcggatttcaactccgcctcgaccgggagcggattttaaaaacatcccctcattatttgcatgccatctaaatgattataaaaaattttaaaaaaaatgactagatagattaatctaaattaatatatttcacaaacatgctggttaaaattcaacttatacaaactataatgaaaaaacaaatttcattgcaacttgttgaagttaaattttggataaatgtgacatatcctacattcaaaatcctttatattttgaaatggagggagtatatatgttaactcaaatataagtttatagctagttaactctactattaaacatcttctataagtttatatctccctagtagcaaaacacatatttttgatggttggcttttggggtggacaagaaagagagcaagcataacacatattcttgtaggagcttctgctatacgttgggctttgtagttgtgcaggaataatgcggtttttgacaaatcaccatctattacatatatgcaggtaatttttagggtaacatattggcttcagctctgagctcaactacaaagatctgaagaagatggtgagttcatacaagtagcatgtcggaagcttgagacggcggttatgcaactctttaccaattatagatggagattaacaaatagacttcgataaatgtgttctccttatcttttgttttggttggtttctctttaatctttggtggatgtttttgttgttttgttgaactacaaacatcttctaaattaggatggagggagtagcaggatcagggtttaccaaaccgtatggttatcatggttatcatgtgcggtagcctttttagtttttgaaccacggtatatctcgcgaggttaccgcaataacaatcaaaccgcgggttaatggtaaccccaccctaaacggtttggtaaaccttgacagaacccaaccacaagtattctattgctctgtaacgaataaataatggtttcaattctccagaaaaaaaagatgatgggttgatcagggggagtatccttaatgtatgttcattaagagcatgttagtttttcaaactattaaacggagtgaaaactttctgtatacaaattgctttataattttatctttttaataattaattagttatatgctaatcacgtttctcattttagttgtagaagagagggaaaaaaatatgagcatgttttaataatgtactccctccgtttcacaatgtaagtcattataacattttccatattaatattgatgttaacgaatctagacatatatatctttctagattcattaacatccatatgaatatgggaaatggtagaatgattcacattgtaaaatggaggaagtaactattatttattattttatgtattttacacgataaaaatatattagatttatttatatatttttattaagagaagaagtatgtttcatttgtcccggccccacgtatcaatgaaaccagaggatcccaatcctctactcctagcccaccccaaccaaaccatcgtgattcccgagccggacggacccgaaccacagttcacccgtttaggtcgccgcctcgccgcttcccactcccgaaccctcccctcccccctcccgcccgccgcgtacggcgccggcggccacggcgagggccctcgtcgtcggaggccccctaccactggcctggcggggctcacccgccgccccctcctcctctcccgaaggccgaagaggcgcgcctccatcatcagcaggtcagtttgggggtggtggtggtggtggtggtggtgggcgtcgtgtacctgcgtatctgtggacgcgtggggtggccgcacccggtgggaaccaatgccggcctagagccgtcggtcgcgcgcggcgcggatgcggctcttaggggtagagagggggtagggcgaggcggattggctcgatttgttcgcgcatctgttcttttgttttttttccctcgctcatagaaatagcggggatggatagtgttccgcgcccttctgagttggggggcactgcgtatatttgtccaaggttaaactgatagacgcgaggatttatgacatggctagggattgcttatgcggacgctggtagtggtagggttcggaatcgatttgctgctttttcgctctctgtgaaattttagaattttctacattagaaatgccatgaagcatgaaagaaaagaaaatctttagtcgtatatgccacttgtaattcagaactgtatatatatattattgaaatgcgcatgagttcaatatcatcgtgaaagagatattcattggctgcttttatgaacttcatgagaagcatgtttcagtttgtggcttttagggaaatgtaggtctggagccaatttttttgatcgaattgaacatgtcctgtatgatatcgactagtacgtgcatcctagtagcttatatgaactaagggagaaagcaattatgggcctgcttgggagcgattgctgtggcttttggggctgcagcggcacagcgcagccgcttggctgcatctccaaaaggccacagccattgcatcaatcagctgttgcgggagaagctggctagctgctgcagcacagcgacaggcagctgaaatgaacaagccctatggttcaaccaatgacaaaaaatgccctctaggaactatgtttacttttatgtgcaacagcttctatttatttacattgataagcaaacatcactgcagacttgaaatatttcttttgcttcactaaacaacttcttccttctatttcctcagcttttcatagcaaagactagcttgaatagattattatctgccaatggcaagggaaccaagtcctgaaattgatgatgaactattcaatgaagtttatgggaaggcatacagtggtccagttgcaacaactactaacaatgtgacgcctagagtgaatgatgagaagaggcccctcgaacgtgaaaagtcagatgaggaagatggccccccagatcccaatgctgtccctactgacttcactagcagagaagccaaagtctgggaggctaaagctaaagctacagaaaggaactggaagaagagaaaggaggaagaaatgatttgtaaaatatgtggagaatcaggtcattttactcaggtagtcttttctctgaataaattacaactggcatgcttgttgattgagatagacacataatgcattactagactttgtttatccacttgcagtattttcaactctgcagtaagtcagtaacgagttacactcaatattgatactgaatttaacagttagcatattcaaaatggagattgctctgtaaaaagattagtctgctgtagtgttgtatcaacctttattttttatcttgaatctaaaaagtatattataacaaaaataaattctgtgactactattatttgtcattttcttttcctttttcctttcatctttatttatcatttttcagacctttctcctttttcattactctcaatggtgaatttggacttaaaaactttaatacaaaagaaacatgttcagtagtacatccacaagttcattcattctcctatctttcataatttatatgctaatctgattgctcaaccaaacattcgtgcactggataccttaaattcattgagtctctttaaagcacctcagggagttgcctctatacatcttgacattgattacagtttagagacactgtagtgttttatgtgcattgtttgtgcatacttataggccctgtttctttcagcttgggattattataatccagattattgggagtaagctgagagaaacagacaacttattgaaataacttattataatctagagcccagcctattataatctgataagctcatttaggtgagctttttccagattattgggtgaaaaattacccaccataccaccccactccctctttagacttgcaaaccaaataatctaggctctaataatctaggaaagaaacaactaaccgcttattctactacagattataacaatctatcttatagtaatctgactcaataatctagattataataatcccaagctgaaagaaatagggcctcaaaatttgtatttcagcttacaattttttccctttggaacagggttgtccatccacgctgggagcaaataggagaaatgcagatttttttgaaagagttccagcaagagataaacaagtcagggatctattcactgagaggacaataagtcagattgagaaggatgtggggtgtaaaataaaaatggatgagaagttcctgtttgtcagtggtaaagataggttaatactagcgaaaggtgtcgatgctgttcataaaatcattcaggagggtaaaggtaaaaatacttcaagcagtccaaaacgggatcgtttgagatcccctgtgcgaactaccagtgatattcgcccaaggcacactgattctagatggtcacatagtccaagaagtgctccgcgctctcaaagtaaaggatattataacgaaaggcctctagatggccgttcacatgatgatatgcctaagttttcgaaagaatctccacaaggtagggcgctcaagcacactcgtcttatcattgttgtatcggcaaatattaggagccaggcattttagacgatttgagataaagaaaatgcctctgatccctttttgttggttaccaccatctatggtaatttgtttggttccttttgcagctagaggtaagttcaagatttatgtgctcaaatgactcaatgtatgtctggttatgatcagacaaatttacttgaatacaacaagttccatatcgaaaggttttccagacatctgacttggatggcctgcaatttgtgtattgcatctggcattattcctcctttcagtgta

SEQ ID NO: 66646 - DNA, 701 bp, Oryza sativa
attcctgcagcccaaccataataatttgggggattgtcggcatacctggagaactttccgaatatattactcatgcttcgcagttgatcaacataccaccaaaggacgggtgttggcctgtttaccgctgttgaggcaatttttcctcgtattttctggcaagaatcaggacatcgatgagtgccttattctacatgaatctcgggcaaacaggctttggctatagtttcagtggtatgttggaaatttaggaagtctgagtggtatatctgcaaggttgtccagacatgctggtctcttgcaatttccgctaaaaatgtagaaatgtaggagcctggccagatgaagcctaagggtggactggcttaaagaaaagaacataagtttcaacaacagtacaaatttgcaccggctatggattgttagcatcagtgatcagtctttgactatgttagcgttcttctccaaaaggaagtattcacaatgaaaatttggaattgtccatgtaccactatgtttggagaacttcccaaatgtatgactcatgcttccatgttgaccaacataccaccaaaatattatgatgttcgcatgttgccctgtttaccactattaatcaagacactccccctcctctcttttgttttcctggtgaacatcaatatattggtaaacaggctaaggttgtaattttctgtggt

SEQ ID NO: 66647 - DNA, 10706 bp, Oryza sativa
aagtcctgtttgggtctcctggcgcagtttacaaatgaggaaactgtggttatggggtgccaacattttaactgtggtgttacgagatgctcttaatatgatttctataccattggcatcttgctgtcagagaaacaaagatatggggaaaatcgaatgttggcagtgcagtcatggactagtgagaatgggctggggaaccttcattttaagcctttatgtcccccatgaataatttactggaacacattttgtctacaattgctccaaatgtttggaatgcatcttttcaagccaatgtctgtatgactgacgtggtttcaaccattctgccctgcaataggccagaaggaagttgcaccatcaagctgaccaccaattctgtggggaaaaggaaatcctaattcgatgactacatgttctcaatcgcgagatgcaaaatgcttcttgttttgcgaaattcacatttggcctgtagtggagtagactcgattcttcatattttgtaactcgaggagtcattacttgttagactatccacctggaatttggtgacttaactttctgtattggctgtttttaattcctgttttgtttggtaggtcgatgctgttgtttacttggtggatgccgctgacaaggaacggtttgcggagtcgaagaaggaactcgatgccctccttgcagacgattccctagcaaccgtgcctttcctgatactgggaaacaagatcgacatcccatacgccgcgtcggaggaggaactccgctactaccttggtctgagcaacttcaccaccggtaagggcaacgtgaacctagccgactccaacgtgcggcctctggagatcttcatgtgcagcgtcgtccgcaagatgggctacggcgaaggcttcaaatggatgtcccagtacatcaaatgagaggggcttctgctcctcaattgtcaatagcagctgctgctcctgctgtccacagtgggagtgggtaattcaggcctctggttctgtttatcaactctcctgatgctttggagaaacctactgcacctgtaaggaaaaaagtttgtcgtagtggtggatagtgaatgcctgtaagttggtgttaatactagaaatatgacggggtttatttgtttgattgtttatgggtggtgtgaccttattagctagaaaatgtgggttgctggaatcgtttcttgacaacaggaaatgtttcagccaatgtattcacgctatctatctagccagtgatatgtgtatgagcaacttcggtctcttggctgctaacgtctcccctgtgatacttgatcaaaactctttttttttttaagataatggattaaaacacgacctctatattcaaattcttgatactaaccatcaacaaaagagaagaatttcgattcgctaattctatcatataccaagttcttctacctattgtagacgttggtgttatactgaattacaactaatagaaaactatgaaatgaatatagcactatgaaatgaacatagtttaattgattgaattcatttggatttcttacaatggaaacttagctgattgaattccttttgatttcttatgatggaaacttggcatggatgctcccaaatattactaattaattattttgttagtggtagctgttatactcgtagatagtgagacgttcacgatgattttctcaatcttaagttatactaactcaatttcttgaagatgctagggtaggtgagggtaggtgtgcatgtgtatttaggggtgataactgtgtttacctaattttttagaagtgttagggtagtatacgtaatttataagggtgagtgtaagtattatgagtgcttatgtttgtacgtgttttaaaaaaaaaagtaggatagaaaaaaaaaagacatgcactttgcatgcggagaaaaggaaaggcacaaaaacggataacaagcaatgatcttgttatttggcgaccaagatttgatctggagttcctatccgcatctctgggctgtcgacactccaaacagagagcgactcttgtggccagagaacaacgctcagttcatccgttgccttgcctctaccaattgccgaacaaagcaaatcttcattcatctgtggcctgaagaccataaacagataatggaaatgtgcatacctttgtgtgcctcatctacagaacttgttattgcaaaccaaaataaaatagacgtggaaacgttatggattcaatattaactagatgggtaccctgcgcattggtgcgtgagaattacgtgataatttttttgcggggagaattgtgtgataaattaggtgttatttgctctgtgttcccaactcctctccttcgtattccatgcgcacgcttttcaaactactaaacggtgtgttttttacaaaatatttatatacgaaagttacttaaaaaatcatattgatctaattttgaaaaaaaataaccaatacttaatcacgtgctaatggaccactccgttttccgtgcggaggagatgggttcctaacccgaacgaacgcatccttagtatatattagttgtaattttttcttactatatgattttctttcatgtgcttatactttgataaattattcaaacgttataaatacttaagttgtatggtgtgtctttcagggagaagagatacaatttgcactcttgatgaatcatctaaagactagaaataattgagacgatgtgacttaagggagaattagtattaactacaattagtggtaatgacgtttttctttaaaatgtggacttttttcatatggacttgggtgggtatgctagctgtgatgtccattatgaaattgtgttgaacagtagaattttatgatattatgggagtacgactttgaaagagcgtagaagcattactaagggcctgtttagttcgagaaaagaaaaatttagagtgtcacattggatgtttgaccggatgtcggaagggcttttcggacacgaatgaaaaaaaaatattttcataactcgtctggaaaccgcgagacggatcttttgagcctaattaatccgtcattagcacatgtgggttactatagcactttatggctaatcatggactaattatgctcaaaagatttgtctcgcgatttcatccctaactgtgcaattagttttttcatttatctatatttaatgttttgtgcatgtgtccaaagattcgatgtgatgtttttgagaaaaaattttggggaactaaacggggcctaacaaacatcgacgtaactttctggtggaacacagtgctttagtacatatatattgtactttcttacccaacaacactattacctattgtcattttctttttcttgacttttacaaaacatttgattgcacatgttacaacacgtttgattgcacatgggaagaactgttctatcatgctggttggaagatgttctatcatgctagtataaaccgtgctacagtttaaacttaagatgcatcgagtttatgacttcattcttcccaccgatgctagcccgatcgaagccaaacagtaggctcgaagttacaagtacattaccctctccatcccaacaaaaatactaacctaagactcctactattatgaatctggatagattagaaggggtcctactagattggcttttttggaaggagggagtacaccttcaattccaaatacaaggatcttttttttccttctttgtttgaaaagaacctgacatcaaatgcacaccaaaaaccaaatcttgggattttgactccacacacgtagggtttgaaagcttgaagtgccaaaaaggaggagcagatcgatcgattgatctatctacaggccagttgtggccacccattcctcgtcgatcgatcggtcgccggccggcatcctccggtcgccaccgccggctgtgcgccacacgtttcgccccctcctctctctctctctctctctctctctctctctctctctctgatcgccgcggcggcagccggccagcagcgagagagaaaacacgacgccgcttggattggatcggatcggattgccgtgtatatctgccgtcgcgtcgagtcgcgtcagccccagggtggccggattggcgcgacgccgacgcggcgcttgtcgccactcgcgggcgagctcgtggtcgtgggttgccgacgaccgcaagctggaggaggaggaggaaaagaagactttggaattttatgccggcacgaatgatctttcgctcctgtttccgacctggcagggtgctgcgtgtcgccgtgtcggatttctgccgtttgatgccagctggatttcggtgaaaagtctgaagaaaacctaactcaccgtcgattttcttttttttttccctattacgaagggcttgtttagtttggaagaaattttaaccaataaaaatagaaacgcatgcacatatcgattcgtggaaacttttcaagaggtttgggtttgttttgatagtgaaataaataaaagaagcgggattgggatagagaaatgagtgaagattaaatctgccatgttctaaactgattaagatatagattttttttctcggtttccattagcacgcttttcaaactgctaaacggtgtatttcgtacgaaaactttctacataaaagttgctataaaaactctaataaatccatttttttaagattttcacaattaaaactcaattaatcatgtgctaatgacttatctcgttttacgtgcgcacttaatcttcatccttgcagtagattcgaacgggagagggataatggatggttaggattggtgggtgggaaattatttcactaacccattagccaagcaaatcccatgagtggatggaaaattttctatgttttctctccacaacttgtaggaacgagaaattccttttattttgaatatggataagatttgcatattttatattacgcttggggagttactttaccagagcaaaacaatcggaacaatgaaagggaaaaaaaacaaaatagcttagtgctaattctcacgatctagcttggcgacttgtcgaccatagcactcattgcccctacagctgcatgctcgttaagtgccatagcgcatcttcgtctacctcggtagcttcgcgcatggttattgaatactcgttgttccgttccttttaaattgtccaaactatgaggcattttttttagaaaatggattaaaatccggtctctacagccacaatggatgtacacagtccaaactatgaggctaaagatcgtgtcgtaaccatgtcgttgtgctttggtgatctgcttcgctaccacaccaccaccaaaggaaggaagtggagtttgcagggaagcaatgcgcctgtcgatcgcgcttaggatcgcccaccatagctaacgtgactctggacgctggatcaagatatgatcaatggattcatcagcttgatcgtagaagacatagttgtcgggatgtagcagctctcatcggatcaagcggttagccatccagcacctccaatatatacgctccctatattactacaaaccaaatggtgtttatagaaattaatcttttggaatccaaatctcttgttttttcctctaaactgaacaagctctaaaaatcggtaattatagagctttccattcgtagaactacagaagaacatgttgacttttttgtcacatcaccaacacattttgtggtattgattggagtcaccaaccacctcaaccttgaaaaactcctaaggctatgttcggttaatccctgtcagcgattgtggtgtggaattattccccctcaatcccctccaattcctttcaacccccttcaaaccgaacaagacctaattgagatgagttcatagattaaaaccagctagcaaaaccaatttagaaaaattgggataaacatgtctcatggattagatggaagtttttttagacaaatctacaaacaagatttacactcggggcgaagagtgaaggcttacaacgcaaaccgatgaagatgaatgaaccaagataaaaactagacaagaaagtagatgtaatatcgaaagaacgatttaattgagtaattgtgttggttatagattgtttccccaattaacctgtcctaagacggtaaatctaattggagaggcccgaaggggtctccacaagatcctctccacaaatttcttcggtgctctaaatggtagtatatttgatttgggtaacgaagactacccccatgtataaccggagaaactttttttttggaccaaaaccggagaaactttagcgagaaactttagttagaaggtttggcgagttttgaacgtctgatcaaacggcaatctgtctattagacggctcgcatgtggagaaggctactttcagtttcagaacggtgcaagtgtgcaagatgcagacggaaacgggatgggcaacggcaattgaggatgcattacttccaattccatttccagctctggcaatgctccagtccagccagccaacaaaagaaaagaggcgatgtgtaccgtacgcgtataaacgtctccacgtaatacgtacaaaatacggtatggtttctcggcaagcaacgcgtacttgatacgtacagtacaatgcatcggatgcctgtcacttgcttgttacacaggagactgacgaggagtcgacgacgcaagctatgtacagtacgtttgaatgttcattacgtgttccgatacggttgcctaccctgccaaccagttgacatatatgtcttgcttcatgacgcagcttagagacacaaatgggcaatatagacagacaccagtgccaagtcctgagtccaattaataaatttctaatatagtttagagtctaattaattgacatttgatcttcatctatctgaggtccttctttttttagtgtcaaaacagaaaatcagcatctgggtgtgacacttgtatggcattccactctgggaagaaagaatcattgctgcagtagcatacagcagcactgcagcagtgtggtgtgtaaaccaacaaaatgaatgaacggatggatgggatctaaccacgtccgcgaatcacatcaatctgacgaccaggaaggctccgatcacgagcagcttcgccggcaccagcaggacgacgagcagccgggcgtgcgcccgcgcctgcctcgccgtctccctcccgccctccacggcggcgtccaggagcacgccggcgccggccagcgcgccgtgcgcgccgagcggccaccacaggaggagccgccgccaccgcccccgccgcgtctcccggtgccgccgcacctccttgcgcaccacggcccggacggagcggaggtaggagttcacgtcgtggtcgcggtacacggcgcccttggggccgtaggcgctcttgtccttgaggatctcgagcgggtgcggcgagttgaagaaggtggacatggcggaccggagccgccgcagggaggtgcccgacgacgacgacgagtcgctcaggtggtagatgccgctgtccggcgggaggaggtcgtggtgcggggatagcctcttgtcaggttgcaggatgaacatctcgcccattggggcgtacaagagcttctgcagtgaaatccacagagagggttacaaccattgttggtcaattttggtaacatgcaaacaaagtgaacattttacaaacaagaaaactaagtggtgatgggtgatgactataagagctgcatattgcagtactcagtaaagatccaagtgttctttgccaatattttttttaactacttttacttttgttttaaaaagaagtgttgtttttcagtccctgaaaatgtgacagccaggacatcatgctagatcttcaacctgcagggcacagttcgctgtataattcaaccaactgatgggtttattatttgttctccatgtcaaagcatcagataaattttctttgtagtcttaagtcattaaattcaggaacatatactgttattaccacataaatgagctaatttatcaactgaagtggattcatgaatctacctgatttgtgaggcatgggtgactgcggaaattcccattggctagtttcagaatattagcaacatggtcagggtagttgcacgaaaagactcgaggaacaatatctcgatgcatcgtgactgactgaacatgattccttggcaatccaagtttacgaagcaagtggtcaccgccacacatgatgcatggtgcaccaaatgttattacaggcaacaacgacgaagcaggtgctgctcctctcatcagtagcattagattcacaagcaaagccagactaccaccaagagaatgaccagtgaagcgtaacgttgcagatttaccagaacttctcaagtgagatttgacatatggcaacatttggtgatacattcccttggctgcttcatatattcccctatgaacgagcacatcgagtccctgcaaaacatcacaaatgtcttagcttacataaatttgtcaagcccttcctacgtctaatatgtcaaattaaatgtttgtgtgtcaatttaatacacttgatcaatccatgatgcacatctaaataatgaagctgctggtgcacaatgaatgaatattggcaagattgattctatccatcattcatgagaaactgagaaatgtaggatggcagactagtaggatacctcaaatttaactggttcaaataggaggttggcctgccaagaagcgattgactccgagccctgccaattaacaataaaaaattgatgaagatgaaccagggaaagtgaaaattacacgaatcatgatatattgggcagaagacatacctgaaccacaaagtatcttgtgctgccttgatcatcatcacaaatgaaccattcgcaaggacaagatcttgaagagttcagatcatctgcaacagcttgtcttgtttcttccttggcagcaaccatggaggtaactgaatttgtagtggccacaaatgaagcttcatccatggttaaaccttcaccactctcaccgtttacaatggccatgatggttggatcgttcttgccatcattcctggaaccaaagggaacgacgcccatagcccgtgaatgtaaataagaggcagcagacgacatgacatggtatgcgccgaaggggtttacccccaacccactttctttcttcttattgctccctggctcagggttctctacaacttcagattcttgatctgaagattcaccttcctcagtcttcagctcctgcttctgatcaacaccagttttggctttctcttgtactgatgaagtcacaaaccgcaaattgtacctccgcagcaattttggctgagaaagcaaacagttgctaagtcaggcaatgaaatactaatatcacacagaatgtcagaaaggaaacttgcaaattgcaatcataatctagttatgaggtactagaaaggtaattgtgtaattaacaacatcacgattaccacaccaaataagtatccatatgccagaagcagcagctcaagtgaagcaaccaattgaaagacaacaatagacaaatacaactcaggcacagatagctccaagagtataattgcattaagcagacctggcactaatccatcaaatccttcaggaagaccccactataaggtccaaaagcacataggggaccaggacgaataatcgataatggcataatgcataattttgcagaacagtaaaggaaattcttcactatctctgtaaaggaaatgcatagacaatacgtagtagaagccaaaacagactaaataagaattcttagtaacaccacaacctgcatttctcttgaatttacagcatggacaaggactcaaccatgaacagttcatcaccagcaatcgaattggcgtgtagacaatccaccaattattggctgtgattaccgcatcggtgaattgtagaatagcagtcactcgcattgatgctttcgatcttaccgtgatcttggggatcatgtaggcgatgttgcagaggtaggacatcttggagaactccttggcctccccgagcgacactttcctgaggagcctcgagaaggtcgcgcggtcgaacaccttgccgtcgctctcgtcgtcctcctcgacgccgcagcatccttcgtcgtcacctccaccgcacgaggcgcagcactcgtcgccgtcgcgggccgccgtgagcgcttcctggccgccttctcgagcggttccggtgactcccgcggcttcggcgtccgccggctccggccactgtggctgcacccgcagcatctgcagcacccagttcccctgcttccgctcgtccgcctctgcctccgccgcgcgctggctcctcgcctcctcgccgcgaaccgcaccaccgaccgcaccgaccctctcccctcctcctcctcctcctcctcctcctccgacggcgccgccgccaccgagcggccatagccggagcagcggcgcgtgcagaacgccccgcgacggctgctgctggtggtgccgctgcgccaccggaggcggtggcggctgcggagccgcggaggcggcggggctgatgccgcggacgaacctcagggcctccatggccgcctcctcctcctcctcctctcgcgaccgcgaggttgccgttaacaatagcggggttaagtttagccaaatcggcgatgatccccgtgtgctcca

SEQ ID NO: 66648 - DNA, 8902 bp, Oryza sativa
catacttttatatgtttttcttgccgtgttataattagtattttattttttaagaaaaactatgtggagtgtagaacgaacattttggtcagaggaaggtatgccatgttagtacgtttaccacgtgccaggacaacgttgtatgcgtacgagcgtatcggatacgagcgacacggcggaggctccatccgttttttgccacctaggccgagccgcagaagatcaggaggaggagtcacttccgtggacgcgtcgtccagcgacacatgccccgggacacgtcagcggatgagaacttctccgaggtatacgtggaggccttgcgtgccccatgcaggcgtgggcctcggttttatccacccacagccaccacaaatccacattgcgagatccggcccatcactggagtatgggccgagttaacttttgctgctgcgtaccatgtgcaagtgcgaatgggcttgagatccatctaccgttggatggtcggacacacacatttgaggaccttgaatagcccatctcccaccatcagcttaaatttttagattaagctgatcgatacatgtaacttaacatggtatcaaagctataggccttgagttcgtatgctgcctggcgagcctcgtgtaaggggagtgttggaatataaaatgaattgctcatcttttcccatcaatttaggtttttggattgaacttttcgatacatggttgaataactaattttgtgataactattcgaggctacaaacgaaagaattaaccattctaagctattcgagagtacaaacaaacgaattaattattacaaagttaaaaatacattaagatatttttctaagaaattcgtaataaatagttttctaaaaaaatattaccatttaggacacagggaagcgtaatagctgaataaaatggttccatctgaagaacacgacctgtgtgctcaactgtcaatagagacacaataacttcttgcaattatcctctgtgctgtttgacattttcttggttagtgaagaacagatgggtaaccgtgtacttagattggtgattacttgcacgaatcagtaaaaaagaaacattttctcggggaataaataccgtagttttcatcacgtcaggtacgtggtaggtttctcaacccaccagatttttcaaaacttgcccataaattcagtagcaagtaatcaacatgtcatttctgaaaatgataacataaataaaaatgattaattttgtgtagcaaacaggggtgaacgacgtacggaaacacggagcattagatcatcgccatgaaaattgagatcaggagatcggtagattatggtcaagattagttggccagcttttgggaaaaaatagatttatgctcaaatcagagcagaattaaggagattgatgcttagtggctactgtgttctgtactaccacccagtcacacacgttacacatgaaaaacagagaagcgtgcagcatgttttctgaatgcgaaatcgatccccgctattatatattcagagtttcagacaatcaggctggtgctatctatctacgcttgcatttcttcctcctgtcctatggcacataagaacgagcatgagaagttgtgaaaagtaattgacaagaacgataatggcttgggtctccatgacctggtgttggcacaggagcttcttgctcatgatggcgtgcgtctgcagctggtcgatcacttgctgcaaatcaggtttacactatgctgttgctgctcttttggtgtcatatctgaaactgaaatcgatttttgtttgcgtttttctgaattctgatgcatgcagacgaagcagcagcaggagccttccatggtcagaagaggagcactgaagacatcgtcgccagagctatcatctgcttcagcgatcgatatgtaagcacatcctcttagcaaacattgactgctcgtaatcaagcttgaacagtaattaacacagtttcagaccaaaagaaaaggagagaaagaattcgagaagaaaattaatgcacgctgtttctgattatgtgctgcgagaaatgtgttttcttgcagatcttcagcgggtgccaggggcagtacaggctggggccggagggcgcgctgcgcgtgccggcggcggcggcggaggcgttctgcggcgggccgtgcctggcggagacgaggctggtgctcggctgcgtcgacggcatcatggacagcttccgcttctacaacggcgcctccgtccgcgacgtccgcctcgcgctcgaccgcggctgcggcctccggggcgacttcgacgtgctgcggcgcctcgggggcgacggctacgactacggcggcgggccacgcggcctcgtgaccacgccggcgcctctgctgctgggcgccgtcgtcgcggtgcttctgtggggatgatcaatggtgattaaggaaattagaactagtttctggtgattatacatgtatgtagacagtacagtatagtatgtactctaccagagttaattaactgcagcactacggtaccagggcgtgtacgtacttcgagttagtcaaccgtatgtgagccttttttgtccattttgtagaatgtccaaggaccactgtgaatttgtttaagtgaaaaataaacaaatatttgctctttgattcaaaggatttaagtttttcaaatcttgtgaaattttaattgaatgacttattacatgtagattttagagaaaacttagcaaaagatccaacctcttagaaaaattcctttaagtttatatctctcattcgattcatatgtttttcctgcgatccaatagaacgatgtgtgtttctccgtgttttcaattcactattttacacttttcatttctatcataattttatgtatttttatttctctgtttttccattcctacgattgaaagagtagtgtccaatgtccttttaacaaaagaagttatttattttgtttattttattatctaagagttaaagtatttaaattagtacttcaacgttgagttgagccattggtacataattaattaaatataaattagtttaaatttaaaattttgattaatactatcttcatccaaaatataacaatttttagttataaatctggacacatactttcatagctaaaaatgtttatatttggaacgtagtgagtataattatcaggcgacaactatgagcgatatgcttgtcactccataccagctaacacgcgcggctatctatcttgctcgccgccacctgcgaagctgcggtgcatggttggtcgatttctgattgatgtcaggagtggcgtactagtgctgctcgttgtcgtcgttgcttgaacgcatcttcgtcgttctccccagcggcggcgacggcggcaccgcctcgtccaagggcggatgcagaaaatagcatgagcgggtgctaaggatctaccacttagatagactaaggatctaccgcttaggtagactgaggaaacaaaaaagtgtcaaaggggcatttggccccactcgctccagttatgtatgcacggagtgagaataaaccttagactattagccacgcgcaaaacaaaaaacatgattagtatgattaattgagaaattaatttgatttaatcttgcaattttaaaaatctaaaaataaatttatttgatttttcaatcaattattatatataaagtttagtactttaaaaagcataaatgaaaacccgatccctacgtttgaacaatccctaagtttttcgtggttacgtggaattactatgaaaatgagtctaaagataacattcctgtagttattcgaaaattcattaagcgcataagaaactgacagtttcgatatgttacgttatccacgcacattttttttaattaactatataataattctctctattattcctttttttcatgaattttagatctatctataccatgcttgattaccaaaaatatataaagcttttgttgtttgatttatattataaaatatatctgtagcgttagcacatgcatattactagtaatacaaaatgaaattgttgaaaagctttcatcactttcttaggtacattacagtaccatatattatcccaggctttacacattcgatcaggcgacaactactagcgatatgcttgtcactccacaccagctaacaaacgcagctatccgtctttctcgccgccgccgtcggtggcggcgaagctgcggtgcgtagttagccaacttctgattgatgtcaggagtggcgtaccagtgttgcccgtcatcgtcgtcgctcgaacgcatcttcgtcgttctcccccgcggcggtgacggcggtggccaccgccgtcggtggcggcgaagatgcggtgcatagttggtcgacttctgattgatgtcaggagtggcgtaccagtgctgttcgtcgtcgtcgtcgcttgaacgcatctttgtcgttctcccccacggtggtgacagcggccgccgctgtcggtggcggcgaagctgcggttcgtagttggtcgacttctgattgatgtcaggagtggcgtgcgtaccagtgctgttcgtcgtcgtcatcgctcgaacgcatcttcgtcgttctcccccacggtggtgacggcggccgccgctgtcggtggcggcgaagctgcggttcgtagttggtcgacttctgattgatgtcagtaatggtgtaccagtgctgcacattgtcgtcgctcgaacacatctccatcgttctcccctgcgccggtgacggcgccgccgcctcgtctaggtaacatttaaatataatttttttttgaaaaaacgcgtgcattcggaaaaaagggaaacaaattgaaaatataccgtttattttttttctctcaaaatattcggatgtaattttagtcgcacaaacataccgttgatactgtcgtctcgcacggtgagagcgggacctaattagcgagaccgacagcctcgccgttaatcactgattaattagtgattaattatcttgattagcaattaattaattattaattggataattaatcactaattattattaattaatcgctgatcagtctatttccaaaacgctgtcgcaccctcacgatgcgagaccgctcccacatcagtttgccaaaaaaaaaatacatcaataatattactgaggaaaaaaatatatgaacggtatattttcaaatttaattcaaaacgagagtccgctgctctcaaacgcaggaggttggttagtggcaggaaagagtattggtgttttggcgcgaaaagagtcgagagggcgcggagccttggcgccactaattcagggagtgggtggcagtttcgtaataaaacttgtttattttccgcgagctcccagaattccgtagaccctctcctgctgcgtgcgtccccaaatcaggagtcctcccaaccctcgccaccggcgccgtccgccccatctccgacgccgcctccccccgaagcgaagcaggtacacgccacctccaactcttccctcttcctcctgtttattcgatggcctcacgcttaggtccatctctgcagtagatctgatcgctaggtcctcctgtttaggactagggtatcagtatcaggtatggctggagagaacggcaaatttccttggctggattttcttaggaggggaactagtggtgatcaaggagggaaccacatcgattttcctgtcgcaaactgaaaacccgagtccgagtggttgtgcccttcttggattaaatgaatcaaggagttaaatgaacttgtgggctggatttaccatgtgcttgctaggcatgatcccgtgatagaactaccaggagtaggagatttgtgggatcccaatttgattgcttgcctgtgtcatcagattggtaattctgaattgtgttgatgaatatgaaaagccatgcgttttgcagagatggatacatcaggacctgcagcattcgtcaatggagagattctgaagatgttcgtcggccgaagagtgcgcacggtggtccaagcccagcgcgaggaaggcgggttgcttatcgggcagtccaccgatggtcatcagctaaccatcaaaggggcctccggtgcccctatgtcgcactatgtggagattattgggatcgctgaacccaatcaggccatccgggctgaagtttgcacagattttggtgaaaacttcggtgagaattgttgcgcctcgcattcttttcctccagtaaatagtactatgaattgttagtctgtacagtttgttatcttttacataaatccagacagtgcctgtatcttgcctattctgatgctcccccaccaatggttttttaacatgttacatagtgattggggttcgttattcttgtgttctatattttcttgagcaaaaaaatgtacagttcgcataaaaatcatactttcataagtacgttttgttacatttttcatcgtattcatgcttacaagagcaaatttctgcctttgtaaatgtgtagctgtttgtgttctatacgaattcccaaatccagaagcattcaaaaactaatattgattgtttaattgttggactttttttacctacagccaaatttgactttagttgtatgggaacttcaatctcacccctatttgtgtcaaatttgtgtctgattgatcatagagtagattttaggatgacatgcactcttgtctggttggtaaaatgtagcttttgaagctcatgggcttaacttctgggaatgagcgatttgcgattgatcatctagagtagatttcaggtggaaaaacattcttcaactaagttgaaaatgtagctcttgaagttcatgagtatacttctgggaatgaaaagctattttagcttatatgcccaatgttacagcgtttctttgtatcaattaataaaataatctcaatcaacgtttcttttgttctcgtctgacacaggacaactagtatgtggtgctaaatctttacatttgctgcaagaattttatcttagacaccctcattacaccattgatctctctatcatgtttgtctgcagatcctgcaccattcaatggactgtgcaagcttgcgaatggccagatgaaggatttgttcctgtagaggtcggcatcacatacaagacattctgccaacaaagcatgtctcatgttcatgatttctctagctttaagatccgtccaactgtttttgtcagtcatctcagtataatcaagctacttagggtcagtattggtgcttattaagacatattaaccttaagctatgtgaggacaagcgtgtgcttttgttgctgaagagcttgtggtgtttgctccttctaagcaaagcaaaccaaagcgttgtgctgcattgttactgtcgcttgcatttggatccttgaaagctgtgtttcttgttatgctctccggtgcatcttgatgaagtgagctagtatgatgctttctgatgaatttcaacatatcaacatagtaacccaaagtttcaaattaactgcatgctcattgtcctgatgcaagcatattactttgattcatttgttttctgtttataaggcgctttggtggttgtttccgactaattttgcacgcatccacccaaacttgggtcgtttgcagcatatatatgctcacttctaaaaaaacaattaaaatgaaggtcgtgactgataagtctgaacattaatcattcatcctcttcttggaacaaaaatcttttcaagcattcaagatcaaaatgcttcttccttgataggagtggattggtattgtgtcactctcgtacctatcacagcgattacgaggcctcatctttttttcacttaaccatagaaacatggtatcttggttatgctatgaacaaatcaaagagacaaaaggaaaaggtttcgtttgggctcctcattcgtgtctcactgcgtttgttaactactaccgacttcagtgtcttcgccgacagactacttgcatcaacaactacttgaaaacacaatggtgatgatgatgatgatgacaattgtcaggctaatctgtttttgaaagcaaaaggcatgacaatttcactgtattaattgaggaggaatatcacctataagagttttttttaatgaatgatatatttcaccacacgcacactaaaaataagcactttattagatcatgcagaaaataacaagaattagtggtattaagttcccatcaaagtaccaaaccaaaggccaaaagatcaatgtagccagtcaaatgcatcacagtgatttgtacagttgtactaatgcacatctgaagtgatggatcaatgtagcattgccacaaaaagatagaaacaaacagagcaaaattttaatttacatcctttgttttccttttcttttttcatgcaagccctcgcaagattacgtaaagtgctatttgaacttcaaaatgtggcgatttggtagttttccctttgaaggcgggttttcgcgtttacgcttttacccagaggaaagcggatgcattgacttggcaagcccgtagctccgggccccgaacccgaggcatccgaggacgaggccctgccggtacggcagcgacgtcgcgcgccgccgcggcggcggcgccgacgacctctccgacgaggtggaccgccgcgccggctgcagcgacggcgggcacgggcacgggcagggcaacgctagcgttgctgtcttcttggaccgcgacgacggccagatggacgggggccaaaagcccgatgacctctcggcggcggcggcggcggtggcggagtcgctgttcgccgtgctgccgaggaggaggtcacgcagcgatatccgccggcgagtgctcttggcggaggacgaggaggaggaggaggaggaggtggaggtggaggaagacaacaacgac

SEQ ID NO: 66649 - DNA, 1799 bp, Oryza sativa
gtgcgccgccgccgccgtcgtcgtcgtcgtggaggacggcggcgagcggaggatgtagtgcacggggctggccggggcgctgaagaagaagaactgctcgctgccgccgccgtcatcgtcagcgtcgtcgacgtcgtccttcccggcgcagcggcggcgcgtggggcttgacggcgccgtggcggcggggctcccggcggcggcgtgggcgtggctcagcatcggcggcggcggcggagtgaagggaagggaaggcgaggcgagattttgaaggagacgtgggtaagcggagtggttagcggccgggggggaggtatttgtaactgtgcgcgcgcgagtctcgatcgtgggcccagactcgcgctactacgtggggcccgtggcatttaggtaaataaatgatcatttctatttcgtatttatttcgaaatttctaaagtatagaccgaaagaaatttctaaagtttagaccgaaagaaaaaacaaatcataatttaggccgaacgaaagaaaggtgaagatatagggtgtgattggttactggccacaatttactataactaacattagataaattgtgacagtcacaaaagtgtggtgaataaattgctaaccacaaagtgtagcaaagttgacaagaaaatctagtttacgacatgtgggatatgctattgaaaaaatatggcaagtcacaatcaaatggctggctaacaaactgtggtagctaaaactgtggtatggcaaagtgtattccttagtatcaagattgttcttgaattgttgtgagaggagttgcgagaaatgatgagatcgagtgtgaatagttatatttggattaattggtaaatttaggttgtatcatcgaaaccttcgtatgccttttgtacactaaatgagctaatactaaagcacacgtcgccatgcatcatacttgatctattccaaaatgttaagcaacaaactaatgtttgatcagttccaatatttcaaaacgagtgcaatctagcattcgagctgtgtagtgacagtgtgacacacacataagagcttagtgctgagcctttctcaacggcttaattgcgcgtgtagtttataactaattaattactactaatcaatctttatatactaccttaaattcggcggggtcaacaattctttatatgcaggcttcgatgaacgtggcgagcacctgcatgcacatatgcaggctggcacgcacaaacgagaattttttttttttgagggaaacacaaacgagaataattatttacttaattagtgcgaaaaatacaaacacgaacacggtcgagacagtggagaaaagtgagaggaattaaacaaccaacgtcaacagcaacaacacgtagcgcccatgtatagatgtatagtacaggtggtgacgagcaatataatacggagtatatctagctctctcacagagaaaaaaagaaaaggagaagtgtatttgcgagtaatctacgggcacatttaattttatgggagaagcggctataatatatctagatcgagtgtatatcagtactatataggagtgaatcgtagattaatttgtagtggtggaacgtacgtgggtgccaaagttttggcaaaccgctccttcgcaaaagctacatgttagttattaaaataaaaagcacaaaatacaccagtgatatgatggtaaaatcgtagattcatgacttcaactatcacggtttaaattaatcccaatactcacaaatattacacgtacatgtaaattgattttcaatgaggatgtgtcactgatgtccgtc

SEQ ID NO: 66650 - DNA, 713 bp, Oryza sativa
attcctgcagccctgccgactcaaatcaccacgaatcgatcaatccatcgatgggatctaattagggtgttctagcggggtagggaggggaagcgcgcgggtggcgcttacgctgcagaggaaaccagcgggtagcaacgctgcctgacgaggagacaacgatatcgtcgtgggctggaatttctatggacgaagacgaaagtacccctcactaatgaggattagactgttaacccacttttaatctcagccacttatgtgctttgattttcgtgcaatttttttttaagaagtatagaagcacatctcttataaaaattgaagatatttttattaatactttggtacatcattcgtgtatgaatcggtttttaagttcgtttgatttaaaaatacatatttgtatttaagtcgggttttaaattcgtttgcttttggaaatacggaaagagttgtataagatactagtatctctttaaaaatatcgcatgctaacttgattgagatgatcggactcctaattgcagctcatgattttttagaaaaaatatatatccaagcgaatttctacagtgaatatcatcttaactcaacctaccatataacaataataacattaaaataacattcacccgttgtaacgcacgggcatttttttcctagtcaatacaaagctaaaagactaaaacaatcgtactttatcaaatcgcaca

SEQ ID NO: 66651 - DNA, 1310 bp, Oryza sativa
tgatactactggagtatcactgggatactcagaaggatatccatgtatgaagagaaaactcaagataaaatcaacgtaaataatttcaatgctagaaaatcatatgtttatcaagagagggctcaataaaaaccaataagggaaatcgattccagaaaaaagtcgtcatagctgtagaaacacccatagaacatgtagaaaaacctaaatcaaaccccaaagcaagccaaggcaggagcttgagggtcatgaacccagatcttggtctacatatctacaccacaaaagggcattgtccttgatggtagtgacctcgttgacgatggctgcatcttggaacgtggtgagcagctccacctccgtcatgtgctcggacacctaccccacaaacaacttcgtgatctcctcctctactcagtttacacctccaccaacagcaacggcggcgatcaagacggcaacttcctcgacgcccgacgcgccaccctgcatgaccagctgccgtcattgcctccgtgctcatgtgggtggtagagagagagaaagagtgtggggaggggaaggggaagagattaaggagaggataagattaaataggtggtgtgagtagtggtgctggatatttactagtagtatcccgtgtctacgggactccgttctctagattttctgattttttaaagatttttgtcaatgattagtagcggaataaatgttttacatatacctagatgtgattaattgtacaaactagaaaggtatcaatccctatattttccgagaagattttatataggttcatgcccccattcaaggaaatacccctacggcccactaggatatatatacaaagtataaaaagtacatatatgacactaatgtagactagtaatctgcccgtgctaactctacggtgttataatacatttttgttaacgaattacacgttatttcctccgtttcatattatagaactttctagcattgcccacattcatatagatgttaatgaatctagacacataatgtgaaatggaggaagtagtaaaaatatgtttcctagaatccacccaattgagctttattttgatctaggtcagatattaaggcaaagtacagtgatattatattatctaaaatattaattcaaaaccatcaataatcatatttaatcacttcaataccaatatattagacaatgcacatccacacttccacaaaaaatggttgagaataaattacatgttccaagcaattccacgacttctgaatcattaacacacacggagctggcaaaatggagctgggaa

SEQ ID NO: 66652 - DNA, 2635 bp, Oryza sativa
attgcatacgtcttagagtgattgtcaaaataaaagagtttagtaaaaatgttaattagttatgtaaaaaaaattgtcttatagagtaactgacatgctacagggatataaatatatttgtattacttagcaagcatagcagtgcagaatatggtcaagagaataaatcagggatcatgaacggttcaaatgtgccatcaatggggctatcctatatttcctgaaagagtcatccactgtttttcctttttgatagtagtcaatgacacaacgacaaaatgttcaatgggataaaagagtaccaataggattaaactgtttttttaccatcatgtttttacagtgagtaacgagaccaaaactccaattggttaattagtacgtaccaattagagaaatcttcaaaaaatgaaccaaaactccccgcgattaccttccacaattccaccttttcttctctacacaagcctgaaacagagtaaacatttgttttcacatggaaaaaattccatcaagcagttggccataatgagaaagagcatccaatcaagctatgtatcatttttgcactgcactaaatatcagagatttgcagcatttttcactgcactaaatatcagtaatgtaaaatattattaaaaaggaagcttaacataaacttgttagtttttctttgaatgaataaacttgttagttcttacgtacatactacatacgaacgaaaataagggaggaccagatgtgcattcagtgatggtggcattcatgaacctgagcagtttaaaaatgaagaaatatacatcgcttcagaagcaccagaaaataagatagaatgaacctgagcagtttaaaagtaaacattgcacatggtacaaaagcagaaatcgattaatttccgggagatataatgagcattgcacaaagcaatggttgaaaggcattataatcatacagtccaatttgtcagatatttttaatacatacacatatttgtctatacgatatataattctaatcatggaagtgtatatttcatcgtcgataattaactcacttttccttaaactaactctagaaaatcccaataattaagaatctaatcagaatctgcttgcaagtattgggtttttcattaaccaatcaaccaatcgcagcagaggaaatttagggggagaggataaaccaaggcaatttccgccttaccttctgcgccttatcacgatgcgaacaaatcgattcgtcaactacagtacaacactaactacctcatcctgatgaaggcatgaagcagagaagagaatctgaatttattcagacattaaacatctgatttttttttcataaattcactaataaactggtaagttgttcctttagagtttagacaatacattgaaagtgcttgcacattactaatgcatggcattctacatattcaggtgtcatgaataaaaatgtaaaccaaatttgactttttaaagggaaaaattatcactgcacaaatcagaactttccatgtggttcaatagagcacaattccaccattgaagtaaaatctcattatgtatataaccttcggtacacatcacagaaaatgtatacaacggaaagtaaaagaagctctcaatattggcatcatgatttagataattaaattcttcttttaacttggatgtcaatttggatgttgatctcttaagagagcacacaacatgtctatcaatttaattggtttcctgggttatgttgttgaccaagcaatgaagttcaaaagaaattatctaaattttcagatataaacatcccaataatgacttaccttgttggcgagcggatcgcagcctgtgcgaggccagtgccggggttgagaaatccgaccaccgggacttggaatctcgaactcgcacgcggccagaggaaggggctggtgccgggatcaaccgcgaaaacagggcggcatcactaaggccagatcggagcaagagggaggagcgctaaaaatcaaatggaagacatcaaacccaaatcgtgcttataacttatttaaactgtataactacgagaatccagtttgtgagtattttttaagctctgttgaacacatgataacatcataatattatattcgcatcatcacaatacatgatctatttaaattgagaaaataatttacagaaccaaaagctggtctgcacctgaattgccagcatcacttgtttcaatcccacataacagaatgaccagcacgcatgtttattgtactataaaaatttacaccctacttatcaaaacccaagacatcataacctactctcattcttcagtaaaattagcaaccagaaattaaatgggcatcccacaaaggaatttaaccttctcacatcacaagaacatgcatataatttcatatacaaaaattgcaaaatattatatccatgtgaattaaattcattcttccaatatagcaagcaaggtgtacacctcagaacaagtaacaatgagtgtaacacatcaacagaggcggcttatcaccatattgggttcaggaatgatctcctccagatggtagattgtctaacattagtcaattgacgggtgacttcagagggaattcatctgaaacaaaaggctgggc

SEQ ID NO: 66653 - DNA, 5493 bp, Oryza sativa
ggagcttgaccggagttcttgtcttcggcgacattacctgagacgccgagagctcgtcgggcccgagtatcctccaaggccaccatgacccgttccgtcgccggggatcatcgtgtgggtgcggtgacggaacggtgacgtaaatcctggacgacgacggatgcgacgacggtgatggggattggttgagggcgagccggcggcggggatcggtggcggcgagacgacggatgcgacgaaggcggagcggcggcagtcgagggtggcggcgacgacggatgcgacgacggcggagcggcggcagtcgagggcggcggcgacgacggatgcgacgatgggtgacggcggagtggcggcagtcgagggcggcggcgacggtggtggcgcggggatcggtggcggcgagacgacggatgcgacgacggcggagctgcggcagtcgagggcggcaacgacggcggtggtgccgcgtgagagggagagattagggttggggagcggcgcgcggttggggaggggcggggacgcgtgagagcgagagaaagggggcggagaggatggcgcggtggagaggtggagacgatcctgagcgttggattttacacagagatgatctggaccgttccatgagtaatgaaagaatgagtgatgagtgaaacaccttgttgaactatagagtaagatatatgagtgcaagttagatatttattatctcaatttatgtgattaatgaacctgataattacataatggaaataaatggaatgataataattttcacatctgatctgaataataaaatctcatccactcgaattcatgtttgaacggtctaaataaatgggagcgataatggttttgattttgacatccaaataacatttttgtccgtctaagtctacatccggttgaatttgagaatataattagttacctttttttgtcgcaataccattaatagttagcaaaatatatcaatttagtatcaaatattctaaattatctcatgtaagtgcttacattgttattattgtatagttgaaaacttgaaatgaaactacttaggtattcgattcggaccaaaatagattactaactgattctagttcacatattctccacacatcatatttgtattctcacttgacacacattcgattcattttccaatccgtctcaacttatatcgtgtatgatatagtttagccattatccaatttgaaattgaccgatcacacccctatctagacctagtcgactaactcgacgaggtaagcagtggcaagatgtggtcaatgatatggtcttcggcttgaggttgttgatggcttcttatgcatgatagttcggtacttcggtgatttcttgagttgtgtttagttcctgaaatttgggagaagtttggggaaagttggtagtttggaaaaaagttaggagtttatgtgagtaggaaagttttggatgtgatgtgaggtgatgaaaagttgggagtttggagaaagtttgatgtgaactaaacagggccttggtgtcttgaccttacagggtattcgtatctctaagttcctgtactcttgaggtactcgtagagagaattttgatcagctcatgacaagtcatggtcatatctaacttggtcttgtaaaatcataccctatttggtggccaatatatataacatatttgaggagctttaaaattctaaaaagcagtcgattggcaatcagcttcgatatgagaatataacaaagctaaatttctcagcttttggcttctaatttattttctaaattttacaacaaaaacctcgtgagcaagtcatcagcactccatcggtataggccgttttcgtgagcattgggtacgaagttgaccctctaacctccttgaccaagcgttgcacgaccaaggctgatgtagggaggtggagcacccttggggcccataatgggatcttttttttttgcggggtccataatagggtctttgatctacacacgagacaattcgtggtaggagccgatatggctctgatatgatttgttggctctcgatacaaataacacacacgaaccttgggacaaacacctgatgtttcaaccacacgttcgcgtgtgtgattcatagacaagagccaacaagtagtattagagccaagtcagctcctaccgtcgaccgccaatccgctatgagagtgtgtgggactttccccaacccaccttcccctctatgccggcctcgtcactgcgatggcggtggccgtgagatggtcatgcagcgttccacgacactccgcggttgacgacacgcgccatcccacgcatcccgctcagagtgcacacgacccggattccatatgcgcgccatgagcgctccgcgacccgcgtgtgccgtcgtagcgcgcgactcggactcggactcggacgcgctaccgctgccaccacgcagggtgctcggctgcccaacgagaacagaaaagagctaactaatcatgccaatattaatttgtagatcaacgttggtcacggagcaggtgggcagaacaagaagcggagcctgtcgaggcgtcggtacttgatgccgacggcgagcacggccatgacggcggcccagatcagcacgtccatggcgagcgacgtccccgactgcgacgtgacgaacgtgagcacgaggctggagtaggacaccaggaacggccactgcacggcgcgcgaccgcggcggcacgccggtgagcagcgccagcgtgagcagcatcgagctcccgaacccggcccagctcgccgccatgaacagccagtaccgccgccggtgcttgtcccgcatgatcgggtcgccggcgccgtcgtcctgccagtaccctcccgggatgttcgtccccagctggtacgtcagcgccgtgatcagcgtcgccaccaccagcagcgtgtcgttcttgttcgccccgaaccccggcgcgtgactgcggccgccgcccgccgccgccggcggcgacactgccgttctcccgccggtggttgtcgcccagctccccgccgacctccgccaggtggccggcgcggccgtcctcaactgctccggcgtccatcttacctcaccacgccggcccctaactcaatgtccagctgcaaagcttaattagatcggagaaagaacagtaaaatttttgcagcaatttagacgaagccaatacttcttgtctactaagatcttcttttctactcctatcttgtgttcttgttttcaaacatgctgagtgcatatgcacacaaacacacgcaccgccatatatagaggagaaatttcatagttaaatcacgtactttcttgatcgctgccaatcggtttgggaggtaatttctctgaaggagatgggaagcacagcacggagttgctagtccactcaagtcttctgtccgacgaccttgagctccgtggatatcgcgcgttcaggtaaaaaggacctggagctctggtccgatcgggcgaagactgaactattcagtctctcctcgtcaacgccaagtccacgtggagtctactacatgctgggttctgcttatcatattaatccatttttaaagtattttaaatcataccgaatgcaagttccgttttccactctacctcctcccgaacacactcgtacggctgcgtttgttgcaccagactgagagaggaaaaaatatatctgttttctgttttcccgcactgacgcttatgctaaacgatgtgtttttttataaaattcttttaagagaattagtttaaaaaaggagaacagctactttagtccctaaaatttctttatagaatcagtttagtcctaaccttttaaatagtctaaagaaatccttaaactttgtcataaggcctagaatactccttaggtccaccaaaatcatcatatggatatgccatgtcatcattcatgcaaaatctatgatgaattgtctaatttaaccttatgtatatcatagaaaaataaatataaaagtgaattagacatagccataggaaaaaaatactctttttttcaccctttagaggtatatttttgctcttacatataccatgtattttttttaactttttccttttgttttttattttcctgtgcgtaagggtaaattggacaaatcatatagattttgcataggaatgtgacatggcatgtctgacggagctcgtggctcctcaccgggagaccgcgcaggcccccctttgccagttcggccgggggcttagggtgagatctcaagctctctctgtatgtgggaagatcgcgtgcccggaagaaacgcgagacacggacgatgtatacaggttcgggccgctgggaagcgtaataccctactcctgtgtttttagtggatctgtgtatgagggagctacaaagtattcacttcctttcccctctgccttccaaaagggaaaaagtccccccactaaatgggcaaggtcctccttttatatctcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggtgtgcgtcagaccgccagtcgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccctcgggggaaatcaggaggagggcggacacctcaccctcgggcccgacgtccccgaaggtgccaggccatgtgggcgattgcgtctgcctcaagcctctggtcatgatactcccggtcccatatcaccgacaatgtccatgtggtgattttggtgggaccaaggactatatcagtccacatgataaatttaaaggacttgtttggacaatatgaaatattaaggactaaaatgacccaggagcgaaactttaaggaccatattagctattctccctttaaaaaatcataatatttatttttttaaaaaatataaaataattaatacttaattaattatacgctaatggtttaaatcgttttacatatttctcaaatttctttt

SEQ ID NO: 66654 - DNA, 3506 bp, Oryza sativa
  unsure (1)..(3506): unsure at all n locations
ctaaccacagccaaagtggcgaagcgcaaatctgtaacttacacatacggctctggatcccctggacgtggctacaaatacatattcgcttcgtccaaaaaaaaaacagaaatcttagaggatgaaacatgaagcatattctaatacgataaatatagataaacatatatctatattcgtcatactagaatatgtctcatccccaacatatattcatcatactagaatatgtctcatccctaacgaatatgtctcatccctaactaggttagatgcttttgggacggaggaagtaattacatatactgaacagtgaacatccacaactcagttttatgcactaaaacaagatactaacagtagaacgaggacaggagcagttttatgcgcgaaaacaagatactaacagtagaacgaggacaggagagaagggagagaaaaacgaaatgtttcaacaaattgcgacggttactgaccaacttaagcaactattataatgcaaagaccaaactcctcgttcttacaacactcactcaacgatacatcacaagatataaacaggggcgagcgagcaaggcaggaggcactagagtgacaccaagcgattatacttaattacttatatataaaccatgcattccagacacaccattcatcatcacatacaccaccatggcacaagaccagaacgcaaccccctcctccaggcaggagatcaggatacattcccgacttcacagcaaaattaaatcaggaaggaatacttcgctctaagctcaaccagatctaggagtcccatgttcttccaggctgctgcctaggctgcgaggacgattatcactatgagcaggaccaccccgaatataaccagcaacaagcatatctgcaacataaaatgagaatcgaacaatgtttcacatgttgaagtgagtgccagtgaaatatattaatgagtgctaaaggagtctaaaagtaccagcgaagagttcgacttctgagttttagcagccttagagagttggccttttgcttgtgtagtcgctataacagcattctcgatatgggtgtcaatgtcatctgcagtataggaggagatacacaatcagatataacataccagatatatgagcagcctcgtgcttcaacgtatcaaatagcacataatcccatctatcatccccaacggtaccacataccaatcatttgtccttgatcgtggactagaacagcaagatctttgaagatttcatttacttcagtaatttggtgctgaatttcttgtattccctgatccctctcctcaatgacggcctcattgaacacgatctcattatccaagaagactaattcttgcctacagtaaagaaaaaaattgaggttatcatgttcacacatttgcaaaggagtgaatttgttcattcatttcaaaacaagtgaatactttatagaaatgttcgaaaacaaatagtccaaagcataaccaaatagtactatcaattcaccttcttgattctagaagcgccgtgcgtgctcagccaacttatcagcaccattgttcacctcgctcgagttatagctgcaaagaacaagccatcctagattactcatatgttgacaacatactggaaaaactttgacaatatattatcatagaccagcctcaaaaatatgttgttattattattacagaaaattaacatataatgaatgtgaggtacaaaattttgcaatgatctaaagtaccattgaatggagataattttaagaaaataatgttttgctgttttacttggaagacccaagaagacaggctacacttgaaagtggttttattattctgagttctatgaataagacaaacttcatcgcaagtttagtcagaaaatgaatttatgatattgaaagctagggcctgggggctgagaaagtggaccatgaacaaaacgctagatatttaagggtaaaacaggcagagaaacttatacgctacagtagatcaaaacagcaatacgaactatttggataggatcaaatatgaatgctcatcctgtaaatgcgcaccagaaggtattgtattaggttggaataaaccagggcattaactattagggtcatcaagcacttggcagattaaaagcactaatccagtgttattattattccatttacctcagaaaacataatccagtgttaagtccagtcaaactgaaaatatttttttcatgaaatttttttaaaacttgacgtagaataatttatttgttcaagagagagtatgcaacaaaattattctgcagagtaagtaaaatgtaacaggatgctgtagcattagtacactaccaagaaaatgataaacaatatgccatgaattatattattgtagtaagtgcacttttgttcaaaaacataagatgccaggaagaaaaataagcaagtatttacagaaagaagtacaccagctgactagcaaactacctttgtggcaagcccgcttgagaaatgaagggtgcataagcagcttctctttctaccgctaaccgttgagctttctgaaattctttcagaactgcttggaaatcctttgctagcttcgcatcagcaatctttttgctggcctgtagttccaaacgaggtcatcaacacacattgtgtaatacatcagcaaaaatggaacatagaaatgttccttaaaatagtaatgatcatagattcataggcaatcaatactacataaagcagctcatataagaaatgcaaatgctacatttgatctctacatgattctaaaatctgcttgtagattatttctccagtggcatggcaacacacttgaaaatatcatgactggagcatattgagtatttaagaaaaccattcggttgatgtgctgaggcaaatcactgttcacagtagtcaggcaaaactaagactgatacagataaaaaatgcccaaattagaagtgatgtttccagtcagaatataaggactgggtaggttcagtttccaaaccaatatgcattattacactcttctgtactttgaaggaaaatgtcaaaattgaaggttttctggttcaaaaagtagcatcacatgttgcaattccatttcattttgatgcaaaaggtgaagagtactgaaataattctggtttcaaacatacaagatagaaacagttccaattctgttttgagaaaaaagcaacttggacaaagatgcaagagaatacttacgctgacttcgacacgatgatcagcctcgctagcttgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66655 - DNA, 1314 bp, Oryza sativa
agtaatagtgtatgccgagttggatgaaaatccatgctggttacactagatccctgtgacaatgtacaagctactgtcctgggaagatcctccactgaccataaaggttggggaattggtgcaggataggtggcctgaacataagcgtagatgactttgaataattgatagaaaatgcaccagccatatatcttctatgcaaatgcaacattacctcatcaacaccatgtccacttggcctcaatcgcttcattagttgctcagattctgcactttgatagtctgttatagttggtcgtttcatgattgggacagctgaggaaatagtacgataagttgtatgtcatgagaacgtgacaaaagaaaacaacatatcaggacatgcaaagcagaaataataaatgttcatgtacatttatgttgccaaagagaattaggctttgtcttagaggtgttagatgtacttcaagctagaaggattaggcaaaacatcaaagaaccaaagaaccgcattgctgaatagttgatgcctgtaaccgtattctatgggccaacagaattacttcctccgtttcataatgtaagactttctagcatcacccacattcatataaatgttaatgaatctagacacatatatatgtctagattcatttacatctatatgaatgtgtgtgatgctagaaagtcttacattatgaaactgagggggtatctagtatatgtcccaactcaccttttcttatttagcagttttaaacttattttctttattaaaaaaatgagaaaacatgtcaaattcatatggaaaataaccattaagtcagacatgtgaaatcagaaagcaatgatcattagtgcaatgaattagaaaatattagtatcagagaaatagcaatacctagtgtgaataaagaagttgtacagtaggaaatattgcagatttaggtcagaataatataataaaagaacagtaaaaacgctcacattatcaattagcaaatatcaacagaaaagtatcatcttaccttgatttggcggaacaggtagtgatgatgccgccacaacagcagatggaacagatgatgtagcagcagcagcatttgccatccaacccgctaaagatggaccagcaggaggaggttgaaatggctgcattaatggatatagtgagtaaaagtgaaaagaggcattcataaaatcatgcaaagaagaaatggtaaatctcaaacatacagtatgagctgtaagtggtgggtatgtgccaccggcctttggaaccgctgccagtggtacagaaactggtgaagcacg

SEQ ID NO: 66656 - DNA, 9410 bp, Oryza sativa
aatgatccatgagcacaactaaaccaccattacctggtaagtggtaactaaaaaaatcaattcaagaaacatcaacagctcattgtctctgtcaacacattatacatttctttggtgtcattgttcagataaaggaataatctaaagaaccctaataatgcaaaattcaactagcaagcctatcaacacactcgcacaacagtcaacagaaaatacaaggcaagatgaagtaagaacctgaaattctcaagagttagaagctgtgttatctctttatataactcctcgttgaatgtcgagaagactttaagatctttaacaagaatatctactgcctttgctctatcatgcctgttacaaaaaaaatatataaatgaatatgaaaattagtagaagttatatctcacccagtgccaaaaggatggaacacaagtcctttttttggttgaaatgggaactttcccttcagatatgaaattatacctgtcaagtgcttccaaatacttctgctttctgatctcaaagaatatcttcatagaatacctattgtcatccaccttggtgaaacctgaaagatatttctccacttcatcccactccccagcatggaccttctcttcaaagtacttcatgttgaagaagaatcctgactcttgctcaagcctaaaacagaatgtaccatattaggaaattacaccttgctagaccaaatgtaccattgaatccaacataatagtcgtgacaaggaaatagaacattagttgaaggattttttttccccatcttttcgtagaatgagcagtaaacgagtgacagcagagctcaattgcaatgacggagaccttcgggtgtcaagctggacactctaattcggactaacctaccgtatgccactataaagtctacaatgtaaaaatttgagcagaaacgacagaaagtacagaacataagttcagacaagttcaacaacagctttgtaagttataattgcccgactgcttgcttaaaatttggttatattttcgtaaataattctcaattatttcgacggtgttgatgcaatccagagaaatgacatgtacaattactggctcagtcgacacagcacaagtgattataatgacaaaaccaatcaccgacttaatcacattgaatctagagattcaattgttcagacgaatttaagcagccgacagagaataggattcgggataaaaaaaacagacaagtttttttttcccgaacaaggcaaagcgaaaaaaaaaaagaggcgcatgtgagctcgaaatttcaaatctccccctcaactatcccaataaaataaaaataccatgaccagagcccctcccccaaaaattgatattgaccaaattgataaaatactaacaaccatcctggagaaaaccacgaggaaaaaaactttgaccaaaccagccaaaaaaaacttcggaaaaaatttccttgcatattaacagatcaaacagagcgaatttttttttccgatggaactcaaagcccaaaactaaaaaaaaaatctggagacgcatcacgcaaaaaaaaatcatagataaaaaaaacacgcacaaacactcgcgaaacaaatcccaaaaaaagcagagtcgcctgcgcccaaccaacctcccaccgaatcacccaaaaaaaaacagagcccacggtccaacccaaccggcgaacgaagaaaccagcgagagaggcaggggagggagaaaggctacgcacttgtgcacggtctccttgaacttctcctcgtcgaggaactggaggatgaggaacacgagctcccggctgagcgacgacatggcgccgcccccccgccgccgctgaaacccccctcccggctccgatctgccgcgggcgccttcaccgcttcaccccgccgaattctagggtttccccgtcgccgccgccgcctcccctcgtgatgagagagagagagacggagatgtggaaggaggaggaggtcgcgagagaaagaaagagagagagaggagaggagagagaaactttagtctcgctttcttcgatgcgttgcagacctctcgcccttttctctctccccacgccacccccacttgcttatctacgataaggaggtcggcttatgtataagtgggtgcgcgtatcgatacgacaactcgcctatgcgatacgcgcggagcggcggaatcgaagggggcgggattaaatcgggtggatattcgtgagctggcgtccggtcgtgagtgcgacgtgcgggcagcggcccacgagagggagagagagagagagagagagaagcgcgcggactttttctcgcgtctccgcgagatgacgcggtacgagattacagcggggcgagacgagatgagatgagacgagacggtgaagttgcgggagaggagttgtcgcttcggttgctggttttctttttctttttcttctttttctcggatcggcggcggctactgctgctgctgctgctcggatggatctcgtggaagcagtactagcaccgaccgagtgagatagggatggacccgctgacgtgttccatccttgttttagcccgagcatttattgcccaggattttatatttagagtgtatttagttccacgccaaaattagaagttttaagaaaaaagttgaaaatttatgcgtgtaggaaaattttgatgtgatggaaaagttggaagtttaaagaaaaagttgtaactaaaccaggccctaatttcattcattggtgacagtttgattcattaattagagcaggtttaatagtatagccaattattagttctaaatcatctatggtcgatttacaatagttatctataagcatatacagagtattatactattaatacatggtcttacctgtcatacatgcattgtgtcttggagtctatgttgcagctggctgttatagcccgctgctcttctctttcctcttttatcttctcaatatgtgtttatagctggcttatagtctgttatcgtacctgctcttattactccctccattccattttaatcatcctctaagatttttgaggtcttctcaaaatgatcatcatttaacaaagtgttttttttcaaagagtaaatatgcatcattaaatggtgttgtatgaaaccaataaaaaataatttctattcgtgtaatggtatgcaatatttaaaatatgagcaatacacaggacatgaagcgatgaagcaccttaaccaatgaggattaatttgatactccctctgtcccataatataagggattttgagttttgattgcactgtttgaccactcgtattattcaaaaaagttagaataattatttgattttttgacttactttattatctaaagtactttaagcacaacttttcgttttttatatttgcacaaattttttgaataagatgagtggtcaaacaatgcaaactaaaactcaaaatcccttgtattatgggacggggggagtaatgatgaatactccctccattctaaattgatatacatattttagaggtacaccaagaccaagaaaagctaataattttctcatactatatttactctagcaatgtatgcaccatctccactattttctagccaatagtaaatcaagatattgcatgtgggttataaatacttgtttgcatggatgcatgtatcaatgtccatttactccaatgcacaaataacgaataggcttaataaatgaataaatatgtagatcatttaggaataataaaaaaaactatatatagattaatttggaatggagggagtatttggatgcccttattcttgatgtcatttgcttagagatgatcaaatcgccaaatcgggatggagagagtattacgatgtgctctgtacatattttaaactggtcacgcgcattttaccacgtaagcagagggcgttttgcctgtatttttgctcgtatggccatttgtaactcgctcgtgtccttgatgaccaaaaacaaacagagtaaacaaagatacgcattacgctacatatgttccttccttctgtcttgttcccatctaaacaaaccactaccaacctaagttgttgagtaaccaactggtaataaccggacaataactaaagggagtagttcggttgaaaggctgtgaattgaaatcaaaatttgaaaattgaattcatttcagccaaccaatggaccgtttggtagattagtggccatgagcccatgataaccttattgctccaattggtagtagttcaaactcttgggaaaatcaagctgctaggacctagttttacccaagctatgatcttgcatccataatgtatctgcgagtcgttgattctttctcaataaataaatacttataaataccggtacaatatttggcagctattgttgcccctcattgaaaaataaatattgcataccaataaaaatatgcctattaaaaataaaatttttagatttggaaatatgattatcaaaagtagatggagagagtataattctacagattgaaatttaccttatcgtttttccatatgcctcggtgtttatttattcaactgatattcatgaccttggcaccgaatgatgactttaattttcttttctttggaccattcttcatctgttttccgaaccatccgtcctttaattcccttcaactacaactacaagtataatgtcttcgacttacccaagaaaacattgactttagccccatcacgtactgacggctctgtttggagaactagccaagagttattttaagagctattttttacataacgaaatagccataagttgtttggatccaagggttattttgagagctatttggcttttaatgcactttcccacgaagagagagagaaaagacattttttcagtgggcccacccgaaatagccccaattagagcaggtacaatagcatactataagccagctataaatatattttaaagagataaaagaagagagataatagcagcgggctacgatctgttgctagctacagtatggactctaagacgtaatatgtatatgacaggtgggaccatgtattaatagtaagcaactattctatgaattcattggctataaatgatttggagctagtagttggctatactattaaacttgctcttagcaccccttgagaggaatagtttttttggatgggttatttccaaaaaagccctgaaatagctcacatgtttggaatttttgggctatctggggctacgtgagggagggtaaaaaataacccatggatccaaacagggccgacgtttagatttgctgaagcagagaaaagaaatgtttgttaagacccatttaaatttgacgaagataaagattatatacggatatgcaaactgagaaagccattagcatataattaattgaattttaatatttcaaacttaaaaaataaatttatttaatattttagagcaacttctatacttaaagtattcgcacaaaatacaccgtttagtagcttaaaaaatatattaacggaagctaaaataaaatatactttcttcgtcccaaatataagaacctaaatcggatgggatattttctaatactataaatatgaacagactagaaaatatttcatccgattttagattcttatatttttgaacggagagagtacatcttagggtatgtttagttcacgctaaaaattagaaatttggttgaaattgaaatgatgtgacggaaaagttgggagtttacgagtatgtgtgtagaaaagttttgatgtgatggaaaaattagaagttctaagaaaaagtttggaactaaactcgatgttaaaagaattgttcttaatgataacgccctaggctgtgtttagttcagcgcaagtttggattttggttgaaattgaagataatgtgactaaaaagttgtgtgtatgatatgttgatgtgatagagaagtactagtttggattcaaactccctactttggcttaaccatacctttattatccggtgcacccacccggaagtctgtgccgggcagcggatgcagtgtggcctgtggtgcagatggcagccaggaaagcgtgcaggcaggcatgtggaggggaaaagtctcgactccagccgagaaagcaacagctgaaatatgaaaacgggcaagtacgctagccgacacgctctgcgcctctgcccccaccccccaccccccaccccgatccaaacccaaccaaaacgcaaaaaaaccgcaacgcaacgctcgtcgcatcgctcctctcttctcgtcgcgctcgcgccggtgcgaaaccgcgagacgcgcggtagccaagcccccaaccgcgacgcgcgacgacgtactactacctgcccgtgccgcgcgagcggcgaaaaaacgggaaagagaaaaggaaaacgctctcggtttcgatcggggcgccgattcgcggggttgggtgtggtggtggacggacgcgcgcgggtgtggagtgagtgatcgacacgacaagacgcgggcgtcacagacccagcacgtacgagtactacttctactactccaacgtggttgccgtccgtgctggtagaggagggttcgcggggtcgctgctcgctgcgtgcgagtagctgtgcactcgcgcaaacgcatgcggctacggctgtgtctcccttcaaacttctaattttttcatcacattaaatttttaaacacatacataagacattaaatatggacgaaaaaaactaattgtacagtttacatataaattattagacgcatcttttaagcataattacaccatgatttgataatatgttgctacaataaacatatgctaatgatagattaattaggcttaatacatatctattatttgttttattattagtctgcgtttaatactttaaatgtgtgtccgtatcctttaattttttttaaaagtaacggaacacggccacgaagagattcgttttcatggaaaaaatccgacaagagcagcctagctgcctagcagcggtgcggtaacctgccggtgagggtgagacgcacaagatgtgcatgtgcgcgacgctagtctctcactgtcactggtagtaaaatgttcccacttgtgatgtgtctcgtcgatcaatttttttcttatccttttgcggggtggacggtcgtgcgtgggcaaccaaggacagccaggaggcggggtgcgtcctataattttgagtttttttacactatttaaccactcgtcttatttaaaaaatttatacaaatataaaaaataaaaagttaggcttaaaatactttgaataataaagtatgtcacaaaaaataaataataatttcaaattttttttaataagacaattggtcaaacaacgcaaacaaaaacttaaaatctcttatattataggacggagagagtagttcccagaacaaaaacttttcacctatcacacagaatgtttggatatatgtattaagtattaaatgtgaaaaaaaatcaattacacagtttacgtgtaaattgcgagacgaatcttttaagcttaattgtgccatgatttgataatgtgatgctacagtaaaatatttgttaataacggattaattaggctttctggtggaatatataatttattttgctagtagaatacgtttaatacttcgtatatttaatgtgacaacaaaacctaaaaaattttctacggccatcggattctttgggcaagtgcaagcaagtggacgcttcacagcttcacggggatccgtactcccctgccctttttctctattcctttttactctgcactttcttcttacccacacacacgcatgctcctaattcaaaagataactttattaagaaaaactaaaatagctactcattaagaaagtataatatcggtgtaggcatatataaggaataacggaggataaatcttatcaacttatggattaaatgtagttaatgagataaaaatcaagacggattttgaactgtatggattagcttaaaatgagtacatcatacaccccatcaatatggtccagaacacacatttaaagagacggagaccatcactaaatttatcatatcattaaaatgtaaattcttattaaaagtgtcgtttgtgagtaggtgatgtttatagacactagaatattaagagcttgtttagatccttcgaaatgacaaaagttttaccgtttaggaccactttttagcaaaataaatctaaacactagtagcaaaaattaggcaagttagcatttgttatttggaagtccatagcagcaaatttggccaaaaaagcatcgggccccgtgcacgagagaggcagcagcaattaataacgaaactttaccatgcatctaaataccaacttatgaaattgtaataccaaatcttttaccaataaaacttttaaaaaaaattgccatagtaaattgatctaaacaggtctaaacaaatcaatatacctatgcgttgcagaaagatatagcatatgttcctttttgttattatttttacttggtggctatagcgtggcatggggccatgtaggatcggttggatcggttggaccaaccagttttttttttttgtccctgttttcattttactcaaggctcttaccgtgatatggataatggatgctttttggacgggtttttccatgacacggcgacaccaagcccctgtttggatccctgggctattttttagccctctcaaatagccccaaataatctaaaagttctaaacaggtgagctatttcagggctatttggaaataacccaccaaaaaaactatcccctcaagaggtgctaattgagactatttgggtggggctcactgaaaagcggcttctctctccatgggaatgtgcattaaaggtcaaatagctctcaaaataacccttggatccaaacaagttatggctattttattgtagggctatttctttgtgctaaaaaatagctcttaaaataactcttggttagttctccaaacagggcccatgctccgctacacaagggagtggactaaagagaaaaaaaaagttttgcttttaaagcaatcaaatctataggttttcttcatccctcgaagcattattagtagcatattgtcagcgttgcaacaagattttaattcaaataaaatgattgttgacccattattagcatcatttttgacatatatcatctattaatttctacatatatttgctactaagttgtaggacctttggcccacactgtcgtttttcttttccattttaagttggaatgtggtggtaggggtggttgacatatgagtcctctggcctataatattttcctttttatttaaaagtatagagttactgctgtagatggtgatatattcatcactcatcactaccattact

SEQ ID NO: 66657 - DNA, 2536 bp, Oryza sativa
tggaagtagtgggagaaacgctacatcactagtcgagaaccaggcagtagtcgtaactcgaccacttgaagtggagatagtgggagaaacactacatcgctggtcgaggaccaggcagtagtcgtaactcgaccactgaaagtggaagtagttggagagacgctacatcgctggtcgaggaccaggcagtagttgtaactcgaccactagaagtgaaagtagtgggagaaacgttatatcgctggtcgagaactaggcagtagtcgtaactcgaccactagaagtgaaagtagtgggagaaacgttacatcgctggtcgaggaccaggcagtagtcgtaactcgaccacttgaagcaaatgtacgagagatcactacgatcaactggttgagaaccggtgagtaggtgtccatcgatcatttggagtcgtggtacgaggaccgctacgctgccggtcgaagaccagtcgtagctgttcctcaaccatctgaagtcatggtgcgaggaacgctacgctgccgtagtcgtacctcaaccatctgaagttaaggtgcgagagattgctagagcagaattatctctcgaacaccaatggaagttgcggtgtgagagattgctacgtactggtgcgagaaccagtgagcgagcagaattatctcttgaacaccaatggaagtgctagagttggtttattgcaagtgtatctcatgtggccagcatgacttacgtacccaacttatagcatatctggatgtccgttcgcaatcatgtcgggtgatcaagccgacgacgttcgcgaggaattatccgttaacaaccttttctcgagtagtccagccatggccgatgctatgagataggtcatcggtctttgttggtaggttgggtgcgatatctccgcatttgtcgagaatgttctcgataatggagtgtactcgaccataacctactcgagtgctcaattgttcctgaaattattttctagaaggcaagacatatagcagataatatcgagtatgtactcaaaaactgtgtggatcttctagtattatcatgatataacgagcagattaaatatcaggcattatgtaaaccataaacaagcatgatttatacagaagagaacggagtgagcccctagcgttagaccatagttggcctatcatcggaagtactcgcacaacggatattgtataagaagcatgctctaggtaaacataataaattatagatctgacaatgctgtatgatctgaataggtacgataaattgcatataaaatattgcgtacctttgtagatatatgccggatatatctacggcattagtagatcaatttgaaaaatcaatctaccaattaccttattgcgtactcgttcgacatcatatgatctgacatcttttggtacgccgcggagcttgagggttggataatctcgatagaccaagttgtcgatgacgatgatggttccgatctggtcggaagatgtattttagtcgggttagatctcctcacagccgaagtcgtcgagtagcttgttgtcggagagtccatctcttaaacctatctcgtcgaaatcctagagcaccaaaatccccctacctggcgcgccactgtcgacgtttgatgtctcgactatggtatttggacagtatggggatcgtcggtactaggatatacacgagactgaggtaaaagagatggagacaaagatttttatacaggttcgggcccctgaattgtcaggtaataaccctacatcctgttggccgaagccggtattgcttttattcaccataatcacaccagtacaatatgtgggtagcctatctaactgttgtggacatgtcggtctgaaggtctgactcgtagtcgacaacagggtagtcttcctcctcgaatctgtgcccggcgagatcagagatagcgctttcgtatctcctgacggtatccggagacaccgtaggggaatagccatgcctatccttcaagtcgatatccggcggcgtgtcttggcgtatgtaggcttgtatgttgtggcttctggtaggcgtgtgttgattgtcatgggtgtctttcactttcatggtggttgtctctccccctgtcctcctaggagggcttgtatttatacctataggtgtccccttgtccaagtagaactagggaaaccaatatggatacaatctgagtagtacttgtcgtttccatgtagaactctggttatctttccttatccagaactccctcgaggtcagtttccgtataagacatggtatgtagtgtatcctgccgatatttagtcaactactattaggtatatgtggtatctataaccctgacatatatatatatatatactgttatacacatacgtatacgcaggggcgaagctacagccattcataggggtcagttgaccccgacgatgtttcacgaacctctcgtacctctctttattttaccatctatgaccccagcgaacagaaaaactagaccccggtgattttgttgattgttccgggctgcaggaat

SEQ ID NO: 66658 - DNA, 5336 bp, Oryza sativa
ttcctgcacccctccaaaacacaactttaacttcttgtttctacaaaaatatttattaaaaagtgatatatgtatacttttatgaaagtatttttcaagacaaatctatacatatattttttacattttcaaactcaagagagttattcatgatttatattcctaaggtttgactaaacgacttcctttatgagtatggagggagtagtttttaacaaatttgtagacatttcattttatcataatgtatttcattaattttgttttgtattatatatagtcttagatcattaattacaaactagatgacatttccgatttagtgttggattccaatgtagcgatatgacatttttcaccaaattttaataagttttgatatagttttgtcgtgaattctcaaaaaacattcaaaactccgctcagaatatacttttcgtcccacgtcgaaacatcaaaattacatgatttttggtgggttttggtcgaaaacataaaccctggttaatactgaccccggtgaccatttatcctggcttcgcccctccgtatacgtatattggactgttggactggaggggcgcgcatcagccacccccgacggtgaagcggcgtcctgactcctgacactcatttggcagctacaacctgctggcggccattcatgtcatggtcatgggaactgggagcaggtgggcagaaccagaagcggagcctgtcgaggcggcggtacttgatgccgacggtgagcacggccatgacggcgccccagatcaccacgtccatggcgagcggcgtccgcgactgcgacgtgatgaacgtgagcacgaggctggagtaggacaccaggaacggccactgcacggcgcgcgacctcgacggcacgccggtgagcagccccagcgtgagcagcatcgagctcccgaacccggcccagctcgctgccatgaacagccagtaccgccgccggttcttgtcccgcatgatcgggtcgccggcggcgtggctcccgtcggcggcgtcgtcctgccagtacccgcccgggacgttcgtccccagctggtacgtcagcgccgtgatcagcgtcgccaccaccagcagcgtgtcgttcttgttcgcctcgaaccccggcgcgtgactgcggcgcccgccgccgttctcccgccgccggttgtcacccagctcagcgtcgtcgacaccgttcttctgccggctggtctcacccagctcagcgtcgtcgacaccgttttgccggctgttgtcacacagctcgccgccggcgcggccgtcctcaactgcgccggtgtccatcttacctaaccactcttaagcctatgtcaaagtgcaaaacttagatcagagaaagaacagtaaaattctagcaggaatttgatgacgccaatgcttcgcaagaatcacaaagcctgtgttcttgttgtgtcaaacatgctatgcatacgcacacaaaaacacacatttatactggaaattttcttagttaggctatgtttagttcccacacaaaaatttataccctatcacattaaacgtttgaacacatatatgaaatattaaatataagctaaaaaaataacaaattgcacagattgcgactaatatgcgagatgaatcttttaagcctaattgctccatgatttgacaatgttgtgctacagtaaatatttactaatgacggagtaattaggcttaataaattcgtctcgctgtttgctgacggattctataattagtttttctattagtgcctgaacaccccatacgacaccatatataatacctgatgtgacacgccaaaactttacacccctgattaaaacacccccttaattactttgcttatctctaacaatcattgagaggtaatttctcagaagcagatgggaagcacaaggagtggctcgtttagggcctgtttagttcactaaaagaaaatttctgggtgtcacatcggatgtttgtccagatatcggaaggagttttcagacataaatgaaaaaactaatttcagaactcccctgtaaaccgcgagacaaatcttttgagcctaattaatccggcattagtacatgtgggttattattgtactagcacttatagctaatcatggattaattaggctcaaaagattcgtctcgtgatttcccccctaactgtgtaattagtttttttaatctatatttaatgctccatacatgtgtctacatattgatgtgatatttttggaaaaaaaatttggaactggccttacttgtccgagagctgcaactctagtcgagcgaggacttctatgctctaactagtcagtcgtcatcaagttgccgtggaatttatgcagttagaagttagaacaaacagaagctgatgtagtggatatcttattcaaaacctaaatcaacgcatcccctctcccccatttcacacctcggaatccctctgattatcttagtcaattcaaaataatctgaacttggatttccttatctgacagagaattcaggaatatccaacttgtcatcacagcttatctcatcttatgtacaactgtaacctccgttgtataatatatgacgaagttgaattttctcttaaaccattgctgaagcatatctcatttcatcacgattaatggctaagattgcatcgataatgccatgggatcctggtggctgctgcttcctcaagttattagctatatcagctttgtgggcaagctacattttccaggccatcggattgttgttggacagttgagtgatagttctatccttcacaagccaaacatttcgatttgcttgagctgtcttttgggatgctcgctctgttggcaagctgagaaatgaagtccacatttctaaagctttatgacagatagagggtttgtaatgtcaaaagttcacttgccgtaaacttgtagacaagtcgaatttgaaggagagatttgaacgagaggagattgaatttgtaggagagggggattctcaggagttattgggtttagggatggcaataggttaggtcaggcacgagcatagcaaatccatacttggcttgagactcacgtgcccgtgtccgacccacgcctgcgaagtctcttgggcaaaaccccatgcccgttgggcacgggcatgcccaacggatacccattgggtatcacagtaaatatcttaaccccatgcccgtgcattgccgtgtcgccagccgccgcctgctcccatgcgccgccacctgtgccctggcgccgccgcgtcgccatccacagcagtgccgccagccatcgccttcgcccgtgcgccaccacatcgacgcctgcgcttgtgcgccgctgcgtcacgctgccaatagcctcccgcttccttcccgtgctccaccgtcgccgtgtgaagacactggagaagagtagaagactgagagagtgagaggtggcagtggggaggaggataaggttaggggcttggggattttcaggctagggttttattgagtgaatatatattgatgctgtatacaaataggtcaaatgagctattgggtcataagagaaaggttaaactattgaaggtctcaaggatatacatggactaaaaaaaattaatttttggctcaagctgtcaagcatgggttacccgcgagtgaagtataaaacccgtatgcttctaataaattcgcaggtatcgggtgggatatgcccaatgataaaaataggtacccactcccatatccattggttcgagtatcatgaatacgcgaacctacattggattgcactttgcacccttggctgttcggaactgcgaaggtcacattggtgtgtttcaaacggagtctcttttcgaattaattttgcccgtccgtgcttgggctcgtgacctgagaaattgtgtccaatgggctgtcgcccacgctcttcgccagcttggtccatgggctctctctctctctctctctctctctctctctctctctctctctctctctcattcatcctggaggaatggcactaattcgatcaagccaatctatgtaaccgcataaacccatttgcataaccactcggaatcgatggactcactgggggggcaggcagtgtgtgtgatgatgcgaatccaggaggagcctgcagcggcaagcaatgcaaaaacgaagcgaataaccaaccttgagtgtccgtgctgctgccaccgcccactgaagtggctgctcgtctctacggagtaggagtatgtgggatgtggcctacgcctatggtttttttggtcggtccagctagcctagctcatatgccctcgtccacccatgtaaaccgcgacggaagcatggcacaatccggcacaccaactcgtcgattcttccggcaaattcttgcttgcgtgaggcccgatcgagcatcgaccgacactagctaccaacatgtcctaacaacaaactgtcagtacacaacagcaatagttagtgatcgatactggtcgcattgttatcttgtactctagaatgtcatggtcaaatatcaaatatttgtccaaaatcgttcgtttcgtttgacctctgacgacctcagccgagttttgtgctatccatatttagttttcttcttcttcttcttcttcttcttcagcagcgaagccggtgacagtcacgcttttatttacaggagtattttttacccgtcctctacatctaattagatatgtacagtattttaaaattgaaaacttagctcctaaaacaacacaatccaaaattcgctctttttaaattagaaccatagccacttaaataacacaatctaaaattcgcttatatagagatttgaattcaatatcttaggatgctacttaggttaccgcaatcactagactttgcctttgacaataacgctagccgtgctgcacaatcacacgaagttagttaaattaagccaatcattgggctcaaatccgtgtccctttcctcgaaggcgaaaaggagttgttgataaaggcttcgatgctgcacacgacctttcttctgcagcaaactataccttgcctccatttgcaccaagaccagagcacgcacgcttgccactctatatactggcacacctcgcggccatggcgagacacactcctcgctcgccagcaaactgctgcttgcgaccgcgacaatggcgtccaccggcgcgctgcttctgttgctcttgtttgtgcttgcgtgcggcggcaatggcggcgcggccgccgcggtgttctccgggtgttcgttcgagagccaggaggaggccgaggcgttcgaggccgcgctgctgcagcaggcgtgcttcaacgtgacggcgttcg

SEQ ID NO: 66659 - DNA, 7115 bp, Oryza sativa
ccgccgcgtcgagtcggccgtgacgcagctcactcagctcgtcagcaacctcctcgccatgcacaagaagctccgcgacatcacgccgcagcaccaacaccaacaccaccaccaccccggcaacaacaacaacaagaacggcacagccgacggcgccgccgccggaggggatgacaccggcccgtcgtcggatctaccgccatgggtgacggacgtcgtcaacgatgtcgaggaggaggtcacggcgacgcgcggacgagggaggtcgtcgtcgtcgggaaggaaggcgatgcgcgtggacgtggtggtggcgcaggacgggagcgggcggtggcggacggtgagcgaggcggtggcgcgggcgccgagccacagcaggaggaggtacgtgatctacgtgaagcgaggggtgtacgaggagaacgtggaggtgaggaagaagaagacgaacatcgtcatcgtcggcgaggggatgggggagacggtcatcaccggcagccggagcatggccgccggctggaccaccttccggagcgccacgtttggtaaattctagtgcaccgcagtgatttaatttgtctttttgctaattactcctacttttgctactcattttggttacacactcgttacttcgttagtattcatatacgaataccccgctgcgttgctgcaaaaaattaagatgcatatactatatacaaataaaatataatttaattaaaaactaaaacaatttgatataattgagcttaaaataattgagattgtagattttttttagagaagaaaaaagagacaatttagactatagatctatcatccaaatgctagaaataatttaagtgatgtggtttaatgagagaagagaaaaatatcattaactatacttagtgggatgaactatatgagtatataggattagaccaacatgatcgccaaatatatagttttgaaaggctacatatatccagttggatatagaggctgggtaaaaaaatatcattctctaaaaaataaaaaaaataaaaatatagttttgaaaatatttttgttatttaaacatgtttgcaaaacatatagcccaatacctatgaatgtatatcaaccaaaagtcattgattcgagagtattgtatagaaccatgatatttgtggtctcaaggttttactaaacccttcacttttagcaagaaaatacggagttctctaaaaaaattagtgataaggaacatcctttatactctagaacaatcataaaagcgatcatacgtgcatgtatagcagcttatacctttccagcctattatctactcctatagatcgaaccgaccgaccacaatcgtgaccgcatgcaaaagtgcgcggcggcacccagtaaattagccgcacacgaaccattatgacagcaagattcacgtgtgctttgcttgcatcaagccctcatctaggctggcagataaaccggctcgtgcatatgcatgcgcgctaagaaaagaatatccttagagcatcaccaaccgtctatctatataattccccaaaactaattttgagggattttaatccaaaaatcagctccaacagatcccctactctcctacctgagttttggagttcccttcccccgattcctcgctccgtttatatgcggacgcgaaagtcgcacccaatcacgcaatcccgcctctctcccttgttcccgcgtgtggaaaatagcgatctttctacgcgtgaaagaaaaaaaacagaattttctcttggtagtttaacaaaagggtccacttttaagttttggggattaaatttaggctatctgttggaggaaggagttttttcacttcctattttcagtttagaaaacccaaaaacaaatttttaggagaaaattatagataatctgttggtgatgctttaagatgtcctcttgcaaaaagttttccatcctccacatatctagggtttgtttgttcggtttattccggactattgactattacgatgtagtagaattaattattcccttttcaaaccccctctaattcatgctacttagggattaaccgagcaatgccttagagttgatgttgtacttaaatttaaaccgcggcacaatgaaatcaaaacataaatttgaatgagattttaagtggagttaaatttgtacttcatccgtttaagttatttgaccttttcttagtcaaacttttttttaagatttgatcaagtttgcataaaaatataataacacttttaatacaaaataaacatattatcagaatatatccaatgttaaatttaattaaactaatttggtattatatatgttattgttttttcttataaatttgatcgaacctaaattttgactaactcaaatgttttataatataaaacggagggagtaactgaatttggtttgtgtgtgcgtgcgtgcagcggtgtcgggggcggggttcatcgcacgggacatgacgattcggaacacggcggggccggcggcgcaccaggcggtggcgctgcgcgtcgactccgatcgctccgccttcttccgcatcgccgtcgagggccaccaggacacgctctacgcgcactccctccgccagttctaccgcgactgccgcgtctccggcaccgtcgacttcatcttcggcaacggcatcgccgtcatccagcgcaccaccatctctaccctcccgcccgccgccggccagaacgccggcagcgtcacggcgcagggccggagggaccccaaccagaacaccggcttcgccctccatgcttgcatcgtggaggccaagtacccgacctacctcggacgcccgtggaagcccttctcccgggtggtcgtcatggagtcctacctcggcgcaggtgtccagccgcgcggatggctggagtgggacggcgacggcggcgagctcgccacgctattctacggggagtaccgcaactatgggcctggcgccaacatcggcggccgggtgcggtggcccggataccacgtgatcatggacgccgccgtcgctgtgcgcttcaccgtgcggcggttcatcgacggcctcgcttggctaccctccaccggcgtcaccttcaccgctgacctcaacaggaaatgacgacgtatacacggatgcagatgctctgattgaacttccccctgatatgtgggcccgcgaacggtggggcccacatatcagtcactacgttcctctgactttacgtcagagaatcccaaataccacatacacacacaaaatcagttattcatttggtttggttaattataaattggatatataccagaaagaatatgtttttttttgaattaagtatatactaagctagttatacgcatagctcatatatatggattcatgtaattgatgaacaatagatatatatacaagtttcatgtgaacatcctccaaacaaaaatttctgggagtacttttttaggtctatattaaaaaacttccgtaaattttgttggtgaaaacgtttaaatgtaactacaatgtcatttatagtgtatattttgatccttgccctcgctcgatcctgtcaatttttattcacccaccctagcacaaatcttcaacatctgacggttagaaaatcgcaagtttttttaaaaaaaaatcaccattttttttaaacaaatcctttttttttctagagattttggaaatgtattagaacttgagaaaagtggttgcaaaatcatttggtcaaaggaggcaaggcccaagaaaagtctaaggcccaggaaaagtccaaggcccaaggactgccctgaccctgacacgcgccaagctgttcctccagtttccacgattcttcgtcgtcttctctacttctccctctccgccttcaaaagcgacgctctccacctgcgtcctcgtcatcctcccctagacagacaaactccagctcctcctcctcctccgcgctcgagatcccgcctccgcctccgcctcccccagtcgccggcgagcaactccggtgaagcgcgagctacggattaaggtgcgccctccccctcctcctcctctcgctaccgagcaagtggtcacggatcttggaattggattggattggattgttcacggatcgggggatctcatctcccccttgtccccggttggatccaactcctcctcctgttgttgttggtggtggtggtggtgatgtgagggggttcgctccaagcataggtagatctccccacctttgctgtttgtttgctcgctccccgggtcgtcgtcgcctcgcgcggacccgatctgatcccgcctagagcctcgaggggggatggtggatcatggggggggggggagtggtgagaggatctgtctctgtcttacggattgtggcgtggagcgctgttctcgtgggcgtattacgtatttacgtgttgccttgctttgatcccatggattgttttgggtttgggggggcttcgctgagatttggagctagaattttggtagtggaatacttgcttatgtgccaaacaggttgattatatactgtgccctccaaatttcgctatgaacagcattggggaataatgtctggtgatttgaggcgacatgctggtgtagattacactcgtgcggtggattacacctaaagagcaaatggtccatatgtttgttgctgctagcatgaactggagcaagatagagcttgctgttgtacttttactagcgaaaacgtttgctgtctgcaaacctgtttatcacataatcacattgttacatcctcccccaagttattcttaatgatttagatgttttttttttcacataacatttagatttatctttcctcgttttaatctgtcagaagcttagtatcgtaattggcaagatgaactttgtgtttaacccatgaatctcccttgaaattgtgagataccccctccgtttcatattataagccgctttgacttttttaaagtcgaacttcttgaaaatttgacaaagtttatagaaaaatgtagcaacatttatagcaccaaattagttttattcaatcccacattgaatatattttgatagtttctttgttttatgttgaaaatattgctatatttttctataaatttagtcaaagcgaaagaagtttaacttaggaaaaagtcaaagtgacttataatatgaaacggcggtagtagtatttaatatttggtcaaaggagtcgtggcttgtttggatttcttagtgttgctgtgctgttgtcagtttagagaacgaagctcaagtaaaggacaaatgaaccactacaattttggtccatctttacgagagtgactgctatgcaagtaatacaagtgaatcatgtttacctaaagagctcttttaggcttttgcagtgctccacactctgtgtttacatgtccacttttgcttgggttaaatgtcagcctgtccttttaccttgttcctttgcaatgtcctttgtttaccttgttcctttctaaaatggatatgttagacaataacaaaatgaaacgtcaaggttctctactgcaagctccatagcttatcacgatgattagtgtgccttattgtctgttgtatgacactgggtgcgattctggtacagatacttatatgtcaacatacttttcctaataattttgaccaaccgatctgaatatctagtgacatcctttatgaattaggcatttcatcaaactgttagaaaggtgagcagtatattcttgtcacaggaaggtactacgccgctgtttatttgtataacctgatgtgtcttaggaaatcagttgttaatataatctttatgcagttgattacaaatgaatcaaattctttcttttgtgtttatgatgttcagcgaaaatcatggtattctttctatgtaatcttgtaagaattctctattctgattatagtcttttttattggcattatcagaagtgcaccatggccaaggtcaagccaaaggcactgctggcacaaagcaagcagaagaagagccccactcaaattggcgcaactacaataatcacctacatcgtcctgggagcccttgtcgtctcttccgtttactatgctctcaaatattggcagaacagaggaccagcagcagcagaaggcattgtgggcaactaaggcagctgtgtaaaatgttgttgtatcatcttgttgggtaattttggttgttacagttcagtaaatgaaacatagacagaaggcctcatgttgaagctttagttttatctcctggtaaattgcattaatatttatttgatatgtcgttcttcgacatggatgactctgttgggccgatcttgttaagagtgacatacatgacagttgcagctgtgaaagttgcatgtgatgccatcaaaacgctgattaagaagctttggtaaaacgttttcccatctatgacatgccattatcttctacttcaatagaatgtcatatcagctattactttgctttctctcagatacgtattgtggtgttagaatatcatatcagctattactttgctttctcacattcgtattgtggtgttatagtttggtattaagtcaacctctctaatttgaccaaatttataaaagaatgcagtggcacctacatcatcaaattattttccttaaaatctaacatgaaatatgtcttgataatgtatttattggtagtgtaaaccatgattattttttatgagcaaatttgacaaaaccacaattaatatggatcaagttgcataacgataaagattttgacgcaggcagcctataggttttatggtcagaacatttcacaaaaacgtactgttgatctctctaaggctatgtttggcattccatgttaaaaaaaaatcctcccgacgtatcaaacataacggtttattaatacatgatcaattaagtattagctaaaataccttaaaaattggttattatgatttttaaaacaactttgctatagactttattttaaaaagtaccattcaaaaagcgtgcgtgcgacaaacgagagagtaaaaattgggaaaagggatatagaacttagcctaactcaatattgtagcaaaataataattaatgaacttagttgctactacaactta

SEQ ID NO: 66660 - DNA, 923 bp, Oryza sativa
tatgtagaactcgacaaaactttaacaatatatatttttagacaaaactgaatatataattttgatgtattaagtatagttacatataatgttttagaaagatatgaaccgtatatactccctccgtttcatattataaaacgttttgatctccccattactcgtattcacttattcactgacacctgtaaaaaatacatagattaatacaaaattattcaaaatcgaaaatgacttataaagtgaaacatataaaatatgttcgggcttgtgtgaggttcagcttaagtataagccaggccacaaatattttgaatctctagaattaattttagggcattttcctttttttaaaaaaaaaaatagacttggcttttggaccgttgaaaacacaggcctaaaaggtactagtatatctgaaagttattattattattattactttggtcatatatctttggtttatacgccataactttagataatggttttcaagcataccttatccagaacaatgacatgtagtgtagtatcattctggccgagcgaacttcgtcatgtccgcacatttgcgtggaaatggcgtgcgttggtctccggtcaccggttagaagtacccgcgtgatcgctaccgcttggtagcctgcaatgtccctttgcctgattgcgaccgttctctcttctactcctttttttttttcttttgagaactctcttctactcctaactcctctctaccttccttgctatagctagcttccatgttgctgctagtgatgtttggtgcacccaaccactttcaggatacgtgtcccagctgtacttttcagctaactgtagtcttcgtgcatggtttcgcaggtcagacttttttatttggtaaggaagtttctctaattctactctctctgtcgaaaaattat

SEQ ID NO: 66661 - DNA, 1971 bp, Oryza sativa
aacccaattgcatggtcatgtaaatatctctctactctttttctttgactatgttatatgaagagatataattactccaaatttacaaataagaacaggttccctccatcttaaaatgtatctatttttagaattcaaatttgtttaaaaattttagatgtttctacctacctctgtctcaaattctcaaccaatcatacctatcttccatttaattcttcacctatttttttcttctcaactatttacaatattgcaccattcaatttttacacacttctttaattcccctaaaaacatctgaaaatgcttaacttttgaaacgggaaagtaccaataattacttcaaagttaattatgaataaatataaggaatccatactatgtaccagacaagtgtactatttgtccagatacatattctagatcccttatatatgtggttggaagtagtagatgcaatactacaatctagctaaaagttatttggattttagccttttctctttttctcccacttctctatttaatttgtatatgttgcagcgcgtctaaagctgatgaaaaagtgtggtaatgtgttataactcactattaattgtatatactctatggagtatgttctaagtctacttcttccgtccaaaaaaaactcattcctagcatttcaagataaaaatagtggagtgagaatgactaaaatgccattaatcattgaaaaaatagtaagagtgataggtaggtaaagggtattgaagggataaagcttctcgttttacgtgctgagggtaggtaggatgatagaaattagttttttttttataaaatttaaactctagaagttgctttttttttggacggagggagtacaatagattctatttttatggttaactataaaaacacattatttttgttgtgcaaaaaaaaagatttatgctactccctccgggctgataatacttgtcgttttagataagggtgaggtcaaactttagaatctttaattatgaatcatttttaaaatatttatctttcaaatatagtgactacatgtatagattagtcttaaaaagtactttaataagatcatatatttgttaacacttttttacatattataatagaaaataatggtcaaagttgtttttttaagaccgcgcccttgtccaaaacgacaagtattatcaacccggaaggagtatatatttatcgataaattttcacggtataattatagtgtaattatattgtaagtacaatgtaactttcaggcacatctggaagtaaaggaatggcttaatatttcagaacgttcaaccttcctttcaagtatggagatcttttttttgtcaaagaagttcttatgcatatgtgcagaatgaaagatcctttaaaacaaactgtttttagttggttacaaaccttatagtcttcttgtgtgacctttatgtaactctgtaaccttgtaaatattttctttttttataaaactacactgctgggcaaagccctggcagtatttccaataaaaaaaagtaactttcatattattttgaatcattataccaaacgaggaagaaaaatcatagcgcatcgtgttaccgtggatttttaaaagttacatataatttatattataattaaatgcaagtcataatatcatggtactaagattataaaatttatcaataaatatgtataaatatgagggaaaaaattccaagaaaacgggtgctatgtatttgcacacgattagttaattagctggtcttgaggtcttttccgtggtcacctcagcgaaacaaaaaagaaatgacttttacgtgcctttgacactgtctcgtgcttatccgtacaaaccatgcgtcgtccgttgtcgacggaaacacaattacgagctggctgtcggctgtcgccacttgccaaaataacaaggacttcgcatttgacagatggggctgcaggaat

SEQ ID NO: 66662 - DNA, 1841 bp, Oryza sativa
attcctgcagcccaggctaatcaagggcagcgtgtaattctgtcaattctgctaagcaggccacagccaatgtagtgccacaacattggcaaccaaacagtggtcttgtcatgcaaaatgatacagcagataccaatcctgaggatgcagttccatgcattgctctctccaagaatgattcttatgtgatgtctgcatgtggtgggaaggtttcactgtttaacatgatacatttaaggtaaatgctcaatatcttttttggataaatacttcaaaattcaggaaattttaattatgcttccttcatgcaggtgatgacaacattcatgccaccacctccagcatcaacctttttagcatttcaccctcaagacaataatatcatagcaattggaatggaagattcaaccatccatatatacaatgtcagggtagatgaggtactgcatacataaaatttgcacatactgtaatttattgagccattgctattcatttatattgagctttattttctttccaggtcaaaactagattgaaagggcatcaaaggaggataactggtttggccttctcaaacaacctacaaatacttgtgtcttcaggggctgatgcacaggttactatagccaaaacactttattttacactttacattcattgattctgttgatggatcagtatggctgctagtttatttatctttctcaaaagaaccactcaacccttggataataataatgtcactctgtttccactttgcagctttgtgtgtgggccaccgatacttgggaaaagaaaaaatctgttgctattcaaatgccagctgggaaaactccatcaggggatacttgggtccagtttaactctgactggagtcgtttgttagtagtacatgagactcagctagctatatatgatgcatcaaaaatggaaagaatctaccaggtagctatatatgctgtatcaaaaatggatagaattcctatgttcataattgatcaaataattttgttctggtttgctaaaatctcttttttatctctcttgtttcagtggatacctcaggacgctttgtcagctcccatttcacatgcatcatactcacgcaacagccagttggtttttgctgcctttaccgatggtaacataagaatttttgatgtggagaacttgagattaagatgccgaattgcacctccagcatacttatcttctgcagccataaacaggtactcactactttacgtatgatatacgcacgaaatttacctaaggccatatgagaactagatgtgctgatacagttttaaatttcagtatctgattgtccatgtatattgctacaatatataatgtagtacgagtgtcctagcactttgacctgtaatcatcgtgcattcgtgctcaacatgtcccacccctcctctgccatgccttgagccatgactcctttctgttaggaacagtgcgatatcctaatagctaatgccatataagtctactaatcgaagtttgagatatgaggattatgattttacatgatcctgttagtcaatttaagaaggattaactggcatttttgttctaccaagttttatggcaatcttagttgccctgaaatactctgaattggtagtcttatctagagtagctagatataatatgatcaaaaacacctaatttcaagtgggaaatacataaacattatatgccaaacttttgttgacaagttttgacatttgaaaccccgctcattagaaggttgcgtattattgctatttattcctccatcgagcttcatctaaaaacatatatgtttccttgcaccagcaatccat

SEQ ID NO: 66663 - DNA, 1738 bp, Oryza sativa
atcgtaagatcaggtgtgcttgtaacttggcggatgtttgccctagttatgaaaaggttatcttgtaataaggatagtccataaaattaggttttctcagtataactgggacgtcggatgctgtagttatctttgcttagatgcttttcaagctatacatagtttttccttccttcatgttcattttttttccccaactgttgtggtggttcggacatgaaaaggaagacggtgattgacggatgccttgaatgccgtcggatttttggtagaaagagatactagcatctacctaattgttgcataagttcgttgaaagaaaataagtttgtgtgctaacaacgggaattttatgatttatgctattgaattgcctatatgggcacaatgagatgtcattaatgtaccatctgaagtcgttgtcagctaaaaaaccatatttgcttgtagattttgacggccagagtcacctaacgaggaactttcttgtgctcattttaaagagtaaattgagtcgacgttacatgaggaactttcttgtgctcattttaaagagttacatgaactgaacttgtaagaggtgtactatcttaatacacaattgggatacacaaatgcatgcatgctcagcatgactcttgctgatgtccacatactattactcctttcgttacaatgttagtaaataatagaacaacttatggatgtgacatatcttatttctttctataatataataacttatgattggatatgtcacatcatagtgttacgaatctaaacaagatatatcatattcaatattaggttattatattatactagcaaggaagagtactaccgtaaacttctcattctcatgagtggtcctatgtatatcggctgtgttcggagcagtagtcagtttttcagttgcacatttagtagggtattaattaatcaaatactccctctgttttatattataagacattttgactttggtcaaagtcaaactactctaagtttgactaattttttagaaaaaaatagtaaatttttaaccgaagacaaatatattatgaaaaattattcaattatagatttaataaaactatgctggtgttgtaaatattactattttttttctacagagttagtcaattttagagtagtttgactttggtcgaagttaaaacgtcttgtaacctggaacagaaatggagggagtattaactatcacaaactataaaaaaagtatttgttttcaaagaaatttctctatagaaagttgacttttataaaatatatatatttaacaatctaggaagcatgcttactaaatcaaaacttgaaaatctagagttgcaatgtttagtttatttagccaaaactaaaccgaataaaacgactatactctcgatctaaaataaaccaacttttagagtttgaattttattccaaaataaactaacttctatcttcttacctaccatcaacacatatcaagaagataaaagaagagagaagagtaacgggctatagatttgtagccagctgcagcacagactccaagtcacaatgtatgtatgacttatgtgactatgtattaatagtgtattatatgtttataggtaactattgtatgaattgattattaagttgactataattgatttggatagttggctataataaacctgctcttagagccggtgcaacagtagatataaaccagctataaacatatttaaaggag

SEQ ID NO: 66664 - DNA, 2380 bp, Oryza sativa
  unsure (1)..(2380): unsure at all n locations
atttgattgtaaacatcaaatatttatgacctgatcgagtataaaaaaacatgtatactatagcttgattaattagacaacaatttttgtggcgcggtaggaattcagacttttcggttaggtctgtttgaccacagcaaaggaccgtgatccccatcatccatggacagctggcgtgatcacaaatgtacactttaatcccttggcttgcagatgcatggtgcaatctaggcattgttgtacttgtatgtacagattttctgcaaaattgcagataaaatatattcccagtatttagttatttacttttgctaccaagttaaaaccatgcatgtgttaatttggcaagaaatgcaaaatgtttccaaaaaagaagttttactgcaatctttgtgttccaacggctccgcgggttccatgcaaaaatagaaagcttggcattttagcaaacaccaaacgagcggctcgaagcagctggccagccggaggccacccgccatttttgccgcttccctcaccacaccgccccacggcggatcagcctcgcgagtatttatctccctctcgcccctgtctccggccaacctcaatcgatcccgcaacgacaacgttggcgttgggaaccgagtggagactagctagtgaagaccagaggcagacatggcgagatcactggcgcacgcgacgctgctcctcgtcgttgccgtcgtggcggcggcggcctgctggaccacggcggccggcgagaacgaggaggtggcggagatatgcaagaagacgtcgtacccggaggtgtgcattgccacagcggggaagcaggcgtccaagtacggcgccgccgtggacccgctggcggtgctcaacatgcaggtggacgcgttcgcgctgcgcacggaggcggcgcggaagcacctgacggaggcggtgaagacggcgacgccgaaggcggcgaaggcgctggacctgtgcgacagcctgtacctggacgtcgaggacaacctcggcgcggcgcggcgcgccatcgggttcaaggacgccgtcaccatccgcgccatgatgggcatggcggcgcaggacatgcagggctgcgacgagcagttcaggaaggtcggcgagaagaaccccatggaccacttcaaccggtccctcctcgagatgtccgagatctgccgctccctctccaacatgatctgatcgatcgctctcgccgnccgccaccgtgccggcgcgcgcaccgcgcacgcgtgccgccggccggcgaccctttgcgtgagagcgagcaagcgcgctccagcagcgctggtgattgaagcttctctttttaatttgttttctttcgcttctttttttttaacgatcttgttttcttagtgaaaaatgtgttaacttgtaattgttggtctcgggaaagagaaggcacattcaagagggtcttctaattttgaatggaaatgttgttgattcttttttgttgtaatttatccttgatgtcaaaatgtgcatgagcagtatattgaagtgtaacagcgactaaattaaatgtatacttttgtagcaccattatatataaataaagatttttgtatatttgcaattccagagcctaaatttaatttcgattttaaaatcaactgcagcttaggagacattgaaaatgcatgcatttctagctaattccccccagaactgaattccggttgaatttggaggatgcgcacatgaaacagtttatcccccttgcccccccccccccttcgtagaaaggtgtatttcttcgaaaatttgaaattagcttcagctcataagaccttgaaaatgcaataatttcttgctaacattttattttcaaagcattgaatttctggctgactttgaaggatttgtgcaatagaaataagtttatttgcccctcactaaaaatttttctactactcccttcgtcccaaaatataacaacttataactctcaagatttgtctcaaaatataacaacttattcaccaacactgtcttctcaaccaatcacaacccttcaccattcaattttttcacttacctccacttcacaaccaatcacaaccttcacacatttaattctacatattttcttaatacccgtgctcaaacctaaaaattcttatattctaagagggagagagtagcaaacaacactactaccaccgtcctaaaatattactacctaacacaccattgaataattcctaagagcaagtttaatagtgtagccaactactagctccaattcatctatagccaatctaatagctcattcatacaatagttacatactacactattaatacatggtcccacctgtcatatataaactgcgtcttagagtccgtgctacagctggcta

SEQ ID NO: 66665 - DNA, 6429 bp, Oryza sativa
  unsure (1)..(6429): unsure at all n locations
aaaaaaaagaaaaagaaaataaatcgcagagaatatttggatcgtggtgtgtgagctttaactccccccctttccccggggccaaaagggtttctcttcttctttcctctcctcctccgccccgacgcctggtaagggtttttgcctctccttccgccgccgccgctgccgcgaggagaggagggggggagagcacccagccggcgagccagccatgtcgctgcgcccgagcgagcgggtggaggtgcggcggaaccgctacaaggtggcggtggacgccgaggaggggaggcggcggcgcgaggacaacatggtggagatccgcaagagccgccgcgaggagagcctcctcaagaagcgccgcgaggggctccaggcccaggcccccgtccccgcctccgccgcaaccggcgtcgataagaaggtgagtagtatactcctcgattcccccccgctcccctcccctcccctcccctgcctccgatgacgctatcccatcgtgtcctggatcccatattttaggtaggtgttggattggattgcactttttgagagggtttttgattcgtctgcggcatatttgtttaagtttgttattatacccgcatgtctactagcgtgcgggtgagggtaggttcctgctagatgtaggcaacacttagcaccacgtttcgatgcctcgattagtcacttgatttctgattctccttctgttgacaatattacaagtactgttagttggcacggttgcgaactcctagcgtttgaaatgtttccaggtacatgcctgctagctccagtgatctagttttagttttaggacatgtagattgtggtcttaggatcaaatcttccacggattcactgcggataattagttaggtgaccaggaactgtaataatgattgatcttcctgataatttttagtgtacatcttgctgttgtttcatcttatgttttgatagaagcatacaaatgagctgatgccatattatatctttatagctattttttgtgctatcttgaaattgagggtccagtgcaactttccttatgactgaaccttgtctttagtacatggaagcacataaatcatatagtagtgtttctggtcatgtttctagagacgtcctacattgataacgatacatttatgttactgttaaactacctctggtttctgttctttgcaccacccctaaaagagaaggaaactgcttttaaaccctttttggggtttaatacgggaagttgagtatttgatatctctgttgaatgttgtagctcgaaagccttcctgctatgattggtggagtttattcggacgataacaaccttcagcttgaggccacaacacagttccgcaagttgctttctataggtacaaacctcttaaatgttttgggctgttaccttgtgaaaataatagttgaacaaaagttaattactaattacacccattacaatttttaattagagaggagccctccaattgaagaggttattcaatcaggcgttgttcctagattcgtgcagtttcttaccagagaggatttcccccagctacaggtgtgtgccaacacaatattattttcattatctggtaggttcaaataaaaatggatttattactgtggtgcttttgaattaaattttgtagttcgaagctgcgtgggcacttacaaacattgcatctggcacttcggagaatacaaaggttgtcattgatcatggggctgtaccaatatttgtgaagcttcttggttcttctagtgatgatgttcgtgagcaggtatccgatcatctcctgacttgtctttgtgctttctgtactttcttgatattattttgattgagtgcattgttggagttattaatgtttttacctcttgaaaaaaaattgaaggctgtatgggcattgggcaatgttgctggtgattcccntaagtgccgtgaccttgttcttgccaatggtgcattgctgcctctgctagcacagttgaatgagcacactaaactctctatgctaaggaatgcaacttggactttatcgaacttctgcagaggaaaaccacagccatcatttgaacaggtttggacaaagtttctttgtactctactgtagttagtagggaaagacagttccttaacatgatgtttattgggtgtcaatagactaggcctgctcttccagcactggcacggcttattcactccaatgatgaggaagttctcactgatgcgtgctgggctctttcatatttatctgatggcactaatgacaagatccaagccgtgattgaagctggtgtttgcccccgtcttgtggagcttctcctgtaagtgacaacattgcattacaattttctgccattttcctttagattcttatttgctactctcattataccctttttaatattttatactgtttacaacatgaagccatccatcaccttcagtgcttatacccgcactacgaactgttggaaatattgtaactggagatgacgcgcaaactcaggtattgtgttgattttttgcatctctatatctgacagattttgtatcaattgatatcaactactaagactcatgaatcttgagcttaatatttagaggttgtgttcatcacagttgatattaaattttaggcttgtggaaaatgtttaatatcatagttgatattaaatctagaggttgcatctaatgtggaaaatgttttgtaaaaactattgaaaaataaatgcacatatttgtcatatgtagatgcacatgtttggcaatttgacctactctttacgcccatcaattaaagatttgtctagtttgtgtcacttaaatacttgagatttgtcctctcacagtatcacttagatctatactctatactactttaaaaggtagtagtggtggtggcagtgaatctgccagcactacctctatcactaatgtatgggccctccatgttgggtgaaacccacatgctcaataaatttaaacgtcctccaaaagataatgtccatattgtttggtaagatctacagggaaggaatccataaaggggttgaaaagagccagtctacatattcttcaaatgatgagcatgcagtgtgcacagcatgatttttttttcattgcaacgcataggcaatttgctagtttgcctaaaaattcattgcctgctttgcagcaagtcatagctgctgtacttgtttcagccaaacttggcttttcttattgtattcttattattgtttgagttttaggagagctgagaatttttctgctatgctaaagctggtgttcatataatatgaaatatctactgtagatcacagcatgaaagttaattgcttttttgacatccatattgccatctcatcatctccccccaccccctttttttgtacagtgcatcattgatcatcaagccctcccttgcctcctaagtctgttgacacaaaatctcaagaaaagcatcaagaaagaggcttgctggactatttcaaatattactgctggtaacaaagatcagatacaggtatgtgtacagacttaaaaaatactgacatgctcatcattctactaagtcatgaaggatttgtgtagtgcatacttagtagttttaattgtgttccctctccaaaccataaacaccacacaatgttcatattccatgcaagctttcaggtcaacttttcctttcatgatgattacacttgttagcagactcatccttgttgtacaaagactgagaacatggtagtaacttaaagaaacccttatgtatgatttgctcgcaaagtatcaatggcagcctaatcactagtccaaatgttgctgctgggacctggggtcctagaaggggaggggatgggagcatatggatgattgattcatttacacggttgggaacttgtgcacttagctgcaatctttcgtccttaacctataatagcctatagctatagatcttgttgattgtgcatgttctgaaatgttcaacaatttgctgcattgactaccataggctgtcataaatgctggcattattggtcctctggtgaatctgctccaaacggcagagttcgatatcaagaaggaagctgcatgggccatctcaaatgctacttcaggcggtagccatgatcaaatcaagtatgtttactcaccttgcaccagttctattcagctttatgaaatgcaaatataaccgctttcatagtttcatgttaagcttcatttggatttgatattgtatggtttgttaaaataggtatctggtgagcgagggctgcatcaagccattgtgtgatcttcttatttgcccagatataagaatcgttacagtttgtttggagggtctcgagaacattcttaaagtaggagaaaccgacaagaccttggctgcaggtgatgtgaatgtcttttcccagatgattgatgaagcggaaggtttggaaaagattgagaacttgcagagccatgataacaatgagatctatgaaaaagctgtgaagattcttgaggcctactggatggatgaggaggatgatacaatgggagctaccacggtagctgctccccaaggtgctacttttgactttggccaaggcggtggtgctgctcaattcaaataaatacaggtactctcaatcctcaacatggtttgtgtttattgtgggttgtttccactcttaccataaatcctttctgttctggtatcattcacttgaggcaacaagtaatgatttcaaatttcctcgacagatttgaccagaggtggtaaattgtggccactgtgcggggtactgaattgttctggtggttcaataagctaaaggtttcaagggggccagtgttacattatttccctactggtcacggatatcatatcactacgtctgtaacagggattaaagctttgaagtctgcgtttttcatcaggctactactatgtagtgtttgcatcttttagtatggtgtgcaacattttgctacttgtatagcctgagtcgaagcttctgcaaagccgtcacaacacattcctgaacccgtctggttttgagtttcgtcaggagtgtgctgagttgcagtttgtccggacatgtaaaccattatgccttttaaattatatattgctagggtttgttcggttctactattctagtgatctctttgcatctgcgtttttagttaataccactgagtagggtttgcaaaaccgaaccactcttactgcaggggtacggtgaaaggaaaaccatggtaatctccttaaattcaaataaattttaaaaataatttgaaattttgataaatttcacggtaacctccttaaattcaaataaaatttaaaaataatttgaaattttgataaattttacatggtcgtacggtttactgcggttactgcgtgataaccgtgcttaccaccaaggagctgtaactccggtctacctgtttgtgatggatgctgcacgtatttccgaatagatgatacagcggaggctaatagaccaagtaaattaaattgaaacttgttgagatgtaatcacgaatcaagtgctttacaattcaaatcatgtttgtgctaaaaacaaatggtgtgacatacaagcaaataactcaaatcaaatgctctaatatagcaaatcacgaaagaacatgttacgcggaaaagagtagatgccttttaaacatcaccgtctctgcttaatctccaaattcttctactcgtttcaaactgcatcagcgcactgcttggtgacgcacgccgctcggcttggctggacctggcaagcggccggcgtgatctccggcgcgcttggcgctgtcgccgccgctgccggcggcggcggctggtgtgggtgcgggtgcgggccgtacggcatcggcggcggcggcatgcccgggtgtggggcgccgtggccgacgtagtagccgccgacggggtgctgcgcccgcagcttgttcgtctgcagggccgtgacgtagacgacgaagccgacgacgacggtgatgagtcccaggattcccgccgccgcgaacacccccgggcgcacccggtggcacaccgcccgcggcttcctccagtcgctgacgtggccggactccaccgcgatgccgaccatgagcatcacctccgcgagcccgaagcagatcctgcgccgcagcagcgacgatcgagcgttagttcgaaaccccaatcatggcgtcatcaatggcggtagactagtcattgacgtaccaggtgacgaagaagaggcagcaggtctgccaggtgagcctggcggggtcggaggggacgcgcgggtgtccctcggcgacggcgagccccgccgcggacgagtccggcgcggcgacggcgagcagcatgtaggcgtgctcggcgaacatggcgacggcgagcatcaggaacgccc

SEQ ID NO: 66666 - DNA, 3924 bp, Oryza sativa
gagagcgacaccagcgccaccgccgcccgcccgctcgaccgcgccgcccgcctctcctgcgccttccgcagcgacaggtcgtcgtgcgtcaccgccgccggcatcgccgcctgcatcgatgctagttactcaccccgacgagctcaaccacaccaacgaatataatcaaaaggatttcgcctgcggatcgcttcgcttttgccggcgtatataaggtgttcgacgtggtgcccggaggagaataatggtgggttgcagcggtgggaagggaaggaatccacgccgggcgagggtttccgtgcggtggaggtggagggcgacattcggattcggtttgctttcagcgaggctgtgcatgccttgctttttggcggggaaagcgatcgatcgatttgattcgctttggagaggcgagagcgccttccggtgccaacgaggcagcgaatcgagagggcttgtaaaggttgggtttggctacgagttgctgatgaatcagctcacactcccaactgatcctgcacctcaattcttcaacagaagagtgtggacatgtgatgtagccatgttatacaaagttgttcttttttcttttatcttgctttgataatgctgaattacttttccccagtagtcatttgcagattttttttaagttaatggattttcattaatccaatctttacatccacgaaggatatatataaccaaaagtatagctcacacctcaacaaagagaagaacacacaacaacaacaacaacaaagaagaagaaaaagaagaagaagaagaagcaagaaaaacctacgacctcggtacaaccctgcctctcgacatcctctcttgaaacggctagatttggcaagtggtagtcgactagtcgccgctgcccaattgtgccatagttgcgaaccttcgctgatgccatcttcatccgcttgaagtgagctgacgccatacaccaccgcttagcccaccttcattcatcatcatctagttagaattagccgaccaaacgcaagttgataggattcgcttccactttgctggattcctatgcctctgtcatccatagggccgtaaccgttgacggaatcctcctccgcctcctggactcccagcccgccaccactgcctagggaccacgtccaccggatccaccttttccctgccgaggactgaccatcaacgcttaggctgccaccatccttcgccacacccgccgttgcccaaagggacgccgctactgtagcctcaccgctacccgccgccctcctgaccacttccgttcccgacaccaacccacgtggctaggcgtgggcccgcccatcgtcgctatgcctccgctgcccacctccctgccgtctcctgtgctactgccaaatctgtggacgggaaccccagactcgacagccccacttcgtcgcaacataggatgcaaggtccttgccgagtaacaaccccgccaccgccttcctagcagccgctcgactggccagtgacctactcgggcggcggcaaggcaacggagagaggatacgagggtttagatctgtcttcgaagaggatttatatccattaaggagaatatatgtgagcaagcgcttagcaacaatttagctgcagaagccttggtagtgtgagttctgttgtatatgtagtactttcttttttctttttactaaactctcactagcaccaattatcgtgctaacttgtaagtatgtctaaattttagattttccgtaattttcatctagttaaatcaaaacaattatgtttattattcgtaagaatcctataaagatattttttaagtatatgtagtagaagtacttatacaatgtaatggaccatgctcatataattagggatagtctaggatgatgattgatgataaagcattgtattgttactcacgtggagtgtgcaaacatgcgcacgaacggaatggcagatggcgactctgcttttatagtactagagagaatggcgactctgcttttatagtaccagagagaatggcctttgcatcaaacaagaaacataacgatattggtgtagttgtactcagggttcaccaaactattttggttgaggtaaccgtggatcagttatcgtggtaactatgtgattttcgtgagatttaccatggtttcaaaagttgaaaagttttgataaccgcacggtttttatgaactctggttgtaccctttgtaatgttgctctttcatccaacgcctactaaaaccgccgcctagagtaaaagaaaaaagaaacaaaaatgagatcggcgattcgtcggatacggttgtatcccatacaaaatcgaaatgatctgttcgtatcaatggtgtccattcaaaatggaccgctataggaatcacgcttcaaaatccagcagcaacagctgtcggcggttttcgctgacgagtggactgccagcataaatctcgcagataatttacaggccccactttttcggttatacttatacttatcggccaaaatttaaattttcaaacttaaatttgaagctgatttctaagtttttatcatcgaagtttatttttcaccatttacttttaggtcgctaaggacacacatataaaagttttatttaaaaattacttatcatttgcaaatatatcatttggcttattttatttaaaagttacttctcgtttgcaaatatgtcatttggcttattcaatggttacctagaccgtacaaactgaaaaggcctcgtcaggctaacggccctaatccaaacccaaaacaactacttgggctgagaggagatgattgggccattttgttccaatactcacgtacaacatcatcttgctacacaagctcatgttcccgataaaaaaaaagggattttttttttgcaaaaaaacataaataaaacgtattaccttaaacaagagagtacccagatcgacgaggactgaactataattaacacatcgttcgagaaagactttgaacaagtcgaaaaatccttatcgcccatcactttcttccattccttttgcaatttgctacgtgaaggcgagttgctagctgcaagtgatcatcctgcctctgacccagacccatgctactactcgttccaagtcgattgatgtttgattagcttggagaggacgtgcacatctgcttcagcagtaggtcgcaaccatttctaatcctcatcatcaccaacaaccagcatctcattcacaatttattaaacctcccaaaattaatacacataaacaacattgcaaaataaaacgaattaatctcgcagaaaaaaaaatgcagcaagaagaagccaacaacaactagtagtagtagatagtactatctcttatatttgagaagaaatattgcagagggaaaaatgttaagctgagtgatttatatatcgattgaggacaaaccgatcatctaaaggggtttacatttgttcccttgtcgcttgcagattagcagataattgtatctgatgttcaacagccgaccactaaacatgctgtcctaattgccattaagccgacaggcttcgaaatcatcgaccgatcgtctcgctcaatccaaatatgtggccttttttggacttgcaatccaaggattactttgatagtttagttagggtgtctcgatatctctcggagaaaaagcgaaaggaggcctacaactttatttatgcttgtagagaaaaatgtgacctgaactcacgccacgcgcgtctgtcatcgttccaggacatacatgtggatcagggctagaagaaatcctaacagttccatctcaatttgcttctagttttttttttctcatttacataaaagacacacacaactatacttacacatgctttaataaagttgttgatgtatcaaaatgaacttgtgttatgtgtgaaatcaagatcaa

SEQ ID NO: 66667 - DNA, 1484 bp, Oryza sativa
  unsure (1)..(1484): unsure at all n locations
agtgaagcccacgagctgcaccaatgcaggcatcaactcgttgcttccatgtcagaggtgggaggtcacttccataaagatggcttcgcaatgtccccttggccatgtattcgtagactagaatcatttccttctgctcttcacagtagccaatcattgcaacaaggtgccggtgcctaagcttggagagcatctcaatttctgtttcaaattctttcaagccctggccacataatggatttgcacgcttgattgccactgtagtaccctcatcgacctcacccttgtaaaccttgccaaaaccaccagtaccaataagcaaagcctcatcaaagttctttgtagcagccctaatctctgaaatgctgaatcttctgcccattctatgaccaatggaagatgaattacgtgtcaagggtgatttaccggctgcacgggcatctgtggtgcttttcatagcctcatggaggaccagtgggtgccaaccgggaggggcctccttctcatcagcttttcgtttccttcttacatagcaccatgcaaatagaaccacacttgtcagtgtcacaaaagaagctgagccaattccgacttcttcccataaaattttcctatttctatccttggaaatacccctttggttacccatgtcaatatggccaagaacataagcgaggttgccattcctgctgagcttgaatatctccaaaccattcagaagtggatcggtgcctgaagcactggtcaaggagtcagggcctagctgaagccagagtgagtctacctgctgtggcaagttgtcaaaatagtcttcatgatatgccttattaataccccctgccctgacatacacatcatagtcctcagcagctgtcttgttgttgatgtagatcttgaagaccctctggttgggcttgtcatagaaaagctcacagaaatgaaggcggaccaagtaatcaaagttggggtggacatagaatcgccatgaaacattgaaccgcttgtccacaaccatgttgttgctcatgattcttgcagtctcgtatacatcaatgggagaaattgaggagtcattgtttgagagataacttacacttgaagtgttggacacaatctgagcagcattcgcagaaaacatgaatgcttcatcagtgtaccatggtctgtgcagatactgatcgctggaagaattaagtgcatgccctccaacattcaaccggtacattgtctctaggcctctgttgcttaaaccaagaggaagctgcccatttccagcgctgccaactttgtttactgtgtcattgaacaggttatctggagtnnnnnnnnnnnnnnnnnnnnnnnnaaaggcaaatgacccagggcttggatcaaactcaacctgcagaccacgagaaccaactaaaagaaaatactccttgacaactgcattgatggctgaattgctcacagtgctcctcccaacaatctcctctgacacgttg

SEQ ID NO: 66668 - DNA, 2497 bp, Oryza sativa
caacctgcagaccacgagaaccaactaaaagaaaatactccttgacaactgcattgatggctgaattgctcacagtgctcctccaaacaatctcctctgacacgttgaatttcgagaccagcttgaaatcatttgcagtgacatcaaacaatgaatcattcccactgaaattcccgaatgtgtaagggaagaaatgcagcctgaggcagtagttccccggcagcacgctgaagttataccaagatgccgtgctaaagaaacgcgcggaatggtacaccagtccgaagatttcattgccattgctgctcccagcctgcgacgcagctattccagggctgcttaaggtaaaattcagcccgggggccatgtcgccgatccatctccggccgccagcatccacagtcgcgtttgaaccacagctgagaagcaaatccctcccatgaactcccaacaggtgcaaattagcaagcacgatgcttgcaactgccagcgcaagtagcctcatctgtaacaatcaccactccactgccagattttagctcttgcaggtctcatttagactagagcaagcatctgcaccctagaaatcaaacaaacggaaatcaggattcaaccgctagtgctaccaaaaagtaccgagatcttttgtggctagatccatattatatataaacaccgaatcaaacaaacagaatgaactgtttctgctcaacgattcagtctatgcctagaacacatagcacgaccacgaaccattccaaacagcaatcgagcatctcgaccaaccgacgagagagagagggggagattcgcattaccagcgaacgccgaggaagaagaccgcgcccgccattgcgggagatcagtcccgcccctccgctaccgtcacacgccgcgggagggagaacaccggaggggaagcacagctgcacaggaggcggagccgcgcgccggccaaacagagcggaggagcagccgcccgcggccgccgtctcaagaagcagcagatcggcgcgagttgctggctggcggcggcggcggcttggagaggcggacgcggtagcagcaggcagtggcggcgtggccgcgcgcgggcgcaggcggcgatgggcggctggggtgaggagcaagagaggtgcagtggagtactgcagtgcagcaagcaacagtgttggatgtggatctgcggttcgtgggctcttcttttggtcaatcgaaaggatggttattagatcagtggagcatgtgtgtccatgtagacaaaaataaaattatagaccatctcaaaaagatattgttataaagttatgtagaaactagatggtgctaatttaattggaatgctatgtagcactaggtattcgggaattagaattgtactatcattaagaacgataatatatgttttgttttgttgtttattatgcttttaaatttagtagactgtctaagtaaatgtgagttaaaatgaataatgtgtacttattcggccacattgacatataaatccggccatcctctatttttattatagagtcattcctccgttcatcttttaaaagagaagatggcataaaagttagtacaaaagaagccaccgttaaagctctagtcgattaggatattattacccattcgttcaggttataaaactttttagcattgtttatattcatatagatattaatgaatctaggcatacatgtatatatctagattcattaccatatatatgaatgtgtgcaatgctagaaagtcttataatataaaacggaggaagtagaatataagaatttccattaatacatgtaggcaaccaattttgacaatagtggtaaaaactaaaccacctctctattttagcagtataaaagtgtaacaaaaggttcaaataaaatatttctttctcaaacgaagatattaatgaagtgcctgcctccaaagaaggctcgacgatagtgagttagggccagtttagttctcaaaaattttccccttcacctatcacatcgaatctttggacatatgcatggagcattaaatgtggacaaaaagaaaaaccaattgcacagtttagctataaatcgcgagacgaatcttttgagactaattaggccatgattagccataagtgctacagtaacccacatgtgctaatgacggcttaagtaggctcaaaagattcgtctcgcggtttccaggcgagttctgaaattagttttttcattcgtgtccgaaaaccccttccgacatccggtcaaacgtctgatgtgacacccaaaaatttccttttccccaactaaacacagccttaggagttaggatgcctactgtagttgagtggagtagtagtattgatgtagattttggttttttttattcactctgctggatacttgatgtcgacttgttaacaacactataatggtaacaacatgcaagctttcattgtgatgagggcgataagcaattgcattagctagagggctgcaggaat

SEQ ID NO: 66669 - DNA, 5310 bp, Oryza sativa
cttctgccttggagtacaatttgcagtactgatatactagcagtacaaatttctgtgtaattttcactagtactagttttgacatctgaagtaaaatcaacatgtctactttttttttcttgtaaaatcaatgaagaatctttgagtgaatgcaggatgaggatgaactgatatatataatacaagtactaatttctgtgtaattttcactagtttttaaatctgaagtaaaatcaacatgtctctttttttttgtaaaatccaagacaaaatggaaaatctttgagtgaatgcaggatgaggacgaggacacacgaccatgcatgcgcacaagcacagctgctgaacatgttgcaggaggctggctgtactttgctcttcttttcctgcctctcaactcttttttttttcttcttgttataatggaatgttttttttttcacagtgtactttcctttcttctcttggattcagggcagcgaggttggaatggaaaagaatctctagagagagagagagaatgaaagagagagagagaggtggtgaccgaaagccaccacttggtgtaggccatgcacgaccaaattaatttacgcacgttgaaacggcagacagatgaaaaggacgccgcattatcctgtgattatttattcgtgattttctgctttatattaagagggaaatgggattactgttatgcagtactcccatcgtcccaaaaatataaaaatatagtatcatcggaagagatatttaatgtttgttcagattcgtagtttttatattttcggatggaaaatttataccacctaatagaatataaaaataaaaaacaatgcattatccctcaattatttctagtgcctgatatgagagaggttgatccaaacaaaaggcaataatatagtgaattatttacgcaaaattaagaggacggtgcatgatcagagatggattggaactgcacgggcatacagtacctggagtttatgccaaaaaaatgtatagtagagtattttattttattattacctgtagtgagagaaactatagactcattagtaggaaaacattactttattaaccgagaggtctgtattttattccacctacatttgtttaatctggtgccaggctgtccggtgtggataaggacggctgtcttctcaaccgggtaaagttaccgccccggtaaacgtgaaagttacgcactaatcgcgctcgctaatggctggtcaagcccccatcgattagcttccaagtggccaattccctttttttttttttactgaacagtcacacgtttgaccccgactgcggaaaaagttaccgcaccagcgtttgaccctccggcttttctgaaacttttttttttttggggcgggggggttgagctagtgcagttaggtgatgtcagcaatgaaccgatgagataaaaaggagaagagaaagaaaagagaaaagtttgatctgttattattattactacgtttacatccgtatacccggatcgctcgtgccaacgtacgcaaaaagaaagtcagagatcgtacttcaggtaacggacaaaactcctgggaaacaaactgtacgttgtgaatgaatgtgacttttattactagtaggatatcaatgagcatttgcctcaatttttgtgaagctttcttccaaaattcgttcagcaaccaacaccattcacatatatagccagaaatacttaggctgtgtttagtttcccctcgttctcaacttttcatcacataaaaaactttcctacacatataaactttcaactttctttaaacttccaacttttttcaggaactaaacacacccttagagtctataagttttgaaggaattttcacacaaaaaaatagaaaaaaaaggggaataaacccacattccttttacttttcctaaacccacattcctataaaccgaaagacactcataagaaaaaaaaatccttaaaaatttaaattctttaggttttcttcaaaccaaacaaacccttaaatcacacaacgaaatgcctggctaagagaacaggacacgataacacgaatggatcaaagaactatcatggatgatggaatatggttgtagcaaggcgagaagcaagcacgacgagatggcccaagaagaagaatggtacgtactcctccgctggcgtggagtagtagtaggcgagtataacgctagctgttgcatggaaatgtgcagatctagttgccacatccgggaggccgcctagcctagcttagcccggccggggaggccccacccaaacaaacagggtggcacattgccccctgtagcctgcactgcaacaaacacacatcaacaacaacaccacacacactcgcacaacactctctcacctgcaacaacaaagaagaaaagaaaagctttctgtttctgttccatagatgcacacaccacacagtagcagtatataaatgtgtacacgtatagctgtgtatatctggcaatgccagggagtagctttacgattcggttgaggctcatcagctgcagctgcagctgctgttgctgctggcagagtgacttgattccgtgctgccgtgctacgtatactactgtatccgtggtagatatagaccatgtttagtgaatctacatgaagtattcaatatgagctaataaataaataattatacagattgcgactaatttgcgagatgaatatttttaacctagttgctccatgattcgataatgttgtgctacagtaaacatttgctaatgacagattaattatgtttaataaatttgtatcattgtatcgttgtttactgatagattttataattcgttttttattagtgtctgaacatctcatatgacaccttatataatacccgatatgacacaccaaaacttcaaaactttatgcctcttgatctaaacaccccgatagatagatagctcgatactattactactagaaagggaggagaatcatatgctacaagagggatgcacgaatacactgctaccataataagggtactactacgactccagcagcatgtgatgcgtcattatggagattcaaggcgcctgacattgcatactagcgcacttaataactgtgcgaatgggggtgaacccttgtacgtcaccgcctcaaaagctagagaattagtagtagatcaagtattaacatgcgtagaagtagaacacatcgagttatgatgcggatacacactacagtggcatctaccagtcatcacagtgtttgttggtgtgacctaaagctttggttaataaccagaaaccgcagaatgtcgctacacatgcagcaaccattgatcgatcgcattgatcagtagggccgtgccggcaggaggcaagggcactagtagatctatccatccatctatccctatagctgcgcgaagaacgcgcagcggtatttattagtgccgaaaattaggtgcctaatttattaatcacttttttcactaacataagcacggcattaggctgcgattaattaaaaccctttttatttatttttaacctcctgcttctccgtgcagacgtgttgatggatgggtgctatactactacttctaggactaggagtactagtagcttggtaggcaaaggcaaaggaggagcttgcagcttgcagctgcagcagcaggaggaggaggggggatactgtactagggcaaatggagatgtggatgcatgagaaaacctactaccacaagtggaaagaaggggaaggggggaaacgggaggggagggggggaattgttccatcacatgatgctcacatgctgcatgcccgcatggtggtggtgtggtggtggcgctagctaagctaaccaaccaaccaacccgcggtccttccctcttctcagactcactcacccacggcattttctcgctctcctctcggctaatagcaggtacaatataagattattagctagctataaatatattttaatgagataaaagatgagagagaagcagcgagcccagctgcaacgcggattccaagacgcaatatgtgtatgatatatgtgaccatattaataatatattaaataactattatataaattagatattaaattagctataactaaattggagctagtaatgagttataatattaaagttgctctaataagagcttggtggtgttgtttgccttgatgggtggaggtggtggtggcggtgacagcggtgcgggggagctgggtggtgggggcccacgtcgctccaccctcttctcttctcgcctcactcctactgttcctgatagatccaccaaccgagcttttgcctccttttcttccgttgggggtggcccccctccgccatgttttggacgcttcctcctcctcccttccttgcctgtactgtatacacaccctgtcttttcttttctaagattgaaaattgtgtattcactaaaaaaaatatttttgtgatcacccatgctcgcttcagttgagatttgattgaatgacaaataaattgaaacagtatgattatttagcaagggagggagtcatagttggtaatatgacaaaaggagtcatagttggtaatatagcgcagcagttatattggtttttataagtgatatactttgtggtaaacaaaagatcaagtgcatccgtgcacagcagtataatagcaccgtccaataatatagtagtagtatagtaagatgccaaggaatgggatggtgaaacaccgaacagtagcagacaaacgagcaagggtatcaataagaaatgtttgactaacagctcggtaaaacagtgctggttttcagcgtgcctgtgcaccagtgcatatgtcgagtgagcgaggccatgaaagagcaggatttgacacgagttcgggctctgtagggggggcagacaaccaaagtggaagcgatccaaattttcgcttagatcgcggcgaagaagcaagaaaaccggtggcatcctttaactccaagattgttgtaggtgcgcgcgccggtggcggtggcaccggtggttccacgttaatccaccccatctatctatctatctatccatccattcatccatcatccccaattccctctcctcgcactcccccatgtgaccatcgccagtggcaggtcgcgcttaattattcgtggccccatccttcgagctccagggtcccccccttccctccccttttccctctcttctccaaccctctctttgtctcacgatatcgatagcgtctcgcacgcagccgcggttttcgccacacaaaccaaaagccccaggtgcaacg

SEQ ID NO: 66670 - DNA, 1259 bp, Oryza sativa
ttgggtggagtatgggtaggaagggtaccttttgtgctggccgctatcgacttgagaagactttataaattggggagatcataagaaagattttttaggatcgtccgcagatacgccttagatcttcaaagatcacagcgaagtattataatgcatcaactgtagagaaagatagcaggaaaaaatattagtagtggtatgatcatagataggtagcccctgatctaggggcaagattccatgtttggtcagtaccattaagcaagccaaccaaaaccatcaatattacacgtttttgaccgtttgttcgtttctgtacgatatccaataactgcacagaataagtactacaggattgagaacatggcggcacaatttgtggtaaaataccaggatagcctaaaatacacttttgcccataccttggtatcttcctggagagtggacacaccatggagcaaatggaacttaggagaggcacctgggcttaacagtgccacgtctccaaccccacagatctaccaaggctactactactactactactaacatcatgctctagctggtacatgcttctactttaagttgcctttaggtagttacttatagtgccacctaagtttgtcaacctaagtgcagacacttttaaagcttgacagttatcataacttcagtttaaacgcaaagcaatgtgacagaaagaaccattggttcaggctctgcgatttcgtgggagagcatatgcatgggcaagtaccgctggtcactgaagttttcaccacctgtgtcagttgatcagcttggagtgaattttttctcaggtttttttacatgtcatgtgccgttggtacctggccctgtcgttgctgtcggtgagggctcgaaatctgctccaaacctgcagcagcagatgcgctagaaagctactactaccactgaattcttactcacagttaagtccactgcaggttcagttcttcggtccctttgaaggtggcggaggcattgctcccagcatgggcgcttcgtttgatgttcggaaaagtgctcgacctggcaaagaaatgctgagtaacaggtttctgaatatggcaagttggagtatatctgtacgaggcacacattaccaaatgtaaagtaattgcgtaatggaacatggaatatcatagccacctttttggcccatagcatgggcgtcagactcctaggatgctctttctccaccacagagaggccactggcgttggcgtcacttgcta

SEQ ID NO: 66671 - DNA, 742 bp, Oryza sativa
attcctgcagcccggtatggtgttttgctgagagcttgagctctcatcttttttgcagacattgaaagcgagtgagaggatatcatttccttggtttacattcaggcatcttgtctgctgcatcttacttggtgacaaatgcctccgtctgtaccatataagaaaaaaggacataggaggtcaggataagcaccatttgatgcatctgttacaccagaggtcaaataaaagtagcatacgaaccgaacaagcagaaattatcatgaaataagaaaaatatggtatatctaaactctacatatctagaggtatggaaaaaatgaaagaggccataaaaattggctaaatcattagtggctcaaagatgcagatcagtacatcagacttattcattatatgcatgggagacccaggagtgagaagggtaagacagggtgctaacgagaactcaccagtcaccacttgatcaaattcatcagttctttctatgcaaatatattattgtttgtggttgtgccccccaatctgagccctcactgagcacttcatacagaactgcaaagcaccagccaaatcattgccaactagaacaacttcatctacaatcatattcagttcaacatcttctgccttttcatcttttatcaggtcttcaatgttagtttcctctttgatcactgctaacttgtcatgtccttttgctagatgacctgaaggaaaccgttactgtgttcatccataa

SEQ ID NO: 66672 - DNA, 1682 bp, Oryza sativa
ctgatgggtattcaaatgtttccaataaaattggaccgatgagtccattgcgtaaaggttcccccatttcccattggtagctttcccactaaggtcccgatcaatcggagaagatccaacactaaactaccgccacgcatcaccaaacacaaccgatcagaagttcggaacctggataaaccctaatccttgctgagcactcgaggtatggaactcctagtcacaaactgaatcggaatggtagacggaagaggacctcgcgttacctaggggagggaagaggcaatgcgtctccgaacgccgaggaagaggacgcgcgaacccgcagaaggagagatcgtcggcgccgccggccaccggccgcggcggcgccgccccggacgagcgagggaggaaggaagtgaggcggagagcacgacggcgagggcaattttgtaataagcgcattttgggcttttactaggtaagcattagctgtgggcctttagcgaggaggagagctacggcccaatatgctcaagtcgacacgtggtccacggtggtgttgggcttccctgcctttgaatggtctccaagcccactacgaatatttactttatgcctttttctttttatcttttggatggaaaaaaaatattgtccatcccactagctcttttttggaaaaacaaatgtcatctgcaaggtttgagactttcagcctttcaggggacaagctataatttatggcaccacattttcaaaagaaaaaaagcagtcaaattattcgtttttacactgtaaattatctacatttgcacactaattattattatgtaaatttcaaaagtatatcataaattttctaataagctatataagtgaattatgtttaaaagtaaagtgataggagaggtataaatatatatactgtacatagagacaacaatcacataaggaaaacggttattggaatcaataaaaaaaatgcgtgtcatattttagtaagattgtttttcaaatgtacttaccttcttcaggttagagagtccaaattcccaattgtgattaggactttgttcattaattaattcatataaaaatcccaattacatttagtcatttacagatgtcgttgcctgaatttattgtgatgacaaatagtcatgccgaacaatcatgatgaaggacaaggtttgtgggttatcttaatagaaagaacaaggttgcacgcactaagcgtaattatattgttcaatcaacacggggatgacaattccatgcaaggcaagcaatctaattaagtatcagtactcgagcatgcatgtagtttatagtatactcctagatgattaggtttgaatagttttctcacgtacgcgtatgtacgtgcatgaaggcatctcatccatgaaataattctattttattcgtaagcaagcagaaatggtcagcacagtgattttcttaacacgattttgctgagttggctggcaatttggttcaccgatccgctgataaacagctcgtcggaatgcgcacgtgtgacgttgtctgcagggaaagtttgacaaaattatggggtgatgccaatttacagatttgggtcagattcagcgaattccagctcacgtggtttcagcatgtgcttaaatgattaatttacactcgtaatcttatctgaaatgtcatgaaaggagggg

SEQ ID NO: 66673 - DNA, 8425 bp, Oryza sativa
  unsure (1)..(8425): unsure at all n locations
attcctgcagccccatcatactcaaactgtcaaacttatgcaaccttcagtagcgtggagtagggggcagtaacagtgtgatgttcagatgagatggcaagttaggaaatgttcttatgattaacaccaacttagcatataattatatatcatgctgccgccctgcaggtagcgggctgctctgcagacctcactgctttcgtcaaaatcacacactgattagatgtgagtagatatatatctactgcaagacggctatgatcttccctggtaaattaatttgaccaggttaatattttaaaggaggtgaccagagtgaaacctgcagagccttggcttacgtgtttgatagccttaattttatcccatactgccaaagatgacattagtttgttcaggtgtatcaatcacagtatgttactcagaccaactcccatgtacttaaaaattttctgaatttttgacttgatgctcagttagatctccgtggctcattctgcctctggtgattttaattgatgatctccttccctgaaaaggaccggcatgatgacttgtaatgagaggactggacaaaactggccactgaactgcttatcaggcgatcagaaaattcagaagttgtcaaagtcatcaccaagaccaagtacggagtggatggtgttgtgttctttctttcttcttctccccatgttcttaattttgatttcatcacgagaacagtccattccatccgtgtgccttgttacctgacgatgagatggcgaaagcagttcgcagagtagactttgagaagttcgtgttcaaactttcagtgagacatattgcctgaattcagtgacagacactgtgcaagttccttcgaggcaggccagtggtaacaagagacgtacaacaaagcacttggactagatcactcacttatcagttatcactgttaacctcttccttttgccgaaaatagttagcagccagcaagtttttcttcacaaatcttcagagaaaactagcagagaactactgaggaaagctgcagcctttgtcacaggtttgccgtcaggtcaggagttgctcggtagtagtgaacaatatgaaaatgcaaggcataaataatactgctaataaattcaggagcagccatctgttcctgacgtaattagcaaaacttttcttcaggtaggcgctgctgaaatggagatatgcgcatcatgaacatcctgctgctgatcaacaggcgcgacctgttgctacgcatgctgggtgatgccattagacagtgtttgttcggcggatttggactagtaataaaccagggttaagttcagggatcaaggttatagctttggacgcgagtcgctgatttgatgttccattaattactagcggctgtgttgaagtacttgcgtatcatttcttgggcggttttggcccatggatttcgcacggatcgtagtacgagaggccaagccgaccacgcgaatacagcctaatttttcgtcgtcggctccaacgacagcagattcactgtgtggcggtgttgccgtcgcagtgacaccgccggcgatgacgctcagtagatacatgatggaacgataggacactcgtatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatccatgattacatacctaactaattatatgtatggatactatatacctagaatcaaaatctaacaaaaacaagttcaaatcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatataatccctccgtctcattttaaacgtagccatgagttttcttgtcctactttaatcgtctgtcttatttaaatctttttttatgattaatgtttaattgttattagatgataaaatacgaatagtactctacgcatgacttatgtatttgttattttttaaaaaaatttaataagatggacgatcaagattaaacacgaaaactcattattaccctaataatgggacggatggagtatacgggaagggatatctgacggctgaacggatcggatgtgatatgtgacttcaaattctcatatgatttggctgttatatctaggttaatgtttgactgatactccctccgtcccataatataagggattttgagtttttgcttacacggtttgaccactcgtcttattcaaaaaattttagaattattatttgctttttttgacttactttattatccaaaatattttacgcataacttttcgttttttatatttgcataaatttttttgaataaaataagtggtcaaatactacgatcaaaaacttaaaatcctttatattatgggacggagggattactagatttggacatttggaggtacatcaggataactacaacagaataatgttcggggagaaaaaacatcacctagtgcacatgcccttgtacgggaaaaacatcttttttccttttaaaaaaatatagattataatttcacataggggtatcatttttatatagataaatgagccaggataaattaagtccacacttggaattaaaaaaaaattcaaatctagtctagatatagttagatctctaattaaattcaaggagctatagattcggatttacagttggtaaatgtccaactaactactactacatccgtcttaaaatatagctacattacacttgatgtgatatatcctagtccaacgaatctggacagccacttgtctaaatttattgaactatgatgtgtctcatctagtttcaaattgctatatttttagacggagagagttgtagatattagttttttttatcatataataactacgtatcctcgtaatccggatgagaatatgtttgatggagcaagagactaatggagtatacttgcaattactataagctccacaattcaaacataccatattcataacccatccattttagatattacatttttttatggcatcaaacatggcagatgcttaaaacaaactggcgcatatgccttgagcttaaaattccaactccgtatagtatcaagtacagcaatttctattgggtggcgtgcgtcatccacagtagccgtcgttgcgtcagttcttttcatggcacaataaaagaaaaacatatgtggtctttgcctacctacatagatctcccctattaatactccatcgtgtccgtgtcctagaaaaacttctgcacacgcagccgacgcccttctctatctagctaaatctccattttaattcctctctctctctctctttgtgtctttctcaagggagaattaaccatcaaatcaatatatacaatgagcttgatcagcatgatggaggcgaacctgccgccggggttccggttccaccccagggacgaggagctcgtcgtggactacctctaccacaagctctccggcggcggcgagttctacggcggcgtggccatggtcgacgtcgacctcaacaagtgcgagccgtgggagcttccaggtacggatcagatcatctcgtgcaaaacttcagcttaattttctttcggaaaggtgatggcagatgcgtatattgattagctccgagcagcacgaactgtgtgtgattaattagctttgcaccctctgcaccgatccaatggtacatgcataattgcatagcagtcgcataacctgaagaaagaactgtgtgattatttaacatctgcagcttgcacccatccatctgcaatatctgattttcttttttcagaaaggctatacagaacatccgcagcctgcacaattcagaaaatgtttttttttaaaaaaaggatattcagaacatatgcagctttgacgaattcaggccaaaaaaaaagactcagaaaatgaaggaaagaaaaaaaaaagagaaaaatggcgtcgcccggactcgaaccggagaccttcagtgtgttagactgacgtgataaccaactacaccacgacacctttgtgttaccgaaatttagactaaattatatatttttgagaaatcatcttgcacgaattactatgagcaccagctgcatctctgtagatctcgtttcgattttcctttaattttgaaacaagttccatttgcacatttcttcacgtcactagttgcacttgacctatctgaactatatggttttttttacttgccatgaatcgttagcatatttcttgcacaatctgatcatcttccctgcacgcgcacgcgcacgcgccgccggtcgccggcgacgagaagacgccgcgcgggtgggcgccacggagtggtannnnnnnnnnnnnnnnnnnnncaagtacgccacggggcagcgcaccaaccgcgccacccgctccggctactggaaggccaccggcaaggaccgcgccatcgtcacccgccgccgcgccgccgccggagaggccgtcgccggcggcgaggtggtcgggatgaggaagacgctggtgttctaccaagggagagccccccggggcagcaagacggagtgggtcatgcacgagttccgcgtggacggacatgccgttgccgaccacccctcctcgtccacctcctcctcctcatctaatcttctcaaggtactacatgccagcatttgttttgcgtgatctcagcagtaattattagtgattaatctatcatcacgcaggtaaaagagtgaaaaaagagagagagagaaagatgagaagtactcactctattccaaaatataagacacaactacccttaactcaaagatcaagaaataattaatatatcattatcgttgtcataaatcactctaattaatacaagagatgcaaccaatagaattaaagatcttgtgagtataggatttaaaataataataacttaggggagagaatgtgataattaattacatgcgtgcgtgcacgtcttatattatgaaactactttaaaaaatagatgtgcctatattttagaatggatggagtaaataattactccctctagttagaaatattttgtgtttggggcgagatttatttagttgaaattttgaattctgataatcagttctcaagcaaaataagtttatgaaatctaataaattcataccacagtacctccgtattaaaatataagtattttttactttgaatctggatagataaaaaatgcttatattctaattcagaggtagctgtattccttttgacacatctacacacgccaatgttttcttttaaaactagtattttagaaattacgaatggttaaaatttcaaaagttgattagatattgtcttatgcatcaaatatttatgattctaatgcctagattaattacgtactgagaaaatacttatataaagtgcgtactaggaagcttcgtcagtgttagaagagttctactcttgtaaatgcccacgattgcacgtctcttggtaagtgacagccagaattaggatagtagtagcaacatgtttctttcacagttttgttttctttggctctacagactttagccgaatgctgtttttttttcctttttctgaacattctgatgtgataaactagttatgcaacttgccaatgattgtttctacttgacctagtcccatccaatcattcccaaaccttgtacgtatcaccaatgcttgccactcgaggtttgttcgattggctacatcgctgtgcatcatcagcaacactaaattacaagcctagatatgtaggggaacaatttgaaaaggatttgactgcttttatagcacagattctttattccaagttgttagttgttctgttaaatgatgatttaaggccctatttagatgggactaaaacttttaagtccctatcacatcggatgtttgaaaattaattataaatattaaacgtagactattaataaaacccatccataatcttggactaatttgtgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctgaatctaaataccacctaagcatattcagattattgaggtttccacaatatcaagcatcgtacgaactgtatatatatctatctatctttacaagataatataaacttcatcccaacctgaggtcaccaaatcttattttaaacacgaatggtaagttaagtacaacttaatctactttgtctgaatatttcttttgacaaaaaaaaaatgcaggaggactgggtgctgtgcagggtgttctacaagagcagaacggctacaccaagggcagtagtctccggtgaggctgccgtgtcactgtccggtgagctcagcttgccgccgccgctgccgccgcccgttgcccccgccgtcgtcgacggctacaccggcggcggctattacgagcaagacagctcagctgggtaccaccaccaccaccaccaccggccgccgccgtcggcagcattgccgttcaaggacctgacggacttcagggacctgctgagcaacatggcacaaggcggcggcggcggcgctgccgccgccaagacggaggggttccatcttggctggagcgaggaggagtcctccggctacgtgcagcagagcgccatggcgtcgcaggcgtggaacccgttctagcttagctagagctagagctagagctatatatagctgatataagctgatccagttctgaacttttttcagaaatggtgatgatatacaaaggcaaagtttgtaggtgtagcttagacaatgtaaatgtaatttatcttcgttgtttcagtaattttcctttgttaattagcgtggttgaatcctagttgtgctactgctagttaacagcgtagtgacaaacaatttgtaaatgtggagatggtttggtttacagtaacttttgagatgtacaaaggattgctccattcagttcattggttgctaaagaagagaaatagattcgatcgttactcatcttccaatgatcctcttagcaaaagtggtgcaattagatatctgttttggatgctttgttttgttcaacatttgctttattatgggctgcaagttttattagcatgcattgtgatggtccagtgaagtccaattatggcccataatcaaggcaggcccatcacagcctgcctagatgaatatctgtctgaagtctgaacatatgatcctcttgtgatttttcatcagaagttgatgtactgcacttgttggattcctccccattacggcatcacggacatctgcagtggttgatgacacttgatggtaaggcagttttgtaccggagtgaccagactctgatatgtcaagaacagacataatgtttctatgcctcaccgaagtactatagtaatcaacatggttcaaccatgcattcttaaatgttaacaaccgatacctgcaccaaatgtttataattgagcgttatgcttctcatcgaagggaaaataaagggagaagagcaggagaggatgattcacaaacatacctgatactagttgctaatagattacagttcactacttttcagagacaaaaatgctctagttgaaatgattgccacagggtgtggccttgctagctgttgcccttgtcagagaacattcttcatggaagtatcatagtgttgtgtctttaggtagatggattaataaaatagattgataaatgcagaaagctttggtaaagtgattagcagcaagctaggccatgttccaaaatccaaacggcctcaaaaataaaagcaatggtttgcttcctctgggcggccagatgaagagggacccaagtgttagagcatcttttgctcatagccctcacatggattgccccccatgccggagatcacagaggattaaaggaaacatttgtgactgtttaatataatagtgatcatactaagcactggtgtcccaactagtacaaatgttgcaagcttctttcagagacctgtcccaattaatccagcatctggtgttaagtcaccacacttcttttcagggagtctgattgatccaacatcttgtgttatgtaactcttgggatgctaaacctaaaaaaatcaaat

SEQ ID NO: 66674 - DNA, 2016 bp, Oryza sativa
gcagaagtacacattagcctactttcttttggtcaggaatgagtacttctctagggattcaaggaagcattcagatgggaagaaccaacttcttgactgctgtgatgattcagaattagatttggatgtgctgtatgctgatttggatagtaaagaactggagcttaagttgcagaaacctgttgtcaagactcaatcaaaaggtgactcaagtgccagtggatcaaatgattgcttctttcctggccttcacgacgacctggctcaggactgccttgcttgggcgagcagatcagactacccatcgctttcttgtttgaataagaagttcaatttgttaatcaacagcgggtatctgtacagactgagaagaaaatatggcattgttgaacactgggtgtatctagcgtgtagcttgatgccctgggaagcatttgatccttcacgcaagcgatggatgaggctcccaagaatgccatgcgacgagtgcttctcttgtgcagacaaggaatcgcttgccgtcgggacacaactgcttgtgtttggccgtgaatatacaggtcttgctatttggatgtacaatttactggcccgtggttggtcccgatgcactccaatgaacctgcctcgctgcctctttgcctcaggaagctttggtgagattgctattgttgctggtgggtgtgataagaatggacaggtgctgtaatctgccgagctgtacaattcagagattggtcattgggagactttgccagacatgaacttgccgagcaggctctcatctggtttcttcatgcatggaaagttttatgtcattgggggtgtgtcaagtcagagggattctttgacttgtggagaggaatacaatcttgaatcaaggacatggagaagaatacatgatatgtaccctggagggactagtgcctctcaatctcctcccctagttgctgttgtgaataatcagctttatgcagctgatcaggcaacaaatgtggtaaagaagtacgacaaaggaaataacacctggaacatagtgaagccattgccagtcagagctgactcttccaatggttggggcctagctttcaaggcatgtggtgatagattgcttgttattggtggccatagagtaccccgtggtgaagtaatattgctgcattcttggtgccctgaagatgggaatggtggtgctgactgggaagtgctctcggtgaaggagcgtgctggtgtattcgtttataactgcgcaataatggggtgctgaattacatttctttcggtataatccgtatatgcctcttgtttagcaacccacccatttcttgctgctgcttagctaccccctataatgacctgtaattcagaaaaatgacaccccccttttcgtggagctctcaatgaaatgtttgggagagagcatagagcattcagttcagtttacctggaacttcttttaactcgttcaaaatttgttcttcttgtccagtatgaaatttatgcagtattctttattcatcatccttgctggaaagtgtgcctgttttattgtcctgagttcaatcacatttctctctttcctgattcatgtctgcaccatgcaatatctgttgttctgagttcaatcccatttctaccatcttaccctgattcatgtctgcactgtgcaaatgtcggtggtttgatgaacccaccttataattgtgcactgtcagatgtttccaatgctcagctgtccttgttattagaaatttcagagtggtacaattggcggtaaaaagctacttttgctaccttaccagtacactctctggaagtgatttctggcaatatgtacaattttcaggttctgtgtacttctataagtcagtggcatgaccaagtttatcagtgtaacagtttgacccgggaccttttctatccttttttttcgtgattcttcggctccaattttttctacttcgtttacttcacggatggttttaatctcatcatcgaacacttttggcttttagg

SEQ ID NO: 66675 - DNA, 3316 bp, Oryza sativa
tttgatagactgatgacaactcagagatgtgaatcgtgcagagcttatctttgaggctttgaacatcttcatttcgagatatttacacccagatcgagaagcaatacgctgcctatcttaaacatctcctcgtcacaaaaatcaaacaaacacgaaactctctccaaaaagagaaaaaaaaattgaacgtaatcctatcccctttcggagcaataatatacaaacacaaaaaaaacactagtcctgtctccacatttccagttcttcttcttgtttttttttttcagatagacgtctgcgtcggcgtctctgacgatgagaaaggctccgtttcatcagtggtgctgaacgatctcatgttggatgaccgtgttgtctcgttctccttctgctggctgctgctgaccttgaggtcggcgaagtcggtgatcatggccggcctggtgatccggtgcaccgagaagtgcttctccccggtgagcatcctgacgacggtgctcatgttggggcggcgcgccattgcgtcctgtgtgcatagcaggccaatcttcaggaaccggcatgcctcgtcgacgtccaggtcattccccaggtcagcatcgatgatctcagccaggcgttcttgctcgtagcgtacccatgtctgcaggttttctcgcattcagtaatgtttctttgtatggtggatttggtggtaagtttctaatttagttgattatatgagaagaaaaaaactgagttcattttgttgtttacagtttgatgatgggaacttaccctttcgagaagaaattgatcttcataaggcaatcttgtgttggtgttgcatctgccgctaacgatttccagtagaagaacaccgaagctatagatgtcggatttctttgtcacctggcctcggatagcgtattcaggtgccaggtatcctctgaacagaagtgaatttcaagtcagaacgaaagaactttccgatgtaaaccgagtaaataaatttggatttagttatgcttacaatgtgcctgcaactcgggtgctcacatgagttgcgttgggtggaaggagccttgccaatccgaaatcagaaatttttggggtgaggtccttgtcaagaagaatgttgctcgcctttatgtcacggtggataatcggagggcgaatttcctcatgtaaaaatgcaattccacgagcaacacccacagcaatttttacacgggtcctccaatcgaaccggatgttgctacccctagatcctgtaatatcacagccagaacatttgtaagtatggcagcgaaggaaggagttggtaaaggacaagttcgggaaaataatgtgttactacttgctttttttaaaagaataatgtgttacctagcaatgtctgtgcaagactgttgttctcaagataattgtaaacaaggatcctatgagatccttcagcacagcaaccaataagtgtgacgaggttttcatgcttgatgtcagaaattgctgtaagttcagtcaagaactctcggacgccttgtcttgaagtagcagacagcacctttacggcaacggttgtcccatctctaagcactccctgattaacaaaatgaaatgtaagatgatttgttttgacactatgggcatgagacactgatagggtgaacaaaatgtaagacatatttaccctgaacacagagccaaaaccaccctctccaatcttatttgccccactaaaatcatgggtagcctttctcaactcactgtaagaaaatatcttcactctatgttcacctggaacaacaaaacaacaaactcaagcatgtaagaatgatgaattgttttgaacaatacaggtaagaagcgtgctaatatacaaacgctgctcaccatcatcaccttcaacaggttgtttttttctgaacataaagcagcaatccatctgaaatcaaattgtagaggtgcccacaggccacaagaagcaatgaattggaaagaatttctgcagagcaaaggtaaatagccatcagaacaactgtaaattcatattgcaacaataaactaacgtaaaatgaggtgtacaggactcttagcaagttaatgaccccacatgccagttgttattgtttaaacaacaatttgcgcatcgataaccaccaactgcactgaaaccacatctttgcttgtttgattaatggctcaagttactatcaaaaagtctacatttagtacgatggaaagaaataaaaatgtgaaaccacccaagaaagaagatgtaaagagacttaaaaccaagtcaaggcagaagtcatccaccccatttgctgagcaatttgaagaaaatgaaacgtcggttgccacaagcaaccttaatcctgtctttctgaaaggaatagcgcctgatagacccaacggaccaactatccccgttgacgagtggaaattttgcagcaaccaaacccgttggaaatgaatttcgattcagatatagagcaaaagcctgttaattttcagtaatactaactatctataactaattccgcaattgcacagcagttgagtaactatttatacttttgtagtacaagaaagcaacaagctgcatattcccatacgccgatgagtaactagcatttccttcaagccaggatttgcctcatagctttacctaacaaaaatcggatttgcagctacagaaaccaaatcttgcatgcatcaaaatgagatgatgcatcacaaacacaagaaaaggtatcccctttctacttcccgctgacctaaaccaagcatcacatccatggaactcgatttcgtagaacgggaggaggtcgctcccgcaaaggcgcaatcgatccccaatttcaagcaaatagagagcgaggaacccagcaacatactcctccacatagaaacaaatgtaaaagcctaacgagttcttggtcatcctcactcaaacgcccccaaattaggaaccaaaccaaccaccaaccaatccaaaccagaaaaataaaagaaaaagaaagaactccacacacacagacaacaagaacgcaagaatcacctgcagagcaagcagatcgagccccggcagtgagagcaaagcaagcagctacacgccgaccaacccacagggtgaggagaggcgaggagaggaggcaggagagagcgcggaggcggcgctagtggtttaagaggggaggagagcgcggcgtggggaggaagaaggtgacgagaaggagagagtctttgacttctctctctaagctcctcctcctccgatttttttttttgcttctctcctaatatttctaaacaaatatagagatcagaggcc

SEQ ID NO: 66676 - DNA, 3668 bp, Oryza sativa
attcctgcagccccgctattaatcagcaatttttcacgtaaaagaattacacgtcgatacattagaataaagatagttttgttacacaacacaatcagttagactggcctatgtcaaaagaagggagaaaaagcaaaacaaaaattgaaactaaaaaataaactacagcggctaaacacaactacaaacagcaggaaaaggcaaagccacgctacactctcgagaaatccctacaagcggtaacgccagctaaagaccgagaggatggactccagaaccaagttgttgttaatgagcaggctaattcctttgcttaatcgcgcgttaaacatcacgtggttaattcgtgttgctcacggggagtaattgggaccgagttacttctgaaaaccgatcgatggcgtggcgctcggtttggctcgctcgccggcgccgtagggcgaggagacagagactgtgatgtggtctttgagtgcagttttagctgatcagtgatggagtctctgtgattttgacgtgcaaagtggttaaaggcacaacaccggccactagattagcttagttaggagtagcgtatcacgtgtacctggtcatcagttttgtactctactctattctctatccgcgtacttatggttgagaggtgcccgatgcttactctgaatatacaaatacaatgtgtgcgacaagggtccaaaattcagacggttggatacaaagtccgagagattattagattaaccaactgattgtcgatataagtatatactagcgcgaacgtactgaccagcaaaatccacgcagaacacggagtaagtaaagcataaagaaaaaacacagatcagatcacatgcagcttgttatcattttatggtcaaaagcaatccggcacccatgccaggtgagctgcacctcgcacccccacctcatgtgctcgtgcttggtagatccatgctatagatactactcgtacacagcaaacaaaattaagcacgtgcatgtgcctgttatgtctatctgttcgttcaaaaatgtcagcttgttgttcaataggaacagtctgggtgtcgttcgcaggagaatagaggaataaacaaagttgctgacgaacgcggctgagagcaagtttaagagctcactaccagctatttgcatattttaaaaccaacatatatatgtaataaattaattataagattagctttaattttaatatatttgtcttgtaacatgtattaagctagttttacataagagctcacactcttcgtataagtgtatgatagaattatcctcactacaaagtacttctattatacttgctgtgggtgatgtggcgcgtcacccgcccgcccatccgaccggaagaacccacttgggaatagcgaaaacgaaaattccgcagtcgctgataataccacatcttgccgagctcgagcgcgtgcgttcccaccacctcacctgggcgatcgatcgatcgatcgctacagcgatccacgcagctcagccagccgccgagccgcggacgcacgcaggcgcaggacgtacgggtagtggtccactcgatcggtcccgcgagtcgcggcgcatcgctggtcgcgatcgcgcgtacgaacgtactccgtatacgtacgggtacgcccgcgggggcaaggcgtctcgctgtcacacataccggtctccaattttctcgtcgtctccccggcgcgcgcgagcgttcttcccgagcgtgttggctcggcagttatacgtatgttaggaaacgatatacaaacaaacgataaataataataaatcaatcataaaaacacgagattttagcgtggagctagcctttattaaatgtaaataaatttggaacataacacaacaacgtacgtggacgtgtggtggcgtgtgggtgatcgatcgatcgacgaacgtgtacgtcccgtcccgtcccgcgttgtcaaaggctcgcgcgcgtgcgtgcggcgccgccgtcgtattttgccgattagttcgaccggtcttaggtaggagtagtatacgtcgtacgtgtacagtactatgcgcggtgagtagtgggacgccgtacgtacacgatcgatcgatggcgcggatatgtccagccgagtggccgacccccacgcaacgttgtctgccgccgtacgtacatctccggcggtcagactgtgatcaactgtcatatgcattccaacatgtggtgggacgtcggttggtggttaggctgctcctattcccactgtcccaaagaacgatctattgatgaaatatgacatttattagtacaatgtatattaaaaaaacatcatgttttattttagattagtttttatgaaaaaaaatacgttgaatggcttgttcatattgatgtcatttcaaatcatattattttttggtagagtttttgcaaaactttagtatataagaaatcctactaaaattttaacaatattattaaattgtcaaaatttaataagatttattttgattacaatttgaacagcccaaaatattgaatggttgtcagataggtgtgcacgggccctattacaaaattgatgaatgatagtgccaagttgacaacaaacgagagctggcaatatttaacaataaattaaataatatgaaaaaaattaataattacttaatttttttaataatacgaacggtcaaacgtgttttaaaaagcaatagcgtcaaatatttgatttagagatgaagggagtattgtactagtgttttaacgttttttattgcgacaagtgttacgtatctctacgcgacagttgctcaccgatcagcacacgttgttgaacttgaacttgaacacatctcttcgccagaagttaatgagcaccaattaattagctcttggcaaccatttggtcctttttaacatctgacttccaaaaaaaacttgggtcaaggaagtcgttcgaacggattaggccattcctaacctaataaatggtgtccataacattaaataagttaccacctaaaatgaaaaatgatgtggcaagtgaataaatgagaaaagagaatgacaccatgttttgcatgagacatggtttctacacaacatccaagacatcatgtgagataaataacattaaatttaagtatggaacagtggtgtttgtattggaagagcaatgtctagtactagtttcttgatgatgtggagtttatggaaactatgtctagtgtgttgggttggaaatggccttagatatagtactgttctatttttaatgattctcttatatccatgttttaatataggacgtgactacactgctagtggtagttggtttgtctaaggtggtgtttggttggagggactaaagtggagctaaactttagtccctctcacaaaaacattagtccctaccatagggacttataattttgtgagagggactaaatttagtccctagttcccaaacaccccctaaaccagctaccactccatctataagaaatatcatccatctataattcaaatacaattttctcttaaactactcatccaatttacgatccgatatcaccgttgtgttcgtaacaattaaatctttacaacaagatctcacatgattatattttgatgaaaaatcacacaattacttttagatttcactaagttacttcttagacat

SEQ ID NO: 66677 - DNA, 5184 bp, Oryza sativa
actactacgggcaaatgacatcgataatcagcattgaaaacactcataacatcagtttcagtggaagtcgctctggtggagcaaccctggcactacagtgtatgtggtaaaacgaaaatattatcacaaatgatgaaaatactagtctctgttcctcatctttggtgagcatatccaccatcacagaattttagagtaattttactcatggtaatagaatttctgttcagcaatctggtagcaatttcaatttcaactcatctaagcagtttccccgaataacgccgctttaatggagaactcaatctgacactagttgtataattagagggaaaaaaatgaatatgcgtaatgcagaaacactattgcgaatttagtcactgacaaacctagggcacttttagtcgaaatgcatatttttcttactactaagattccaaggacaaaccactaagacaaatctaagtagccaatcaaaatcatgaacaaaaacccgacgaacaatggaaaattccaaccttttttacagcccagcacaaaactttatccaagtcgcaattgggaccaataaggcagcacttaataataaacagcaagataaaaattttatcccctaatttgccaatgggactaatagcgcaacacttaataatcatcatcatcatcaacaaaaacaataatgggaccaataactcagctcttaataatcaacaacaacaagagtaatcctaaatcctgccgtgccgcagcctccgcccaccagccacgccaccgcgcactgcatcgccgcctccgcctgttgctctgctctgcggctctgctagggttcaacaactcgggggaaccccacagtcagcaagtaaaaggaagcccgatatagcccactggtacgacccagcatcacaaagtccctctccgcctctcctcatcaatcgctcgcagctctccccttcatggcgatacggaggacggcatcgaggttccggttcgggggcaggcggcgagatcgaggtacggcgaggtctccggcacatgagcacacacggcagcagaaaaagaaaaaaaaattgaagggtacaaagccaaagagtaaactaacctatgcctcgagagcacctcctcgagcgtctcttgctgcgattcctgcgctggctccgccgcggctgcctcgccgccgccggcggcggattcgtcggctagggtttcgtccattggcaaacgatgcaaaactcagttcaggcgaaggaaaaagaaaagagaaaaaaaaaaggtagagaggcttttgtgtttgtgggctactcgtgtgctcttgcgggtcttgccccaccttatcggatgcggatctgttactcttgcgggtcgtggattgtcacgatgcttcgcccgtttccttgtctgacagagactgggcgattaatctgttcttcttcagagattctgccccttgtttagatccagattctgccccttatttagatcagggtgtaaagtttcatcgtgtcacatcaaatattatatagagtgttacatggaatgtttggacactagtaaaaaaaataattacagaatccgtcagtaaaccacgggacaaatttattaagtctaattaatccgtcattagcaaatgtttactgtagcattattattatcaaatcatggaacaattaggcttaaaagatttgtctcctaatttagtctcaatctgtgcaattagttattttttagtctatatttaatactttatataaatgttcatacgttcgatgttatagtgtgtaaaatttttacgtgagaaataaacatgaccttagatcgttttcgtgtttgatgtggactgaactcttaccttatacttgtatgatgtgcttagctagatttcaactcctaaaaccacctactccaacgttttgatttcacgcgtctcacgcgaagatttccggctgtttctaaatccgttaatttactgggacgacaaaatggtttttcatgtcgaattgtgtctagaatagtcggagctagttaatttaattcttcctgtaagtgctggtttgaccatgttgaaaacatgcacgagtattttgaaagccggtggagttgaaactatttaaaacatgcacaaaagagcatgggaacgagtaacttgaccaaagttatggaagtcatatgttaagaataatccaatgggttctccatgctcaaagctggctatttttcgtgttcattcctaataaagaggttggcctttttcgtatcaagcaactatgtgatgtgtttcgtaaatacagctgtgtcacggcctggaagaaatcacctctcacgagttgtccgtctcgttatccaatttagcgcgtgcttagttcacgttaaaattaatagtttaattgaaattaaaacgatgtgatggaaaagttaaaaatttgtatgtaggaaatttttaatataatgaaaaagttgaaagttcgaaaaaaaaaagcgctaaaccaggccttaaccaggccttatccttgtgcacctggtgacaacacacttttgtcaacagggagagagacgtacggcagcacgtaacgcgaacacacggcttaacgtgtacagtacggctcagtactcacgtgcacggtggacgtccgtagtacctaagtctgacggatttgatcgatcgaaccggccgtccaacgacgcagcacgcgttcggtttggatacatccttgacgttttaacgacgacgtgccatgcaaaccccgccgtcgcgtatagtcgtacgcccacggctacgtacgcacgcacgcatgcacgcacggcccgcgcgcgcgagaccaaccgagccaacacggccgcgaccgcgaccgcgaggttgtgtgtgttgggagtgaaacgccgagacgtacgcctgatcaccggttcgctctctgctgtgctgcctgccacgcgcgcgcgcgcacggtgacgctgacgcagtgcaccacggtcacacgcagtcacccaccgcagcacgcgtgccgctgttgtttttaccgcgccctgcgttacgtcacgtactcaaatgggtgctcaaagggcataactactccctccgtcccaaagcttacgctgtttgaccatttgtcttatttaaaaaatttatataaatataaaaagcgaaaaattatacttaaaataatttggataataaagtaagtcaaaaaaaataataattctaactttttaataagacgagtgatcaaacagtgcaaacaaaaactcaaaattccttatattatgagacggaggagtagttagtttggttcattcctgataattatttgatccgtgagtagtaccgtcatgtttttttttaaaaaaaccattaccgtcttgtgagtttcgtcaagatataggagtagtatagaactctgtaacacctgagttccaaaggaggcttgagaggggaaaagaaaagttaaacactcctatggtttaaccgtgacacactgacactcctaataaaatctggtcaggcaacgtttggctttacttttaattagaaacacactattcatcatgacgacagacgagaattgccactatcattcaacgactcgtcaggactcaggagagcttcatctcgttttcctactacccgattaacccgtacgcgcagcacctgtccggcaacaattcaatatttctttttttatatatagcacctgtccggcaacaattcaatatttcttttttttatatatagcacctgtccggcaacaattcaatatttctttttttatataaaggagacgactattcaatatttcaacgtgaccacaaacgtctcagaacatgttggaacgcacacgacagttgacagcctgaccgccgaagacatacgtcggcacgcaacgtcgtcgtgcattgggaccagggcacacatccgcaccgccgatggatcggcgcaccgtgcagctagctatagcgtagcgttccactccactcaccatatacacgttacacgtacccaaagaccggtcgaacgaatcggcgtaatacgacgacggcgcccgcacgcacgcgcgcgcgaggggtttggaccctttgacgacgcgacgggccaaagcttagccgccacgcgggacaccgtcacacaccacgcaaacccgtactatgtctatgtacttcatgtcagtatgtgcatcgccgcgctccgccacgttccgcgaccaaccgagccaacacgcgaggctgtgtacgtgtggaaggggaacgtacgctagctgagacgcccgcccgcctttcacccccgggcggcgcaccgccgcgagtacgtacgccggctgcttttccacaccgccgtaggcacgtataagggctggtttggtttgaggcctaaattaggcttaccaatatttagtaattttaatagtgtttagtttctatttggtttgaagctaaattttaacatgcctaagaaaatagaccatttcaatagtaaacttaggctattttgacttcaatccaaatacaacttttccttaccaaaattagtcatgccaaaatttggcattgacaaaatttggtaaggcctatttagccataaaccaaaccaaccctaaatgcgcgggcatgtgggtacgcgctatattaaacgcaaaatctatttccagaggcatctcgatttagacttaacgagcgacgctgacaattacgtgagaagtactagtagcattacagacatgcatataagtagtttttgctattaggttgtgcattttttttcttcttatgaaattttctcttaaattacttatccgatatataatccgattacaccgttgtgttcataacaattaaatctttacaacaagatctcacatgattatattttgatgaaaaatcacaaattacttttatgatatgtctaaattacttttagatttcactaagttacttcttagacatacaaaagtaaattcagtaaagcctaaatataatttatatatattatagaagtaacttagacaaaacgaatgtaactttggcatgtcatttgaagtaaatccgttgtagatataaaaacatggctctatctagaaattaaattaatcagcacatattatgaattaactaaaaacaataataaaagtaatcacctcagagcattatgaatgtatagaaagtattttaatcaaatctaaaagtagggctgcaggaatt

SEQ ID NO: 66678 - DNA, 702 bp, Oryza sativa
attcctgcagcccattgtgttaagagacggttatcactggatgactggaaaacatatcatactgagaccaagactgttaaatttctttttttcccctttagataactaagcaggaaccaccgagttgtagtgctcaccaagaccataggcatgtctgtgataggacaacctaatgctagggccatctttaccacctgaatccaatttgtattctttgcccatttccacatctggaaatgagcccgagtatacaacaatgcgcttcttcaggcagtgggttagagcaccaagctcaagttgcccaccccaagcagcagttgactcaacctcctcacagtacctcttgaagctctccaagggatctggtccagactcgaccttgccctctgataggaaaaatgggagaaaatctgccgcatgctctttcatataattggcagtcatttgccgcagctcctggtaattgtattgtgtggtttctctggaatagagtgacagctggttctcaacagcacggtacaggcagtggccatctggctttatctcctgaatggtcagtcccatgggctcaagcttcttctcaagcttttcattttctatcatgcggtcactgacaagattgttttgctcttcttgaatccgctgctctctagcggcctcttcctttgccttcttctctcgacgccgtgcacccttgctagg

SEQ ID NO: 66679 - DNA, 703 bp, Oryza sativa
cactcttgtgaacatgagttcaaacagatggctagccatccgtctggaaacattgggtggcatcatgatatggttcacagcaacatttgctgtcatgcaaaaccaacgagcagaaaatcaaaaggcttttgcctccacaatgggtcttcttcttacttacaccctcaatatcaccaatttgctcacggctgttcttcgtcttgctagtctggctgaaaacagtttaaatgctgttgagcgggtaggaacatacattgagttgccttctgaggctcctcctgtcattgaggatagcaggccacctcctggttggccatcatctggtgttgtcaagtttgaagacgtcgtgcttcggtaccgaccagaacttcctcctgttcttcatggcatatctttcatcattaatggcagcgaaaaggtaggaatagttggcagaacaggagctggtaaatctagcatgctgaatgctctgttccgtattgtggaactggaacgagggagaatattggttgatgattgtgacacttctaaatttggaatttgggacctacgaaaagtactaggaataataccacaggcacctgtcctattttcaggtttgttgtgaaaatacatgatatatcttctcgtttgcttttcttacatcataaatgttttttttggtactattgtccaggttctgttcgatttgggctgcaggaat

SEQ ID NO: 66680 - DNA, 7450 bp, Oryza sativa
attcctgcagcccctctgaacaatcgatcatcaccaccagggctctcactcgacaagacaggatacagaaagaaagaacagtgctgctgctttccttttattggactgatccatccatgaatcgatcgagtcgggagaggtatgacgacgatgattacagacaattaacagtggggttttcggttcctctaccacctaatttaatctaccagctcaccaaccattattacaaccaattttgcatgcatgccacaaaaactgacatgaacaactcaagatacgaaccaaccaaacgcaaacaaaaccaacaccattgttttttgtactgctatgcatttctgggcttcttttgtttttcaccttcagtcgaacagctcccactgcgtcgttgcaggagcatcgaacgtctcccatttggtcgtcactatcacattctgcaaccgcgcgttggagatcttgagcacatccagcgtctccacgcatttctgcaccctcttcgcctgccaaaaaaagaaagaaaaaggtctcgttatctgatccatttctaggactaatatgcattgtgttggtgtaatttaagattgttttcttgtcatctgtaattattatttgcacttggttgtaataagaggatcgtgactgtagcttttgttgaggtaaaggtcggattatcaattattgaaaaaaatggaaaggaaaacagtgtgtagatagtacttggaatgtaagtaactgttcatgagtgggtcacatcatttccaaagaaaaagttaatggccttttccattctaatcttgaggtggcatcaggagatcatcacaggtaatgataaaagcattttctctttttactctctaacaaacaagaacacccaggatgcctgcacttttggtctccgtctactcttgttgtgacctaaccagaaatgggcaatcttttgcatcttgatctttcttttcttgtcatctactctttgcacaacaaaagcacacaactttcctcaaacttggtacaagttcagttgcttaagggctcagctcacactaaagagcgatctagatgcaaatagctggcatcacctaacattttcagcaggaaaagggcttctaggtagaatttcttgtgtgcttttttccttttatttttatgctgaaaaggcaggataagcattcttgtgtgcctggaccatgtgttttccagaaagaagctaatgatcctgtgactgtttcggggggcaagtaggacactcacccacccatgataggtgacacagacagctacagctccttctcatgaaaacttgtactgattgtcatgccactgcttgctacaatcctactcaggtaaaccgacagccccaagaacgctcaagccggtgagaatctaaaaagactaggttctttttatcttcagtcttctaatttatatcctagattctataactacaaattcttagaatctattacgagaatctaaactgtttggggagctggagatttcaaggagaagcgatagttgtcagaagctactctaaatgtaaccatagcatctctcattggtaccaatggtactgtaccaaaaacctataatgatgttcttgattctaatgcccaatgctaggctctttgcaaacaggagatgatgcaggtgctcacctgaatgttcttctgggaagacgagtccccttcagcgtgtatgctgtccagcttcacagcaagccgcatcagcagctcgatcagcgtcgtgatctgcacctcggcgaccttgctcccacgggtgatcgacttctcgatgctccttacctggtacaagaaaagaaaaggaaacatttttctcgtctaatcagcatcagcatcaggatcagatcatatcatatcacttctgccaaaatgagtctttcagaaactaaagctgagtgaactctgctttagtacagccaatgatggaagtgccctgagatgcaggggcacatccttgtcagggattgaatttctgtccctgctttggtatggcccggtttatgcaacatactaaatgaactcagggaccattgccttgtgcaatggatgaagaaatttcaccgctgcttcttcatggccagaatcgatggacaaccgtgcaatgtagtatcaatttggtcacctaatttcttggacggattactcaactggccatccaattcaatgcaccatgccaccattcccctccccatgcctgcctgtctgaaccagcacagattcagaccataactagccccctaaatcgttcaagcttcatctatctatcctactacctccattccaaaatagtataaacatttcaacaacgtgttgtgtttttgaaaatgtatctcaacatgcgaaaatacttacattttagaatatggtgataaccgatgcattgaccatggaagaagaacagaagaaacaaagaaagaaagaaagaaagaagcagggtttgttttaagtttggtcacctgatcggcgagcttgtcgacctccaaggcgatggcgccaatggcgcggttggcggtctcgatcttggcgctcttctggcgctcgatgtagcgccgctcgacgctggtcgggtcctcggcgaggtagagcttggacctgttcttgacgccgcagacgtcgaggtagtcggcgttgccccgctccttgcccctgtacgtcagccgctggtccgccgccggcagcccggtcctcgccgccagcagcttcttcagctcgcctgccacaacaccaaagaacagctgattattcttctgaaattcttcctacatgctcttgggacatggtggattggatcattgctgcagctactggtcaccaacatttgccaacgttattgaaaccgcgtgtgaatctgtgatcaatacactgacatggtaatggtggtagctctgtactttctttgcctggctggtgatgtttgacagtgatgaggttttctgtggcacgtttggccatttggggaccagatatcagtggtcaactctaccgttctgagatcgtgaaaaaatattttaaaaaaaaaagagttcctccattattttttatgctccagcctccaggtaaagttaccaactaaatcacaaaaaaaaaaaactaaattcctatcatatttccgatgctacaccgtgtcatatttcttttcacgtggtgaagcaaatactataatataacaagacatcgccaattaaggctaaagctagccttattaattgggtcaacaaacctcgacaaaattccaatatcatctagtaaaacattgtttcaatttaaggtttacttcttagctgactttaccctgatcacgaccaaaaccacccgaaccttataaaaaactcaccgcgcgatataaaatgcgagatgaggcgagaagaagagccaacaacgtggtgcgcacgacgggcgacccgtagcgatttccacatctcgctgcagtagacaaacagtgagcgccggagacgaagcactcaacttcacacttcccagaggtgtcggtgcaacgggacaaacgatcgcaacgtgcccctgcctccactccaggctgcccctgggccgtccgattcggccgcccgtacacgtggacccatctgcggcgccagaaactagagagagggagatccaccgtatccaacccaagccccccacccccccccccccccaattgctgccattgtcggggaaaggcaagcttaattcaggcagcatctgctccggcaaagtggaagcaaagcaaagcaaagcagagaacagttcaaagagctcactgatcgggtgattaattttgttaattacttcattagcctcgtaatctgcattcgcctgtacttccccgtcgcattgaaccgcccaatgccgggatttcacggaaggaatagcagtgctatggctcgagaaatgaagtcgtgtcagtaatttttttctctgtcgctaatccagagcacgggttttcgaagttaacgcagcaactgtgacagtaaaattactagcaaaaaattgttttatttcggggtattttcaggaggaaaagcggtcaaaatttaaattacgagatggccgcacaagacagaatgattctgaagccgggaatttcgcgctgcacggagcaaagaaatctcggcgcctcacgggctcgtacgaaattattccgtggattttgtttctttcctttttaaaaaagagggggaaaaaataaaggggatgtctcactgtcctaatatcgcggcggcattaattcctccacgcggcacggccggaactcatggtgaattttaaataccacctttgtatttaaatttgatatacttaactcagtttttttttattttaactggctcgtagtacaagccacgattgccagccagcacgggttttaaagctaagtgactcgaggtcaaattttgacccaaaaataaaacaaatttatgccggctatgttaaaataaacattcgcgcgggatttaaaccgaaataaaacagagctgcttttgcttaacttgctgggtttactttccggagaaagaaaaagaaaacatgagtgctgcagtgcaggataatctaaaaaaatgaaattaaagaaaaaaaaactaatcaaaatttcagtttcgtctcgtctatggaggaaagaacaccatcaagaacaaaaagaagaaaaaaagtttaaggcgtaattaagcacggttacttaaccaaagctcacactttaaccaaaggtgagaagaaagcgagaggatcgagagagagagaaatcgctcactcaccgaaggaggcaatggaggagacggcgacctcgtgccgcgcggcgccgtacttgacccgcaccttgatctccggcggcggcggcctcggcgggatccccatccctcctcctccgccgccgccaccgccggggccctcctcgcgcgcctgcacgaccatcccgctcgggcgcacctcccacccggccctctcgtccccggccgccgacgccgccgccgcctccgaccacccgctgctcgacccgccatccgagctcgaccggtgcatcaccgccgccatggacgacgacaccacaaaccccacccctctctcctcctcgccaacaagaacacaaccacttagtgcggggggtttggtgcagtagtgcgcgcgcgcgcgaggtggtggtggtggtggcgtgagggaggaggcggaggctgcacgcgcgtgcgcgcgctcgcggcggaggaggaggaggggaggagtgggacgcgacgcgcttcgttcgttcgttctccgatcgatcgctttgtctttggctttctttttcttcttcttcttctctcttgggtttgccggttttatatggagacgaggcgatggattggttgtatttggtggggttttctttcggcggatgtacgctgcagccaccgggcgcgcggccccgtggcgggagagaacatggtcgcgttgccgtatttgcttccggggatgggcgccggtctacgtaaaacctcatggtttttgccgtatcactttttattcgggtcagttccgcaggttaagtggtgctatgttatctgtatatttgtttactctgaaaaaataattagtcaaaaattgtttttccacatcgcaggtttcttctaaggacttatttttaggtcagtttcgtaggtgtaatggtgctatattatctgtatatatatttactctggaaaaataattagccaaaaatttaaactattcgtatcaagtctaaataatctaaccatgttaaaactacactcgtatgtaattattatatgcgcgaataaccggttaaactacgctcatatctttatatctttctatacatttgaaaaataattagctaaaaatataattgttcgtgtttaaaaaacctatcaagttaaactaatcacatatataaattttacatgtgtgttatttaatagtgctaagttggattcgatttaatttatcaatttctttctgacgcatatcggacgaattgatggtgtatgatactaagaacgtggactgccatgaggctaggcggtgtcgtgtactttttgtattgtgtattattttaagtcggtgagctcatttggcgcattcaacgtaatcggtctaggtcacggctaacacacggtggatgacatgttagtaagacggatttttggcttcacacgttgacgtagcaagatatatatagaccaattcatcttcaaccatattcgagaatcgatatggaatcttttgagttagatgtatgtcaatgtatccatttactttttccatcatctagaagaaacgtattcattttctttagaacgtatatattttgtctctttataatactttttttacacgtagcgtggttaaagtattttagattatacaactgagcgtagcttagttagttaggttccttgtagtcgaaactaactttttaattttgacttctaaacttggtgtgggtgcttgtatttacggttaactattgtttgagtggtacgtgttatatatacccgtcgatagcaaggtgtctatcgtaactttgtcgatctctctctctcactgttacaacagctaccagctgctgggtgatcacactgatcactgcgctaaccagtaaccactgtttaatgatgccagcttgcttgcatctgcaggaacctggatgcacatgagatagtgtacagtagtattattattgtatgactatgcatctgtaagtgtacgtacgtagatcgtaattaataccgagaagcttatatagctagcttgctagctaaactaaacaaggcagtgatttgtactagaactgtagatcaatcagcagctgggattaactaggatggttaattcgattatattgctcgcatacatgagtggtccatgcaaaagagagggattaatttctcccgggtcactccctcgagcttaattgcgcgatgtgacacctgccggtaacgtcatgtgacgcttaacgacatgcgtcgtcgtcccaatcgaaggcgccgtacatcttgtctcgcctcgatcgatcgaatatatcggctcttcatcagcttaaggatatgaacaatgtatttactgctactgtcttaagctcaaggagtattaattgttcactagcttgggcgcttggcaacaaaatgatagctagggacttcatcgatcacactgctagctaccattctgcagctacaaaaaacggccttgatcaaggccaaattaagctttgtggatatggactgcatggatgcaggcaaatagcagtggcccttgcctgacaacgcatatatgacaatgctgtgcccatttgtccattagcttagctgacagtctgaaacttcaggctcggtttcttccagttgctgtcatcctgcctgttagagaagtacgtaatgtatgcatctggcataatgcttggagaagtacgtaatgtatgcatgccccctgtttagaaa

SEQ ID NO: 66681 - DNA, 4375 bp, Oryza sativa
cttgcgaggacgcgttaactgttttttttctctctttcttcttttttctttcttgcggtggacgtgttaaaatgttttgacgtcatgggagtacgtgcgtgcaagctccatcatttaatcttcggctgataagccgtagctaaaattaaaattttaaaacttaacttcataggctgtttttaatgttttgttattttattttactttttcattagctttaatttgagatgatatacatataaaagtttcaacataaattatttgttatcgttgataagcgttgtcgcttataaagttataatcagcgtgatgtataccgggtccaatggctctactacggacagagatcctcggtagtactgcacctgcaatgctgccgctaagtcctacatgttagcggcagctactaggtggcagttgtgcaaacaatccccactaccccgatgtcgtcctaagtcgcttacggatcacgataatataatgtctcgtattttcggtgttcaatgacttctattagtgcttatgtttgcccaatctttgaaaatctttggatcccgtcatcccacagctgattgtgagactgtttggtacagctctaactcctaaatttagcttcaggagttgggtctggagtgagctgtctaaacccagctccacaactctagttcattttgtgagagagctccacccagctccactcccagttttggtaaagctgaaactgtttggctgagctccagctctagaaagagtgaaactggagctggagctgtgctaaacagaccctgaatgtcttctcgctcttttcctgattggtgtcattgttcagtttttaccgtctgttggtcatgtgttgtcggtgaccgactattgctaccgctgtactgtccggcaaccggtacattgtgcaggaccgcatgatcgatcaccgacaaccttcatctctttagtcattaatcgctctaacccccatcattctacgaccccatttaatccccaaatcagagatgcaacatagcaacagtaaccagatcacatgcatgcaacaccaacctgcagcctgcactcgctgcagcagggaccgcatgcagaagccgcttgattctgccactgtagtccagctctgcagcttcatttctctcgtcggtttcctgattatttgtgacagaagaagccatagcacagcttgatacagtcactctgactcactgccatgctgttccagggctggaagttcagtgcaacttcctgtctcattcagcctgtgaaaatgttctgatgaacaaaaatcaggaattcaggattcaggtactttcttgagacatcaacaaaatcctgaattttctgatgcagtagcaaagcctaaagattacacgtctcacagtgtcacacactacatgccatagcattatttatgttacagaggggtgctgataattgtgttctccaatggtccatggcacgcacactcactcacacacacactgacagagaggaaagaatcatcaaactaggagcaaccgaggtaattaaaacggaaattaccaccctaatggtgctggtaattaatcatcaacggccctctgataggcgggcccacccaacgccgacgagccgaggcgtcggctcacggcgagccgagccggacctccgactcgcgccgcgcggcgcgcctggcgcgcaccacgtacgccacggcgaccgcgacgccgaccaccgccaccgccgcgacggcgcacgccacgccggcggccacggacacggatctgcgaggcggcgccgacgacgccgacgcggtgatggtggcggtggctctggggatcgccgacgcggcctccggcttggcggtggcggcggcggcattggaggcgtcgagcgcctccgggagctcggcggcctcgggcttgctgccgaagaaggaagccatcgccggcgtcgcctcggtgttcccctcgcggaagtcctcgaggccgtgggactccgatccgacggcgaagagcgccacgacgcagagcgcgaccagcagcgggcggccgagatctcgccggcgggacgccatttgcttcagcctccaagctgcaaacgcagttgaccagcgtaattagcaaaccgctactacaatctcaagctgatttgagcagaagctaacgtgcaataattctgcactacacaaaagcactctttcttcctcgttgagatctactccaagattcagatttttttttgctcaaattcagagcgattatgtgaattgtcccaggagagcagatgataagacaaaacgagctcaaaagggaggaaaaagaaagaaaacaaaaggtccaatccacagatctaagtaccaaaagaagctgttctttttgcagtgcagcaagctaatgaacccaattgcacaaagcaaaaaattcatggtggataaagattcgttttgttttctcctttgcgtgtgacacatacctttgcaatgcaacctaggatagcctaatgtgtgcgagggagagagagaaagcagatcagagagcttgttcttcctcggcagaagccacttgaaggttcagaggagcacaccctgatatatatatatatatatatatatcaaagattcctcctgttatcctctccctctaattgctgtgagcctgtgagtatatatggctggagagagacgcaatgtgcatgagagagaagcagataaccaaaccactcgtgaggatctatctactatctatctagctagtaagtatcctgtggcagtagggctcactgtttcatgcgtggtggagtgaaagctaagcgaggctgagagcattgtttgccatgatgccgccatgcttttttgcttggggccttgtggaaaagaaaacgaagaacacagtgcgtgagagcaagagacagagacccacattaggtgggcatgtgagccttttactaacctttgtctgcttgcttcgatctacttactgactaacactgctgtatgcctgtatttcgcccgtgtgaagatgctgtacacatgtactcttctctcatgttgtgccaatttgtgatgtactctccagctctctgcttatcatcggctcataagtatcgacaattacgtacgtatctacgtcagtttaaactgataagggaagacggacaattcactcacgctttgaaccgtaaaagcgtaattcacggacaatggcaatcaggtgagagcggcgtgcatgggaagagaagcagctcatctctcgtctatcttctgattgattagatcatgcgtcgtgagtcgcctcttcttttggctgggcatcatcatcgatcacgctttcttggcgtttggcagtccaatcacggagctcatcaattccctgctttgttgagatctgcactcactctctgctgcatctccatatgcctccggatttgcagtgcattgtacgtcagttggatcaatcgacaaaggaaaagatgaaaattataagattgtgacaaattttcgagtactggagtacgtactggtagcacatgcatgcttgggtagtcgtagctcgttaaactagcgtttaattaattagttttagctagccaagatctcggagttgatgatgaatggaggaggacatggagacagataaaagttggtgcccctcctactaattaaccaaattaaagcacattgctagtgatagctttgcttttagtagtagttggagtggtaacaatattggattggcatggtgaggcagggaatctaacttgtaatccctccgtcataaaaaaaaaagcaaaccgtggattcccgtgctaacgtttgactgtccgtcttatatgaaatttttttataattagtatttttattgttgttagatgataaaacatgattaatactttatgcgtgacttatctttttatttttttttataattttttcaaataaaaccgacggtcaaacattgaacacgaaaactagggtttgtcttttttttgacggagggagtagggttcttgctgccctggtccattgccactgccagaagaaagaaatggcacaaaatggtggccttcgacagatgtcagcaagttcatcggttggttgcattgcccctgcatgggactgacgattagttggcaccttttgtacactcctacctaaccccaataaaaccataaaggtactactcatcatatggcaatatggcatgatgaatcaagatcaggacaggcaggttagttacagtggctttggtaattaactgtactgactgcccttggatatggtgattgaactgttactaattactgcaatggtaacaccatctgcaacaatgtgctactaccagctatacatattactcctatgtaatatgtagctacgacatggagggaaatt

SEQ ID NO: 66682 - DNA, 3284 bp, Oryza sativa
tcctgcagccctgagacgtctgccgttgttttcttgctcttgtttgcttccacgtacgctggaccgcctggacggctggaggtagtagctgtacctcctccgtccttcgcttccggctatgttcagtaggactcagctaatcagcccgctcgtaagacgaaatgggcaattaatacttaattaattgaatattgactattaaaattttgaaacatgaatttatttaactttttttcaagaaacttttatatataaagttttttcacgaagcacactatttggcaattcaggatacatgctcatggaaaataagggtgtatttagttcgcgaaaagaaaatttttgggtgtcacatcggacgtttgaccggatgtcgaaaggggttttcggacacgaatgataaaactaatttcataactcacctgggaaccacgagatgaatttattaagcctaattaatacatcattagtacatatggattactgtagtacttatagctaatcatggactaattaggctaaaaaaaatttgtctcgcgatttctatgtaaactgtgcaattagtttttttatctatatttaatattaatacatgcgttaaagattcgatgtaatgtttttaacaaatttttttagaacttgttcaacaaggcctaaggaagaggccgatcctaccgcgaaaaaaaagaagaaggaagaagccgatcctagggactgtttagaactcagtagacagtagaggtgatggcgtattggcatcgagccaaccgtcacggatgaagaacagggacgaaataagacttgagctatagttgaaggaaacaaaatagacattttctagacaatacgtgcacgataatacgagagcccgctccagtagaaactacttttttgggtattcaaagcccggcccagtagaaaccacttatctgggtcattaaatatcggcccacgtaagagcacgcgagttggaacgccatgggatcccggcccatcaaggctcaccggattcgagcccaatacggactctgctctgtctgcgtgcagtgcacggacggtccggatcggaagcgaggctgcgttggacttgatctgggccgtacattgctctcagggcacgggcggtgcagacgaagcgtctcgtgatcctcgtctcctcctggcggccgcagcgcgtgggttcccaaatcgcgaaattttcttttcccccaaaaaaccgaataaagagaaatctctccgagcgaattcgacgagatcggaggctcggatcgaggtaaattttctcctcgtatttttctttccctgatcgattgtgttgattactggatctggtaatgctctctgttcaagcatgcttgggtaggggacgtagatttgcgcgacgaatcaagtatgttatgcgcgttttttcgcgggatttttcggggttttccatgcgcgttgcgggcgacgcccagcgctgcgttggatttgacttcgaattaagggcggcacggtggtagattcctcgctcgtttagtttttgaagagttagatctcgttccctacgtttcgaatttggtcgcaggttgctaagatttcccggtttgatctgcttattaggtttactttttgtatgtatatgatcatgcaatctcagatttggtgatttgattattgtgcggtgcgaaggttctaggttgacgtgttgtggaggtttctttgatcttattggagccacccttagcttattcggcttgttttgatccgaatttactattaattttggtgcgaattcagagttcaataatccctcttccgtagcatcgactttctcatctctatgaaaaaagtttgtgggagttaatttagaatcactggtttgtttattataaatcgtccccttttctgataggcaagtttgctactgatttatatgaccatgttagtaacaagtaccaacccacctctttgtttgagttggctgtcagattctagaggaattagatctgtgattggaagttactcttataagccttgtgccatttggctgttccaattatgttaaccataaaaattggactttgtcaagtttaagctgaagattttgattttttttttcaggtattctccttctgatttgattggattcgggatctgctggcggggatccatctttaggtaggatttcataattttatggactttgattgcaaaacagcaagaggagactcttcatctgtgaatcgttcatgcattgtcactgaaggcactgtcgtccaggcaaagcccgtttctcacaacgggaaagctaaacactggaatagcctcagtacattgaataaccagaagtgcagttatgaattactttccgacccaaagaaaaatgttgaaacaagtgatggtgagaccgcctcaaagtgtgactcatggtgcttcactgatttgccatccgcattggtctgtgaagtgcttgaacacctcgatccaaaggaacttggcattgtatcttgcgtctccaccctactgcataccctagccacagatcatcaggggtggaagaagttctactgtgaaaggtgggggattcctactcctccagtcaccctcaatgggcccttggttccaggaggaacttcagattggaagtcttggaaaacattatttgtggagcgggagtttcgaagtaaatcattcatgggaagattcagtgtggatgttctccgtgaccacagtgaggatgtacgcactgtgttccttctagcatcagtaaatctgatatttactggtggtaatgactctgtgatccgaatgtgggacttggaggaagggcttttgattgataagtcccgcccactttgttgcaccatccgggccattgcagctgacactaggcttttggtcactgcaggaaccaatgcctttattcattgttggagggctgttgaaggtaattcttaccctttccacatctctgggaatggcactgaccagagtcctgagtttcgcctttgggggcatgaaggacctgtgacttgtcttgccttggattcattgaggattttcagtggtagctgggatatgactgtccgtgtttgggacagatccgaaatgaaatgtgttcagaagttcatgcatgcagattgggtttggagcgtggcacctcatggaaatactgttgccagtacagctggtagggatgcctatgtatgggatatcaggagtggtgagttggaaaatgttatttccaatgcccattatggtaatgcattttctttagctcgaacacacctagctgatgtgct

SEQ ID NO: 66683 - DNA, 8918 bp, Oryza sativa
ttagtgaacgtgtcgttcatctgatctaccaaagtttcatgtgcgattctcatctatagtcagaggagagatatcgtggtttcattacgaagatcccaactaattagaatgtttgtcctctgcatgctatgcagctcacatgctaaataggcacggtacgatgacctctttgtcatatctttcaatcattcgaccattagcaagggcacaacacgcgagcttttgtaaatggaaaccaggacatgctccaaatcaaacaacggatacggaaatgtaaagaaatggagcaattataaacaccgacggatttacgggctctaaaagttttgataaatttcactacagaacatcacgacctcgcggttttagctataagatgaagtacaaactcatttttgaaggaaaaaaaaaactctctaaccgttgttattttctagcactcattaaaataatgtatttatgctgacgaggtaacaaggggcctgatattttacacgttgtgacgccgccactattctccccaccatcctcgaccaacctcatcgccgggatgcaaggctgaacttcgctgtgtggttcgtgtggatctgagtaacctaagggtccacacagtattcacctcttggctgttgtggaagaagcagttttcgccaccgtcggactacacacccaaaattgcctcgtcggcgtgctggagactagtttggttcgcgtctgttcaagccaaaccagctcaatatgatctggacccgcacgcaggggcagtttggtcactccgcgtaaaatatcgggccccctattgtctcgtcagcatgaatacattattttaatgagcatgatgtttattgtaaataaccatgtaaaaagagtgttttccctcaaaactgagtttgtgtggtgtcttacagttaaaacttcgaatacgtgatattctgtagtaaaatttgccaatttctttcatgttctgccattgttttttatcgaactcaactaacttatgtctaaatattttaaaaaagtttagcagtatgatacttagtttgaatgtgaggtgaggattggttagttagtgacatggaaaacaaagcgcgcgattagagcatattaactattataaatttaaaatattattttattaaaaatcttctctatatatattttttgtgaagcacaccgtttagccattcggaaaatatgctcacgatgaatcaggaagtagctgaacaaataatctacttagaattccctaaatctagtcgcacaattagttctatgaattcttgagttaataatctgatatgacaagcaatgaatacttagaaaaataacaacaccataatccttaagataagataagtagtgactacaataaaagcaataagagttggcaccgccgatgaccgcggcggcggcggtattggcgacatgttcatctaccacacctcattattgtatcattagtcttagaatgtttcatttcgtagctctctacatacactatttgctccattattaaaaaaacacatacattatttgcacaagttttccatgggaaaatcagattggtcttagccgctgtggtgcaaacctgaaactatgcaaggcaggtccacgcctccactagagccatttcagctgcgctgctgattgctgaagcagtgaagctgacctatgcacaccggtttgcctcgtattctctcttatcggatccggttcacccccgcccgttaacccgaaatcacccgaatatatagcgaactttccgtgacacagtggagttaaccaccactccgctaaccaacctcacgagctgagcttaattgatgcgccatcgccgccggcaatggccgccgccgcagtgaagtcgccggagccgccgttcgcgttccgccccgcccgtcccccgctcccgccgctgctggacgacgaggaggatggcgagttcgagttcagcgtccccgcggccgccgccgtgctgtccgccgccgacgagctgttctccggcgggaggctcgtgccgatgctccccccgccaccgcggcgtcccccttcttcttcttccccgccgtgctcgcccccgccgtgcctggaggttcccccctccgagccggcgtcccctcgcgccccgcggtgtggtgggcatcggtggcgcgatctgctcacgctcgtgtcgaagaggacgagcgacggcgaggcgaaggatcgggtggtgggtgggagtccgaagcggcgggaggcgcacgcccagccgctcctctcgcgggcctcgtcgtcttcctcgtcggcctcgtcgtgcgactccgggatcaggaacgcgcggcggccgccgcggacgcgctccgcgccggtggcgagcctcctccacctcatgtccaagaagcccgccgccgtggacgcgccgccgaagcggcgagaccatcatcaccagcggttcctggcccgcgcctcctcgtcgtcgtcgtcctcggcctcctcctcctccgactccgggaggaactcccgcacgccgtggcacccgcccggccccgcgcggccgcggccggcggtggccgccgagagcccgcgggtgagcgcgtccgggcgcgtggtgttccgcggcctggagcggtgctcgagctcgccggcgacggcgggcatcggcccgcggcggccgcggccgagaggcatggagcggtcgttctcggccaatgtgcgcgtggatccggtgatcaacgtgttcggattcgggcatctgttcctgccatcttcgccggccaaggagaagaaggccgacaaggacagggacatcgccggcggcggcggcggcggcggccggaggaacaggccggcgaagctggccatggtgctgagagatccgcaagattaggtggtggccatgctggaaataatgcatgatattcttccagtctttggattttttttgtaacttcttgctgctgcttgatctaattcttctttgtctttcagttgttgtacacttgcactgtaatatactctagatttagaacaacaatttgcaaaatttcagagacacttttggtgaatctgaattcactgtcagctgtaactctgattataaatgcctatgtaaagaaaggaacttgatgaacataaaacattcggtagtacacaaaaacccaactaaaacaaatgactaaaatgagtactggtactaaaatgcaatcaagctgcaaataggatcaaagatgcaatgtcaaatcaaaagctcacaaccactggagaaaatgtgacaccaaagttttgaaatttctcgtcgtcctcgacagtacggtagaacaggaggcagtgactcctcctccccctgctgctggagtgagagaaatgggttgattagcctcgtgatctgtgcaggttttggggctctgtgctgctctgtccccacggttgtaattcaaaaagataaaaatatggtttgaactaaccagttgtatttggatttatttggttccaaatcattttaaagttcacccgtcgtgttttgacacaaacatgaggatctctcggtacttgttgccgatgctttctttggtgccggcagggacatattcttacgaatctatgcctttttcttaaagcgaaaaatgtgcacacaagttcaagttgtgttcttgtgaggtggatcaagttccagttgtcaccatcatcctcgttgatgttagcattatctcggatcggaagccaagcagaggcagcacgactggaaactcatttttttcaatcgcccaaaagcagtagaatactcatctacctaaccaggatttgctgccgttgatggcgacggcttccggcgccgctgtctcgccgccacacgccggtaaatgtgttatatgcgctaatgcgcacaggtcgacggcgttggtggcgccgccgctgaacacacaaaaaaagaaaaaaaaataagtaagatttggagagacatccttccaaacagttttttttaaaaaaaaattataagctattaagaattgaacaagagacatcaggattgaaatcacacaccccgcgttgcttttggacacgccgggactttggcacagctccagcttcagctccagacaatttcagctccacttaaaataggagtggaactaggtgaaactctcacaaaatgaactagaaagatggagctaagtttaaataggtcaataactccactttaaactttttatagctaaatttagatattggagctatatcaaatattgccgctacgtgtttttctagcttttgtgctgccaacgccctggagaagaaaagatggcggagtggttgagctgacgcgtgtgacccgagagaacggaagcgaaaaccgcaacggccgccggcaacaacaactactcccgtattggcagcaacaacaacgcgacctgacgaaacttttcagctccacggaaaggaaaagggatattttcctttccttatttttgggtgatatatcatatgatctctccccggtggtcaacgactccgccccgagtcccgaccgcgtcacgttacaactcacacgcgacgctgatggatggatcacagcagcatcagcctgattcagcgttggatcggcaagcagcaaaaccgctcgcgaggccgtgaccaactgaccaccaccaccaccacatgtacgtccacatgcgcgaattggcgatggaaacgggacggcatcccgttgcggcaacggagccctgcgagagacgagagacagagggccaaagtttggggagcttttgcgcttctcctgaaatttcctgctgccagaaatttcctcaaacggtttagattttcacacaatttctaagaaactgtacttgtagaatgagagagactagagaacatgattccgttagaacatgatattttaagtgacttcttcctggtacctgatagcctagtatcaagctgttacctaggcatctcggcttcgcttgaggcggagagacaccaccgccgaccgcagcggctgctgcttgcatggggcaagaccacggcggcgcagcacgtggtggtgtggcacctagaccacaccttcgagaagctcgcgtcggcgcacctcccgctcgtggcggcggcaccgctggtggacgcgctgcgtgcgtcgcccgccaagccactcgcgctcttcgacctcgcccgccgcctcccgctccggctccatcggcgaggcgcgctctacttcctccacctctcccctcgcatgttcggcctccgcgccccgctcccgctctccctctcgctcaccgcgcccgccaccgagctcctcgccgttgccgcttcccccacagcggcggccgttggctccggcaatcggtggggcgacggcgacggggagggctgcacctcgggagccatctgatttgtgggaggagagtgagggtaggaggaggggatccggattagtatagattttctcttgtagaattcagaagattagttttctagcttctctatatttttatttattacctctcaaaattttaagcttgtagaatttagaagaatagttttctagcttctctatattcttatttattccttctcataattttaagctttcttaataggatcggagtacacgctgctgagacggcgggatggacgcccctgttgatgggtcccaattcgcgtggaatctcgccgcctcgacgacatgtcacggcgccaccacacgacccgccacgccacggcgcagttcgtgtcgcggaacaggaggatgcatgggcctcgcgcggcgtgtgggggaagctgcgaatctcgcgtgcggatcgtcgcctcgtcgtcgtcggcgggtggaaggatttcttggcgcatgcggtgacggcacgcaccctctggcccagtagtactaccagtagggcccaaggtgaaggcctggctgataattgcgcacgttgcgtgatgggccaggcctggctgggctatcaggccgtacaggccgagatttgcaggagccgcaggttttttggctggtgttgccactgccgggaattcggtgccagcaaaaggttcacgcacccgatcaccgtgtgtgcgttcgtgtttttatgatccttttgtatttggacatttctaacacggagtaatacatagtatgtttcatataataagttatttaactttttctcagttaaactatagagaaatatactaatatttttaatacaaaataaataaactatcaaaatatattcaatgttaaatttaataaaactattttggttttataaatgttgctaatttttttctataaatttaattaaccttaaaagctttgactaagaagaaaatcatatgacttgtaatatagaacggatggagtacatgtttcaccgatctcactgcggcagcctgcatgtcccggtggttgcctcacgacagcacgaggatcattactggtctgcctatgatgtcgttggtggagctaaacatcctgaaaatagctaagtattccctccatcctataataatataatatagcaatataggataggacgagacatttcatataacaatgaatctggacatgcatacgtccagattcattatcctatgaaatgttttgtccggttctatattgctatattataggacggaaggagtagtgagttaaataagaattaagaaaagttaatattggtaaaaatcgaacataaaattctaaaggtcgctccggttaacagaaacttcataatttggatctatatctcctctcgggcagtgtgtggtatgcggcagctgatgctattgaggctaaaccaaacaacttcaatgtgcaaatatcaattcaccaacagaaaaaaaatatttcacacaatcaacttctgtatcctaccataaagtttgaggataatttcaactagtaaaacaacagagaaataataacgtttacatgcacgcaagacaaaatgatttacgtgaaaaaacatcctcagcgtgaggagtaaaaacatcggtccactccaagcatccactatagtacaaataaaatattgtccagaacacctagaggcatatcatagcagcatcaaaatcgtcgagttatacacttggcatcaacaacaaccataacaactaagaggtatagcaacaataagcgaagaaatggtagattatatctcatttgttggacctttaagctacaatgggctaagagcaaaaagctcctgcagagagaatttagcccaacagatgcctgtacaattttttttttgagagctctccgctttgagtacaagctgtagtatctgaacatacgtgcaaacgcactccaccacgcacacacacacccctacacgcatgctagacctatcaactatacacacacgtgctaatgagatgcacaaagccacctaagaaccttgtgcgtgacgaggacgtcactctactattgtggcgctggcacgcatgctagacctatcaactatctgaacatacgtgcaaacgcactccaccacgcacatttgagagctctccactttgagtacagagtacaagctgtagtatctgaacatacgtgcaaacgcactccaccacgcacacacacacccctacacgcatgctaaacctatcaactatctgaacatacgtgcaaacgcactccaccacgcacacacacccctacacgcatgctagacctatcaactatacacacacgtgctaatgagatgcacaaagccacctaagaaccttgtgcgtgacgaggacgtcactctactattgtggcgctggcacgcatgctagacctatcaactatctgaacatacgtgcaaacgcactccaccacgcacacacacacacccctacacgcatgctagacctatcaactatacacacacgtgctaatgagatgcacaaagccacctaagaaccttgtgcgtgacgaggacgtcactctactattgtggcgctggcacaggagagctggaaatttatttgggaataaatcccggtgagacgcgcggatgatgatcccagggatcgaacccgcgcgggctgctcgctcaccagcgatgctagccaaccgagcaacgctcggttctcgatgcctgtacaattggtccaattggtccatgggctaagagcgactcgtggaaacgacagaagtcctctcaaacaaaagaagtaaaagaaacaacagtactagtcaaaatcggtcgttggccactgatcactcgctgactcggccttcagaatcatgcatggcggctgatggtggcgccggtcgatcgagacaaaaacgcatgcgtggatgcatggacatgtccccctcctcgcatcttgcggtttgttgcatgtcgcgcccactcgcgcgcgccgccgtcgtggtgttcgtccagtaatccggccagcatttgcgttcagacttcagcaagtactgccactcaggtggtgtttgaaactagggacttaactttaactttagtctctgtatttaaatattaatttagagtattaaatatagactatttacgaaacaaattacataaatgaaacctaattcgcttaataattttttaaacctaattaatccataattagagaatgtttactgtagcatcacataggctaatcatggattaattaggctcaatagattcgtctcgcgaattagtccaagattatggatgggttttattaatagtctacgtttaatatttataattaatttttaaacatccgatgtgatagggacttaaaagttttagtaccatctaaacagggtctcacgttgatgctagactgctagtgctcttgattattgctatattctctcataatcagatgctatggtttgtgataatgacagttttctaatctttagttatacccgtggtccatgatattacctgagctaatgataagtcaaaagtatattcaattgaatccttcctttgggctgcaggaat

SEQ ID NO: 66684 - DNA, 1456 bp, Oryza sativa
cttggtagttgcagaaaagctgtacccgatcttaaatttgaatataccaaacaaacagatcagcaagcgaacttcgttgaaaactactactaatggttattggagtacccggctcgatctatgtcttgttattttcccaagatcgttcaaaattttcagcttggtcggtgaagccaacaaaaattcccctcggcaagttggtacttggtagcagacgacgactaagcaccatgattccgagtcgttgcccttgtttttagctaagcatgcgttgatctgagcagtccaacaagtgatacacagagtttttttggcaaaagaaaccggtgcattgcagttagcacactgcagtattcagatttcagtatcaactcgcctgctgttctggaacatccttccctaactcttagaccagcaattcagaaagtactactacaattcagaaagtacttggaaatcttgatctcaatggcaacaacaatgaacaaacagaattgagcttttacactcgaacagactaacagaaccttcagaaatcaagaattctctggtcagtaaagtgacccaggtctgaacattttggcagtagagaaattttacggttcttaaaaagtacctcaagatatttattttttcattaaaaatcttagtacctcaaaatatttagcatccaaagttaccaaaattttatagtagaaaatatggtacctcctgtactttttgaaatatatgataaattgtccttgacaataaggcaatcacagatgctacaattatgtcggcatggcaaccatatctcagaatttcgatgcaactagccgtaggcccgtagtagcctctgctagagtgctagttgacttgcccgtaacgtaaagccgcatgcatatggtacgcccatctcaatcttctcctgcatatatcgttcccgccaaatttcaagtcaaaacctctcgccaaactgacacctttcgtcaaccgcggactctgaccgaagttgacggctgatgcaatctgttctctatatgcataatgtatttgcgaattgagatttgatcatgtgtttgcgtgtaaaagggagaaaatttgtgagcaaaatggcgcatcgcaattcgccagccatgcatacgcgtggtggtgggctgggctggcctccgcttggccacgtccgttttctcagtacaacactgacacttacaacacatccacactcatccctatagatgtatgtacgtaaattctacacctataagtatcttcgaagattggaccaataaatcctataaatctttggtacttacagtatcggatgcatcgagagatactaaatcttacattaaaaaataggtatcttctaatattttctcaatgactttaaaatcactctacctcgcttagttgcacgcatcgattctttgcatctgtcacgcatgtgagatgccactcaccgagatggctg

SEQ ID NO: 66685 - DNA, 8135 bp, Oryza sativa
ttcccctctcttttgccggggcagcccaagcagagtgctcctcgcactatcaggttgccaatgatgatgacagtgttctttgattagtccatgctaacggccgagcgaaaccaaccgaaactaactatattcaactaaaatcttttcctggctttctgaatcatgcacggtatgctggaagtgtattcaattactagtgtctgatttttaatttttttaagggtatttaacacacgtctcttttccatatggctaagatttcttttctttttctttttcttttttgcggggacatatggctaagatttctgattagtggtgaagccaacctttcttaacattaaccaaagcacgtgaacttgcttctgtcttgttcgtcttgtgcacgctgcacagtccaatattttcagcatgatatcttgtccgaaaattttatactactgttctctcggtgatcaactgatcaagtaccaaaatgactctgaaatgcagtttaatatatattttttgtgtgtgtcagtactagtattctccattgtgcaatcttaattttctttctggcagatatatgaacatgctttaaaccgctcgtacgagaggttagggtttattattggtcctgtgttgattagaaaggtgcctttgtggaagccaggctaacatttgccctgggtcctgggcaagttggtacgaatcaaagacatagagtgtcgtttatacctaagcatgcgctgatcttaatcctgattcctgaagagtccaaaaagtgttcgtcctatctgatggcacaactgattgctgaaaagaaaccactttcaactggtacaaggacaaatttagcacggtggattcagaatataccactttcaacaggtctaccgtttgaccacccctttttgaaccagcaaaggattttacaacagaagaaaaaagaagtccattttactctcttaaataatttcattagatcacttaacgcctaaattacttttggctcattttactcctaaactattgaaattagtccagtttactccatagtagtaacatttttcttttttgtttctctttatataagctagtagtatattttaagctataattttttagagtcatatgataccattatcaaagttctaaaaatatattcattttctttcacgactgttttcttcaacttcataatctcgatgttcaaatcaatcccctaggtacttccaagttccaactcagataaactgtggtatgaacaaaaagtattgagatgtgagatgtatactattatcgtcctaccaaatttcattgcaaaatataacttatacatggaaaaacataaaagataaatactgttagggaataatcaatcgtttttaatagtttgaaggtgtaaaataagcttacgcggttaagccatctaatgtacggaataatagtttgaaaagattaacttttttcggagccaacagaaacgatgaagccttcgccgtggtactgcccagaatgcggccgcgcgcggcatcttggatcgtttggtcacatggaggctacgaccatgtcggcacggcaagcaaacgatatctgaatttcgatgcaggagtaaactctgaatttattggttgcgtgcagcatcgggccgtatggcccccatctcgtcctcgccgcaacggccaacctgccaacctggtgtcctcctatcctactacttcccgccacttttggagtcaaactgtggcctatctcttcacacgttgacgcgaccacgttgacgcgatcagggagctcgttgacttcacagtggattgccacaccattcgaagttctttatatgcacttgcgattttgattttgatttgatcccatggttgcatggagaggaataaatttgcaagcaaaatgtcgcagcattacacgaagacgatttgcattgccgtcgtcttggtggccgtgctgttctcgttgtcgtcggcggcggcggccggctccggtgcggcggtgtccgtgcagctcgaggcgctgctggagttcaagaacggcgtcgccgacgacccgctcggcgtgctggccggctggagggtggggaagtccggtgatggcgccgtccgcggcggcgcgctgccgcggcattgcaactggacgggcgtcgcctgcgacggcgccggccaggtgacgtccatccagctgccggagtcgaagctccggggcgcgctctccccgttcctcggcaacatctcgacgctccaggtcatcgacctgacgtcgaacgccttcgccggcggcatcccgccgcagctcggccgcctcggcgagctcgagcagctagtcgtttcttcgaactacttcgccggcggcatcccgagcagcctctgcaactgctcggcgatgtgggctctcgccctgaacgtcaacaacctcaccggcgcaatcccttcttgcatcggggatctgtccaatctcgagatcttcgaagcctacctgaacaatcttgacggggagttgccgccgtccatggcgaagctcaaaggcatcatggtcgttgacctcagctgcaaccagctgtctggctcgatcccgccggagatcggcgacctgtcgaacctgcagattcttcagctgtacgagaaccggttctccggccacatcccgcgggagctcggccggtgcaagaacctcaccttgctcaacatattcagcaacgggttcaccggcgagatccccggcgagctcggcgagctcacgaacctggaggtcatgcgcctgtacaagaacgcgctcacgtcggagatcccccggtcgctccggcgttgcgtgtcgctgctgaatctcgacctgtcgatgaaccagctcgccgggcccatcccgccggagctcggcgagctcccgtcgctccagagattgtcgctccatgccaaccggctcgccgggacggttccggcgtcgctgacgaatctcgtcaacctgaccatcctggagctgagcgagaaccacctgtccgggccgcttccggcgagcatcgggtcactgcggaatctccggcggctcatcgtccagaacaactcgctctccggccaaattccggcgagcatcagcaactgcacgcagctggccaacgcgagcatgagcttcaacttgttctccgggccattgccggcggggctcggccggctacagagcctcatgttcttgtcgctcggccaaaactcgttggccggcgacatacccgatgacctgttcgactgcggccaactccagaagctcgacctgtcagagaacagcttcaccggcggcctgagccgccttgtcggccagctcggtaacctcacagtgctgcagctgcaggggaacgctctgtcaggtgagataccggaggagatcggcaacatgacgaagctcatcagcctgaaactcggcaggaaccggttcgccggacatgtcccggcgagcatctcgaacatgtcctccctccagttgctcgatctggggcacaatcgcctcgacggcgtgttcccggctgaggtgttcgagctgcggcagctcaccatcctcggcgccgggtcgaacaggttcgccggccccatccccgacgccgtcgccaacctccggtcgctctcgttcctggacctgtcgagcaacatgctcaacggcacggtgcccgcggcgctgggcaggctcgaccagctcctcacgctggacctctcgcacaaccgcctcgccggcgccatccccggcgcggtgatcgcgagcatgagcaacgtgcagatgtacctcaacctgtcgaacaacgcgttcacgggcgcgatcccggcggagatcggcggcctcgtgatggtccagaccatcgacctgtcgaacaaccagctgtccggcggcgtcccggcgacgctcgccgggtgcaagaacctctactcgctcgacctctccggcaacagcctcaccggcgaactcccggccaacctcttcccccagctcgaccttctgacgaccctgaacatctccggcaacgacctcgacggagagatccccgccgacatcgccgcgctgaagcacatacagacgctcgacgtgtcgaggaacgcgttcgccggggccataccgccggcgctggcgaacctgacggcgctccggtctctcaacctttcgtcgaacaccttcgagggccccgtccccgacggcggcgtgttccggaacctgaccatgtcgagcctgcaggggaacgccggcctctgcggcgggaagctcctcgcgccatgccacggccacgccgccgggaagaagcgggtgttctcgcggacggggctcgtgatcctcgtcgtgctcatcgcgctgtcgacgctgctcctcctcatggtcgcgacgatcctgctcgtcagctaccgccggtacaggaggaagagacgtgccgccgacatcgccggcgactcgccggaggccgccgtcgtggtgccggagctgaggaggttcagttacggccagctggcggccgccaccaactcgttcgaccaaggcaacgtcatcgggagcagcaacctgagcacggtgtacaagggcgtgctcgccggcgacgccgacggcggcatggtcgtcgccgtgaagcggctgaacctggagcagttcccgtccaagtccgacaagtgcttcctcaccgagctcgccacgctgagccggctgcggcacaagaacctggcgcgtgtggtcgggtacgcgtgggaggccggcaagatcaaggccctggtcctcgactacatggtcaacggcgacctggacggcgcgatacacggcggcgccgccgcgccgccgccggcgccgtcgcggtggacggtcagggagcggctgcgggtgtgcgtgtcggtggcgcacgggctggtgtacctccactccgggtacgacttccccgtcgtgcactgcgacgtcaagccgtccaacgtcctgctcgacggcgactgggaggcgcgcgtcagcgacttcggcaccgcgcgcatgctgggcgtccacctgcccgccgccgccaacgccgcggcgcagtcgacggccacctcgtcggcgttccggggcaccgtgggttacatggctccaggtaaaagctacttcctccatttcagattataaaacgttttaactttgattaaggttaaatcgttttaagtttgacgaagtttatgaaaaaaaaataataatatttttaactcacgacaaaattattataaaaatatattcaattattaatttgataaaactaatttagtttgtctataaacttagttaaacttaaaacaggttaattttgatcaaaattaaaacgtctggtaatcggagggagtaccaaactaccaatccaaccatttcgtctcagtgatctctgaactgaaaacgtctaactctgtgctgaaaaaattcagagttcgcgtacatgaggacggtgtcgacgaaggtggacgtgttcagcttcggggtgctggcgatggagctcttcaccgggcggcggccgacggggacgatcgaggaggacggcgtgccgctgacgctgcagcagctcgtcgacaacgcggtctcgagggggctcgacggcgtccacgccgtcctggacccccgcatgaaggtcgccaccgaggccgacctgtccacggcggcggacgtgctcgccgttgccctgtcctgcgccgcgttcgagccggccgaccggcccgacatgggcgccgtgctctcgtccttgctcaagatgagcaagctcgtcggagaagactgaacaaaaaaaaaaaagaagagaaaagctaaactctcgctgcaattctgcagaatgcagcagcgaaaacgtgcaaatttcttggaagattcagagttcagttcatgatgatctcaaatggtttttcgagttgtttgcattgcgaactttctccattgatgaggtgtactgttgctactgtgcatggtcaaggagccgttcgtgtgagcttactgagggtgtgttagttcttcgggagtaaagcttttgaattatacagacacatatttgaagtattaaatgtatactaataacaaaacaaattacagattctgcctgtaaactgtgagacaaatttattaagactaattagttcatcattagcaaatatttattgtagcatcatattgttaaatcatggcgtaatttggctcaaaagattcgtctcaaaatttctatgtaaactgtgcaattgtcaaatcatctgcaattctgcacaatgcagcagtgaaaacgtgcaaatttcttggaagattcagagttcagttcatgatgatatggtttttcgagttctttgcattgcgaactttctccattgatgaggtgtactacttatttgctactgtgcatggtcaaggatccgttcgtgtgagtttgctgagctgaattaattgcgaggaacagtgcaggtgcagtggttaggtatcaatctcgcccatgctgcctgaaagcatgggtctgaagtggtaccaaagtttctgccttttgaccctcccaaaactttcagagctgcaacatacctgtatgcgcaggccctgcaggtgagaatggaagctgaaagattgaaagattcgacggagctgaaaacaatatattactcgagctgcatgagtgcgaacaaaagtggtgaactcatcacaaacatgttaacgtgaattatggcttctcagatgtagatgtgtcttttgaatccccggcagtagcttgttgctgggcagaagaatgtctcctgataactctcatttactactactcaagattaggtgcagataatcaatgccagttttgtcattacaatccgttcataccacaagtacatatttagctaggaaatatccattgctgcaattctctggagtacttgattaaattagccatgttgatttgcttgtcagagcacataagcatcagcagcaggaagtagactgtctgctaatatacagtacagagatcacaaaaacgctttaggtcttgtatgcacagaacatgacgaggaagcaagatcaggatcaccactatttattgacgtacaaaattaactagttaactgcatgcagtagattcatcactccattgagcaacttgtttcatctccaggaacaccatgaactgaatgaaggttatgcagtctagagtagtagagtctagactgcatctgcttctggatctcttagtaactcgtcaggtggtcatcactccaagaagttgtacgatgaattcctctccgtgatccaaccgctgttgtggccactgctactagctagacctcttctctgctgctcctgcattagggatgaacaactactcatcagccatgacgcatagcttttttttttgaacgaatcggcaagctgccaatttcattgaatagagaaggagtaaactttacaagtaagaaaaaccaggcccaggaccgaaggtcctactgagctaaaaataaaaagcaagccagctaccaagaatgacgcatagcattgttcatgtgcagaaagtctcctttttctcaagcacttatagtacatgtaaatacttttctgaagtgttaattagtacatatcatgtaacaatcaaacaccatagacatacataacctcatatcaggaagataaaagctgtactaataatggcgataaaggagtatatatggactacgtaccggcgtgtacaactgcaattttggtggtctgaggaaattttgaggtggctctgaagggtgcaaattctgcatctggctcaagaaatccgactcgacgttagactgtctctgttgggtggcgtgggttatctgaaatggccgcggctcggaggggcgtatgggaggaatttgagaaggatcagctgtgatatagtgcatgtattgttgcagctcaggaggaacaaccggtgccattcccttccccatgaccagcatctgtgtgcatgacatgattatgatcagaaatcacatgaaataaattgcatcacttgatctctaccacagtttcagatataacttgcataaaaagatcaggtcttggttctaataaacctgatcatatcttatgtttgatgctatttgtacctggagttgtagttggagtgatttcaggtagtcgatcgcttcatccagcatcgaaactttgtcggtctgaagaaacaa

SEQ ID NO: 66686 - DNA, 4530 bp, Oryza sativa
attcctgcagcccttttcaagaatatattcaccttcctggaaacaagatgtgcaataacagatctaacatttaaagataacatacaaacaagaacaatggtaaaactgtctgaaacgtatgaactactcctaagatcatcagcagagataggatcatgttcttccttgtcatgcatacctgagttttggtgtctgctcttcttcttggctagctgcctccttgccttcacctcctccccttatgaactgatacaggctaccaatggctgctagctggtccagccctaagctggcctagagatggagagttctgagagctttcttggtgacaagatggtctcctcgacccaccaacctttagctccagggatagtagtatttatggcatctgaattctataagcttttgcaccatggcatgcagggtctgcgcactgtagttatccttatctttttcactcaccggccgtggaatttcttgtttggatcgatcgtcagcctctaccatgtatctgagtctctgatgggactttgtttacgatttttggagaggcgcccataaggtcaatcatttcacctaccttgctataggtgatggctctaacttgacttgcaaagaaagagttcgtcaaggtacagtactatgcatagattgtttcttcagagttcagagtagtgagggctttctgcataaagacatatacagtagattagtaaatgttgagagaaatcatgactgatgaatgtgaaactagtatgatgtttgtcctactgtaatctgtaatccttacatgcatatgttgttcagcaatattttttttgaacgacctacaccagacattgcgaagattcattgaataaagtaggaaaaaaaattgcaagactagaaccctgggatgcaatagccaggaaagaatgaagaaataaccacccccacgcgccgacaacaccttcacacaacccaggagaaggctagcactggacagaccgcgctagaccaacaaagaaactacaaccgagatcgcccaaaacccaaacctaacaaccatgaccggacaccactctatccacatctttggattgttcagcaataatttcaattatgattgaggatttgttaatacttgggtattatctgaaaaatttagacatgattcttgagctgctaaccaccaacactgtttgctcataaaaccgctaaactttatttttagataatgatagaagaataaaactagtgacaagaaaattgctagtaataaaaatgatagtctggttctggaaaatttgaagatccaagattaattagcatctgattggctgctcatgtgcatcctttatgaacagatgtgactactgacgatcacaattaaaaagcatcgagtagacatgtgcagtgaggatgctggctgctgctagtagtgctagtacctaacatgatgagcagctagctagcaagcagcccatgcgttatttctgaacacaaaaccctcggaaccagaagaatgcatggtatggtgaagcaaattgaagcagcaaagaaacaaagaacacaatcttctcctcacccctaacccctacacacatacaattctccttaattaattcgatcgacatcgatcttgatgattccctgcaaaaccaagagataactttcatcattacatatatacattcaggtgaagaaattctgacgatgatgtggtgaggtgaggtaattaagggtgagctagcatcgtcagcggaaagggtagagtccaagaatcgcccatgccgctgttgcgagggggggatgaggtggaagacgcaggaagggaacaaaggaggcagtcacctccattattttggttgctttcgtagcccgaatgcagcagctagtagaggccaactcctagccctagccctcctcctactcctctgcaatggtagattgcgccggtgactgcacgcgcgtgcgagcgagcagccgagcatgcgtactgccaggttcaggttcggtgaccacgctgacaacagacagattccggcagccaccgcgcgcacgcgtgacaacgcccgattcgctgcgtgcgcgactcgtcgccatcgccatcgccgccgccgccgccgccgcaggtgggcggtgcccgcggcggcggcgttggttagttggttagggccgaatagatccgcgcgatatgggccgattcgccgggaaaaattgggcctcctcgaggagactcatgggccacgttagggtggagctgaactgatgggccgaactatgtatggttgggccggggatgggccgacgccgcgcgaatctcgaggaggaaccggatgcctcgttctcccttctccgagacgagatcacgagacagcttggctgctcgactcaacgcagcacacgcaagaggagtcgtgggagtccaggagaggaggcggaggcgcggaggagagaggaggaggaggaggaggtggttggtctccgccatggcgagctcgtcgtccgaccccgacaagctcatgtccaaggccgacaagctgcaagtcccttcatccccccatctctctcgcttttctaactccagatgatccgcgagcgccccatccgatttctgtcccttgtttttttagattacggatttttggcgtattttctgtgaatgaggccccttactcgagcgtattaagctgcgccctcgtcaaattcatcacgtcgtagttggcgaatgttagattttgcgttttggatcaaggactgggaactcgtgtggatctgtacctgatctgtagatgggggcagggctaccgttcctatttccaatttcgtggtaccgatttaggattttctcaggagaggaattgcctgtcagtttagttttagcttagtttgtttggtgcaaatttggtgagattttattcaaggtcatgccatgttttggggggaaaggtcatagaagcgagcgcggacgctttgttttgcggcaattttgtttacatatgtgtgctgtgtgggagttaccagcagactttatctcctactatgtagtattcgattttctgttcaaatatcttcagaatacagaatgcaagtacgatacttgtgctacctgtatcaattcagcagtggatgtgcttgtctgtgtaacttcagaagtggaaaatcagccactcgtcatcatttacagtattgttcagaatggatatatgtggtgcaccattgtttagacatgcaaactagagttcacttccagcactcgcacagaaagattacttctcaatgtgtctgattgggatatcttgtttgctctcgttttcatgccagtgcttttgagttgattttgatttaaatactgtcattgttttcatgtacttcctctgtttcgcgttataagacgttttgggttttaaatagattcgtgtatgatccatgtatgtgcttcatatgtatgtcaaaattcatatgaatgttagtgaatctagacgagtgatggaggacccaaaatgttctaagtactctctgtcttaaattgctcccagttcatccacttcagagttagctatatgctaaatatgaacattccttttgcttcgcagaacaaaattgagcttcacgagatggaatgccgattggaagagtgctacctccttgtatgagcaagctggtccgttactttttttgccatgttctattttctttctgtcaatttgcttccctgtggtgtatatgacagaactttcatatctactttaaagctattgcttataggttcaaaaaggagaatgagaaagcaaaggatgcctttgagaaggcttcaaaaggacaggaaatgatttcttcgtatccttcagaaaaaaaatttatagctgttgtattttcacatgattgaactatcacttaatgcacccttaactagtttaatataccctgggatgctgctaaacacatggaatctgctggtgctttagcgaaagagcttggacgctggaatgaagtttcagatttttatcgcagagcatcagaattctatcgtgaatgtggaagagcacaacctgcctctgatgctcttgcaaagggtgccaggtaattcaaaagaaatctgaaacttacgtgaacattgtgaaggattattgttctaacttgatgatatcagtttcttggaggataacactccagacgaagcaataaaaatgtatgatgaggcctgttcaattctagaagaggatggaaaggaacagatggctttcgatttgtatcgtgctgctgcaagtttatatgtcaagctcgagaagtaaggatattccaacatattccaacctgcttaatatttgtttattatattattcttctttccattttttcttttacggatagtttttaatctttttctttcttgctgggtaagttgtcattgtagaaggaattgtcaagtaaaccaataatatttgatcctttgtggcacttgctttaatatcgattatatgtggactgtctctgttttgatataatcacttcccatctcacacttctcattaattacaggaagtt

SEQ ID NO: 66687 - DNA, 6078 bp, Oryza sativa
agataataagaaacttccttgaaattgtaaatttgtttatgaattccaaatgggaatggaataaatattgattatccatgtaagcattatcgaaatttgagcaataaacttatctgattctgtaattgttacttttaatatgcagggctatttgagtgcaatcatcatctacctttatgcccatgattttcaacaagctcagaaatgttacaatgactgctcagagtaagttgtacattcatggtagttactatcactgtaaaagttggtacatgtgcattgccattgatatattttcttgcaccaaagcccaaacatcactttcattgttattaccttctgctacattacagggttcaagccttccttaacagtgaccagaatcgatgtgcaatgaaactgctgtctgcttatgaggaaggtgatgctgaaggaatcaaacaggctgcacaatcaagtgccatcaaacaccttgaccatgtggtaatattttgagtttcttagttacaaggccatccgatatctgaactatatataccaggctgttatttcaatctccttatacgattagacagattggatagttagtatgcgtaaaacagtgtgctaggagctgaggcgttacaggttgaagatgttactcatgatctcttttttagtcaacattaccgctctatactatattgattcctggatcatttgattaagcagtgatacctcatcaattatcaggccatcacttatcatcataccataggacaaataatagtattatcagctaaaacatagtctgttccatctaaaatgatatctgctcgattgttcgtgtgcttgttcatccttcttcacttcgatttatggtgaatattactgcaggtaattcgacttgcaaagaaactacctacgggtgatctgcagaccatcaagaaattggcagacgatgacggcgaggattctttggacgagaatgacctaacttaataccaaactacccgtaccgggagacgctgagaaagcaaatatttgaggttgactcatgttaccgttgatgaacatgagcgatttgtaaaaagaagatatcgatgtacacggtacaaagtacaaacttgtgtgaggcagtctgtatcttgatatttatcatgctcagctcaactgtcatatctgatttctgcacatatacatcctacattgtttggtttgttattctcgtgcagcttgatctatctgtacttctataccgatgtactacgagggcaaccgaaccggctgttctgttgcgattgtattcagatggcgaaactccagccagttgtggatttggatcatttgccgatgaattacatttgttttagtacttgattagtgtgatcttgttactgctcactgtcatgagggtctaggggcccacatgtcagtgaccctcacttgcatgtcatgggggtctgagggtctatgggtccacatgtcagtgatcctcacttgcatatgtggagtgcgatctctctttttagatctttttatgttttaattttattaatagatctttttagaaaatatttttgaaaattgaacattttggccacccagccgagtggctggcggtggtggcgtgacaagaggcttgcgtggcagaataacactaccaaaccagctacgcgtgacgtgatagagttatttggccatgtcaggcaggctggtgtggccaaaaagtttagatttgaaaatacttttgggaatgatctataaataaaattaaaacataaaaagtctaaaaaaaataataaaaaaatccgtgattgaacactagtcgaaggtcacaagatggttcgaaactttgaactccgaacccccaatgacggtattgctatgagcaatctccatggaacgctgaattttacgactagttgggatctgctaatacaagcaactagtccaatcggttgtgtctggatgtgtcaatgttgattgtgtattaattcgtcgatgaacttgtgaaatctaacttcattttatttctaatggattttttggatgaacttcatcttctctctgtgtggactctggggacgttcaatattgattttgtgattgtgtccttaggtgacggggatgatggtgaactcggggggagcttggtgattgagatcgatctgctcgataaatcggctcgaaaacctcaaaagtgtcagttccgacacatttattcctcctcacactagagacatttgccgggtgtcggttagaaaatctggtacctattgagcggacaccaatttatctttttatattagtgttacctatatttttaccacatatcaacgtgtatttacgattcatcgttaactgcaaaagattaaggagagctgacacgtcataaaaagaccgatggttttcacgtaaagaacacaccacaacgatcctctcaaggactctctgctttggtacacaacagagtattattactacctctcaacaacaagcttatcttaaaaagacatgatgatgaagagagctatggagatttgttgttgacgacggagttgcgagcaggaggattcccggggacgatgggcggcagcggcaggttgggtatcggaggcggcagcaacgacgccttctcctcgccgactccaccgcctctggtggcctcgcttcccctcagctgtctcctaccatcgcagggcggcgcaagaagcagcaggacgatcgacgccgctagcatcagcagagcgacgacgacggagagacgacgattgtggtgcttggccatgactgctgctatagctttccactgttcggcgaattctttcgctgtgggctgtgtggctgcttagcttgatttgtgtttgcaactttgcatgggcatatttataggcgagatggtgcaacattgcgaggatggagcaggggtgtcgtgtcgatgtagtggactgccgaggagaggaaaactgagaagtgaaggcggcgactgcgccgcgcgtcttctagcttggggaagtagtacgtgtacgtgcatgcagtgcaggggcggagtcacgggcgcgcgcgggggagggaggtatggagcgcggcatgtgcgcgcgcgcgggcgccggtgaagtggtttgtccgtggtgaaccttggggcgcgcgcggccgcttcggcgccggccggtgggagtggggattacacgcagactacgcagttacttccgcaccaatccactgttcgccacgtcgcagattcatcagacctatggttatgcaagcactcatagtgaactctttgtgtgcacagcccttttatcgttgctgcagcaagctcagcgtcgaaagatacgcaagccttatgcgtattctaaaaaaaaaataatttgtgcagaccaacgaataatgttaaatactttattagctggacggactacggagaccgaccttagctcagttggtagagcggaggactgtagtgttgcagattaatccttaggtcgctggttcgaatccggcaggtcggatttcttttcatttttctaatactattttttaaaattctttttacgctttccgcaattccgcatgtaaaaacgcaaacgttttgaaatattttattccattttacgttcttcctatgtataaaatgcaaacgaaaccagtattttattcccttttacgttcttcctatgtataaaaacgcaaacgaaaccgggagggagcccacatcatgctatgtataaaacgcaaacgaaacctcaccgtcacgcggtcacgcctcggcagcagcagaggcaatcaaacgacgcgccctcaccgtggcgaggccacgagaggacgcggcgggcacgcgcctgggccgcggcgctttgttggggcggtggaaagtggaaacgcaaacgctgactccgatcgacctatggtaaaatttcccatggaacaacgacgacatggacacacacatgtcgtctccactgacctctcgcctcaccgcgccgtcatcgtcaagtacgtcgtacactcatactcgtactttgaaccatgacaacgacgacgacgacgacgtacgcgacgcccacacatctggtgctagagtttccgcgccccttccaaacaccttcccccgcggcgacgacggcgccgtcaatctcgcgggagaagctagcgacgtgcgctcctccacgagcggacggcgacggcagatcacaccatcgttttttgccggtgatttcaggctttcagacaaacagaagaacctttgtacgtactcaattatggtagtacatagctcggcttttgtgagatcagagtctgtcactactcactaccgatgacagaagaggaaaattcaggaaaaatgtcctgtactatgcaggacttacgaatgtggctaccaaacccttcccctggcgagattataagatagtaacaccggtcactctcttggccgcagcagccaggaagctgcaaatcatgtgaaaattaaattaccatattaacgtgctttgctacttgctagtatactagaagcaccaaagtccaaacctcccgtcgtctttcacgtattcttgttttctcttcacctcaaaccactctcagaacttggaagcaatattaattgcagactgcatactgttgtctgctttttttttttcttagaagttacctgatgataaaatcatataatatctttgtacgtagtatgaaataaatcaccagatatataccaacctgctactatgaagcttgtctggtcaagaactcaagaaatcgtctgaaaactttaatagatccgtctcttttacatgtcaatcccgcagcgccttttctgaataaaaagcgcgcgagcatccgcctcatcatatggcttctcaactactcccttcgttttaaaatgtttgacgccgttgactttttatcaaatgtttaaacattcgtcttattcaaaaaatttaagtaattattaattcttttcctatcattttattcattgttaaatatatttttatgtaggtatataattttatatatctcacaaaagtttttgaataagacgaacagttaaacatgtgctaaaaagttaacggcgtccaacatttcgaaatggagggagtagtaattaactaatttgttgatcgtggacaagtccaatgccgcaatgcgaagctggaactaattaaaaagggcaggtttccttttgcaagattgggaagtatccgagaagcactcgtcgcgtgacgacgccgaaccggcgattatctttcaagctcgacgtaaattttcgaagataatactactatggtttcaagtgcaatttcgggctaaattcccatgcggccatgctcacacacctctttccacctcgctctagatagctatagctatatagacgactgacacgacacaagctttaacttggctcgcgatcccgcttctcgcagagcttcttcctcgtggccgccgctcgccgccggcgacgaacaatgcgccggcaaccagggcgcccctaccaaccgcgaggcggaggcggcggggacctcgtcggcacgggcttcgcgacggtgctcacggcggtgtccttcctgaccctcaacaccatcggcggcggcggcggcgaggggggcggggcgccgccggtggaaggagccgagcagctgcagctcgtcctggcgtgcgcgatcctcgcggcggggctgctgttcatcatgtacgggatgcgggggcgcggcgccgccgcgccgccgccgccggcgggggcggtcctgttcctccgccgcgccgtggacgtggcggcggcggtcctctggaacgccggcggcgtcgagcggccgctgccgacgccggtgatggtcctgctgctgtgccctcttcttgcagaatggctcggtttcgtctgaacagcgaggcgcagagagagacagcagatcaagttcagggtaaacgtagccctttctttctttattcttctcttctcttttcgttttcttcagaatacgcggtagaggtgcttaccattgcattgtttgttcttctcttctgaagaactgtagttgcgaataacatgtagtacataattaatcttctctttgaagaagtgtagctgcgaat

SEQ ID NO: 66688 - DNA, 2646 bp, Oryza sativa
gctgtccagttcagctcgtcatggattttggatgggtcactgtaaacttcagcatagtctcctggtctccgggtaaggaatgaaaccttgatgctagctcctgttgcgctcttacatgcttctacaaactccttcactgatctacctgataaaatcatgagcaaagcacaatcagaaacaaggaaatacatgcagagaaatgagtacataattgtgcatgtgttgagatgattagtgatatttttaacaaccatgtcctgtgccaacattgtagattccaactttgccaggctgagctttatcaagagctttcacatgagcatcaacgagatccgtgacatcaatatagtcccttatgcaagttccatcagctgtagggtaatcagttccccgaacctaaagcagggtgaaagtcatataccatagtatgttaccatgtgaaaagtcaggacacatgctgaagtgagcatgttcagtaccttcaaacctggaatgattcccagtgctgcatcaaagcaagcaccagaaatccgtccatgctcacgcagctctggtcgtggagcttcccctaaccgcccccctgggtctgatccaatgacgttgaagtatctaattcaaaagaaaacgaagtgagttttctctacgaattaaattttagtataggctataggagaggcggaccttaagatcatgactgccatttctgatctcttagagaaatctaaaatgatgtcctctgccatcttttttgccttcccatatggattgataggattctgcattggttaaaagattgtctagaatcagtgaattgtgcatgatattctttaaactttgagataagaagtccatgcattgataagccaacctgaggggttgcttctgtgataggcattgtgtcaggttcaccatatgttgcacaagtacttgagtatatcagagtttttacattatatgctgccattgcctcaagcactgtcaatgtatttgatgttatgttgtggtagtacctgttattgcagtattagcacagatcatgtaatagtaacagcattaacaacagattatttctgaaggatacaaaaaaggaaaacaaattatcaactaaaatcacatacatttacattaggcagtctttcacactaatcttcacagttcaaattgctcgtgccaaaagtatgttatcggcaaaaaatgccaacattgaaaaagatggaatgcctatattttccattttcactatatagtatgttttcaatatagattgtcatgtttagcagttttgtttaataatagagataaccaagagcagtttgcattgctctgaacacatcaaaggattgcacatgaacatgcaatatataaataaccaccatctatgtaacatgaatacaagaacattagcacatcaatgccttacctcagtggctccaacgtgctctcaccaacgtaagcaacggcagcaaagtgcataacagcatcgaatgcattttctgaaaatattttgttaacctggctattggttaagtgcaaaacagatcacaccaacacatgaatgtatggaaaaatggctataataaggtattaaagttcacattgtagagaaaaaggatacagctttcgcatcgcctaaatcagcataaataaactgaagcctcccaggctctggaaacaaacgttgaaggactctgacagctcccatgttccctctagaaaggttatcctgtaaagatcacatggaagaaattgctgtaacataaaagctctttgagttaggaataaaaacatgaagctggaataagaaatttaccacaatggtaactcggtagttgtccctaagtagacgaagagtagcatgtgacccaatgtatccagctcctccagtcaccaacacatgagtcacaccaatttcatggcgagagaactatagagcatgtgaatgtatcatgaaaactagatcagatgacaatctgaaatgcttcacaaaaacagctttgcttccaatggaattatgaatgtgctttattggaaactacgatggtgcatagaaaataaccactactagcacagaacacagataaatgaacagtgaattcatcaaatggaatggacgatcaatgtgtttctttcaatcatgttaaaggaacctctttctgtcagacaatatgcgattgttccaaatgaaacttacgtgtcacaattaaatcaagtttgaacaatacaacaacgagaagtgaggactcaacagcaatcaacaattcgacagtgaagtgggctagttgtggagagattcggcacttaccacacttgtactggtaaaaccaggcgactgtttcaacacaatgatgcacatgaccgtgagtgcaacagctacggtgaacttcccgacgacattaggcttgcgtctagaatcaccgaagtccatacctgcaaatgtgacttggcaaattaaaagttgtaccggcaaattcgggtgtaaattcagaatttcctgcctccaactctgtactgaaagccaccacaaggtgtacaacattcacccatttgaggaaatcagtattgcatttacacgtaagtacaggttagaaaaaaaattgctagaaaatttgatcgggcatacacacagtcgaagctaaaattacaaga

SEQ ID NO: 66689 - DNA, 2394 bp, Oryza sativa
aaggattcctttggaacgcagcacctcacgggaatcccgtaagcaataagaaccagacaaaaattcccgcgttgcaaaaagaaagtcaccaccagtccggacggatctccagactaaacgcaagcgggagagagaccgagagagagatgcatgcaaataccttcaccttcaagccgatccgaaccgagaggcgcagggcggtggaatgaggccccgaggcccgaggcccagcctgctcgccggaggcggccccgcgcagcgtggagaggctagctcggcgacgggaaggaggggaggtcgaggcgggcggcccgttcgccggagcccccgcgggcgaggcggcgacagagaggcggcggtggctccggctggctgcgcagatcggaggagagagagatggcgagagaggagaggagaggagagggaaggagagtaatagacggtggcgcaacagtttggtccatttttacttctcgggctttctttattttcgaaattaacgtcgctgtcagttactcggaccctacgtacagtacagccatgtaggggaatttttgaaaagtcaaatttgtactccctgctttgggactagattttaatcagcaattactatagattttgtatcatagatttaacgttaaatttgtaagaaaaatatatttaaaactaagtatcgtaaaactataatataaatttattgttgaagttatctagaaactacatattttgaaggagcttaaatttctagtactaatgttatgttggtgttataaacattgtagttttgtgattaaatcaacactaaatttataggttttgtgataaatttgctacataatccgtagttttgtcatatttcatcttaaatctgttttgtgatagtttgatcaaaatatcttgatcaaaatagagtaaatttactctacttaaaaatttaatacaaatatagaaaaatataagttatgcataaattacatttagtgatatcgcaataaatgatactcgtatagttttttaagaagacaaacagttggttttataggtttaaaaatatattttgtgagcaagtaataaaggtcaaattttgataataatgttctttccattcttgacatttaaatgaataaagaatacacctagcgtcccgggtttacgtagggattcaatcgtagaaacaactttatgtatttccaaaggatctacagtttgcttgcgagcaatatctacgcaagaatatatttttagcttgccatggcaacgataaataaactgataaagccatcaaatttgtgcaagtcaaagctccacaattctgccacgctgctcctgcgattgcaaggcgccttcctcacttgttttaccttgccgaccgattcgtcagtgcaattatgtgtggtgctgcctccaataaacacaggtctctctgaattaaaaatacagtaataataatctaccagtaagtacttcatcagtaaaaatactaaacaacaccaggaatacgattcgaatcagttcctaaatacgatagtataatgattcaaaccaattacgaatcaaatctggatacatcggtggatcaagtgtcagtattttgtcggtgaaaaccaaccataaataaacacgaagaaaaaaaaaagaaggatgatgacagaagcctacaagtataaacgagcactgctgggtcggttgattgattgtttcagattggcgcgtgcgcagagagagagatggtcaacactttcatgccaagagattttgagattgtacctaacaattcctacttaaacgtcagcacttgaatttcttttccatccattacatctgtttcctcctctttttttcttctctatttatttatttctgggaatcttctgttcttgctctctgattgggcttcagctatgcatgcacttgcaagagtatagatcgcatcctgcctaacttgctgcaaatcactcgtttttcatttagtttttgatggatctttgtgcgtttggaggaactgcaatcaaggagaaaatttggtcaggctcaacagtttcagtactagtagtggtactaatggtcatggggcagaatggcagatggcccacctcagaaacagtacacgtcttatgatgggctcattgaaatgatgaaatgttcatgttcagatcaagaaaatgattgatgcatttgataccgaagttaggtaggaggaaacccaaccaagccgatgatagccacgttttcagtggcgaccaggctgaaatgatatgggttaaaaatgaaggcgaaagcagccaaaacctgaactttccagcaccagagcaccgttcattcacctgtctgattcctgcatcatgtgctggtctaaattgatgcacattgtgatgaccctgttgtcatgtgcag

SEQ ID NO: 66690 - DNA, 2397 bp, Oryza sativa
atcaaaagttaatgagacaggagaaattgtaagactaaagttagctgtaataggcaatagttctgtacttctgtaccagcactgtactgcaagatatgcaatttttattcaagatttctggtgcggatagttgactaatcatagtttacaatgtcaaagtgtccaacacaaactcatgattatttttagtacgccgtacacattagtcgcttttacttggtgcaatcaactgaccaagtcatctcagactagttcctgatcaaccaatagacaactgttggtttgttgggcaatccagagatgcgaattgaacatatagatatgcatgccatgcccgataagttgcttcgtgcaaaaaacagaagacaggcaatttcttgctcatgcaaccactattatcctttaatcctgactcctgaacttcacttcttcatgaagttacttctttaccgcaccagattcttttccttatagtacaccctctgaaaactgtaacaaaaaaaaaactgggtccatcattgtgattgaaaaattttcaccacttacagttcaacaagactgtgagggtctcagatgtcagtgaaacccaggaaggcaggaagataggtgtactggcatgatggatggttcaacaatcacatagtaaaggaaagaggcgaaaaactattttgtaaacactgttcccagaaagaaacggtatggacgtgaaaaaaaaaagcaatatcataagatgtaaaagacaacaaaatacctcatcatgtgcatctttcaggttgcatgcatgaaatttaatggcaagaaggtccagattcagaagaaaatgatgggaaggccagaaggcaagactataagagtgaagatcagctgcaattatatacattctcttcagatatttcacattttcaatctcatagtggacaaaagatagttactttttgtaaataattatctaatctcacaaacttaccaaaacgaacaatacctttcccagcttcacacaatcccgatctatattagatcctgatcacatacagccctagtgaaaaggtcttggccattataagaccccaatagtaccaagctaccatatcagaaatattactatttgaatatttgagttgttccataaatcactggcatgagaccacaatctagcacattgatgtaacaagttttgtccaagtacccacccgaggaacgaaaccttgctccaccatttgcttcaagacaagatgcgcgtcgtctaaacagtttacactacagagtccatctatcagtaacttgaatgatgagaaaccgggcctcatacgttctgccctcatcatgctaacaaggccctttgcctctacaaactttcctgagctcaaaagaccatcaagaagtacctgatatgtccctgaattgggatagcatcccttaggaaccattgacttaaacaaattgaatgcctctgttaccctttgttctctgcaaagaccagcgatcaaaatattgtagacaactgcatctgcaacaatatcctccttctgcattctctcacaaagctcgaatgctttgtccacctgaccatgttgacagaggaaattcatcaatgtagagtaggtcgtcacattaggcacgcaaccttgcttcggcatctcatacaacagcgaaatcgcatcgccaaatttgccgaactgacacaagcccttgacaagaatattgaagcagcaggtgtccaatgtcactcccaaccttgacgcgctcaagtagacctcatggacaacttcgtactgcctcttacacacaagcatgtgaagaacatagttaaaagtcttggtcgacggccaacagttatacccgggcatcgcaaagagagtctcgattgctttctcgggatggttcgccacattgccgtacatcttgatcagcctgtagaagaactcatcagaaaacctgaacctctcagctcttgccctggccagcaactcctccacatcactgaacctcctgcaggatgctagcctgtcgatcatcatgctatagagtgcctcattgggcttgtaatcccttctatcacaagctctcttgaaggaactggtaataaggctaggatccctgatgttcgcgaagatcttgagcaattcgttgggggaaagccaatccttgtggtccaacctaccgatccagtatccgtcgtcgcacaccgcggagcgcagcctcaagaacggcggcaacgatcggcgcgccacggctctcgacatgctgttggctgtggcaagaacaagaagacatgaacagtgtgggtttgaaaggcgggcgcaagataagcgagggaggagagggtggggggggtgaaggagtagtaccttggctggcgggaggtgaacggtgaaccggagttggggtttgaggatt

SEQ ID NO: 66691 - DNA, 5982 bp, Oryza sativa
  unsure (1)..(5982): unsure at all n locations
gaagtgaccgcgtggcctaatggataaggcgctcgcctccggagcgggagattgtgggttcgagtcccatcgtggtcgtttttttctctttttcccatcgtggtcgtttttttctctttttcccatcgtggtcgtttttttctctttttttctcttacaatgtttttgaacgttgaattcctaacaggaaaggattcacatggtggtaattacgatgtagtactacattcagcaatgagcctctctagactctactaggaatatgcatgcaaatatcttgatagtttttacaaagtaaagatataaggggttgttcaaatttatgtcaatttaaatcttattatttttttaagttatcaaagatgtacatatatttagtccttgcactgtgtttttaaaatcaactactaattccatttcaaaatagatgacaccattaatttttctcgtaatgtttgatcactcatcttattcaaaactttaatataaacatgtaaaagtataagttactattatattttttatttgatgataaaacaagttaaagaatagataatatttatagttttaataaaacgaacgaccaagttatgtgaaaagtcaacggtatcatacttttgaaataaagaaagtataacatccatactactataaaagacaatagtgatggtggtggctttatcaccagcccagcaccactacttttgcacattatgtaatagtttaatagttggttgaatcaaatgaacaccatatatattttaataagtatggacattttacccatagcaaagcatgggtattttgctattaaagttataatatatgctcacctaagaagcatgaaaatgagtgtttgtgacgaaccgcatcctacgatgtcgagattattatcatagtgaggctagctctgtaatagatggttgaatgaacttggccaaacttctcttcttcttttttataaaatgccaagtcccacctcccatggtcgatacgtgtcctagtgtgttagcattggataaagaaagtatcttcataaataactcaaacctctactgcataaacacacacaaagctggggtttaggtgctatgcatatcgctcttcctttccaagatatctgtgagaatgtgaccccttctcactgcacagccgccacacccatcaatcttgggcaattaaaagtcaaaaatttatgcatatccaggataatcactagaaaatgggacatgacctaatagcattatgttacgatcgcaggcgtcacccgatgagaaactgatgatcgaccactattagacatcgggttattagaggcgatccaaaaaccccactagagatggttttgtgaattgtctatgcacgtgcgtcattgcaatctgccttagacatatttcaacaaataagtcagaaaaacctacccacataatctacttaccagagatagtaaaaaaaccgccttagacatatgtcttgtcaatacaattatgaacgaggtacaatattatattatatatatttacagacaattatgtcctatgaggatttcttatttaatatttatggttttatggatctatcttatgactatatctctagaattaattagtactccacctcaaacatcatgtcctagctaggcccgttcggtttatattattgagtggataaaattgacatatattatttacttaattatagagatagaataaatattttaaaatataaacttaaaaaatatcatcctaagatataagcattagtggctatgattttagacatacatttatccagattgatagctaaaaatagttatattttaggataaaggcagtaccttaaaacaagtggtctaaacaatccaatacaaggatgcatttttgaagcgttgagcgaataatccatttgcataatccagcgaatatgttgttgtatgtatcggacattgacaatattatctgtagaatatagctttaatctccaatttttatttaaaaaatatgttatatttgaaaagataatgaaatttgtgatcgtgtttggattcaacccgagttcaaatcctggttacaaatagaaacatttacgcttagaatcgacctatagagacagggtcctcgtgtattagacacaggttgcctgtttggtagagctctaactcctaaatttagctccaggagttgggtctagaatggagttgtggagctgcctaaacccagctccacctctctagttcattctatgagagagctccacctaactctgcttctattttaggtggagctggagttgaagctgtgccaaataggcccttaattaaggcacgattcataggggatagctcctgtcatcctgtgcaggggacctgcttctatggcctttcttgaatccaaatttaggtatttcttatttgaaataccttgggtaggtatttaatttcccttaaagccgagggtttctttaaaaaaagaaatgaaatttcgatattttgatagtattgtttttcaatagaatttttttttcatgttttcaatctactcactcctattcagagaagtactgacagcaatgtttaaccccacctaacccaaaatcactaattttttgtactcaatggagtatcttgctagattttccaattaagcacataatcgtacatgcatgcatgtacattccacaaaggatgtatacatgcatactccaggagtattagtgatgtcatccgcagggatatggaactgtcacttcttcagagacttcagtgaaaagtaacacttgtttaagaacagagatatcctatatccaacgtcgccgcaggtagtggagtttacagaaatcttttaacttgctagtggacgcacgacgcatgttggggcgaaactgcgtatgaaaattttcgttatcttccccaaattttccacccatatcgtgcaggtattccacagaccaaggatacatatattatgcatatttatgcacgtgattacactgcataaacaaacagttagtgggactgtaacaagacaatcaagcaaaaataggttgtgtcttacgtaagagtaataattaacacagacacagctagctcgtattgtggtttaattgtggattcctactcaaactacacacaatgaacagattaatttggagtagtagtggaatgcagtgaatataatcatgtactacagcagtatattatgcaagtagtccacttcttcagggttcaggggttgccttttacgcctgtataaattggtactcttgcgtagtttacaagcagctcaaaacacttagctagctagctcacaaaagcatcagagttaacgtacactcatctagctagggaagaagaagctaactaagccatggcttctcgtgcatttgctgcagtgtttgcagcagtagcacttgtagtgtgttcttcagtcttgcctcgtgctctggcctctgacccgagccagctccaagatttctgcgttgctgacaaactcagtgctggtatatatatacaaactcatttcatcaatatatatgttgctacgtgtaaattacagggatatgtcaggtgctaattaagtcacggtattgataacaaacttgttattcgccgtttaatttaaacggcttactgcatattcttttcagcatcatgcagttgggtacgttttattataacaacataacttgcagcaacccaactagccagcccgttggaccatatatatatttgtcaaaaatacagtaatgaaatgagaacaaaaatacaccatcaaatttgtgatgagaacatttttgagactgtatacatttactgcaccacatttttcatcagaaaacacttaaattttccaaggcatggtattttaccagcatattgaatcatataaggaacttcacgtatgtatcatctcggtctttaatttgcaaaattgtaatgcagtgtttgtgaatggttatgaaactttgactacaaaatccaataaatttatagtattatgatattacttttcaaagaaaatctacgtataccattccttatgtttttaaaacaatcatttaaaaaagatattttttatagtttttgagatggtactaaaaatttagaactgtaaaatttctctttgaaaaaatattaatgatcaaagttttaaatgtttgactaaatcttatcataaatgtcaaagaggtttgaccaaagtattaatctatgaacaataaattgcaaatgcagtgttcgtgaatggtttcgtgtgcaagaacccaaagcaggtgacggcgaacgacttcttcctccctaaagccctcggcgttccaggcaacaccgtgaacgcacagggctccgcggtaacccctgtgacggtgaacgagctgccgggcctcaacacgctcggcatctcgttcgcccgcatcgactttgcccccaacgggcaaaacccgccgcacacccaccctcgtgccaccgagatcctcaccgtcctccagggcaccctcctcgtcggcttcgtcacatccaaccagccgggcggtggcaacttgcagttcaccaagctgctcggccccggagatgtcttcgtcttcccgcagggtctcatccacttccagctcaataatggcgccgtcccggccgtcgccatcgccgcgctcagcagccagaaccctggggtgatcaccattgctaatgccgtgtttggatccaccccgcccatcctcgacgacgtcctcgccaaggcgttcatgattgataaggatcaggtcgactggatccaggccaagttcgccgcgccaccggctgcctctggtggtggcggtggcttcattggcggcggcggtggtggcggcttccccggcggcggcgcgccatagacggcctcattctcgacgcgcttagcaatgcatgcaaaggcggcgtcgtcgtcatgcataatgcatgttactatcttataaaacctttattacacatgtaagctgcgtgtctacgtggcttgacacgtaggatacatctcgatcgtgtccaataatctggtgaaatcgcatcagtgtattatgctaaaaatgttacacctctttatgaaataataacaaagttggatatttatgtgctgcctatgcacaggaatagcaaatatgattggagtctggcagaaacgtaggtgcaaaacttatttattcccttgaaaatacagaggttcagcaacatgaccaactctgaactcatacagagtgaaactgagctgctagacacgccgtttgatggacaacacagatgacaactcaagacatctagcatccaaaattgcaataacggccggacatgtttatttcgaatgctaaatgttacagaagaatagatcatgagaacagtgctaaatttgttccttttttggtgatctagttagcaatggcttcatgttctgttatcgcaaccaacggagattcccagggtaagtaggactcgaggagctgtagaggccattccatttgtttcctttgaatattgcaatctacaaggaacagtagcatgcaccccttgttttccaaacctgcaacactatgaccttgacaacacaccttttgagctgcgatcaagtcaagaaagatacgttaatgtttcaatatcagcaaaggtcagagataaaccatatgcttagcaggtgtgaagtttttgaatcaggcatcaacagtgtagttgggcacaacatagaatttcctaaacgctatttgcaataagctaaaacgaacctggggacagtgccgcgtcggcgcaagtcatattctgttgcttgtcgaagggctctagcaaatgctttgaaagttgcctcaataatatggtgtgagttttttccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66692 - DNA, 926 bp, Oryza sativa
tgcttcaatatttcactttggtgttcagatgctctgagagacgtgactttttaaggaagtggtacaagcatgtaataagtaaacagaacgcaaaatttacccaaaatgcacgttctcaaattcaatgcgtcctcccttgaactgcaaaggctgtgcatgtggttcatcctttattccaggtttttcctgaacaaagtgaaataacagcaatgaagtttctggggttgtgaaaggatgaaactgaaactgcaagccatttaggcccccaacagatagtcacgaagtttttacctcaagcaattgaaacatagacttcatgtcaatcaggctttgcctagattctcgatagacacttccaaggaagttcagaggcaaagaaagttggaatagaagaccattaaccataacctagatatcaaaatttaatcaaattaataaaaatcagtcaaaaataaagaagaaaagcagaaaactggcaacatctggaactgatggttcatggttcaaaattaactattgttccaaatccacataattagttcataatcaatgatcatttgacacccctcgaagtggcatttgatgatttgccaccgctctgcctttgatacatggaccctggggctacatgtcatagaaacatgagtggcaaataatcaatttgacactctaaaggagtagcatatgatcaaaactttccagttagcccttttcacttaaacaaccttcctgactataaaataaacataatattgcaacaacatgctttgccactgtatgaaatggatatggtgctaaccgaacatgtcaaaacgggataagaaatacttgcatcaaataatatataagcggatgtcataaaaaattaccaaatcaccgacagtcagagcaccactcattacaccgtatgaactcaaaaccatagc

SEQ ID NO: 66693 - DNA, 1803 bp, Oryza sativa
  unsure (1)..(1803): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtcttcagttcaatcaatccccatgtgcattcagaattcaagatccaggtcagaaacatggactagctggttggtcggttgggcgatcgatcaaacggctcgatattaattcgagtcaaaaaccgatggcttggcttagcttgtgcagagctaagcttgtacagtttgagttcgctcacctgtccatagatgttcctcgcattcacatctgctccattctccagcagcaatgcagcaatctgagcacacagtttggttagttgaacactgtcaaaactggtaagaattcagaacatatcgattgttcagagattgaacagcagctgaatttttttctccttttaatcgataataagacaattgatttgagctgattaccgaagattctgggcacacagttggttagttgaacagactgtcaaaaactgataagaattcagaacatatcagttgttcagagaatgaacagcagatgaaatttgctccttttaatcgataacatcacagttggttagttgaacagactgtcaaaactgttcaaaattcagaacatatcaattgttcagagattgaacagcagatgaaatttgctctctcttttttgacaaaataaacaatggtttgagttgatttagcgaaagatttgtcgtctgaatcgtcagggacgtcggacacgtacgaccacgtccctttttcgttgatagtgtttctgaacacgacggcattaaattttctggtgcaacgtactaggctgtacgattggggaacaaattagtatgggtccatggccatacttttcataatgattttgcagcaaataacttcacacattttttagactaaatttttagtttatctctctctctctttccatgatgaataattgtttttttttgttttgtaattagtttttaccgttctacaaaggagaagcatgataattgacgaattccattaatagtgtcactttcttttatagttgcatcgattcccaatcaacatgaaaaggaattttaagtatataagtgttggtacacaattacaaatcacacacatcagcataacaataacccgcaaaatgaatagaggcaacttgcatgcgtaaatgttacatctcactaatgatgacgttttcttcttcatttttggcacgcaaatcagattaagagacgagtgatcaattggtcatttgaagaattaatcatcctgccgttaggttttctgtcacctcattcagccatcgcgggataaagctagctaggactgattgtgatttccattttttgcgcaacacttaaaagattaataattaatatgggatctaccaggacagcagtaaattcttttttttttactctctctttctttcgaattcttttttttctttaatgacatgcatatgtgtgtgtgtgtgtataaactttttccaaaaaaaatcagttgaatatattcttttggcaaattaattaaaaacgaaaagattaaaaaacttgttcctagggcaacatcactcatatgcctggttaatagtaaaaaacatagcaaaccaatctagctattacctcgtctgtgatttgatcattgagcatattattacagtaaattatctattttattatagaaataa

SEQ ID NO: 66694 - DNA, 1332 bp, Oryza sativa
ctccggccacatgggagccccgctgctgaccgtcagcttgcatgtcaccacattattgctgctgtccaacagcccggtgagccagagcagaggcgaaaacgtctttgctgttactggtccaccagtgacagccgatgccgcgctccccaccagcagtggcgccgcgccgagcgcgaacagccagccgagcaggcccgcatgctgggaagaggtcaccgatgccggcgggagcggcgcgaggtgatgatgatgagccggtggggtgctgtggcggcactggcgaagtggacggcaacgaagtgatgatgatgaaccatggtgatctccctgtcgtactcctgccgccgccggcaatgactggtggcgcagaagggtgcaggaggtggagaggaatgtgttgagccaccggtggcgttgagcacagtggtggcggcgccgtggctttcacctgccagtgtcgcaggaagacgaacgggatttgggcacaatccaatggatgcccatgggctgaatccactttctatctgaactttcctaaccaaaaccaatccaatactttcctaaccaaaaccaatgcaatcaaaaccgttctgcatctccatccaatccacccctatccattagctgcatcaatccatttccacccaccgaaagccaacccacactgaaatccagcccattgaatccattagcaagcctaggtacacgtacatatggtacagctatcagaagaatgatatattaggaattttaaagcttaccgatcagaattaataatttactatggttagtttgcaaatgtttttcttgcatgttgacatctagtttttgggtttcttctgatgcactaagccaatgctagaagcctgaagtgttgctttgatactgtgcttgacaaggacatagttattaacatgtcggtgcttctttatggtcatgtcatagccctagcactttgcatttaatccaggtgtttaggtatgaagttctctgttatgatcaaataaaattatccaatgatctttgtcaagaaagcttatcagtgccgccttttctttttattaattggcaggccgtagttggaaggcttccgagttacgcctaaaatcctgggatgaccttcagaagctatggtatgtccttctgaagaaaagaacatgcttatgagtcagcgccagatgctacattcagagaatatgcgttttccaaaccctgaacgtgtttccaaggtattgcacggccatcttaacaccctgcctcatgcaagtaactgagactatttaagttctcagttttgtgtaactaggtcaatacgggacagggctgcaggaa

SEQ ID NO: 66695 - DNA, 718 bp, Oryza sativa
aagcaaaggtggaaccaaatttgtatgcaagtatacttgacaccataccaatctgtaaatggaaagaaaaaaaacagaaggcacacatcagacaaaaatgtaaaatgtgactggcatacattacggaaagttagaaacaccaacattgcgcgtatatgcatagttgatgggatataacagtcaatgacaataatctgagtacctccaatattgtgggaacaacattgaacaccatcactgtaaggatgtaatttatcgcacgactacctcgatcaattatgcgatttagggcaccagtttgccggctgaaaatatagaagccaggtaaaggcatataagagctcagataattttcaactttccagttctaaaactcatgaaatatctgattatttgcttgtttcttataacttgtttccacaccaattttcagaagaatcaaagtgggatataggctataaccaccaaaatagtgcagccctagactaggtttctcatcatctcccatgcgtaaatgctgaaatatatacatgcagtcaagctacctaatttggcaattccttgcaattatttgctacaacttgtaagccacctacattaactgggatgcttttctatatattggattgggcatgtgtgcattaacggaaatatatcatttgataaatttaagataaacaaacatataagatgaataggaggcattttctagaagtac

SEQ ID NO: 66696 - DNA, 8466 bp, Oryza sativa
gccgggcgcccacgagagtcgccgcattgtccacacccgccgccacctccacacgtctttatccgccgccgccgcctcattgagcgccgccgcctctgcatcgtccgcgaccgccgccgcctccatgagcgccgccgcttgcccgcgaccaccacctccgcgcgtccacgagcgccgcctcgcctccacggccgccgccgccgcctccacgagtgccgccgctcatccgtgaccgccacctccgctagcaccgccgccactccactcagatccagccgccgcctcgcctccgcgcccggcgcctcctccgcttggtccatgactgccgccacctccacgagcaccgtgaccgccatctccacaaactccgccacctctgcctcgtctacgaccgccgccgccaccttcgcaagcgccgccgccggtcctctcagatccgggcgccgccgagtgcctctgcccctagacggcactaacggtgagtacaaatccgtccatcccatcccacctcaatcccttctaccaaacaaaaaactataaccatcccataccataaaccaaacagacaactggaaccatcccatcccacaaaactaggataggtctgacccatcccacttcgtccccaaaccaaacactacctaaaggagcatgtagctttattagcataaacagttccatatgattaaaaatgacagaaaatgataaagaattatcatagtcattacagatgggagtgcacatcgggccagtagcatgatcaacagtcaatgaacagctagatgaggatgcagatgtcaagatagtaatagctattttttaatgattttttctcaagcttttttttccatgaatttaatttttttaatatataaatgttgtggaaagtactgtttacaatactagcaacactacataaataagacaagtacatcaatgcgtagaaagaaataaaacttgagataaacaaaagattcataaatcataatgtgctggaacatctagataatagaggaatttagtagatggttggaaaaacatgacaaatgagtggtaacattggaataaaaaaggaaatttcaatagttaccgtactggagactgaacggatggctctcaatgtcactttagaaaagacagcatttcgcagttctggcaacagaaatcgacgaataaatcagtagaatcagtatatatttcaaagaggggcctggcaatgcatgttgctccaagctcacgaaaggaactcattttttcagggaaagaaacaaccatgcttttttttctaaccaaaaagagtttacctgtacaggctgatactcccgatcgtgcaattccatatccaatcagaacagctgctgggcttgcaaagagagccaatagggtagcattagcctctgtgaatgatgcaagtgaagtttcagcaccagcaagggctgcaagccaatcgacagcaagcttaaacaagaaaggcacttgaacatttataacctggtgttcattataaatgaaaacggtcagataaataagttgaaagttccatgtaaactgtaataacagccaacttctgtggttatcatttcttatatgccctaaatgaaggtgcataattattcctttgatttgacaacagtacttgaaaatagttgtgtatctaacaagcggaacttggcaaaaatattttgaggatatacatccaacagataggccatatctagctactagattgcatcatattatgccaaaatgattccttctataagtaaaaaatgtcactgcagaataagaagtgaatatgtatagaactccagccaggaagattagtattgatctcaatccagcataatggtcaatggtactctatcatgagataagtggcagcttataaggaattgccataatgtgcaccttgttattattcattaatgactaattaataacaaaagaaatatcttaacaacagaattaggctgcaggtttatcttagccacaaaatactctgctcatatgggttaccactttcaggtgtagcattacctttgccccaactaagaggcccaatgacaatataagcctgaagcggaaatccgggctatcattcaacaataagtatttcccaaggtttttcagtatctgtgtatctgctatctgatcatcaacatcctttttggagatatctttcttcactttgtcatcagatgatttcccaactgccacagcattggcagatgtggaaaatgcatgtcctctctgcaaacatggcaagaatcacaaaaaaacaaactcaacaaatgagtcctttcatagtacaaaggaaaacaacagagccaagtaaccaaactcagactcaattttctgtattggatattgattactagagttgaaatcaaccgtgagatacttgaagaacatttaataaagatgaaaacaatgcattttaaataccaaaaaattgcttgacagaatcatcacaagcgtagcaaatattattgcttgtaatcatatatatgaaaaaatgtgagtaagcgtgtttgtactttattttgtgatctgatggattaagtctgaaaaaatcatcagaagcataacaaatatcaacttgaacgcacgaatgtcagcaatgacaaaggaaacaagggtatagtaaatttctgataaatttatccttttgcaaggactgagaataacactgaaacaaaaccaaatgcgcccagcaatgccatccacaatgcttaataatccttttttaagttcctgtatcggtcaaactagtaactaatcacatctactacagtctacagccgactgttttgctaggaaactcgcttgtttgactgaagtattgatacaatacaaaatacataatcaaccactactgcctctaaccatccccaaatcgaaactaaaccaaatgcaataagcacaatgcagtaagccagtaaccacaagttaccacatcgcggggaggcggcgggtaggtggagtccgacatgaagcagctgaggcgaccaaagggggcatacttcccgtcgccgggataaacccaacaattcggcccgaagcctccgagcagagggctcgggagaggcctcggcacggtcggcggccgccggaatatgggggcggcagcggcgaccggcgaggggtcgtagcgtgagcgtgagccgcggaggaggtggcccgcggccagtatgcgggaggtcggcctcatggcgctcgccggcgacgacgatgcagatgattggatggaagccgaagcgtggaagaggcggagttggacttggacactgccccgttaaaaaaacggggctgataacgggtcgggctcggctcgcccgcggttccttggaaaccgcagctcggctgttcggagtgggatcggagcggtggagctcggcggcgccggcgatgtcgccggcggcggccagtggagatggggaaaaggcggctactggtgctacgttttttgttttttgtttttttgtgaagcagcaatttgttcagggatcccggatactccatccacctcacgaaaaacgatttttcctgttatttcaaaaaaaaacagataaaagaaaaacaacctttttttttcaaacaaactcttttcaagtttttcccggtgggaaaacaagttgtttctaaagttaagcaataaggacttgtcttagtttcgtctttagaaatttagagtctagagtaaatgtaatttagggttaaattttaaaaactacatgtataatccttacttcattctatgtcgaataaaaaatcaagggaacatgaattgggcatacttcttttttttttatgtgcgtgggcatgaggcatgcgacgcactaacaagatgaatcatcaaagcacatacctgacacatgataccgatcatcgaatttttgtcaacttacttttgcacataaatagctaaaaaaaatgttataataaagttgtgctaatgggtttttctctctccggtttggggccatgtgccgccgctaagttggcacatcttcatagaaaagcatttgacactgactatacttctacattagaaaaaaaaattagagttggttctaatgttatattagcattggagagggtgtaatgttatattaggattatatggttttatactatgttgttgtgatatattagtatgatataattacaagattataatacacacataaatgttataaatatcggtaaaaaaaggctaatccaactattaaataaccagtacacacaggctagagaacccactaaaacacaacccaataacctaattttcaagaataagtagccaaatgtgtagggtgaccctttcaataaagatgtgtagggtgactggatgagattgcttttggttgtattttcttgtaacaagacctgtatgtgtaggatgagggtgggtttttttcccttctcatgtttccttctttcttgataattttgcaaaatttattttgagtaaatttcacaaaactacaaatattatgatcaaactatcacaaaactacagatttaactcggtgtatcacaaaactacatatttaacattaaattatcacaaactatatatttaaaataaagtgttataaaactacattttagtaataactaaattatcccagtcaaaaaaaatatagctccaacataacaactatgctaaggatttaaactctaaagctatagtttgtgataactttaatattaattgtttagttttgtgatatttagccttaaatctatagttttgggataaatttagtgctaaatctgtagttatgcgatacaacaccttaaatatatagttttgtgatagtttgatcaaaatatatatagttttgtgaatttttattcacttattattttctacaagaatctgaaaagaagatagaagtcatacttaacgggcccagatattcacgaaaggcccagcgcgggaaaccaatgggctgataagcccatggcaacgtggcccaccgagttgatcagactagatccaacggtgaagaacccagaggcttaatccaacggcagctgctttctaggcggccctccggttatagccggcgagcgctccaccccacccgccgaattttccctccaacctgctaaaaccctagcacccgccgcccccgacggcgccgctcgacgacgagtcgccggcgtcggtcgccgacgagagctagggcaagtgcggcggtacagggtttcagaggaggaggggagcatggcgtcgaacaacggcgcggggaccctcaggtcaacctccatcaacggcgtcaagctctactccatcaccggcaaccgctacgtcgccccatgggtcctctcgaagaagaagcgcgccctccgcaaggacgcaggcatcctaactcgcctcacgctcatctgctctctctattttgggttcttttttcttgtgcaaatgacatgtattttctcatttattgtcgtgttgctgtcctttttttttgggggtctttttagagtatcagcggaggctggatttgatccatgacctgaggttcgagaccgccaccaccaagatcaaggtgacaccggatgagcagtatgtgatcgcctcaggtatgcgagctcgctgaatccaccattttctgcaccggcgttgctttgatcaggttaaactccacagtgcatactcagaaaggcatataactaacatataccctggaataaaaggcagtgcgtcaatataacgtaatggtggttcaggagtcagttcgcataagttgctgaaggaataggtgtccaacaatatctttagtctgtagtgtctttctgcgtccatgtccacacctataattgagctttcatccttgcctcactcagatgagttcgcatagtctagcgaagttaagatgaaagctcatgttctgggtgcgagtggcatggagcatcacacaattatcgtggaatgctgccgtccccctactatgtcattggcttgcgcttcatcgtccccctactatgtccttggcttgtgcttcatttgaagtcagagtcaaaacatttaaaccactaaggcgtttcttggagaagcttgcgtttatgtttgcttattgtgagtccaactttgaataatcccatgccttcagaaacaatccatgtaattcatgctctacaccttttttctttagtttgtaatatcacttgttagtttaatcttcacctttaatgtgtttcagtattgtcactttcatcagattgtttacacctctgtatgtaagtggaattcttctgtctatgatgtcaggtatttaccccccacaagttaaagtctatgaattgaaggagttatcaatgaagtttgagaggcacatgatttcagaaattgtagatttccaggtgggactaggctctagtgaagctcattcctcttttactatggagaagacatttgaattttccacaaatcagaaacttgcattttcattagctgtgtaacaaattagattgttaacttagactgtagtacatctctgttgaatttattttgcttatgagagttttatactttccgctatgagttcatgctttgtcgtgggatgtaatttaaagtatttccacattgatacaaaccattggagattaactgctcaaaattgtctactatgcttgtaggtgccaacctctgtatctttccttttgtatattttctatctaataacacatattgcatctttctgtaggtccttggtgatgattactcaaaacttgcatttttgtgtgctgaccgttctgtatgcctgcatgcaaagtacggtagacactatagctgagaattccaaggttagtctgtccttatcacctacatcctatttcttatatacttttcatgcactaactacttggcctttggtaaagtgaagcgacatcttcaagaacacataaactgtcagaattaatatttgaaccattaacattctaacttccctcctgcctctcatgctgattacacccagctcattttaaacgctactcttctgtgctcctactgctgattaggtgcatgttaagtcatcgacttggttgcattgctttagcccacctcctgctgctcatgctgaaaaggccaactatttgggcatttttggccttggcactggctgcataatttccatttcgtcgctgccaaggatgagatatatctcaggtttttttttgagtctttggagtctgatcaggatgaagctttagcaaaactaaaacaacatgatcacatcattttctcttcttttccgtgatttccaaacaaagtagtctagagaagataacagtgagcatggtaataaaatcaataattttcatctggcattgacagtattctgtttaattttctccatcttgcacctccatgtctgcctcttgatttctacatgcaaattcctgcagcaatacatggagtatcacatgtagtatagtagtactaaacagccacctgttgccagatgcagacttagttatatgggctggtctggattagtaccaaattttgccctaccaaagttttggcaacttaaattgtgtcatcttgatgtttggtttggtgccaaattttgccacactagttctaagttctaattagcagtactataccctatcaaatttggtagtgcccaaacctgcctaggttttcgtactaccaattatttggtatggtacatttttggctccaccaatcttactgaaggatatttctcgcatttcattgttctgtcttaattcaatacattttgactgccctattatcaacattcttttagtgtcttatggccagtcagagctatgtaattattgttggttacatgtttagtatgctagaaagtagtaagagctccctgttgcctgtgcaaacatagttgtctatctgctgcataatgattttttcttttagtttctacattttgtatctcttcttatatcatgggtctaaactaagcttctttgagatgatgataactgataacactatagtaatggaatgtttcaatacataacttgccttaattttgcatgttgctgatttccattttgacagaatgggaagagatatggcatatgattgctggtcttgtgatttgctttgcgctgcttcatcaccagatgtgtatagaatcaatttagagcaggtctgttttctttcttcatcattgatatgtattttaaatatctggttaccttagtcttaggaaaaatcatactatactttgtttggcacctgttagtacagaaccaagatagagatgatacttaattaggttgtttgaatgtaagcctaactatagctttatcgcatatcctctgattaatttttctcatcatctatcctgaatctaactaaatattcttcatataccttgtattaagttgctaatagttgcaacattacaatggtgttttcttctcatcatttgctttcagtcttttcagagaatg

SEQ ID NO: 66697 - DNA, 785 bp, Oryza sativa
ttcctgcagccctcagaatgagtatacacgaaaatatgaaacagtgacatcaatccaagtcacacaataacaagtacgataaaactaagagcaacaacttgagaaaaataacacacttgcttataaactagtcagactagatctgcacatatgtaactatgtgagtaatacctcatttcctttgttgccataatttatgcagatctctgtttcagccttcacaaagcttttatcagctagagggagatacaaaaataaacagtcataaattggaactataatcttatatcaaaatatttgattaaaggaaagatcatgaggttctcttatcaaaaggaaactggagctacttatgtacctagtacaaggtacattgaagaaggacatccagtaacatgtcccatggaatcaacttcccatgttgccagcgcctttacatctgaaaaatatgatatacctatgtaagactgaaaataacatgttttttcaatgagtatttattttcagtacaacaattttttttatgtaaatccttgcaaattcgcctacagttttttttttgtcaaaagttgaatatagaatgatctgccaactagatatttcgtctatactacataattcataaacttttattagaactcttactatgattacaaaagtcgattccagggacaaggccctcaacccaaattgactctgtattacttgatttaggattatcattgccactgatattcttagctgtaatggcagtcccagttccctggaaacaaacagttagcatg

SEQ ID NO: 66698 - DNA, 5222 bp, Oryza sativa
cagaatttctctgttggtatgaaaaattttcagggccaagaaaggtcctatgcgatgttcctctctcttgacaacaaaattccattcaaggtcctatgctactctttcatgacaagaaaaagtcatgtaaccaatgtttaacctctttttcacttttcagataggttgtacatgagcaaaaaagaaacctaaatgaccacatataatcgaggggaaaaaattaagccacacacaataagtaaataaaacaattgagaagaacctctgaagctaggatctgcggtcagaaaaaatgcaattaacctgaggggcactgagactagaatcaccacaatcatcaccaatgttggcccgcttttcgtctagtgattccggaaaaacataaaaacgaggcaatggtatattcaatgctcgagtccagaatattgagtttgccctgccatagagtcgtgctgctgagttacataaaacaaagaaagcagggaactgaaccagcaactatgtgaaggaccctgcatcatatgtgtatattgcatttttcatttgttgacataaaactgttgttccaagatatttattgaaggagctgcaaatcaaagccatcacccaattaagtacaattttcttatgaatgagctaatttccaccttgatggcttgaaaattgtaatagtagcaaaggttagttgatgctaggtacaaaaacatccccaccattttgtaaactaatgcctaatttgtccaaaaaaaaattagcacactgaatcttttgcacacgaaattaacatgatatgccatgtcaatactatgaaactacagtatcagtaaggcttatattattccccccaaaaaaatgtaagccttataatatgacattatcactgcaaatgcaaagcataattatacataccaaaggaagtcttcgaaccgcacttcaattgagctgcaaacaatattttgatagtattactgttaaataaaacgaatttctttgtcagtaaacatatgatagggagtcatgagaattagccatattggtatatcattgccatactagacagtaaaaatcacaaactcggtaggtgggcatacagatgtataacagaacaatatttgagtgatattgcttgtggattcatgggttttaagtacgcacagaatcaataaacaaaaatcatgctggatacactctacttagcactagaagccttcacaagaaaatattcatttaatagggttggctgaaaagaatattcagatcaaaatatttcaaaggtacacaaagcccagtatacagtgcattaaaatgatttctaacgtatttataagttaaacctatgccatgtcaacaaaattcataaatgttctgtaaaataaaagtagcaatttatctcatagtgcagcattgccatcttggtgattctcatttctataaaattaaataaaaacataggcgctatcccagatgacaacaaatggtgcactcatacacatgaagatatggaacatgcgttaccccaaatcactttatatgagaagctattcttcatatcatactttggggtgcaatccccatgtatcgcagaaccccagtacagaagtgtatactaaaatgtaaaagaaactatgcatgtgtgcttgatacagaaatatagtgataaagttgcagcagcgctggaaaatgatgcgaaatcagtacaaaccttcctgattcatcgacgtttaagagctccccaaccagacctttaaccttattatcgaataaggtttgcaatgacttcctctgaaacaaaattgcagcatgttcgtttaaacgaatttgctcttggctccccaaaatatccccaaggaactgaaagaaaaggtttgcactactgatgaacctgcatcacggttgcccggtgaagtgtggtcccttccaactcagcaagctcatcttcggtgaaccaaatggagcttccgaaggtgcttggaagcatatccaaatacctagagaaattaccaaaattcaatcactgatcaagttgtttaacatggagagatgtggattgcgaccatacggcttccagagggagctagggcggagtcgctcgaccatgaggaagagcatgacgaggaggcggtcgtcgacgccaccttcctcgaagagcgcgcggcaccgcggcccgacgagcgggtcctgcagcacccgcatcggagtgatggcgagatcgagcggcaccaccatcaccacctctgcaacgagacacagccaacgcgcgagtcagcgcggaggacgagctcctaaaacctccgagagaagaggtggaatagcaaatgttaccgtcggtggcgccggcctcggcggcggtggagaagacgccgtagccctcgcggccgcagcggcggatcgtgcagccgcggaggtcggcgccgttggcctgcggagaggagccaggggtttagggatttggcgtgcacgcgagtagaaggggatgtgcaggagggacgaggagcaacctggagccattgaggaaggagtctagcttggcgtcgccgggtactgctgctgcggcggcggcggcagccatggtgttcgacgggcggcgccggcgcgggcgaagtggaagaagcggtggagcggcatcgaggaagacgacgacttggctgggcggtgggctgggtcagcgaccaggcccaaaggcccataggatcacaaatttgtagatactggaagactggaagaggggacttgatcataaattggtaatcacttgatccaaatatatcatctcttgagccatattttttctttgctttatagtagcaaatacgtcatctctatccaataatcactatattattcgatcatcttttcataatgaggtatttgaaatgtttcttgagctaattacatgggggtcaacttcggtttaagtttgtctgcaagcattcaagagagagcatggcaccaagctgatgttgatggatggtattagtgataagtatgacaagtgcacaaaggagaccaaaaataaggaacacattcaacaaacagaaagcaagcacactactcggtaatctactatagcattatatatcatcaggtccacgttacattctaccactcacactctcatctcatctcatcactcatctcactcttatctttcagcttgcatcgcaggtgcaaggaggaaggcaagagactagcgaagcactctcacagccacaggacacatggtgaatggcacagataaacaaaatgctagcacaccagcgaagcccggagcgagtgcgtcgtcgacaggttggtgcaggacgcccaccgtatcaccgactcggcgaccgccacatccaggtgctcgcgctcgccggcgccgatggtgtggttcctcctgctgttcatgccgatggcgcgcgacgggttcgcccttacggcggccctcaggacctccgctgtcctcggagccgaggacgagacgagggccaccaccgtcgcgtcgcagtgagctttctcgcccaaggcgtcaccatcaggcgacgactcaggctcgccgggttcttggccgcagaagaaggagaagctcggcatggaagcgaccggggacgggaacacggcgttgcagggttcgcagacgccaccgaaggagaaccccgagagcgcgcacgacggagcattctcagcgacaaatgcagagaacgatgatctgcaggcgaatgtgggggagcacgcttcttcagacatgctttggcaggcgaccgggccaccggtgttgaagctcacatcgcggctgcatgacgccagcggcgtcgagaacgaacatgagccggcgtcctctcctctgagattgatctcatggcaatgtccacaagaatcttggattggtcggcatgatcttgtatccaggaatgctctgtgtaacaacagttgtttagattactccacatggcaagcattacaaaaaaatggggaaaggaatcattagcagctgatctgtacagtaaggtccgggaatgatgcaatgacaaccaaacaaaagattccacgaaggatgacagaatgaaccagcacaactaaaggaatggctacaatagacaaaaggtgatgaagtgccaagaaattttaaagttcatctgtaccacagtggatctaccagaacatgaccctacaacaaactgtgatgcaacccagctttttcccccagccgtgcaagtttaaattagaccaccaacttaagctggcactaactcagtacttagcagccaagttttgttaatttattcaatatgtaaagtaaacaaggctaacctcatcaggaaaattttgatcaatttcgatttacaattccagttacatgcatgtattaatagtcagtgagcattttccatcttaaaaaaaaaaaggcagttccaagttctcaatatgatgctagtgatgtagaacaaggacaggaaattgaaagtgtgtggtttctgaaaagattgaggccgtgtctcacctaggacctgcttggctgtgagcctctgtcgaggatcgcgccgcagcatctcggttattagctccttcgctgaatcggaaaccttgtcccagggatcagaaggaaaccgcagctcagtcgacctgatacattcgaaaatctttgatttggttttcccccaaaatggggggatgccactcaggaggatgtaaagtatcacacccgcgctccatacatcggcagcctcattgtacccaccggcgagcacctcgggcgcaatgtaaaatggactacccaccatgccactcaagctccgacctgacaaaaccgaaacccaattcagcttcgaaacaccagccttgacagagagcagccacgaaattgctcaagaattcccaattataccaggctggatgtaggttgcgaggccgaaatcggcgagcttgatcggcgaagaaggcgatttgctgacaaggaggatgttctcgggcttgaggtcccggtgcacgatccccttgctatggcaatgcgccacgacctccatgaggtagcggaagagcgcggcggcctcgtgctcggagaagcagccgcgctcctcgaggcggtggaagagctccccgccggcgcagagctccatgaccaggtgcacggacgcctcgtcctcgtacacggccttgaggtcaacgacgttggggtggcccgagaggcgcgccatgacctcgatctcgagcttgacccccctcacgtcgtcgggggacacgag

SEQ ID NO: 66699 - DNA, 1636 bp, Oryza sativa
aggaggttaccgcagtatttatattaccgtaccctcgcggtaagcccggtaaccgcgcggttaccggcggtaagtcgaaccctgagcagtagtactctactcatccctccgcataaaaattgtagactacgaatctggacataataatcttaggatggagtaagacgatttattaggataagattttgataaacaattgttctactaatatgttggttgtttatatagtaacaaattacgatcataagcaaatacttttaaatgtagatataataacatcaattttatgttggttggttaaatgattgttctaacagagtgaatagtatttgttgttgactctagaagaaaaaaatgattttcgccagactggttagttaggaagaggtatgaacgatgatgtatgagactttgaattgttctaatgtgtttggttggtttgaattaggtgcagcagttgtggtaaggtcttgtctttttttcgaagtacaaattatgcgtttcgggatttgttttttttttttttgggggggggggggtacagaccgttagacaccaatacagatgcagtctgtacttcgagtattttttttccctgcgaccgtattagcacataggagtagtataaggtactagtatgtcaatgcatgtaaagttgttaaagactgaagaaaatgagatgtgcaatttgacccggtagtttgagatacactcaagtgtagtgacactctttctacaactcacgcaaaaacataggtgaaccttcacaaatcagtaaggatatgcaagcagctagcgcatcctggtacaaatcactcaaagttattcattctataaaaaaaataatcttatgtttataaaaaattccttctgttttttccaatgtcgacccaattatatgtcgcaaaaggagtcccaaaaaactgcaaatgcaaagtaggacagaagcaaaagaaaaaccagaaagaaagtaaacacaaaaagggcccaatctcctaaaaatttgttgtttagttaatgtggtgatcatgccgatgtgtgatggttgccctctttgctggattggtttaaggagcactacaagttgtgcctctagtggggctacaaataattgttcttaagcaatgccatttgcatgcctttatttttttttttgcttattattttttgtccttgttctttctgttttgcaagtgattgatcaggggaaagaaagatctaatgcaatgttgtgtggttggctggcctaccagagtgggaaagcgacaggagggcgaaagagagatgcactgcatttaatttgcttccttctggtttcaacgggttcgtttgcttgcgtccatttcggaggtggaaaaatgaattagcacattccctagtcagaccagctagccgtagccaaaaattaaaatttgaaacttaaatttgagttgattcttaaaagttgctaagtacacatatcttaaagatttacgcataaattatttttgttgctaatcatgcttaaccaattaagattttttttaacggtcagacccgttgctgatattttatataaagaagaaggtgccccattttaagaggtaagtgggactaacctagtgctcagttaattagagaaagtgagcaaaaacca

SEQ ID NO: 66700 - DNA, 1064 bp, Oryza sativa
ccaaaatttctatgaaaatcctacaaaccgaatagatccttagtattgaagtgtgaaaaaaaagagaatttcaccacaaaatttaccacacattgtttcatcaatggaaaatgaaatataccgtttgggatacctaggacgacattcatgctaacttatcatatgctttactttgcaaatactatgtcgatctcgtgcaggatatatttcagcaggtaacatgttttcttttttaatacactttgttggtgtgtggatcgagcgtatttgataagggcattgtttagttttccccatattctcaactttccatcacatcatatcacaacaaaaactttcctacacacataaaattccaactttttttccaaactcctaactttcttcaaacttccaacttttttcagaaactaaacacacccaagattattctccttctataaattctctgtccaaaacctcatgacactagtttgtcctaggtttaactttggcaaatgatatgtgaatgcaatgctctaactaaagagtttgtaccttgtactctaaacaaaccatttctcgtttggtagagtagacgacaacagctcagaggtatccgtacaatcatcagctccgctagccacgaaaccacaccgtacgttgaccactcatctgtcgccacctggcgcttagctggtctagctgtctgtgaacacgcagtgggccccacctgtcagatcctcggagtaagtgtgtaatgaatgatcttcgctggaatgtcaacggtggggagtaagtagatgatcacggtcggttgtggctgccacgtgatgtgattagatggagctgagatgctgatgtgtgtgattagtgggtaggattagtttgttcatcactttttgaaaaaaaaaaaacacaccgtaagttgtggaatggatccgttggccttggcctttgggccgttgacctactgcatctgactttcctatcactcattttttttattttttttcacatgtttacttttgtttttggaaggttttatactcccgttctaaacaaatcaatctatccagatttgc

SEQ ID NO: 66701 - DNA, 722 bp, Oryza sativa
ttgtgaaccattggtggtatagaacgcagccttaggagacgatccaggatttcccttgcgcgtttactggtcttgccgctgcagaacggtaactacaagtgcccgaaaactatatcaagcattctaaaaaaataaaatatatttttataaaatttactcctggttatatccaattgttcacggatgtcgtggtaaggtaaagggtccatttgcatcttagcaatagaaaaacggaggaatagagaaaacataggattttgacaaaaatacaagtgtgcagggacctgcgtagtaccctaaggtcctgagttcaaatctcctatggagcgaatttcagattgggttgtttgcggggctaagttccctatttcaatggccgtatatatccggttggatgtagaggccgggtaaaaaatacccttctctaaaaaaaataagaaaaaacaagtgtaaaatactctctccgtcccaaaatataagaatttttggacctgacacggtcttcgagatgcttctttgaccaacaatatctataaaagtaagatgttttaaataaaaagagttgcatattatgatagtttatttaatgataaatatggttgatcttcttttttgctattaattgttaaagttaaaaatgtttgacttgtcactatgctaataatgtttatattttgggacggagggagtagatgattgaaaaatacagaaaaaacacagga

SEQ ID NO: 66702 - DNA, 2788 bp, Oryza sativa
  unsure (1)..(2788): unsure at all n locations
ttccttatccaatccgccatccgcaaccgccacgcaaatttcttctctctttctctctcggcgggaatccagaacttttagaaagagaggagaggagaggagggcccccgcccccacgggtcgccatggccgacgcgtattgaaggtacgccgccgccgccgacgccgcgcgccaccaccaccaccaccagctgcccctttccgccgcccccgccgccgggatgcccgccccgccgcctgctgcttctcaggtcgccgccgccgggcagccgctcaagcggccccgccccgccgacttctccggttcgcctcgccacacctcactccctctcctcgctggcagctgctcgtctcggctctgaagccggcgcgggtgttcactgtttatagggttttagggtctcgcagttgcaatgctcggctgttcttcttcggtcgtctctgggttgtctcacttgcgtgatatcgcgtgtgcatatcgtatcatgcatttcgtctactgtttcttcgctagactgtagtggatctccncgacgatgcagtggcccatttgttacngctatcccactgaacgctgtcccatgaaaanttgcacgctctctcggttttggtagcactgtcgctctgaggacactgttggattttgcgtgtgcttgatttcgatttaggatgacacctatcaccaatccggattgtcgtataccattgttcacttataatttagtactagttgtggaatgatttagtcgatttaggatgtcacctatcgacaattcagcttgtcgtatgctgtttcagttatattttagggctagctagttgtgcaatgatttaggatgcagtagtgtctcgaggactaggccatatttactactaccacttttttcccttgcatagatgtacctggtgctcgtgaaatggctgcctattactctcgtgatgaagaaaggccagggtatcgtcctgcaagagacactgaggctcttaacgcttcctatgaacgttttctgcgcactggggtatcaaaacctgttcttaacacatactatattcaattccttaaacacattgtcagctgacacttttttcttctttttgtactcacaaattcaatcctatggagctggagctggagctggacctggtgctgaatctattaggcctgcggcaggtggcaatgctggatacccagttgaggatcgtccaatgatggctggtgggggcatggaagccagaaatattggctttggtggtgggatgccagagcctccccttccaccagatgcatcaaatacattattcattgaaggaattcctactgattgtgcacgtcgagaagtttctcgtatccttaaatcccatgcctttttctgtctatctttaatctttcatttgcacaaattgtgggtgtaaattattcataatatgcctccatctcttagctgctggtccttcaccttcccccaagatatcttccgaccatttgttggttttcgtgaggtgagacttgtaagcaaagaagcaagacatgtaagtgagctttttggtgctgtcacgcctggtctcttgtttcgttcttgttcatccatctaagtgctttgctgttaacagcctggtggggatccaattctactctgttttgttgattttgaaactgctagtcaagctgctattgctatggatgctttgcaaggtgagtcagtgaactatagtttgttgacactgagccatttatcaccttttgatctcaaatttcttttggctgcgtaatgcccaattaaatctgacagctgtgggtacaccatgtgaagctgttgatccatctctcctatcagtgtcttatgagtcatgatattgaacttgtgtgttttcttctctatctttttccctgtttttagttatctcattgtcatgcatgcttataatttnggatgctttgtttaccacagatctgatagatgcttgtgatggttggtaatttggggtattttgctaaaagccgacagtcagtttctttatggttgaatagaactcattcgactgaagtatttgtccttaaaattggtgtggagttattggccaagcagctaaaagtgggctgtgaaaatcttgtctgttcctaatttatcacctgaacattttgcttcacattgttaccatagctgtgactgcctttataatgcgcccccccccccccccccccacacacacacacacacaagatgttattgcgttgtctggggactaggcctgtggaaacactctggcagaaaatggcatagatatcaccatctatctatattactagtagctcgctggtgcttctcaaatggtaatttccccttcacttgacaacaactttagcaagctatattaattcccagtacggttatgatccacttatgatgcttgtcaatgtattctaattactgtgattcctaataggtagctgttagatcttgtttgtaaaaaggaatagctgttccatgatcatgtcaggcatctattgcctattttttgtagcatgatcaaagtaatcctgtcagtggccatctaaaacttttcaaggtcatgtacgaaaatagagtaattcgcacctgcaatgagttagttctctgtggtgtcttgggagtgagaatacatggtagttgactggtcattgaaccgttcgtttgattgcttaattcccatgttttaaatcatgaaaattcatggttaattttgcaggctacaaattcgatgaacatgatcgcaattcaccccatttacggctccagtttgctcgttt

SEQ ID NO: 66703 - DNA, 4534 bp, Oryza sativa
tttggtgcacatcacatatttgtgtacaacatattatctcccttccgcgtggtgttatatttagtagtctgttctggtttctgatttgcacgactcggcatgcttacattgttttgctacttgtaatcctctcggagattctaaaatgcctcctctggagcgaaaggtagaaattttacagctgcttccatgactcagaaatttcacatgttttttgctgaaactagtttaattcccacaaaacccctccaaaattatgtggtaaatttagatatgaatacctttgaactattttgcttgatgtgggctatgtggcctaagcctgtttagattcaggggtataaagttttggcgtgtcacatcggatgtacggacacacatttgaagtattaaacgcagtctaataacaaaacaaattacaaaatccgcatgtaaaccgcgagatggatttattaagcctaattaattcatcattagcaaatgtttactgtagcaccacattgtcaaatcacggcgcaattaagcttaaaagatttatctcgcaatttacacgcaatctgtgtaagtagtgatttttttcgtttatattaatacttcatgcataagtccaaacatttgacgtgacagaaggtaaaattttgccaatgtgacggaaggtaaaattttgccagaatctaaacagggcctacagcatgagcaggacgatcgcatcaatcaaccgtgttatcctgtacataataaataaataaaagataccatcgagccataaaaaatgctgaaagagacggcccgcttgcctctattgtaaggcttgtagcattggatcgaacgaattgtcctcctcacagcgacgcaattctcccaaatctgccgtttcattcgtccattagctgaaaaagaaactctacaatctatctataaacagaaggttaggtacctgtgtctcaattttctcactgatgcctacaggtccggagtaaaatttgccgcaccttggacatggactgaaccaaaactttgcagatgcaggcagatttttgcacaaaaagtcaagagtccacataagctactccacggctactagctacaaaggcaggcactctggctctctggcacactggcacagctcccaactcctcccattatccatccatggcgtcctcccatcaccaagaagtacaagagcaaggccatggagatggagaggaagaggaacaagataatagccaaatcacctctccactgtgtaagcacggcaaagcctagtcgtctcagctgttttctttttcccgccatggaacaccactagaagaaagcaaactgttctgttgcctgatgagttcttctcgtgcagtgcgatcctcaatgcggctcggctcgccggaggagaactcgccggtggagcaggtggcgctgacggtgccggtgggggacgacccggcgacgccggtgctgacgttccggatatgggtgctgggcacggcgtcctgcgtcgtgctgtccttcctcaacaccttcttctggtaccgcaaggagccgctcaccgtcacggccatctcggcgcagatcgccgtcgtgccgctcggccgcctcatggccgccgcgctgccggagcgcgtcttcttccgtggccggccgtgggaattcaccctcaaccctggcccgttcaacgtcaaggagcacgtgctcatcaccatcttcgccaacgccggtgccggttccgtcttcgccattaacgtcatcaccgccgtccgagtcttctacgggaagcgcatctccttcttcgtctccctcctcgtcgtcctcaccagccaggtagaggtgacatcaacgtgctgcagtaataacagtacaaggtgtcatgtacactcatgttcatgaacttgagcttcattttgtaggtgctgggattcgggtgggcgggaatattccggcggtatctggtggagccggcggcgatgtggtggccgtccaacctcgtgcaggtctccctcttcaggtaataagcaaatagtaattcacattaatttactctccacatgtgctataaatctgattattcagatatagcttgcctatgattggttaaaaggagttgaattgccacttgtaaagtaatctttccaccagtagaatacattttttttgcgtcgcatgatgtgtgcagccagttgcttgcaattgatgtgttaataaggtacagctaagtgctagactacccaaagataaccaaccaaccaccttcccaaatctcaaaaccaacgtcaacaaaaaaaaagatactttgaactttgaaggacaaataagggtttttattaagctggtgttcaagtcgtatgttgtgtgaacagcactgaatacgatggcactgctattcagcaatatgctaattatataaaaaatattatctgtcctatatcatggttttgtcattttcattcataataagcagagatatattggcacatcatgaattgtctaaaaagtagatattgacataatgactcaagcgaacaggaatcatttaccagtcaattcaataataaaacccacccagcatcatcttcatctgaattctacgcaacaattaggagatttaggcgacttggacactcagctatgcaagtgcatgctgctgcagaaaaccagaattccgtgtatttggagatatcctgagtaataaaagaagcagtcaatcaattttgacagataaaattcaaagaaagaaaacaagatatataaaatatcatatcacttcaattatagacgaagagcagctattaaaactataacaagatttttcgtcccaaaccaaggcataacaattttccatttacgaccaaggaaacaagatcagttacaaccagcaacaagcatcaactaaaccttatacaatatcaagattcatttgagtaaacccgactagacattttaaaacaagatgtttacttccctagaggcttcaatgatttgtcagaaaaacatggatacaatttgtctgcaaataaaaaaaaaggttcagcattttgttgagatgacacttataaatcataataaggcataaatctgtgttgctctgccaatgagtgaattcatctaaaactttcagtggcaatctgaaaagtgagcttaatagccatactggacacacttgcaaatgcagaatcaaattagcagtaaaataataactttctccgtagtcaaaggatggctaaaaaaaaactaccatagaaaagtgaataacagatttgctgcacatgttcatcagggcacttcatgaaaaggaacggaggagcaaaggcggcatgacacgcacccagttcttcttggtagcatttgtgtgcagctttgcctactacattttcccaggctacctattccagatgctcacttccctctcctggatttgttggatctttcccaaatctgtgctcgcacaacagcttggatcaggtctccatggccttggcattggtgcaattggactcgactggtcatccatctcgtcatatctcggaagcccactggctagcccatggtttgccactgccaacattgctgccggcttcttcatctacatttatgtaatcacaccaatcgcctactggattaatctctacaaggcacaaaacttcctatcttttcagatggccttttcacagtgactggacagaagtacaacatctctaccattatagactcacagtttcattttgatacaaaagcctatgagaagaatggaccattatacatcagcaccttcttttctatcagctatggtcttggttttgcatgtcttactgcaacagttgtccacgttcttcttttccatggaaggtatcctccccttccttctccctctaggtctattatgtaaaattagatacacagataaatttgtgacacctgtgtccagtgaaatttggcagctaagcagatcagcttttcaagataaaaagatggacatacatacaaagcttatgaagaggtacaaacaggttcctgaatggtggttcatctccatccttatagccagtgttgcaatcaccatgttcacttgtgagtattacatagaacaattgcagttaccctggtggggggtactacttgcatgtgcccttgcaattttcttcacccttccaattggaatcgtcacagcaacgacaaaccaggtaagaagtaaaagcataaaggcaaatgctaatgcacacatccaagtgtagcacttcagcttattatactgtatgtgacagactccaggcttgaatatcatcacggaatacatcatggggtacttgtatcctggacgacctgtcgcaaacatgtgcttcaaggtatatggttacattggcccacagcaagccctagcattcctacaagattttaagctgggacactacatgaagattccaccaaggaccatgtttatggctcaggtcagcttcactagtcacatgaataaatgggtgtattgcttgtaaaaaaggaggataagcagattatcattttattcagtgttgattatgtccctaat

SEQ ID NO: 66704 - DNA, 2656 bp, Oryza sativa
aagtgcatagccaagtttcttctcatccacagtaccggcggcaatggtatctcaatcatcttaaggaggatgcaaagatcaaagaaccatgccagagaggggctttaaacacacctcaaaatggaagaaccaaaaagaaaatgtccatatgttacaaggaaatgatactacaaggtgtaccgaatacaaaaataagtaaagttatttggtgcatgctaaattgttgccggtgacagaaaacagattatgataatagatgaactgaatttctgaaaccaacactgaattgaaagacagtagccatcgtccatagaaatagttaaagtctgaacatgattccacttacctgtaaaggtaacatcaggatcaccttagcctttaatcatcacaagaaccttgcaggaaaaagtaagaaattcagatgttacttttgctttgagggaaaatgaaacaatacggtcagcatgtaatcctgtatgaaacatggataatataaactgcattatatattgtttcattggaagtataaacagttctgattcatcgtcatgagctagcatatgctactagaatatggtgggaagtgcggtgctgttcacctactatcggcattccatgatttctcaactctataatacacacacacacacacacaccacgattgcaccagcttcagtgcagtatgactactcttacggttctcgctaggaaaataacagagaatgtgaatggacgggtgaatctacaaacgtactctttccgatccaaaataaacttagtgctggatgtgacacatcctagtacaataagtctagatacaaagatattcagattcatcatgtgtgacatccggtacgaggttggtttattttggaacggagagaggaacaaatacagcaagggggaaatcatggagctgttgcccgaatatacttaccacttgccatctcccgcaacaataggtgtactctgaggccttgagcaacacctggtggaatactggagatttggagtgcgtgatggcatcatccagggcgtgctacgcgccagcaagccgggtaggcatttggacgagcaccgtgtgagcgaaaccgacgccgcgccaccagtgtaactttgggaattgggagcacctcgagcgagcgaggccgcacgccgccggggacgaacaggagccagagccggttagcggaggaaggtcttcgcctagggtttaggaaccagaggcggctgccggcggagggcaaggggtgcgcgcggcgcaggagctggagaggtgagaagcgcgtgggcgtttggagaagaagcggatggtgaccgcgccggccgggggcgtgtggagcgcggcggcgaccgacgaggtcgccggcgcctgacgcggcttgccgcgtgtccttgaagatgggcctgaccgggccggccttttagagatgtgggtgggctggatgggctgcatttcgtgaggcctaatagcaccgtggaatacaattcagattagcggacgccaaaactgaagctcttcagagagagccaaaaaaagaagaagaagaagaagcaaactataacatctcttttggacgacacatcaaccaatgcaattcagttttgaattggataccatcaaaacaagagcaaaataacagatgaaagatggaagtataactttcagatgacacaaacttcaccatccatggagaaatataacacatgtttcatttcattctgattctgaacagagattacatgtagaatgaatgatgaaagaatttgattgtaataataatgttgtataataacagccggagacactaatagtgactgtgagagatgctgcccctgctaatctatctactgcttctttgctttctttcttctacatgcagctacattttgcaggggactctctctcaacagccaaaagaatatttataaagaattacaatctaaaaattgaattgaatttgatttaattgaatctttccacctatcaatctataaaacaaaaaactacacctttctttcttctttcttttctctgaatgtataaaagaattgtcatactgtatgaactaatcatcattaacaaaagaagcactgtaaaaaaaggctttgttctttctttctcttcacctaatcaccattcatcgtcagcttagctttgctgagaatgtgatgctgttgtggacgccgacacggtgctgcctcccgcgccgtcgcccgccggcgtccacgccgtcacggtgtacagcggctggtccagccaccggagcgtgagcgcctcgccgccgccgctgccgccgccgccgtgcgcctgcacggtgtacttgtccggcccgaacatcctcgcgatcatgcgcccctgcatcgcctcgcgctcgccgatgccggcgttcttgaacccgccgccgtcctccatgcgccgccgccacccggcgaagctctcgtggcgctcgaaccgctcggggccctcgaacgccaccgcgttgcggatctcccgcgcgaacatctcctccgccttggccctcgcggggctcgcctccggcagccccgccgcgtccaccgcgtcgaacgccgcggcgtagtaccgcagcgcgcgcgcgaaccgcgcctcccacctccccgagttgaggcccccgccctcgtgctcgccgaggag

SEQ ID NO: 66705 - DNA, 10307 bp, Oryza sativa
  unsure (1)..(10307): unsure at all n locations
actgggtgaccggcggcgcggggtgcgtccggaaggagcaggtggtggcgccgctcctggcgtcgccggcgacccgcggggcggcgccgtcgccgcggctgccgcgcttggagaagccgcaggggaggatgtcgaaacgctgcgcggtgctcatctgatgcctcgacgacgagaacgagcaacccgccaacatcccggagacacgtcactcgccggaacgcgacgtgccaagaagagacctcctcctcctcctgctcctcctcctcctcctcctcgtcttcttcttcttcttcctcctctgtttctcactctgatttctctcacactctctctgtggtatctggctaaggctttggtggaatggaaatgtatatgattcgatgtacaaaagaatgagcagataaaaaccagatgatcttgttgttcttccaaagaatttggtcagtaaatcaacaaagaaaaaactgagaaaaaaagagagagaaataatgtttgtgagatcagatgggggctatgtgtttgtaagtatatatgcaggaaagaatgggtggcttcgccttagaatgcttagtacaaaagaatcaaagaataggatcaagaacaaatgggccctaaaacatgtagaaaaaacaaatcacgaacgatcggacatgccggggcagagcccgcacggcctcctcatcggcgacgacgacgacgagcagcaggcggcgaatcccaacaatacctccattcgtcaaaacaacaaaccaaaagaaaaatcaagaaccctagtagaacatcctaaaatgatggatgcaatgcgaatcaatggcgatggagatggagatgcagcctacaaactacgctatcctagtgatgatatgaaatggaacctactcttgttgcctcaccattaccactcctctctcactaacctctccggtggtggtggtctctgctctcactctctcactctcactcacctctccggtgtggtggaagggaagggaagaagaggccgggaggggcaacccaaggggaggaaaagagtgcgggaggcgcgaatctcgaggcggctcccacgccgtcggatcgcgaccggacggtgcgagatggggtggtccgggatgtgaccgttgcctgattgcctccccccctctctggtcaatgtgaccgttgcggtcaggtgcgacgcacgtgaccaccccccctaacgctgtcacgcacgcgtggacgcggtcacgcagcacgcccccgttcttttgttaccgttgggctcccaccacctgacacgcgtgtctgacgcgtgggcccccgcgccgaaccgacggcccagatcgcgtgagccggacgccacgcggtgcggccacgtcagcgcggcaacggacgctgagctgtacgtacaggctagtgtacagggtggggtacggtgtgctgtacgacgtactacgtggctgtatcctgcgtgtctggtgatgatgatgtttgtgtgtttgccaccgtcggatcgggacacgtacgcacgcatgcgtgtcccgtgttttggcgtcaatgcggggctcagttaatgatgtgccattgctgtcagaaaaaaaagtgtcattttggtacgtgacaaaataccgggtgttttacttgcagacagctattgtcattagctgggttagctgctggtatatttgttttggctactaagtaagctcgagttttgggtttgttttgatcttgaaatgcatcattgtgttgtgccaccacttttgagtcttaatttgtttcttcctcttacttgaaattttgtgggaaattacaagaaatgcgacggtgatgagtagcatcggatcaagctgtacaataaccgttacaattgaaatgactgtttagtacaaccgttatgcgttgccctagcttctactcctaaatggcaacattagtattgcctatctatgaaccactcgtacatatacgcctgtaatggttgatttgcatgatattttgctgtctaaatgttaacattagacgtcggggacgtaaattcaattaccaggttaactacatgtaatatttcacactgtagttcgcgctataaacaaacgttggtttgcttattaacagagtagtttatttcaagtttttttttcaaacaatgtatgtgaaccggcaagaaaacatgagattaaatccacaactgcagttcatagggtccacgtctaactactggagttactcataaattcatatccaaagagccatttgtatttcatacacacagcacctctctaacaggacgtatagtagcagtaccatccaggaacattatggtaacaataaatgaagtttcaatcggatgttattcctggcgcgagcttgaaatcttcaaatcgaaatcttaaaggcacatttcctaaatgtgtgttttatactaataagaatttaacttctcctctctcgtttcatatgtacgcatttcctcaattattgaacgatatgtttttataaaggttttctatagaaaaatattaaaaaacaaaattaatttagttttaagttttttatataatacttaatttattatgcattaatgaatggttctgtttgacatgcgcagcgagaagtttccaaccattttaccgagcacaccctaatttgctttacctaggccgtgtttagttccaatttttttttcaaacttccaacttttctatcctatcaaaatttttctacacacacaaatttttaacattttcgtcacatcgttccaattttaaccagactttcaattttggcgtgaactaaacacacccctagctaaccggagaaagtgtgaggtccaaagcaatagccgttattccgttacaggctttattacaggtcttcttatcgccggtcgtacgttggcccacaatcccggcccgctcaaatcttagctctaaccacgcggcccaacctggaatttgggcccactacacaactggatgttgggcctgatctgcgacaggtgccggcccatatagagtggatcgcggcgcatttaacctccttttcccaattcacggggcggctggcttgacgcgtcatcttccccgcgaaaatttcaaagcagccgaggagaaatccaaaatttccccccaaatctttcccggcacggcgccctcctgctccttccctcgcaagccacccccgccgccgccgccaccaaggcgcgaaatccaaaattcgcgcgcgcccgccgctataaaggcgaggaggggatgcctcctcctccacacccactcgccgagccaactccaatccccaaaccaccagatcgaatcgcggttgccgcggcggaggcgaggaggaagacgaggatgccggcggcggcggcggcgaagacgctggtgccagcccgcggcggcggcgacatggaggagccgctgctggcggagtcgtcggatcgcttctcgatgttcccgatcaggtacccgcagatctgggagttctacaagaaggcggtggcgtcgttctggacggcggaggaggtggacctctccgccgacgcgcgccactgggacgccgcgctgtcgcccgacgagcgccacttcgtctcccacgtgctcgccttcttcgcggcctccgatggcatcgtgctcgagaacctcgcctccaggtcatgtccgacgtgcaggtcgccgaggctcgcgccttctacggcttccagatcgccatcgagaacatccactcggagatgtactcgcttctgctcgagacgtacatccgcgacgacgtcgagaaggaccgcctcttccgcgccatcgacaccgtccccgccgtgcgccgcaaggccgactgggccatgcgatggatcgacggcggcgagcgcttcgccgagcggctcgtcgccttcgcctgcgtcgaggggatcttcttctcgggttcattctgcgccatcttctggctcaagaagcgcggactcatgccgggcctcaccttctccaacgagctcatctcccgcgacgagggtctccactgcgacttcgcctgcctcctctacgacctcctccgcggcaagctcgacgagtcacgcgtccaggagatcgtcgccgacgccgtggacatcgagagggagttcgtctgcgacgcgctccccgtcgcgctcgtcgggatgaacggcgagctcatgagccagtacatcgagttcgtcgccgaccggctgctcatggcgctcgggtgcaagaagatgtacaacgtcgccaacccgttcgactggatggagctcatctccctgcagggcaagaccaacttcttcgagaagcgcgtcggcgactaccagaaggcgtccgtaatgtccagcctcaacggcggcgcttcttgcaaccatgtcttcagcatcgacgaggacttctgatcacatcgactgccatagtagtattaaagtagaaatacatgttctcccaaagtgttcgtatggtttcttgttttatttgttctggtttgacatgtactcctgtaatgaatcaagtaaaaagtttctcaatacatcaactggtcattgcctgtatgcggtgtgttcgacgaaatgcttattagaactcatgccattctgggggcgcaaccagggcgttcgatgaaatgtctctgagcataagatgttccaagcgaaggagattgtgttggggaaatggattatggatcgcttggctccagccgcacgcgcgtcgcctgttccgtttctgttcaccaatccccttcccttcaatccttcccgaaagacgaaacgagcgccgcgccggcgactccaaccaaccgtccaacagaaccaagagttggagacttgctgacagctgactttagcattcgttttcccctgttggcctctcctacacatgaacacatctgttttagagctaggagagagtttaagagaaagggttcagatcggcgattcttgcagacaaccatggtatgattttcttgattattacataggagtacaatacaactaagggtgtgtttatttcacgccaaaattgaaagtttgattgaaattggaatgatgtgatgaaaaagtttaaagtttgaacaaaaagtttggaactaaactcggcctaatatatttttttgctgccttgcaaggttctaaagactatataatatatttttaggtgtttttttaagagattagagcttgccttcttcatgtttcgttgacacgttttcagattccagccgatttgcaatttgcaaatcaaggtactactatattgtacatttgtactactgttcttggtattatgtcagtcaggaagtatttatctagaagtgaaaaaggaaaaaaaaaaggaaacgagtagatgagttaactgaatcttaatgggagcaatcgagaagttctttaggaataatactgattcctttagaaatcccgatgaattggctttagttgttttcaacgagcaaattaatgacagttctagagaataccaataaggcaatagcatcaatcagaatgaagatgtcaataacttgagtgagcatgaaacctaacatgattcggctgatacaaattctgtgggtgttgatgaacaaccaacttttgctattgaatttttgatccaagaaattggggtaatcttgataataaagcaggagatatctaaataccgatttcagggtgcaatctctaccgaatcattgggccacgtggccaaagctaaaagcaagctcacatctcgttaaaatgtgccatgtgtccagaagagcacgttccattccgcacgactgtgaagactctagataaaacaaaggaaaaatccagagcattccaaactcggttgaaaatcacaccaaaacacggaaagaactggtgaaaaagattgcataccgaggaaacaatggagaagaaaaaaaagtgtctaaaaaagtgccccaagttttttaaaggaattttttttaaatctaactataatataattgtaatataattccactataactatactataacaatattataacttgtatataaggtcctttttagttggtgaaatgaaaatttttgggtatcacatcggacgtttgaccggatgtcggaaagggttttcggacacgaatgagaaaactaatttcataactcgctggaaactacaactatactatactatatattgtagttacactgcaactatactatagtaatatttgaaagtttttttttccaaaaaatataaacagcgagccgatgttagctgtcgtaaaccggcgacgaggaagacatctacaacagtattttccggatccacggaagctatttccaacgagcaagatccactcactcaacggatcaagcgaagggcgtcgagccgtaccagctgtgatggtccgcgagtgtggacgcatcaaccagccggtgagcgtcgaggtcgaacacgtccacgccatccacggtagcaacgaccacgacctcgagctcgaccacatccaggagaaagagagagggatgaagaagggcccaatgaggatacccagatttggaggatcaagggacgagggcgatgttgcctctgctaccatcatcttcctctttttctccttattctcgcaagcgtcatcttcctcaattgctcatgcctttctcccagcaccgacgcggcaatccggccttgttctcgcaagcgacatcttccccaacggttgtcgcctttctcccagcaccgacgtgccaatccttgttctcgcaagtgtcgtcttccccaaaggttgtcgagctgagaggtaaaaagaaaagaaaatattaaaacatgaggttttatcaacacttatcataaaacaaacaaatgataaccgtaatattgataagtatatgttaaatattataaaaataataggtatatttgttaaaatattattaaaataatgtgagcgatgatgattagatatacttacatgttgatttgtagaattaaataaattatagatgatgttatacgctagcatgagtttaaatatataaatattgcttttatctgtagtgattgggccacgtgtcctctctcacatggtagataaatctggagaacaccaaaaggggaaaaaatgataccaagagttgggcagttgtgcgtcgagtgcgaaggaaaaaacagggttgtgggtccaatcaatggcgtgcccacatataacttaccggtgtcacaggacaccgggtaaaattgttaaattctaactatttatgctattttgattagtatactagtgaataattagataanctactatgtagtggacctcgagtaatgtagtggaccccgggtaatttttattctagattcgccgctggctcccatcctcccttgcagatgaaaggataatctaaaaggatcgattaggcaatcagcaaatgcctctgtcaatggagccaatggtggccacctgctcanaatgtatacgttcgctgtgtgtctaggagtacgagggaagagcatggctgtggcagctccagtcctctcacgcagaggaaggataatctggaagtatctatatatcaggggaaggagcaaatgcctctgtcaatggagctcacttgctctacatgtacatgttcaaagatagagtattctatagtacatttgcaaaaaatgttagaatgcatatacaactactcatattcatatatatctctataagtattttcgaaatattgagctgcatatcttaaatgaaaaaaaaaactattttatctcttcgaaccaattcaatggacactactaaaaaaatctatcatgagttaataacttaattgtaatttaaaaaaaacaaaggaataactaatggcatggatggaaaaagggagaaaatttgatgattttctcaacaatatgatctattacgttaaactggaactcaaaaaattccattcaactaagatttttttaaacttttatgaacaatgtgctaattaataacacaaaaataatatatacgggctataaatcatgcgcgccaggtgcgcatgattttctagttttagtggaaatggggcctacaagagaagaaaatattgttttttttgttgtgttcaacttatgaaaagtattattaggcgattggaaattggaatgacagttagtatgacttacggatgtttttgttcaataatataatgaattattatattcactattgcaaaaaaaaaagttatgagggcctctatctttatttcacccaagggcttccaagaagttaggactggccctgaataaaaccttcattggaatgaatggatgaattttcagtgtttgttttgtgagaatcgaactaatttcgatgatgatcctgtgaaatcttaaactattttctcactaattacttcaggctgtgtttagttcacatcaaaattagaagtttggttgaaattggaacgatgtgacggaaaagttagaaatttgtgtgtgtagaaaagttttgatgtgataaaaaaattggaagtttgaagaaaaacctttggaactaaacacggcctcaatcttcgtaaaatttctccgaaattcgtcaagtccaaaggctgcatgccttgctgaattctgtccacacaacaaacgctggtctcgtgtcatctccacatcgccggagaagaagacgatgatgacgtcgacgacgatggcgaggcccacgacgttgctggcgtgctgcaagctctacatctccgagagccgcaacgacgccgccctgcgcgccatcgagcaggcggcgcgcggcggcggcggcggcgccgtcgtcgtcaaccgcttcaccgacgacgcctacaaccgggtgggctacacgctcgtcgcgccgctcaccccctcaccggcgccgccgccgctccggcacgccgtgctcggcatggtcagggcggcgctggaggccatcgacttcggcgcccacgccggcacgcacccgcgcctcggcgccgtcgaccacatctgcttccaccccctcgcccatgcctccctccgccacgtcgccgacctcgccggagccgtggccgccgacatcggagacgagctccaaggttggtgctgctctccactcctcttctcctcaattttcacttcaagaaacaatctaatggcgagctcgccgctgccgaggccgcagtgccgacgtttctgtacggcgcggcgcaccgggaggggaggacgctggcctccatcaggaggcagctcggctacttcaagcccaactcctccggcgaccaatggcggggagcgccggagacggacgccctgcccgtcgcccctgacgccgggccggagaggccgccgagatccaagggcgtggtggtcgtcggcgccaccagctgggtcgacaactacaacgtgcccgtccacaccggcgacgtggaggcggcgaggcggatcgcccgcgccgtcagcgagcgcggcggcgggctcccgtccgtgcaggcgatggggctcgcgcacggcggcggcgtcgtggaggtcgcctgcaacctgctcgacccggcgagggtcggggccgagcaggtgcagggcatggtggagcggctcgccgccggcgagggcctctccgtcggcaagggatatttcactgatttttcccaggataaaatcgtcgacttatacttcagatcagcagccaacactgagggttaactgcagcgcgagtgaaaagtaaatctttacagaaataaatttgatatgatttcacagaaacaagctctcaaccagtggatcactgatgagttctaagttccaactcaagaaatgcaatcacattatcatgcgtaaaatttaccaaaaaaaacagaacaaacgaattgattcaacttaaacttcggtctctgctatatatatatatagagattacatctcaactgctggccagttgattgaactaatcatttgcatatcttgggctacttaactcctgactgattaagctaaacctttagtttgtaccgtgatggccacttgattgaagcggctagctatctctctagctaggctcagtgaagattttgcgagggaagctgagattttagaagaaactgagagtatgtctaaattttcagtgaaattccacgtttctctccattagagttaagtgagttttttaaagaaaattgttactatttccactagcaaggtatatgagacaatatatcgttttccaagtgttgtcactagttaccaattgtttcttacacttgccatctcataaacccactaacctcgcgttattaggtacccatatataaagaaaaataagcgatttaagcatataaactccattgcttagctcttaacattatagcactccctctctctctctctctctctctctct

SEQ ID NO: 66706 - DNA, 2124 bp, Oryza sativa
gtataaaaaaacacatggaggcaactggaaaaggcacaaacaaatctaaccagacttagtttggactaatcagctcaggtcacagggagctaaatgcttaggcttgaacaacaactacagtaatcctcctgtccacttgtgaaacacaggtagaggagatgtagatccagaaaaggcattcttctttaactaaggctgagtttagatccaaagtttgaatccaaatttcagtccttttccatcacatcaacctgtcatacatacacaacttttcagtcacatcatctccaatttcaatcaaaatccaaactttgcgctgaactaaacacagcctaacctcaaattaaacaatcacaatggactgatccccagaaacatttcgatatccagagtcttcttgtgcattcatagaagaaaatattcagactttttgcagatctgaaccagcctttgtcagattgggaaaatagctgtttttgttgttgcaaggatagattcttacatacataccatggttggtggtgtcatgtagaagtagttagtttcagaacttgttggccggttgttgcctaccctgtttgtcactgacctggttagatatctctgaaaagaatgaaaaaaaaaagtattagctttgacaaacgcacacacccatccaataaaaaacaccattcgtgcaagtacaatcctgtggtctgtcattctgtaaatcaacaagaacatgagcagcaatttttcaacgagaacacaaaagatttgcgtgaataagagcaacaaaaccaggccaataaaccattcttgacacttgacaggatacagtgacactgtgttgttgcacatggtaatggcaatcagctattgagctcaccaagcactagcatccatgacactatgacagtatgacatcttgcagtttgcaacaggtgtccaccttccatctcaagcaagcacctttcaaccacctcccctctcttcctcccttctccacacgatctgaattgcacaacagtgaacgaatctgaactatctgaccgaggagatagcaaatttcagttcttgatcggtgattgattcagtgattattcccaaatttccagtagctggcaaaggggaggagaagtcagcggccatgctgctgcgtaccatgaagctcccgctccccgccatggccgccgtcgtggcgctctgcgccgcctcctacctcctcgccgtgtggacgcaccctgccccgccgctccccgcctcctccctcgccgccgtcccgtgcaacacgcggcagccaccggcgcccgcggcctcgaagaacgacaccgccctcgacttctcgatccaccacggcgcgtccgaggaggacgcggccgaggcgggggcgccgccatcgcgccgcgtcccggcgtgcgacgcggggtactcggagcacaccccgtgcgaggggcagcggtggtcgctgcgccagccgcggcggcggttcgcgtacagggagaggcactgccccccgccggccgagcggcggcggtgcctcgtcccggcgccgcggggctaccgcgcgccgctccggtggccgcggagccgcgacgcggcgtggtacgcgaacgcgccgcacgaggagctggtgacggagaagggcgtgcagaactggatcaggcgggacggcgacgtgctccgcttccccggcggcgggaccatgttcccgcacggcgccgaccggtacatcgacgacatcgccgcggcggccggcatcacgctgggcggcggcggcgcggtcaggacggcgctggacaccggctgcggggttagttacttttaccgcgtttacttctcagattaacctggtgatgatagtcactgactggtgggcccagtcccgagtggagtttttccttgttggttgactggtggtcaacgtaatctcgaccgcacatctctgatctgacggctagtggtagagtttgactggttgaggttgatattttacaatcgagtccctattttattttccaaaatttgtttgcaattcaatccctatgaaattcgggctgctatcaatatttctccaccacagttgtgttgttttcatgtttttttttactgtttcttgatcatcagcgcgtagatcagtgtaca

SEQ ID NO: 66707 - DNA, 4337 bp, Oryza sativa
cgagttaaacacccttgtttttttctatcgtatttttgccaaaatgtaggggaaaaaacccttttttttagccctgcgaaaaaagtatggttttttttctactgggtaaatgcctgtggatctccatgtagtcatctgtgattaacaccttcaccagttatccttgccttatctgtttgttaaatgttggattaaaaatgccactaggatagttgaatgttcacaactagtactagacatagagtacatggatgcttcgaggacagacagcaaaattagatatatttggatcagcttctggatgtggatcaaagctggttttatgttaactaagtaccctctccatgtgtagagtcggtgtgagaaattgaaaaaagaaacaatggattaattgatgttaggtctgagtcggtgattgatatctagtttggtaggagagttcgatagaagtgtgcacatggaattgtgtactgatgagagcttatttggataagaaaatactaatcatagtccaactaaccagacggcagatagctttatctgaactcaactgtgcatctttggatctggttgctcgtactccctccgttcttaaaaaaaataatcaaaaatcaagtttttaaattagaaattggttttctttcaggacgaagagcttaccttactaattgatcattcttgctacctttgtgttcactgtaaagatggtacaagatgtctgatgcgacatatatatccagctatcaacactattgaacaaaatgtccaagacatgattttcttcccccttgttgttggcttgtgtttcttggctaacttcaaccggagtacgacgagtttaacactagtatcgtttacccttcggcctgtaatttaatcatcataaataaaacgatggttgtataaaacgcgtcaaataagatttctcgtaaacaaagttttttcatcagacaaatcatccttactcgggaaacactcatgcatgagtcaagctgttggctatgacaattgatgagaaatgcccaggggttttccggctagctccacagggtggtgggctagacgacttgggttcagagcttcacctcttctaattatttgatattaggtcatttcctaatatccgtgtcttctttgctatgacaattgacaaatcaatctgatgctaatgtgcactgtctactactctgaactctgaagtgtgaacgaaccacatgtgcaggtcgcgagctggggagcgtacctgctgtcgcgcgacgtgctgacgatgtcgttcgcgcccaaggacacgcacgaggcgcaggtgctcttcgccctggagcgcggcgtcccggccatgctcggcatcatggccaccaagcgccttccttacccggctcgcgccttcgacatggcgcactgctcccgctgcctcatcccctggagcaagtacagtacgtgctttgtaactccaccacctcaaatttcacccctgcaaaatcaaacttgtgcttaatttgatttggaagccaccaagttgacaggctttttcgaagttaaggacgagattcggtcaaacttttgaaattccaaccatccatggataatacctcaaatgcttattttaaaaacgaaagaagaaaaagtactaaagtagtatcattgtatcatacttattataataaaaaactagcatggtggcccgcgcagattgcgcggctagtatcattatattttctctcatataatagcatatatgttttctcattatattattcaaatatattaaaatgacaacataattttaaattttgcaataactttacaaaactactaatgtgtaatattcatattatattttatatatgtttagttattaattatttttaatatcaaattttagttatttgtaaattatatatattcctatatggactctagacttgtcttttaatatttattttttctaattccgaattttctgtaaattatatttctatataggctctatgctcttcttccaatattatttatttttatttttgaatgttcatattatattttatatacgtgttagttattaattatttttaatatcaaattttagttatttgtaaattatatatatatatatatacatatatatatatatatatatatatatataaaatttaaaaataactatatatatatatatatatatatatatatatatatatatatatatatatatatatatatatatatatatatatatatatatatatatatatggactctaaactcgtctttaaatatttctttttttaattctgaattttccataaattgtatttctatatagactctacgctcttcttccaatattatttatttttatttctgaatttttattatctctaattgtgtgtctatgtggactctaaactcatctttcaatattctttaatttttagttttgaattcagttacttctaaattgtatttctatattgaccttaaactcttcttcccatgtttttcttaatttcgaattttagttatttgcaaattatatttttatacgaactctaaactttacttttaattttcttatgtttattccaaattttatttagtttaaaatccctatatggactctatactctacttctaatattcctttttttaattccgaatttcttttttttcttaattgtatttctatatggactctatactctacttctaatattccttatttttaattccaaatttatattatttcctaattgtattcttatatggactctatactatacttttaatattccgaatttctgttatttcctaattgtatttctatatggactctatactctacttttaatattccttatttttaattccgaatttcagttatttcctaattgtatttctatatggactctagtctcctcttctaatattccttatttttaattccgaatttcaactatttcctaattgtatttctatatggactctagtctcctcttctaatattccttattttttaattccgaattttaggtatttctaaattgtatttctatatggactctgttttttctttttctccgattaatgtgagaatttctaggccatgagagcgaacgtagaaattctattcctttaataatataatagatttttggtcgggaatttcgaagtttgattaaatcttgttctaaacatcgaatatttatgatcggaggggtagctttgattgatcatggcaatatcaacaatggttgttgcatttcagacgggctctacatgattgaggtggaccgggttctccggcccggcgggtactgggtcctgtcagggccgccggtgaactgggagagacatttcaaggggtggaagaggacgccggaggacttgagctccgagcaatcggccattgaggccatgccaagagcctttgctggaccaaggtgcagcagatgggtgacattgctgtttggcagaaacaaatcaaccatgtcagctgcaaggctagcagaaatgagcttggtggtcttggtttctgcaattccaaccaagatcctgatgctggctggtatgcatgtttatcacctgaaaatgatccaaacatgattccattcgaatgaaaatttaagatttgatttgattaacaatatgtagttttacacattataccttaaatctgtagtttcgtggtaaactcggcattaaatctgtagtttttttatactccgtcgtaaatatgtagttttacaatagtttggtcaaaatatcagtagttttacgaaaaatactcaaaaacatttataaactcttaaaaaaatgttggcttcgtttctgaaagttcttgaaaaatgatttcaaggtatgtgaacatggaagagtgcatcactcccctaccggaggtgtccgggcccggagacgtcgccggaggggaggtcaagagatggccggagaggcttacatcgccgccgccgaggatcgccggcggcagccttggaagcagcgtcacggtggacacctttatcaaggattctgagatgtggaggagacgagtcgatcgctacaagggcgtcagcggcgggctggccgagaaaggccggtaccggaatctgctggacatgaacgccggcctcggcggcttcgcggcggcgctcgtcgacgtcctgtctgggtgatgaacgtcgtgccgacggccgccgttgccaacacgctcggcgtgatctacgagcgagggctcatcggaacgtaccaagattggtaagctgaaaattcttctgaccaaaatatgttcagtgtcgttgctaatgcaaaatcttcagaaaacaattgcagaccagcatatg

SEQ ID NO: 66708 - DNA, 2736 bp, Oryza sativa
  unsure (1)..(2736): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccagtatgttattggattattctacaagcaggtactccagtaaatagtaaatcttatagccaagaacatgtgtcttgcaataaatgtttacaacgcagaacctcacctctggtcggtgacgcttatggtataagtattgctttaaccttcgagaacaaagcccattctcgacaggagtcctaacaggtccagctagctgcattccaggctgcgctagtggaggcctcaactgtggctgccgaggtatgccaacttgagattgttggatctgtgaaaatggttgcaacatctgatgctgctgttgctgctgaatctgtgccagtttatgctgatggatcaaggcttgaatctgagggttctgttgaccctgcagatgaagagaactctggccttggagcagttgctggattaaattgtgttgcaggatatcatcttgcctaatatcaacccttgacttcttctgagcatgcaatgcaccagcagcatcaataacaggttgtgatgttacactagaagaccttcgcttctgcatctgctcttggggaggactttgttgcacaatgggaccatcaataactgaagatccagagatgttattggatgaaaacgacattggggaagcaggaaggcgcatgaatgaatcagcattcatgctcgtacttggctgcaactgggcacctccggagagcgatgagttagcatccgtcaccaaagagctaacaccaatgcttggcccagaggaatttgtagtgctaatagggatactaccatgcatatccctgggaacaagtccaaggttggagcatggcgccccagacatggaggttaccagggttcgatcccaatcatcactttgaagaacctgcaaaaggtgaacatgaattattaggaaataaatcatcaaatatcttactggataagaactgttaacagcctaatgcgtgagaactgagaaatggtcagcagtaactgaagccaaacagatgcaagtagtaatgagattttagcatcatgaaatttctcgattcaatggttgaaaaaacagaaaacagaagaaggccatttttcaattctctaaccatactacgctactgcaatagcataaccagaaaatgaaactagaatccaacaaatggtaaataaataaaaaaatcgtctttgaaaagaaaataagggacagaaaatatagcatgaaacacaaattgcaaaacagttgatgctggttatgcagggtgtgagctgaaatttactcttttggttgaaattagccgagctttagcattctttccaccacacaaaaaaaaatatttttcccaggttcctctcatacaagtacaagaatggagcatataccaaaatgtcttccaggtcagatcaaacaacgaaagaaatgaaatagaaatcaagttcacatcagacaaaatagaatactgaactaacttcacaacaaaaggctccagggcaacgaatcgagagaggaggggaggggaaactgccacgtccggggaggatggagagagaggacaacgaaggccggagatgtgcccgcagccggatcgccaaccctagcaaagtagaggagcaggagacgaaacaaggagaaaaattcccccctaatctttgctccgtagcagatggataaaaaccctagcccaaactcgccccccaaaaaccaatcgaaaaaccgagctacaaagattaagctaacactcgaccaagaacagaaattccacctctacacccccaaaattaccacgctacattgcaggaatcggcacccatcaacccaaaaaaaaaatcacccaacccctcctctcacaacccaaccacaaatcgccccccaaaaaggggagcaaaaacaagaaatacttaggtcacttcccgcggtccgagccatcaacccccccccccccactaccaaaccatctctctcaccttgagttcgtcggctcaatcgctggccctcccaaaccccaacttctcctcctctaccttgcagctgcgatttttttttcttttttgctgcgaattttttttttctctcctcttccgcttcttctcctcctcttcctgcgcctgtaggcggcgtcctcgccgacgagcaaaccggttaaatagattcgcggcgcccgggacggtggcgaccggctgcagccggtgggccgggcccacattgaccgccattgaccggtctccgtggggcccacgggaggcctccgggccgtcggatcggccgcggagccgcatcgcgaggcgggtgtgtacacgcggccgcgcgtgattggctcccggtgggggcgggggaaaccgggagacgggcaggtcggctcctcgctacgcgcaccccgctcgcgcgcgcgcgcgtacacacgcggtggtggggccatcttgtcagcgaccgtgtggcttggcgggtgtggaaacctcggtgctttgcggtggaaggctcgggtggatctttttggccgagcacgcgggtagctcttcgtggggcccacacc

SEQ ID NO: 66709 - DNA, 2765 bp, Oryza sativa
ccatgcacacaaaaggctacacacaagggtggggggagcttccttttgtggctgtacaaagggtgggggccagcagaggctgtgctgagtttgactggttttgcattgtctatgcaaggctggaagactatcataataggctttcctttagcttgattattgcagcttacatagcctaaatcattgtaatgggggcataagggattttttttatgtgggaaatacaaaaggatgaagattgaagatgatcaatggttgttgtggttatagaacatgtattttgtgataaatggaatacaattatggagtgtaggttgtcctaaaaacgtgattcagcatagacagaaaagtgatatcttgtctagagcacaacttcggatagtgagaaatatacggcggaataactggatagaaacctatccaaaatacatgaaacggttattatatgcttttatatctataagatattagtagacttgtctagcacgtcggatctagtaaaatatttagtatactatttttgaaagaaatcagataatcatgcttggagtggcattccaataattttatattattatttctaccaataataatataaaattattatattattatcttgtactccctccgtcccaaaataactcaacttaagatgggccatcttaggacaacgaatcttgacaaatgctttgtccagatattttgggacatagggagtacatgactatgctatgcagataattcttttcaaatcgaactgggatgaattttgaacctgtttagcctgtttttgaccagctttaaaagttaatgtacatattccaaaccagcatattaatcgcttcagctgatggtttctagcgttgtgatggagtgcattccaggttaaccgcgttgctaaaccagccaagccaagccaagccatccctggttacttgattagtctgtgtgacgtgtagcggttgcatccttcgcatggaagaatacatgacgaggatacaagtcagcggccactatataattttccatcatgtgcatatacgaggttcttatcgtgatctaccgcgatatcttgattatatttcttgtaatttgactggttttttcaaagaaagagaactcaatgtcaactcatctttttttttcccgacagcagccccgatgaactaaggcttccttcgaaatagagtatggagtgagcttaattatcaaccgtacgcaaaattaaaaaaaatcattagcatgattaaattaattaagtattaatactagctattacaaacttaaaaaatattaatctaattttaaaagaatttttatgtatatttttttagaaaggaaaacacgattaattgtttagtaagcgtgctgacgttaaacgagaaagttgcccgaaatatgtttgatcaagtttactcaaacatttaaaagaaaactcacatgatgatttgctttaatttagtaagtacgcagtacatgtgaaactaattaactatcttcatatacaagccctgaacgatgcattcacacggatcaattaacacgagccgcgtcgagtagcatgtatgatttctgatattgtacaatcaaccttgaccacccaaaaaaaagtcaaaaagaatccaatttgaagcgacacgtctcctagctaacaaaacgcagcagagagaagagtaacagtaacacaccatgaacacgtaggtacatttgcgttctgtatatatttacggaattttcaatttggtttctcgccatcgccaatccaagacactgcgaccggccatcttaaatcgggcaggaaatcgacaagtaattcgattttgatagctttcagtttacgttccaccgcgacgatcgatggattgatgatgaaataatctcgatcgatcactgcatcatgcatgctgctgagtccaatcaataatcggagatcacctccccttcatgtcggcgagctgcgcgaacatctcgccggcggcggtggtggacacgtcgggcacggtggagacgccggagccggaggaggtcgccggggccgcgccggcgccgtcgtggtcggctggcttgtcggccccctcgggcgggttggcgtcctgcagctggagcgcgtactcgaggttccagagcacgtcgcccatggagatcctgtcgctgccgaactcggcgaggcacttctcggcggcctcggcgaacttgttgagcgactcctggttcaccgtcccggcgagcttggggtccatgatcttctcgatgaggcccttccgcttccactgcatcccccactcggcgaggctgacctgctcgcgcggcagctgcgggtcgatgggcggccgcgcgcacagcgtctcgaggagcacgacgccgaaggagtagacgtcggacttgtccgtcagctgctggcaccggaagtactccgggtcgaggtagccgaagctgcccttgacggcggtgctgacgtgcagctggttcatcccggggccgtccttggacagcccaaagtcggatacctttgcgacgaagttgtcgtcgaggaggatgttggtggtcttgacgtcgcggtggatgatcccctgcgccgtgccggtgtgcaggtagtggaagccgcgggcggcgccgatgcagatctccagccgctgcttccacgtcaacgccggcaggtccttgccgtagatgtggtcgcggaaggggccattgtgcatgtactcgtagacgaggatcatctcggcgttctcgtcgcagtagccgatgagggagacgaggtggcg

SEQ ID NO: 66710 - DNA, 10067 bp, Oryza sativa
cttgtccgtcgcgatcgacgagttgacgacgatgtccttgtagtacgccgccgacagctcgccggtcaccgtcgacaggtccagcccggagatggccttgcgcccgttgacgaacacgttgaagtagaggtcgttcatgctcttgctcacgatgtccgcgaagaagagccggaccaggtagccgaacgccgggtccacctccatcttccacgacatgttgaagctcgggctccccacgccggcgtccgccatcttcgcgcagctcgcgtacacctgcgccggcgccaccagcttcgacgtcccgtcggggaacttgatgttccccaccggcaccgacacgtccttcaccgcctccttcgactgcacgtacggcgcgtccacgtcccactgccgccccagcgtatccttgtcgggcgcgatggccgggccgccgacgttgatccggtacaccacctggtacgccgcctcggcgagcccggtcatctctccgacgggagcgatccccatggccatgtctgtgatgagctcgtcgggggcgttcacgacctcgatggcgttgatgaacgcggcggagcccttgagcgggtagaacttgacggcgaggtggttctcggtggcgttcacgaggaactccttcatgaccggcttgttctcggcggtgaagctgtggaggaggacgttggtgtcggtggagacggtgaaggtggcggtggtgaggtcgaagtcggagttcttgagcgggaagaggtagaggcggacgaagtgccagcccgggacggtgagcgggaagctgtagacggcctcgtcgcggaagatccgggcggtgaggtagagcggcgagggcacgtcggcgtcggtggtggcgaccttgatggcgtccttggcggagagaaggctgttcgactgcgcgtccgtcttgtacaccttgccgccggtggtgacggggctcgtgctgccgcagtcgatgaggaagttgtccttgggcgtgaacgtcgacggcgtcggcgccgtctgcgcgccgctctcggtgaccggccgcccctgccccgacacggccgtcgcgagcgccgccgccaccgcggcggccagcagcagcgccggcgggatcatcctcccgcggcggcgcatggtggtggggtggcctacgtggcacgcaagacgtggcagtgtattattggaggaggcgcgcggcgccctctcgccctctctctctggttggtggggccaatcggaggagagggaggagggggcgtggggccagggagtctagaagagggtggcggagaggtgggcgggttatgtgggccaatgagcgcgccaagtttagtttaagcaggccgcccctacggttgggcccgcctcgcgcgctccaccgctcgcaaattctcgcatacgcgcgccgcgtcggccgcctattcttagcacgcgacggcttcgttcgattgcaggtggaggagcaagatttgtaccgcacacgaaatctaatttgcaggtggaggcaactccggctcggacgtccgacgtttggggaaaaatcgggcgctgatgtcagcgcccgatttacgtgcaaaaactactttaaattaatttttctcttaaattacttatctaaatcatgattcgatttcaccattaaattcgttgcaattaaatcttcaaaataagaccacacatggatatattccgacgattttttttagcttactgttgaattatttttaaatgttgcacgatgttccaccaggtatatcagaattgtttcactaaatagatcgaaaatgtttcactcgtttaaatcgggtgttgtttcaccttatataaaaataagggccatttgcttatttgaccctgttttgaaggctaactaccaatttgaccctctttttttgagtttgcttatttgaccctgcttttcgaaaacgaacgatcggtctgaccctgttctgttaaggtgagttgacggtgttaagttaggggtaaatagtctattttgcccttgcaacgaagctgacgaccggcgatggcaacgaagctgacggaggcggagacggcgacgacgatgctcttcccggccacggcgggcgcgagtgcgggcgtgagctcgctgcacggggccatcccggcgcttgtgtcggcggggctcggcgccgcggccgacgagtcagcgggcgacgaggccagggacatcggcggggccggcggcgaggccatcgtcatcggcggcggtgggggccttggcgagcaggcactggcgcatgtcccctccgcgcgcataccgccgccgccgccgccccctacatccacaagctgacgccggcgcggatccgcctcccctccgcgcgaatcccgccgccgccgccgccgcccctacctccacaagctgacgccggcgcggatccgcctcccctccgcgcgcatcccgccgctaggcccggctcctctcctcccttcgccggcgcaggcctccgcctccctccccgcgcgccgatgcagatgccgccagcgccgcctctgccgcaggcccggctcccctcccttcgccggcgccggcctccgcctccctccccgcgcgccgatgcagacaccgccgccgccgccaggcccggctcctctccctccccgcgccgcatgccagcctccgcctccatccccactgcgcgcgttgacgccgccgccgctaggcccggctcccctccctcccttcgccgcgtgctgtcaccgccgccgcaaatcgctagcagaagagagagacatggagactcagagacatgtggatagggctagagatggatatggtttcctcaagggtattttgggcattatgaattttaattatatttttttctttttttaaaatcaaatcttaacggtgtagtggaaatagggtcagacggaagattcatttttgaaaagcagggtcaaataagcaaactaaaaaaagtagggtcaaattggtagttagacttcaaaacggggtcaaataagcaattgtccctaaaaataatgtttcagcaaatagcgaaagaatgtttcagttcactgcaatatttgatccatacataatgaaacattataagtacactaggtgaaatattttttggtggaataagaaatgaaatgaattcccttaatagggggtttccaaaatatatgggttttttgttgcaatgaaatatttcagttcactgcaacattggatctatacatagtgaaatattgtgagtacactagatgaaatattttttgtgaaataaaaataaaccaaattcccttaatagggggtttccaaaatatgtgggtgatttgttgtaacggcgcgttccataatgtcaaaatacactacaatatttgatccgtacatagtgaaacatcgcaagtactagctgaaacatcgtaaaactactagctgaaacatcaaaagagatcatatgcaatattcaaaaaaatatcaatagaaaagctaaaatattttttatcgaaatataatcatgtgtggtcttgttataaagatttaattgcaacgaatacaacggtgtgatcggatcgtagattggataactagttttagagaaaaatcgttttaaaaggagcgataggaggcgcgggcgcccgaggcgtccaatttttcctctgccgtcgggcgccggcgtgcagcactctaagcccatcgcagtggcggtcgaggagacacgccggtttagcccgttgtttttcgttgggccgtggactagtggtgagcggtgaggtcataacatattgacatagccaatccaaggtttatttttcttctttaaattttgtttttttaagaaaagacaagctgccaatttttattaaatagagaaggagtaaacggagagagctacaaatcgaacgtccgacgttgtaaaaaaaatcggacagtcaaatgtttcggttgactgttggtgcaacattaagttatacatagtgaaacaaaaaagtcagcctatgaaacatatagaacttttgtgaaacataacaataagaatacatggtgtaacatatttctatcacatatgaaacattgagtttttattgtctgaaacatatgttttttttcatcagaatataatcatgcgatatcttgttgtaaagatttaattataacgatttcaacggtgtgatcgaatcgttcaacggataagtagtttagaagaaaatttttttttaagatcactaaatacttgcatcatgcatggtgtgggggagaaagctaatagaatagcataagagagactaggggcaatagcgtctcatattttttcagtgattggtgaaacattgagttgcacatagtgaaacaaaaaaaaattcagttattgaaacatttaattttttttatgaaacataacaaaaacacacattgaaacatattgctactgcgtctgaaacattaaatttaatggattgaaacatatatttttctttcatcggaatgcaattatatgatatcttgttataaagatttaattgtaacaaatataatgatgtgatcatatcataaattggataaatagttcaaaagataaaacattttgaagaccatcgtatgaatgtgtggagacatagggtactattagtagtttgttcatccgatcttttcttttcgtcggacttatgatctcaagtattttcgaggttatgtgggccagcgagagcgccaagtttagtttaagcaggccgcccctacggttgggcccgcctcgtgcgctccaccgctcgcaaattctcgcatacgcgcgccgcgtcggccgcctattcttagcacgcgacggcttcgttcgattgcaggtggaggagcaagatttgtaccgcgcacgaaatctaattagcatataattaataaaatattaataattataaaaattaaaaaatagatttatttgtattttaaaaaattctatttagaaaattttaaaaaacacatcatttaatagtttgaatagtgtgaatagtgtgctaacggaaaatgaagaagttgaaaattttggagttgaagaatggaattgggcaaatgggaggtagaaatggcgctgcaaatttggatcggttgtattcagagatttcatcagttatttcttcttcttctaataatgcatgaacttggacagcagacaacactggttgatggagcaagcaccgaacacatcacatggatgcataataagttcgattaattaggaacccgtgtttatgttttgtgtttgcagtggtccaaaatcctatgtttgcagtaacgttactattgttcagtaggggtgactgactattatcttgtttgcctccaataattacacagctgaattgcaatgacggagtcgatcgatcacctgctgcaaattctgcggttgtttggcccaaacaggctcgaatcaatggtcattagtgatcagggaaactggagatattaatttcttgtgcattaacgatcaaaacaccgaagtagctaaaaattcccgtttatattttatacgtcttgcacgttacaaccaataacacaacagacactaacatcgaacagaagaattaaaacaatacgtatagaacaaaaacgcttacttcctccgtttcacaatataagtcattctagcattttctatattcatattaatattaatgaatctagataaatatatatgtctagattcattaatatcactatgaatgtggggaatattagaatgatttacattgtgaaacggagagagtacataatagtactgtgtatacgtacggtatatagtagctagctcctaataggagtaataagcacttagagaataaggatagataagttaatccacgcatgatatcttgtttgattattagcatccgacattgaaccacctcctccttgctggcttccaccgctcctccgccttcctcttctccttctcgcacgcacatttcgcttccttcagattcttcatcttcagataaaaaaaatatccatcaaattaattcagatttatatatttttcgaacaagagattcagatttatatcagatcgataaaatgtgtattgataatgcacagtttccagacttttctttctttgtacatttctgcaattattattagtactaatctagcgagcttaatgtgtgtgttgctaatgaatgcgattaattaatctgtaataatcatgtcaccgtggatgtgttcggtttggtgcgatgaagctgccgcgcgcccttgtacaggaaatgcgcgccgctccagctcccgccgccggccgcggcggcggcgcaaaccggcgcctggtgtttgcacggctccggcagcggcggctccgaccacgcgcggtcctcggccggccgcgccaccgccggcacgctcgagccgccggccgccgccgcgacgtccagctcgcagctgagctgcctgatgcgtgactcgagcaggttgaggcggtccatcaggctgcccttcgcctgcacatgctgcagcgccgccgccggcagcgacttgctgtgctggtggtgcgccgccggcccgccgtcgccgtcgccggcattcgcccgccgctgctcctccagctgccgcaactgaaacaaagatcaaacaacgacatggtgatcactgatcaatcgacgaatggatcgatcgacacgcgacggcgacgctctctcgcgctcacccggaggtcgagctggtcgaggcggccgaggagggtctccggcggagggagggcggaggcgctgatgaggacgcggcgctccgagccgaggagcacgtcggccatggcggttgcacgccggagcacgcagcggcaggtacggtttatatagaaggccgcgcgcggcggcgagggcggagccaagatcgggtcgtggactcggctccgcaatctggcccgcgctcctcgcgcgcgcacctttgacttggacactgtcatactgggcctggatttgttggggttgggctttgtatggccctcgtggcaggcctacatgccaggcccaatttgaggcccaccgagtagtcgtaattaacaggagaccaacaaaacatgatactccgtatctctttgaagaaagagagcagagttgatgaatgtcatgtcctgagatttggtctattttttttcacgaacgcgtaaaataattgcacgttaatatattagaggaaaaatagtttttgatacacaacgcaatcagccagatcggcttatgctaggggaatgaagaaaagcaaaacaaaaattgtagctaggaaggaaaaaaaactactacggcggctatgaaactccgattggtgggaaggggtagagccacgttacattttcaataaatctccaaaagtagcaatgcacgctaaagaccacagatgatcttccaagcagatatactctagaaccactgagaccgaagagagcgtagaatcgaaaactctggagttccgttccttccatagtgccaagagaccagaagtatcagagagtcgaaaccggcacggagatgctcagataaagcaggccctagaggttggccaccaatcctgaagccgactgccacaagaggaagagagagcggtctagccaggaggcgacaacacacggaacctgacctgccgagcgaacacacagtcgaggatttggtttagagaatgtctctattgggtattgtaattggaagataaattgcgtagcacgtaaattagctagacatgtttttaatttaatcaattttttttaactaggttcaacccctggcttcttattaaacgttccaaatgtcatccctcaaaaagaaaaagagagagagagagcagagcagagaagagttgatgatggttggatggtgtggtctggaacataagaaaaagtcagaatcagatgattggtccggaggcatctctctctctgttgccaaaagcaatttctgtggtagcaaaccatgatcatcatgcttcttgttctgggagatccactgcaaatttccacaaccccacttcacaatgtacacccattgcttgcccttctctctttaccgtttttctgcatccatacatgttttctaagtggtagcaactcatattcagctgtgtctggaattgcctaaacattttgaaaatgcttcaagcactgaactgctctctaccaaactcctgcactactgcatcgcctcttgctttgaccatcagaatgttacgaagaaattgcaccccttaagctccacatttcacgccagttgcttgtacaccttttttttcaaagcgaaaattgcagaagcaactgtcgtgaaatgtagagcttgacaattgttaaaattacatgagtacaacaatgtccactgtattaagctctacatcccaccggaatatataatcaaaactcgggagagaaattagcctgcaggactgcagtacaggactccactccacatgatcagttgttgtaaccagactaattaagcaaggcgagctaatgagcagcagatcgagcacatggtaatgcctcgctaaaccgatcctgatcgatccatctgcttttatattaaagagatggcacaagccaccagacgatcgaactacctggcaattgctccttctctctctattattatttttttggccattaattgctaactgaatactcaaggcaaactgtgccaaatgatttaattatttgatcacttatgtttaacactccaacgatcgcataccaactgctagtactggtattataaaccagtattaaactagtactatcatgcatgatgatggaagtatgggccattcaggtttcaggtttacgtgcagtgtggctatactgtaggacgaacactcgcaatgatttaaaccgacacttgtggtcaattcaaacctgcccaggatcacgcaagatctctctaattttaattagttcgtgctaagaaagtattatatatgaaatgatttttggttgctctgaaccttttgtgtcgtattcaggcacccaggctgtcttggaagccatttggattccatgggccacaaatataggcatggacagcatgtgaaacttctgccttttaacaaatccctgcaatccaaaggcgattaaaacactttctgaaaagtattttctaacataaatacaataactgtctttttcacacaaacattttctctaggcccatgattcaaactctcataaactatggactccatctcgaacaaaataatttctttttcaaaaaaacgaaaagaaaagaaaccggtatgaccgcataacaatagtcagttacatttcaataaacaaaagtaaaaacctagacgggttacaagaaaagggaaaagaaaaccctcgccgaacaaaagaactccatatagatttcatgagattttttctatttttctatattattctcgtgggaatcatacatttaaaaaggaaaattatacgaagtgagtgagcgagttggtccgtgtttggacggaagtagaggctatgggcagcatgaccaatgacagggaagcggcaccttccgatcactcaggtcatccattcatccattcatccatccatccatccattcatccatccatccatctcaatatatagctaatctgtattttctgtgtgcttggaagcagctttggagggctctattattgtctttagcctctctgattgatatgactccctaaccatatgctattatgatttatgtcatactggcaatgtacatacgcctctatatatattcccatatgtttagcttaatttaaatctacatgatttagcatcggtgtcggtatagctacaagatatcgtaagcttagcttttgatcatgagccttgttgcgactaataggaaggttcatcagtgatgaaatgaatagtgaggcttcgttctggcatccctagggggcgatctcgtctgtgtctctttgttggtctagcggcggtcggtcacgcttaacggcggtcgatccggtgctagccttctcctgggattatgtgttggcgatgtcggtgtgtgggtggttgtatattttttcctttttcctgggtacgaccctccagggttggaatcttgtaatttttttcctgctctat

SEQ ID NO: 66711 - DNA, 5609 bp, Oryza sativa
tggattatatttttgacagtgcacaaaaacacactaataaggcacaacaaagtagcactgttagggtggcggccattcattaaagattgactcgtatcgctgaatgccttgtgttcctgattggattcaactgtttactttccgtgctccactgtttgggaatcaatggttaattatggggatcattagcatgatgctttgctttcttttgtcatcagacttgtatgattcaatgatgatatttttttcttaataaatggaatacaaactagtaattgtcaggctgatcagctcacatccagacagagactgcatactggctgatactgtcagctgtgtttgtgtatgaatctcatacagacagcagcagtttactcagctggttggtaacaaatgtacaccaggttacaataactcttctgtagtttttgaactataaaccaaaaacgacatttagagggagtgacgtccctccaaatatttttttaagaaaaaattatgagtgtatcgggaattgaacacgagaccttggggttaaaactacataccccttgtcattgtactatgaagtgcatctcaatttggaactatagttttatagtttcttttgtttttgaactattaaccaaaagagatagtactctctacatttgaaattactgaacattttagctttcttttaagtcaaacacgtctatctttaaccattaatttttaataggttcgtatagtctaataacatatgaattatatatatgttatgaaagtctcatgctgaatctaaaaatatacttgaaatttattatgttaaaccatacaaatttattaagaaaaaaaattgacttactagaatgacgagtagtttaaaactgagggagtagcttgtttctaaaaccataattcaagagccacttcaattcatgcatcgaaaagctgattgccagcactactgtagctgtcctgcaaacctgcaacagcaaatctagctgtgataaattctgatatctgaaccattgcacttcacttttgaatcatagaagatgaattccacaagcatgattcatgtcccttaacttgtgccttttcttttttctaggatcatgtgatctctttatttattattcctctccctcctggcacacaaagccttcctatgaccactactattgtattactagattttaaacacctctaaataaattaaaaaaacaaactcttacatttttcaacattattatttggcattgtcatgctgcctgctgacctagaatttcacaagattttcataggaaacaattcatttccttcaagatttccacaaaattcctctgttccaaataagaccatgccaatgccaacctcaatggccttgccaaaaggttttgatcatataggcaagtttatttttagttgttttttaaataaaaacttggaaaaaaatatcctgttatgttggacagttcaaattaatcaagagcaatttttttccggtagttggatctagctaactaatcacaaacaaattattttcgcaccttggcgcgaataatgctcccgcgattatttcatctgcatgtgctgcgtattctccactgatgatcagctgctgaactgtaccagcactgctaatctactacgctagctactttgtaactgtttttaaagcgggtagttacatcgttaatttttttttgttttgattacaagtactcggtgctaaaatatatagtatttaaaaaatctattaggcgatggttgggacgttatatcgacaagcaaatcaaacaggaaggaaaaggtttgcagcagcatcagccgacacaatacgaatcaccatctaaccaaacgaaaacgaatcaaaacttggactagcttgctgcaaatttcctggttttaaaagccaagaaaataataatttctcaggcatgtggaatactagtagagacgacaaggaggaaacaccaaaaaattcagcaaataaacaaataaatgaagtgtattcatttctgatggcgccatgatcaagcatctagcacaatgtggagcatccacccttcctttctctcacattccacagtagaatcaaatcaattttgtcatgaaccaacgcaactctgaccctgatcttttcagtttatttaccagattattgaaacatattatttatcgtacactttaaaaactatattttctttataaataatttacactcctctattgcatttcttatcgctagtgttattttctcattaatataaagattttacttcgattttcgtaagcacgcttttaaaactactaaactgtatgcgaaaactctaaatatgaaagttgatttaaaatatcaaatatattcatttgttaagtttataaatattaaaatttaactaataatgtgctaatagctttatcgtttaaccgtgcgtcaacttaatcttaatcttatgagtttcaaacactattattaagtttattcatcaaaacatgtactcctactttatatttatatctgagtgcatagtccgccaataatctaaatcgaacaggaatatatatattatcatgttaattaaatatagttttccagaaacatttatttatataaatctctttggaatttgataatggaaaatgtcatgtggccagtggcaagtaatctaattggcgtatatattccccttgtccatggcgttgcggtttgttccctcatcaacctcaccaccattattttcttctctcctcttctcttcttcctcctctcctctcctctcctcgctctccatccatctcgtcttcttcttcctcctcctcagcttcgagatttcagcttctccaaacccccattcttcccgccacaagctctgctctgtgctttgctcgctcgcctttcccgccattggtgtgcttcgctttcttggcttcaaagatccgacgagctctgtgatagctggggagaagaagaggaggagaggaggatgctgggagcgagccctaaggccaagaaaggcgcgacggtgaagttcgggtcgatgaagaatcctcctcctcccccggtggttggcgccgccgccggagcagcggcggcggcggcgggtgggaaggtgccggcggaggaggtgtgggaggtgcggccaggcgggatgctggtgcagaagaggggcggcggcgccgacgaggagcccgtcaacgtgaagccggtgcccaccatccgcgtcaaggtcaagcacgccggcatcacccacgagatctacatcaactcgcaggcgtccttcggtcagtgcccgccgccgccgtcgtcgtcgtcgtcgacggcgaactcgatggatgggggccatgtctgatttcgttgtgggtggtgcaggggagctgaagaagatggtggcggcgcgaacggggctgcatccggacgaccagaaggtgatgtacaaggacaaggagagggactccaaggcgttcctggacatggccggcgtcaaggacaggtccaagctggtggtcgtcgaggaccccgaggcacgcgcccgccgcctcatcgaggagcgccgcaatggccacctcgagaaggccgccaaggccgtcgccgccgtcaccgccgaggtcgacaagctcgcccccaaggtaggcacccacccacattgcccgccatccatggcgacgccgacgccgaggtagtaggctcacctccgattggttggttggttggttggttggttcggcaggtggcggcgctggacgcgtcggtgaggaagggggagaaggtggcggagaacgacgtggtgcaggtgaccgagctgctcatgaacgagctgctcaagctcgacgcggtggtcgccgacggcgacgtcaaggcgcagaggcggctacaggtgagctgacgagctacctcgccgcctcctccaatctccaccgactagcttgaccgccatggttaatgagctcaacctgttcgtcccatgactctgcaggtgaagcgcgtgcagaagtacgtggagacgctcgacgccgtcatggccaagaacgccgccatcgtgcgcaagtccggcgagaagctcacctccaaacaacaccatcacccgccggcgaggcagcagcagcagcaagctcaccaacaccatcagcagccggcggcggggcagacgcggtgggagatgttcgacctgctgtcctcgctgccgtcgacgtcgtcggcctcctcaacgaccaccgtcagctcaacggcctcctccggcgcgccgccgccgctgccgccgccggcgaaccggctcgactggatgctattctgagcacacacatcacagaatcggcagatgcaatggtggtgcttggttggcaagaattgcacccatgtccggaaaatccgaggtgtcctgtccctgatgagatgatgatgaagatgatgattgaattgccctggattatttgctgctgctctagcaatttggttggccacattacatggtactactaccacttctagatgagttcagttcatcatgtgagagtaatttttttttaattttgttttttctttctttctttctttcttcttcttcttcaccatcaaatgtttgatattcttttgtgtgcatatattctgagaaagagagagagagagagagagagagaggaaattaggggggaagagagaaattgaagtgtattcagattgggaataagtcaaaaagggttattattgttctccaattggcgtttgaagaaaaggcaaagaaaatgttgtacccatatggatacagataccaatacataccgttcttgataaggggagaggccatggacttggactgtggatgatgaattcttaaatctttttattattatttcctgttagttgttatgattaaaaaaattgtttctttcttctccttgttgttgttggtgttggtgttgtctgtgttcttgagttagttggcgcctatctgtcaggcttgattcctttcagaaatgaatagtgcaggggttggtgtgcatctaaatactttattgctgtgccacatttaggtgttgcatcaagccatcagagtccgagctgttttgttttaggtaaaaagaagaagaaaacttgcgagttgctttggcctatttggcgattattacaacaaactaatcagctctaatgaatgaattttctttcttttcctccttgttgattcagcttggatgtctgatgaaatgagagatcaagcgttgattgattgattgattgattcaattaattactagctggttgccgttgcagtgtcagtattgagagagtgaagcatcatgtgtgtattagtgatgtattagtagtggactagtcattgcctggtggttgagctgagcttctcctcttgtgcctgtcacatttgcaattgcattgctggctagagagagatgttgccttccttcctctcctctcctccaagctaatgacaccaaattacatgatagtatccttccttccttcttttgttgtttcttttaaagttgggctatttatttctgaaggtaatgacatggtaccatctgccaattagcaacattgcatggttggtgctgaatagagagagagttttgagtcacatgtttctcgagtggggctgcaggaa

SEQ ID NO: 66712 - DNA, 3244 bp, Oryza sativa
ttttctttaatttggtgagagatcatactccacgagatggcgtggaaccagcttgttaaacactgatttattcatgtttaaataactaagaaaaacaacaagagaagaaacaaaaagggcaggtaacgagtctaacggcagaaggatctttatcatgtatgtctcgtcagagttgttcatcagccaatcgtcatcatcgatttacagtcctcaactaactaatcataagctcgtcaggcagaataaaaatcctgaaaattccatagataaactagtcatacttggccaaatacatagcttaaaaataaagtgtttttgaaggtgataatagtaaagtttgaactgaaattaaggtggcaactggtgctgtaggtgagtctagaaatggggggatgttggttacgtggtcgccgtcgaggggtgagaacaaaggagatggtcggcgttcttgaaagcgaccactcccggcgaacttcgacgacggacacatggatgaacacgcttcctcttcgcctacaccgacgccgccggcaatgcagggcaacgcgcgtttcttttcggctgatcggtttggctgattagctacctgcacgctaaaacatgagaaacataagggtgtagttatatttatggcgtcatattttttattaaaaaatagtcggcatgtatttacattgtaagtccttaaattacatatgtaattttagtgtatttacaatgtaagtctcaaaattacatatgtaagtaataaaattacatatgtaaattcgaaaattacatactaattacatatgtaagtggggtgtaaatgaggtgtaactactgtgtaagtggctgaaaaaaaatcgactgtagcatatgacgccatatttctagcaactccgaaacataattattaactagctgggtggtggcccacgcaattgcgcggctagcacccaaacaaaatcttatatttttttatgattttacttaaaatttattaaatagctatctcattgtcttaagactttgaaagaccaaaccttatcatcctcgtgtttctaatatatagtttgtaaaagtcacaccagttgctaccccttatgtcattcttcatttttataattttagatgtcccgtcaaacgttgccactatactcctctgcggcccgtccactgtctcctctctttattatcattgagattttaaaaatcgaacataattatcgtttgggttcatttttactttctagaagtcccgccaaccgtcagcggttttgccattgtactcctctacggctcgtccgctgcctatctttttttattgtcattgagattttaaaatcaaacatgattatcattggttttttttttactttttagaagtttcaaacctttaaaaactggacttgtagttttattttttataatttttagaagtcccatcaaacgatgccactatgcccctctacagcctgtccgccgccaaactctttattgtcattgtgattctaataatcgaacataactatcatcggaattcattttttattttctagaagtcccgtcaaccgtcggcgactatgcaattatactcttatacaccccgcccgctgcttcttctttttattgtcattaagattttaaaaattcaatatgattatcaatgggatttgttttttttactttctagaagccccggcaaccgccttactcgtttgcttcacggcctgcctgacgtccctccttttaatcgtcattaggattcaatttggtgttttattaacaattttatatctcgtatcaaccgccaccactctacttctttataggcttgttacttaatttatctcgtcatgtgtttagatggtcttttcttttaataatctatatttttatcacaaattttagttatttttaaattgtattcctaattgaaatcttatttttctttttctaatttcagattttcttaaaaaaaagttaatatcgtattgtgttatttttaatgtttttattttttattttcaatttcagttgttttaaaattttattcctacttgaactctcttttaatttttctaattttagatattattttatttttattctaaattttaattaatctcgtattgggttcttatatggattcttctttcaatgttgcttatttttaattccaaattttagctaattttaaattgtattcctacatgaactcttattttattttattttcctaatttcaaatttatttatttttatttcgaatttcaattaatcttgtattagattcttatatggactcttcttttattattcctaatttttaattccgaattttagctattttctaattgtattcctacttggactctcgttttcttttctaattttgaattttatttcattttatttttattttgaattttgattaatctcgtattgggttcttatatggaaacttatttcaatattccttatttttaattccgaattcagctatttttaaattgtatttctacttggactctcctttcctttttctaattttggattttattttatttttattttgaattttgattaatctcgtattgggttcttatgtggaaacttctttcaatattgcttatttttaattccgaatttcagctatttttaaattgtacttctacttggactctccttttctttttttcctttttctccgattaatgtgggaatttctagctcccacagcgaatgtggtgcctcctttcaaagctgttttaataatataatagattagcatataattaattaaaaaaaatactttatatgccctaaaatatatgagattttgattggatgaaatacattgtccataattcatagtattagaatgtattctatgcaaccaaaataccctatattttggaacgaagggaataattattagaaacatgaaaaataaatttagtttggctttttagtattaactaaaaaaatttcatacaaaacataccatttagcggtttgaaaaacatgttaacggaaacgagaagtagctatgctcaattagatcttggggtcttaattctcgtcttctcggctaattaatatgtctccacgtttaatttaactctcggatttcaaaccttaattcagcccatgatggaaaaattaaccaaccaagcaaacattaaaacgatgaaaataaagtttgatttcttcacacagatccattaccccatcgattcatctatctgtccatgctgaa

SEQ ID NO: 66713 - DNA, 1330 bp, Oryza sativa
gattcttcaatctcattccagttgtaccgtgtggtgaaaaagttaaaactgtcatcactggtgaggatgacacaagagtaagtactgataatgccttgaaactgtaggaagaacataccaggatcttctcttgctttgtttgtttctcaaatctcttcttattgatcatcagaattcagatggtgagaggcgagcaagagggagagatcatgcctaaagtgaaaatagccgtactcactactacagaacttgagctgttgggcatattgatgagtcacttagaacatcttcaacacagagcgaccatttttgactctcaaaataactatttggccagcctaacaaaaatttagagagtcaaacttatcttctattccaacagcctctacacatttcactctctattaaccaatgtaccccacctgtcattcttctcctcctctttcttcttcctccactctccaatcccctgctcgtgctagcggggtcagcggcggcgacgctgcggaggcggtggcaaaggcatcgagccgccccgctgccgctccctccctcccttgccgcacatggagggcgacgacgacggcgtgggcaggcagatcaaggaggagaaggagccattgcgggaaaagggaggtgggggggggggggggcaaagcagccgccattggtgggtggaccatcctcgccgaccgactcctcatctcctctaggtgcgctgacctcggcaccccgcaccagtcgcgtggaggcggcggaagtcgctcggtgacggcgcagatggtggcgatggtcgcggctagcgacgacggcggcgctggggcaatgcaagagagaatagtcggcaaggagatgggaggataatgtgtgtggggccacagttggccagtgatttttggttggccaagtttggccagtggaaggagggttttggccagccgggttggagaggctattgaaggacgttttttgactggaacggctaaaatttagcttagagaatacttggagaggctgttggagatgctctacgggtcagtgtgtcctgtacctcgttgaacttgttgcatgactaaatagtaaataccattaaggggccttttgtattgtaggattggcaaataatttttctagaggattcaattcctttgggattttctcctatagaactctttattcatataaaggtatatattttttaaacaaaattgcatttctatggtcaaatttgtaagaaaataagtaagaggttacacctcttggaaactttccatttttttactgtggtgtaatcaaaggtcatacctttctgtttttctgtatcttcaat

SEQ ID NO: 66714 - DNA, 2432 bp, Oryza sativa
cgattatttattaaacatatcccaatttgccccgttttgatccgggcacatccacaacttacacggattttcggcacttatcctccacgtttggctatttacaacttacaagacactgataactactataaatttctctcaatattgtaacactaaaacttgagatatgagtcaaactgtctcacgatattttgaacccatctcatacaccacattaataacattctaatccgtgaaagcacctgcaactctcggtgacgaagagccaacatcgggtgccaaaccttgatccaatgtgaaccacctgtagctcatgaagatacacgttcttattttttttttgacaattttttgccaaatccaagcaactgactattataatcaaacaaatggataatcttatttttaatttttcttataggcgcacgtaaaaatgttgatatatgtgcatggagatggttgatagatgcatgtggtgctttgtgttcttaattagtatcatggttttacttctaaaagaaattctaactatgtacacttttgagtagtgttttattccattaagaaacaaaatttgatgatacttaatgtttcataacacgaggatttgcgcttgtggatttgtgcatgtccttagaaaaaaacatctaaatttgatcataatatgatttgaagttaaaattttagttacttttttttagaaaatttaccgggagggagagctttcccacctgaattcattgatataaggagttgaaagttcagtttatccaattatacatcaaaagagcgaatagtggaagaaaatagagacttccacgccgagattacatgacgatcatataattttaaccgctcagcccatagagaggcttccgaaacacacataatgcatacccgacacagggaagcttcctcatgccggaagaccacaccatgacgatgattccaaagacaccagaaacaaagtaggtagaacaccctggaatgtttgttgggaatttgatgtggcagaagaagagaagccagctcacacattgacgcaatgttgacctgaatattaaggttgtcctaaaaagcagcagcaaaggggcagtgtaggcacagatacgaagccgtttctttagccgagttgcaaagatcacaggcgggggtggacacaatgttcttcttacaaaggtttttcttcattgggagccgatctttagcaaggagccaggcgaagaactggaccttgagcggtgctttgttgttccagataaacttccaattgaggcaaggaggcagttcactgcgttggacaagatagaggtggctcgtcttcagaatgtcactagaatatttcgagtttctcacatcaggtctgtcatttgccgtggtatgctcagtcaagagaacacgaaggtagttaaattgttcagccataatcgacgacaggcggagagcaaagtgatctctcaaatccatagaaaggacctcggtaaccgagtcttgcttgccaagcgagtgcgtgtagagtggttttattgattaaacataatggtctcacaatattttagttaccttttaaagaaagggttaggctttattgattaaacataatggttacaatcccgcaaaataagataatgtacctttactattgtgagacgtgacattactaacaaaaataattatttggatagggagactcggggttttcaaaatcgtgcagttgtcatataagataaaccttctcagtttttgaaaccacaatatacctcatggtaaccgtacggttttcacggtaatcgtacgattatcacagtaaccgctaaagcgtggggtgacggtaacccacctaggttcggtgaacttgcatggagtacacaaatcatacggacttgcaaaacaggtgcgggtacgttcccaagtgcgcgtagcaaattattagacgtgcagagggtggagtcgctgtcccgatctcctctcctaataaatcacaacttcgcttctcggttggcagcagcgatttcatccaagcaccacgccgccgccgccgtcgaagccgatctcctgcgcgcggagcggatcgcctctgtcaggtacgacccgccctcttcctcctcccctgctaatttctcttcgcttcgtcggccacgccacgccacgcgcgttcttgccaaccttggtctcgcgagcagcgaggatggggaggaggagaggaattcctctcgaattgatcgccggttgatgcgcccggcttgttcctcttctgcggcctaattttgtacgagttcgggggttgtttaggtggagaaatttggtacagattcgattttacccttttggtcttcttcttgtgcgtccatgccgccgttcatcagctacggtgaccttttccagtctagcttttggaaggggccgagctcccagccatggattagctatca

SEQ ID NO: 66715 - DNA, 2839 bp, Oryza sativa
ttcgttatcactatgcaacagagatcacgactgagcctatattatttttggaattaatttgtttcttttcctgcttcaattgtgtccctgattctgtcacggtaatgctcatctattcactgctataattgtgacccaacatcttatcaccgatgcagtcaccagctatacagtatgagttcactggagagtgcaagagcagatcttgctctgcttattttatacctaaacaaggctgaagcaagagataagatctgtagagctatacaatatggctcgaaatttgtgagtaatggacaaccagggcctgcacagaatgttgacaagtcgactagtctagctcgtaaagttttccgactttttaaggtaaagttttaatccttgtccgcagtagatattgcaaatgagaagctattttttcataccttgacatgatctgtggcaccacattattttgcagtttgttaatgatctgcatgctttgattagtcctcctgccaaaggaactccactacccctgatcttacttggaaaggtatgttgaagcttgtattgccttgtaggaactctgagaacctaaagatacgttttttcacttctcattgtatctttttgctttgtgccatccacagtcgaagaatgcactgctatcaactttcctctttctggaccaaattgtatgggctggaaggacaggaatatacaaggtttgattttctcttcacatcattactgatatacataagcaccatacagcatatggttttatcatacctagatgttgacagtagaaattaatggtaggtaatctaattgtttgtacagaacaaggagcgagcagaattcctcagcaagatagcattttattgcttcctgggttctaacacatgtactagtattattgaggtatgagacttcagactgtagaatctatttaatcctgcccctgatattattacaatcaagagaataccatctgactagtatttcattataggtagccgagcttcagcggctatccaagtcgatgaagaaactagagaaggagcttaaacaccaggagctgttaaaggtaccgtcttatatgatcatagctcaatgtaaccacaattttcacatcttgcttttgatgacataatggcgtgtgatggtattggcagaacgagcaataccagatgaaactgcagaagtgcaacgagaggcgtctcgctctcatcaaatcgagcctcgacatagttgttgctatagggctgcttcaactggctcccaagaaagtgactccgcgtgtgacaggggcgtttggatttgctagctcactcattgcttgctatcaggtaccttaactctcacatattgtcatgtggactatcgtctgtttagagttagcaactgcaaaacctgaaactttcattttgatctgcttatttcctctgcagttgctcccagccccagccaaatccaagtgatccacctgaaggggtgtcagtgggcagttccaatgttgcaaccagtaagaaataaaagtggagctgcttgattgactcatgtggacttgaaaatcctttgtgggttatggttaatatgatgatctagtggattgctgcagctgtaattttaaggtgcagtacttgtgacaaaaaataagaaacttagcatgggaaaaatgttgcattgtttgccaatggtttagtgttgggactagctaataagaacattgccattatatcaacatctgtttgtgtgccttgttcgagactgatgagtggttaaatatgctgtgcttgcttcctgcgtgtgtagcgtgaaagcaatggatgtccggtttcggtgcatcgtggaggaaggctttttctgtgggccgtagtttgtgtgggccggcatagctagctcgtgggcctccgtttgcgttccttgtccactgtcgtcgccgacaagctatttattgagtgaaaaaaagatctaaccataaaaaaaaaaagcatcgcaatacatgtctctactattataaaaattgaagatgtttttgccggcacatttagtacgtcatccgtgtatgagtcggtttctaagctcgtttgcttttagaaatacagatccgtatttgaatcgggttttaagttcatttatttttggaaatacataacatataagaaatctatttaaaaaaactcacacgtaaacttaacatgattttctagacatatatatccaagcgaattctcacagtgaactataataagattaaaatagcattcacccgttgcaacacacgggcatttttttaagtaaaattaaagtatttgacatggatagcaaatataatatattttgaccatacaaaataatatttctgtgcctcccttcgcccctccctgtcttcgcccttaagtgtatcgactcacgaatccatccatagatcaaatagatcgataacctttatgtgggggaggagtgcgcgtcagctggtcgggctagcgagagttaagccatggccgatcgaagcaagcaaacagccactttgatatgtaatgtaagcactgtacagtattttaccatgaatcaaatgattagaaaaaaattaataattacttaaattttttaaataagatgaacaattaaacatgttaaaaagaatcaacgcgcgttaaattttagagacggagagagtattatattatcattattgtatgtccacatgttcttttttaggggatatgtccacatgttatgaagcgatactgtcacaccctaaaaattcaaaatatataaattgttgtttaattggaatttttagaaataattttaaaagcctagaagagaagatctaattttttaatta

SEQ ID NO: 66716 - DNA, 1927 bp, Oryza sativa
tgggacctagcgccgccgtcgctccagccgtgcgccgccgccgttccagtcgtcgccgtcgctcgggaaggtcgtcatcgtggtcgccgtcgcgtctccgtcctcgtccgccccttcgccgtcgccgaagatcgccggagcaccgtcgccgccgtcaacccgaagagcgtcgccgcttcttcctcgtcgtcgtcgccgtccgttgatcttccgccgctcttttggtcaccggtgagttcgccgcgtcgcgctctacccgttggtgccttccgttcgcgccgccgtgccgtcgttcgccggcgagcatgcaagcccgagccgccgagccgccgccgccggtggtgacgtcaccgctgacgccatcatcgccctctcccgtgaaccggtcgtggaccgttcgatctcggccatccgttttggatcaagtcgatctcggccgtccgttcgcgtgaaccgtcgccgtgcgcccggtccaccgaaaccctagcccgctgacgcaataaatccctttttccttttcaaaaataatttattattgcgtcataattcaattaaaatcaatttaagtgttttaatccgatttaatcttcaaaaattcataactaattcatcttagctcggatttagttggttcaagtctctaaatttttctaaaattgagatctacatgttaaaaatatccacatgtactgttcatgcttgtttatgtgctgttttggtgattttgctcttttctgtttagattccgtcgtttccggagagtccgttttcaccggagaagagtttgaagagttccaaggccagcaaggcaagtcacacagatcccaaacaaccctttgagcatgttgatcccatttaaagctatggtttctattcaactattgcatttattttcgaatgtcattgggtggaattaacctattgtttgttatagcccttttgttcttgattactttattccttgataccttgggttattataattggactagttgagctttatatatattggttcaactagatattaggtatgattgcttagccatgcttagaaacattagcacactttcgggataacttatgactcactattacttaatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccaactgagaagtggcggagataagcccacgggggtcgctggggagtccatgcattgtttataagggggtgattatgattcaggaaggtgcgctgcggtggattgtgttatgtaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttctcaccatagtaaatgatgctataattggtaataatttgattaactcctggtttggaatggtacattcctggtttggagatagaactgtgcagccgggatggttgttcagaatggttgggcctatacaacaaggtatgttgtatagcgttggattaatattgtttaatacttaactgttttattaaattctcaaatgtttgctaaatgctgcttttgcaaatgaaaccctactatgccatcctttgttatcctgtgcacttgcatatttgctgcgtggcttgctgagtatgtcatatactcacc

SEQ ID NO: 66717 - DNA, 3510 bp, Oryza sativa
tggaattttggatagaaattccgggcgtgacagatacggcgaccgcttggctggtgctctcgcaaaaccaatcacaaggacaacaagagtcgtcagagaccgacggccgtagcatacgccacgtggccaccggcaggcgacggcgtctcacctggaccacggacacgtgtcagtggcgttgtacacctgtgagctgccgctgccgccgtcagcagaaacaaacacaaaaggaaatggagaggccgtccggaggagcgacgagcggcggcgcgtgggcacaccggccaccgccccacgtactactactactttcagcactccatgtgtttaagtactccctctgccccgtaatattgattttgattttttcttatgttgtttgaccattcgtcttaatcaagaaactttgaaattattatttattttatttatatcttactttattatccaaagtactttaagcataattttttattttttatatttgcacaaattttttgaataagaagagtggtcaaacagtgtaaaaaaagtcaaaatcacttatattatgggatggagggagtatgtgtttacctaaagtagtactctattcatattatttactaggaacaaaaaaatgccgtcgactttttattaacatttgatcaatcgtcttattcaaaatttatgtgtaaatataaaagtatttatgtcatgctttaaaaacatttgaagataaatcaagtcataataaaataaatgataaaataagacgaatggtcaagcgttgtaaagttaacggcgttatatattaaaatacgaagagagtactgcatcagtatcatactagaagaagtaataccagtactaaacagctttgatattttcgctagtagcccgcatatatcctcagttaatttgttgctttagttaaattgtgttaagagtgaattgcaccttgatctgagtatctttttttttgttatcgtagttttactttagatcacctcttaattcatggtttttactttaaaactagggaatgttacattttctagaatagatggtccaaaatgaagctctggaataaaatatagcccaatgtataattcattaataagaatagtagtataaaaatctccatgtaaaattattttcagttgattagtactcaacaaggtatattgtgtcacgtagaccataagatattgtcttgtagggatgtaagtggacaatctcactacccatataaagcctcacttgccaattactttctcaaaactttaaaagaaaaaaaattaactagaacaggtaaaagggaaaaaaaatcccgcttgtccgcttcccttggcatctggatggtcacgtggcaggaaagaacttgtacagtagtagtacgtgctagggtttgaagtaggagcgcgtgtcaatcaccaaaaaaaaaaaacaaaaaaaggcacagcagcgagtggaaaggagtcgatgggattttatgcccaaaaccgcgagagatccaccgctgtttgatgggttcgttgggacttgggaaggaatccatcggcgaatcgccgcgcggctccgatccggggcgcaagcgcaaggccaccggcccacgtactccactactcctactccgtagagaggcgacgcgtttgcgcgggcggcgccgcggccgcccaacccaaccgtcgctgcctccgtctccgtagtccgtactgcctgtgtctgcctctgctactgctgctgcctgagagcaggtaccatagcatagcaggctacaaaccagctacaaacatattttaaaaaaataaataaggagagagaatggtagcaggctacagatttatagccagctgtagcacggacttcaagacacagtgtgtatgacagatgggaccatatattaatagtgtaatatgtaactattatatgaatgagctattatattggctatagatgaatggtagttattagttggctatactattgaacttgccagagaccaaccagctactccctcacgtgcggctggattaaataaacattaatcaattaattaattatagagacaatcagttgccacttgccaattaaggaagaaggcataagtactgtagcactgcagccgcacactccacgtctccattgggaggaaatggaaaatagtttttcttttttttaaaaaaaaatagaaaatagtgctccttccgttttatattataaatcgtttgatatttttcttagtcaaaatttattaggtttgatcaaatatatagaaaaaaagaaacatgtacaacatcaaatttcattaaatttaacattgtatatattttaatataatgtttattttatattaaaaaacattactatattttgcttaaagtttgacttaaaaaaatctctactattataaaattgaagatgtttttgccggtattctagtacatcatctgtgtatgagtcggtttttaagtttgtttgcttttgaaaatatatatccgtatttgagttggtttgtaagatcgttcacttttgtatgatacaaaaggaatcatataagaaatctgtttaaaataactcacatgctaaattgagacgatcggattccaaactttagctcatgattttctaaaaatatatatatccaagtgaactcccacagtgaattttatcttaactaaactatataattaaaatagatttcacccgttgcaacgcacgatattttttctagtactccctccgtttcataatgtaagacttcaaacattggttatattcatatatgtgttaatgaatctagacacacatatatatctagattcattaacatctatatgaatatggacaatactagaaagacttacattataaaacagaggaagtaactcataaatacggaacgaaggggtagaaatatccgcatctcatacacacacagaagtggtcagccgccgcccaaaagcttgcctttgtcgccatctccacgtggccacccccatatactattgcttaacgctgtcacctcaccctctcgcggtttgagttttccacttccacggttccaccccgacacctagcgaagtactcgtagtaatccgaatcccaccgttccatccgtcgcggacgccacgctctcggctctcagctcacgtgacgtcaaccccgccaaaacgcgttattgccgtagtactacgcctcttcttccacctccatctccccctccgacatctccagccaattccagctcagctctcgccgccctcccctctcccgccacgtgcgcgccgcccctcctccaaatctccttttcttttccttttctataaataaatcaaaattcacacaccaaatcctatataaacttcttcctctccatccccttcccgctcaaactcaaacaccaacaccttcttcctcttcttcttcttccagcagcagcaacacacactactgacatggagtactacgagcaggaggagtacgcgacggtgacgtcggcgccgccgaagcggccggcggggagga

SEQ ID NO: 66718 - DNA, 1439 bp, Oryza sativa
gccgcgctcgccctccgcggccgcggcgcgtgcctcaacttcgccgactcggcccgcctcctccgcgtcgacccggccaccctcgccacccctgacgacatccgccgcgccgccatcgagctcgccgagtcatgcccgcaagacgccgccgccgccgccgcctccagctccgccgccgccgtcgaggcctccgccgccgccgcgcccgccatgatgatgcagtaccaggacgacatggcggcgacgccgtccagctacgactacgcgtactacggcaacatggacttcgaccagccgtcctactactacgacgggatgggcggcggcggcgagtaccagagctggcagatggacggcgacgacgatggtggcgccggcggctacggcggcggcgacgtcacactctggagctactgatgatcgcgagttggagctagcagttttgagctcaaccagctttgctcctcctatacagctaaatactgtaggagaaattaatggagattttttccttctttattttttttatattttttccaagataaaatggctgagctggtagggagttctagaaggaggaaataaagattacgagatttgtaatactactacgagggacagcatgcaaaaaagaagtataattgctatgctctctctctctctctctctcttttgtgtggagtggaataaaatgccagctctgcttatggtcagattttcacttttttttggagtgttaagacaaatgaaagctccagataaattagtgagtgctactgcttatctgaataaatgagatcattcatcatcctataaaagaataattaagaaaatgggtgtaccatatatgctattggcagacaaaatttagcagtacttgtaagtactagaatttggtttcactttattttaagtgagattgagcacttgtttatcatgctatcatcggtctacaattagttagaaactgtagttcgcagctcagttattactggatcaaaacttcgtcctttttttttattttttgagataagggtgtttttactcggcctcatatatgcaacctttttaaattagcaaattagcctatcaatcagaaaacttatttcttaaataacccaatctaaaattcgcttctatatatatttaaattcaggacgttgggaaggtcacttcgtccttttttttaagcttcggatcagttcgcactagctggagaagcagagatagttgcaccagattgatggtggttcgatgcctacgcctacgagaataagtactatatactgtatatgatattttcctcgtactagtatcatacgagtactttgcaaaaacacctcgtatctatacgtccgtgcttatatatatggctgtatatatacgtccgtgcatacgatcgagtactcggcaatggcacgtgctgagtactaatgtaa

SEQ ID NO: 66719 - DNA, 771 bp, Oryza sativa
tcctgcagcccagctacaccacataatcaacagatccacagggatgtttctgcaaattaggccacacacaaataattaatgcactaatcatgcccagcttctaggctctccagccagcttagccccttgatatacatacatacataccaattaagagatcatgtatcactcactatatatgagggacacaaaatgagaggagatgagatggatgtgtagtttgtgtacatggttagcttagctctagtactactagcttttgccaacaacccagctaagctgagctgatctcttcacgtttgtggcgtgagctagctgagcttattaactatctctctaccaaatcaagctaagttaattagctggatagctagctcggtgtggtggtggttgtcgtcgtcgtcgtcgtctccggcgtcggtgagacggcggccggcgaagaagggggtgcgtatatatggggaattcgcttggctgcgtggggcttggggagaggttggcggcggcggcgaaggacggcgacgcggcggaggcgcagcggctgctggcggcgaaccccgggctggctcggtgcaccaccttcggcaacctcaactcgccgctccatgtcgccgccgccaaaggccaccacgaggtaagcatacgtccacaatgaactgatcacctctagtacaaaaaccatctccattgatggtgcagcaagctagctaagctatgagctagcttctcctgtttttttttctttcagattgttcattgaatcattgaaat

SEQ ID NO: 66720 - DNA, 1715 bp, Oryza sativa
tattgtgttcttttaatatttttattttttatttttatttttagtcgtttcaaaattatattcctgcttgaactctctttttaatttgtccaatttcggattttattctatttttcattccgaatcttaattagtattattgggttcttatatatactcttatttcaatattgcttatatttaattccgaatttcagttaattttaaattgtatttctacctgaactcttcttttcttttcttttttataatttctatttttttattccgaattttaatattttcgtattgggtttttatatagactcttcttccaatattgcataattttaatttcgaatttcagttatttttaaattgtatttctactcaaactcttcttttcctttttttttttgctaatttcagattttattttggtggtctgaaaattaattaatctcgtattgggttcgtgtgttagtttaccatgagcctatgcttttcacagtaaatctagaattctaagcacaggagccgtgcagccagacagagtatgaagggccggtcggcactcggctcctgggcagctgcaattctaccccgtaacggtttcattaaagaaaaggaaaaattcgtgcggctgcaatcctaatcctactccttaacggtttcatcaaagaaaaataatccgattctgcctgattccaaatatgagcagtagattgctatatttcatccacaacttattataatttaaaaactacaattgtactacatatatattgctatcaacctacaccgttataatttagatccactacgatctaacggtgtagatttttctttttttctccgattaatgtgagaatttctagtcccacagcgaacgtggtgcctcctttcaaggctgttttaataatataacagatagatagatatctggtcctacctgttatacacacattacgttctgaagtccgtgttacagctggctacagatgtatagtccgctgctcttctctttctttatttatctttttaaaatataatttatatctggtttatagccctgtaattgtacttgctctcagtggcttgtggtgacatcgcgcattcgcaggtcaggtcgagataagagactccactcagccggcagggctgcctcctcgtgttggctttctggtaattttctttccccccaaaaaattttccggcctcgacgtggtcgatgcgatccatccatgatgtgatgtgaccaactcaccaacggcggaaagccaagcccatcgagcgaagcgaaggccgccgcggacagcgagagggcgcaatttttgtgtagtactcactccgtccacggtataagtgattttaatttttttttttcaccactcgtcttatttaaatttttttttataaatatataaaataaaaagttatgcttaaagtataaagtaagtcacaaataaaataaataataatttttaaaaaattaaataagatgagtggttaaatattgtaaacaaaaactcaaaatccctatattatgggacggtgggagattatgggacggtgggagtaaaagcgtttccacttcattataaaaaaggcggcggccgcgctggccacgctcgggcaccaggaaggcggagagagaagaagttttccgcatcgcgaccgcgcggacgatgcaggctggccgtcggatcgggctgaccgcgtctcgtttagaaata

SEQ ID NO: 66721 - DNA, 2640 bp, Oryza sativa
cggcggcggcgacgatgccgcgctgttcaaggggtccgccatgacgcggcgcgcgcggtcgccgcgctctcctacatggcctgctccggtacgttcccccgatccgcgccgcttcttcttcttcttcttctctgatgcgtcggctgggtctcgggatgcggtcgtcgttagcgagaatttgagggtggcgtctcgtgatgcggctgcgaatttggggggtagcgcgtggttggggttcctgcgggttcagctcacgaatttgtactactactaggtgacttttggtttcagttttggtcgttaattcagttggattcgattatctttgggaagagggccggttggttgacttgtgtccaacaacttcagaaaaaaaagttcatccattttggcattacacgcaaagtacatgctgcgtggtgcttggaaattcgtgggggtttcacttgacggatgtgttccgggggtctgggaggctgcttgcatcttcaacattaaatactaggacaggaggtgctaagtggtcagcggctgtacaaacatcattatgtagtaattactgtcagcgtttcagtgaaaatctacaaggataataaccttttagaagagaaaaactgcgtttggtgaaaattctgaaacttttgtttcgggtttggccatgatgcagatctgcgaagcaatcaaaatcgatagagatctctgagatgcagatagcatgtcgatgataggttgaaaacctggtgatgattgagttgagaatccaatattatgccacttagttgtccaacacagatagtcagctaggtggtgttcttatgaaacagggattagtcacttaatttcacatacggacatcttgttttcgttctttctacatttgttttcatttttcagatctcaggtatcattttactaactttggcaacttttctatcagcagtgttggtagtgatgtagaacaaagcagcactgtgttcatatgatttcccctgtgcaaatgtcattacgctccttcaggtacttctcatgtccccttggactggactctggaaagtctggctttgctgttatgttgtgcaagtgtgcattacacatttacacatgaataacttgcttgtagtctaggagataaactgtaggatagcataatcaaaacattacatattcgattttatctaatcaaagaacattctgaacttccgacccttacttgagcatctgcttagcaatggatattgctaaaggtcttttcatacctttatttgatatcactgttgatgaacttcttgatgcatatatgtaatctgctgctcgcatctcctgcctctttttttttttgacacttaataaacatgtgcagatggtgtgctcaacaggccttctttatgttctgaggcggctaaagataatttcatttacaaatagcgagccatccgtgccttctgatgcgttattcttcgttccgttcagaatactgttgcgtactacacctctttctttggcttatttactctatatggtatgcttctttcttcacttataatacatttattaaatacacttagtcgcatgtattctatttgaattgaatcctgagtaatgttttccatcatggtaaaagttagcttcaatggaatctgtgcgtggagtcaatgttccgatgtatacaacactgaggcgcacaacagtagtctttacaatgacaatggagtatttcttggcaaaacagaagcatacgccacctataatcggcaggtacatgtctataaaaatgatttttccttttttttactgtattataaattcgtaatattctcagaatagtctgacgtgctagtaactaatgtaagcttccttttgtcatatgctttcttatttatttctatatattatttccatcttttggaaaccctgaaattattagtctatcccagtgaactagcaattagtatctgttgctgttttttgttttctgtagcctattgctaactgttgtacctgtatttttgtagcttgaaataaggttgcagttgtagcacttgttttcttacgctaaaaatttccagaacattgttatgttctgaatatgccatattttactttctgattttttttaccatgggtttgtcagcgtggctttgattgtatttggagcatttatcgctggagctcgagacctgtcgtttgatgctcgtgggtatgctattgtctttgtggccaacattacaacagctgtttaccttgctactataaaccgtataggtaacatttcattttcagttttgccacatacaatcccattctaaactacatagctttctaaccagcagttttgttttgttttaggaaaatctagtggtctaaatagcttcggcctgatgtggtgcaacggtattattttgatgacctgtttcatattcataatatccagataaaccatatttgccttagcattcatatcctatccatttggattccaggacttgtctgtgggccttcagtactttttctgacatatattcagggtgacctgaagaaggctatagaatttccctacctctattcccctgggtttcaggtacagatttcacagaaccatggtcatcactgatcttatttgtgcaatatctaccctccttt

SEQ ID NO: 66722 - DNA, 1605 bp, Oryza sativa
aaaaaattatgttcatatttgtggtttgttttcataacgcaaactgataaaattgtatccaaagctcaaatgtctgaggttaaattgatgaactgataagcaattgagatgttgagtttcatctagcaaccaacaaccactaatcatggttgctttagaaattagaataccagagaaagaaaactcctttagaagagcttgacactagagtcatgtcagctttagaaattagaatactagagaaagaaaactcttttaaaactctttttataaattacaaaacccacttagaatgaggcatgtcatctttctaggattagtgtcatctactcatcttggtacaaactgattgtgtatatttgtatgttctgtacttgtgtatggatattgtcgcaacaccctacgtctgcactatgctcaactaataagctactagtgtaaccaaatacattgtagttcactctgagttacaactttttcgaaagaatgctatgtgcataagatgattcagagactaggatacttattccatgatctaaaaaagatactccctccgtttcacaacgtaagtcattctaacatttctcacatttatattgaagttaatgaatctagacatatataacttcaatatgaatgtataaaatgctaaaatgacttacattgtaaaacggatgaagtaattttaatatttaagacttgaatgctccatcatttgcttttcagctcatcaaccgcggccaaaatttaaattaaaaaacttaaattcagagttgttttttatgttttatcgtagttatattggcttttaaatcacgaggaacacgtttaaaaaatttacacataaattattgttttcactaataagtgttacggtttataatcagcagtggacgaaacgatgaaacttgaagtgaagaactgaagatcctgttgagttggtggttggtacatttcaagtgaagaactgaagaatcgtagagggaacaatgtcggagatggaaggagctctgagatcctgcatggagcagctgctcatcgccagggaggagcgggagcagatcatcgtggaggcggccagcgagatctcctcggagaagaagaaagcgcgggagctccagcggaagctcgacgccgcgaccaagaaggccgcgaagctcgccgccgagaacagcagcctcgccaaggccctcgacgccaaggacgcggcgatcggcgagctgagggagtccaagtcggcctccgacggcgagctcgccggcgcgagggcgaggctggacgcggcgcataagcaggcggcgtcgctgcagtacgaggtgcggatgctgcagaaggagctggagatcaggggccaggagcgggagtacgacctccagtccgtcgacgcgtcgcgccggcagcaggcggagagccagaagaagatcgcgctgctggagggcgagtgccagcggctgcgcgccatggtgcggaagcgcctcccgggccccgccgccatcgccaagatgagggacgaggtggaccagccggcgacacccgaaggtcgcgctccgtggcgcctatgtcgccgcggtccgtggcgccggcggcgccgatgacacccatgtc

SEQ ID NO: 66723 - DNA, 2335 bp, Oryza sativa
gcagctcaggctgcgcgttccgcgacgacgagctccgccgccggtaaacaagaacagccaccgcgaccagcgccgcgaccggcaggaacacggacaagaacagcttcagccacagcgccatactctcctaattaacctcctcgcacctctcactctcacaccactctactcgatcaaatcatcctgcgccaccggagctgagtcggcgaggtggggcgaggtcatggacatggtggtcgtgcctggactgattcgtgtgacctgttgagttgtcgtgggggtttggtttggtgagtggtctaggaaggcaggcgcggcaagggaggaggctgactggctcaacggaagcaggcgaggaggaggaggaacgggagggcggttggagatggaaaggtttttaagccgcgggaaagcggggtgcatttttggggtgatttctctgtgggtgggtagcccgtagccgacgggaggagggctaatctgcaacgggtacatgggcacgtcatagggttgttaggttagtgacgtgatgtgagaacgccttatgttaataacacaggcgaaagtgttccgcaccaaatctctgtttcctgagtatgaacacttttcgggctccaaatggagaaatgtttttgcgttccattggctttatagcactcaataattaattaaacatttgttagcatacagttgtgagactaaacatttatcaataagcgtagcatatatatatccacgattctatgatagagacgccaattgtagtaaaccagtaaatttagtacatatttgtatttttaattttaatatagtcgtctttgtcattgtgttgttcttaaaccatcgactcgttcaactagatatattggctgataataacaccttcacacttttacgcccccacattttttgttgttagtatattacttctgtgaaaaaaaaatgaaatgcattgaaattttgtttcggcatataaaagttaatgatcagtataaccttgaatacgacgattataatctttttagactaacgagattgattgataggacaagcctaagtgttttaagacaatggataaattggtcattgctttaatagaaactacaactacttattacaagctaaacataagagccttactgaatgaatgattgaatgaatgcaaaaatttaattttgaacggaacattttgttgtggataagctagtagtgtgtccttctctcacttagtgaatgtggctcacaactttgatataaaatgcattcccagaattatgtatgaatatatgatacatttttttagaactaatatatgatacttggagtagtctagtagatgcagcactgctctcaacgaaatgtcactatgtggtatttgtgacaataagttgtagttggttagttactatcactttcccaatcactatgataaactacatgacgttaccaaatacgtgtaatgatgaaagtataagtacacaattggtagttttcgctcacatctcttattttaaataaaataaacaattgaaacgctctagtcactcacatatcttattttaagataaataaacatatcaacatgcactagtcatccgcataccagctcatctgtactccctcccatatttgattttaaatatatgtttgacaattcattttacttaaaaattataaaaacattacttgttttgttgcgacttttaccattaaaggtgctctaaacatgtcttatgttttatactaaatttttaataaacgaacgatggaaacatgaataaaagtaaataatgtcatatatttaaaaatagatgtaatattattttgctgatttcaccaatgtgaaaaaaaaactgtccctaagaatcggtcaagttatgtaatttgtgtaacctcccccctccctacaaaagaaactgatggatgttggcagtacttcttttcagctgaaaatttttcaaaaaaaaaaaacttaagcgcgtaattaatctgcataacgcatccgttaacccttttttctttgcaaaagcttcagctctgacctcactcctcactaagccatccccttgcagtttaatttggaggtacaaaacgccggtggacgtaagccggatggcacgcgagaacagacgtcagatatataccaaatcctatgaaaagtaatatgttctttctccgatgcgtcggtgtcgcggcaaacgtcagatgcccgcatgatcatccccggccgttctgttcacgatttcttccacttttttctattccaacggctcgctaatctctctctctctctctcgttgatagcaatcaacagcacgtgatttggaaggggctc

SEQ ID NO: 66724 - DNA, 821 bp, Oryza sativa
aaatttcccgtcgcccgggtgcaaaatcccatagctggcggggcaaaattcacacttcgtcttgtagccgtgcggtttactcttatctgttgatagagtaggaaaacagaagtcataaattaggatccttgttatgagagtaaaatcattagcagctgacatcagagagtcggcatagcagagagtgacataaattaggcaccaaaccaacacacgataaatgcagtttatgaaattcaataaatccgtaacatgagccgtgacttaccgatgatggtgcaggtcacaacggtcgcagagtcgtagtcgtcgtagcgtagctcggcgaagaactgcttgtcgggtgactcgggaggagccctgttgcgcttgttgcgggagcgtcgcttgcggcctcttttcacgtcggattcgtcatcatcggcagcagcagctgctgcttcatcggctggcttcaccgggctgctcctcctgcgagccaggaagctgacatgaacccagagcgcgcgtctgaagctgacggacgcataacccagagccttgacaggtcgaactcggcgccctggaaaaatgttgctactatgtcagtaacatggtttcgtttaagtacattgctaatcatcggttttgcatccatacatattcagttgttactgcagttatgtacgtagtgaggtgcttacaggattgttagcgttgtagtgatggagagcgcggttgacatggtcgacgatcaaggagagttcagcttgcctgcaattgcaagtgcggaattattgttaccgctacatatactcctcatcttaagaaaatgaagaaat

SEQ ID NO: 66725 - DNA, 2629 bp, Oryza sativa
  unsure (1)..(2629): unsure at all n locations
agaaagataaaaagaagctgaccataataggaaactttaagtcataccctggaagcctggtcagagccttcatcttctagcaaatcagcaccagatacttcagggggagaacaggactgttctaaaactctggcaggaatatcatttgtacacttatctgtgttttgtacagaaagcctatgatggatatcatcattgccaggtttcagcctttcatacttattactgaaagcacattctgtcagttcaccttcaacattgagctctggtggagagctagccccattcgagtcaggagaagttttggaacttgctgaggatgagacatatgctggtctttcttctgaaggttggcagcactcaaccattatatcaagaagcaagtctatgatagcctgcttcaagacactaactcccatcagcaaactgatgaggcttgtggaactcgagtcgcactttgaaacatctttctttccaccagccctggtggatactttggtaggaagtagcatgcgctttacttttgctgggttatcgaggtaaacacgcagaccagtaagaaatccagcaattgcactagcatctgttagaattttctctcttaaagtaacctgcggctgagtatagttttcaccatatgtaagagaaaacccagctctcgagaggaggtttcggaacatatcttcctcatcaccactcatatcctcgctgtcttcagactcaataaagtcatcaggatctgttgacaaatcatcctggtcgtcatctgacgccaaaacctgcaattgtgtgactactataagagatgcagagagcttttctaccagnnnnnncagcaacagttatccaagtacaatactacagtataggaaaagactagaaggccataatgttatgctaccacccgaatacaggaaaacgaatagaagaacacctggactgctactcatgcttatgtccttaaatctagtgaatattgactaaggctgagttctttccccaactttcccaactcggctcccttgtgttccgcgcgcacgcttttcaaactactaaacggtgtgtgttttgcaaaaagtttctatacgaaagttgcttaaaaaaatcatattgatccatttttgaaaaaaaaagttagctaatacttaattaatcacgtgctaatggtccgctccgttttccgtgcgcagcaaatgggttcccaacccaaacaaacgagcacagcctaatagtgcccagaacctggcatcttcttaaggactttgaaattgacatgtcagtaatgccaccagactttgaaatccattggcatggaatactgtcgtgctttagtcctgttgtctacaatggatttgaagaaatcatttttttgatttcctaggatttttgggtagttcaatgaagaatgtacatataaatggaaaatggacacaatattcgatctgaccagtgttgcaatttatttttttctgtaaaaatgcttaaaagaacatttcacctatgcacctttgtagttgtgtgttgttccaactaaatagatacacctaattatcaaatgatatagcactagttcttcacagaagtttaaattatagcctatgtctatatatgattcccgtcacaaaaaattgagcactatagttgttacatgttgtcaacttccattattaatctcttatcataatgtatccactaaattaaaaatatatatatgcagcttgtgcaatccctgttatttactaatctcagctatactatacaaaaaaggtgtgttagcatttcaagacttgtgtcactatactcccaaacattccaaaagcaaactaatccaatatgacccaaatcaccaaaaaatatgagtatcctaggctttttcaacttattattcttttgatctctgtcatatgttatatcaaatgtcaagctgcataatcacattcgatatgaacaattggattttactgtactgcaacaacatttggttagaagcatgcatgctatacaacacgaaggcaatttggatgtatttggagtaactataatagtatcatgactatcatcaatatttaccccaacccagcacaggaagcaaaaaggaacaagccacatgaaaaacagcaaatccaatctcacctcaagatcagagaaatcaaaccatggacagcagtctatgatttcacaaacaaaaacaacagtgtcccggacaagaaaaccagcatcagtgtccaacaggtctgagaccttcatgaactgaagaactgaattgttccatgtttttgtgcagattgatgattccttacacaccgtttttgcagaattcttctggttaattatagccatcttatagtgtacccaaaagttcttatcaggatcaaacccagatggctggtcactttccaggtatatgcagatcgtatcaaacgactcatatacacctgcaaattgtgataagatgagcacaaaaggcaagaaatgtatggcacaagacatgaaaagtaacttcctttacctatacgcaactcacaaccaccagcctggaaatatttactaaaaatctttcttgtctccataatatccttgaaggataagaaattttccaccttccacgtgaatgatggacgttttggca

SEQ ID NO: 66726 - DNA, 1551 bp, Oryza sativa
agtgtacttaacaaaaattgaggcatctatagtttttaaaagatgagttcaaatgaccatatgctgcatctaagagaggagaattggcacgatttatgcaacaaaccaattcatttgtatcatttaattaataaacaggatttgatcatatattaaaacgaaaaatgtgaaacccaagctgcttaatttatttagtggcatactagccagtagctaaactagtttttttttaatcttttgggatttacctcatttccatttccaggttccaatttacacaggccacttaaccttgattccaaaattttcaaacagttaaaagcaccccacacatttagctatgttatagttctgattaaatcaatcaggtgtgtgatgtgtgtgcctgggtatgttaccaaagtttagcctctataagcagtatatgtacttatgtagcagaaatccacaagttgatcttgcaaactaccagatgagtatggagaaaacatttgctagaatgcttaccccgtggatacacaataaggcggcagtctcgattcccgacctgaaactttctgcttttgatgcacagacccgtgatctttcgcttcttgagcagctccttcaatcttgtgaagttctcaatcctccacacaaactttccaaagtgtccatccgactttctagccccagctcgtccactgccagcaccactcatgcctgctatcatcggtaagctgcgagtgaacgagtttgactccttgatcacatgcactgaagcactaaacaccacagcaccatcaagcaggtaacccccatccgcagccaaaaaatcatccatttttatgtaatctccccacccaaggctggcattgtcagccccaaaccggccatacgagtctttgtggatgtgactcccacctggcttctgattgaggatcgaaacacgaaaaagacaccagcacccacggtcaccatcgggcacgccgctgcccccggcactcgacggcaatgctgatgccgaggaccctgatgttgcctgcaccaggggctccttgctctccagacacaccgacaaatggtccgcgccagatacattactctgatagacactaatccggagcccgcagtcgctcccaccggcattggccgccgggaagaaggcagggctcatgatcttctgcgtgcggaccatctcccggaaggtgccgaagttgagcaccttccaggtgaagcggctgtcggcctcggcgaacgaggcggcctcggcgagcaccgatatgtcggcggcgatgacgagggagtcgtgcggcgggaagaggtaggcggcggcggcggacggcgcgaagtcgcaccagccgtgcgaccgcttcttggaggagaagcggtgccacgagtcgcgcgccagggacttggagggatcgggggaagggtgggcgacggagaggcggtagctgaagaagcactcccatttggaggaggaggaggtggtggtggcggacgacgacgacgtcggggttttggggtcgagcacctggaggtagagggagaggtagcccgggagcgcct

SEQ ID NO: 66727 - DNA, 2387 bp, Oryza sativa
tcaaacattaaatccttaagccactagtgatgtattcttacttgttcaaagttactttatggtctatagtattttattaaggtaaatctaaacatagatggtaataataaatggtgcttgcatgcaatttaattaatttgcgtaaatctgcaaaatttaagtgaatgacatacatgatcctattgtgttaagaaaatagttttacttgtcttggattgataccagttggtatgtttggctaagctagctaagaaaatggaagtttttttcgaatgcttttctcttttttttatgggaaagccggaaacagggtgaggtatgatattttccaagcattgatgatagtttctggtttgctctaagttgttttatagactatagtttaaatgtttattaaggttgcttattaaggtaattcaagcatgcaatgtaacaatgataagtactaagttgtaagttaattaatatatagaaaactacatgttttgattggatacataaggattttttccgctgaaaaaagttacatatgctaggtcgtcacaaggttggtgctagctcaaacattaaaaccttaagccattagtgatgttgtctcgattgttcaaagtcgctttatgatttacaatattttatttttaagataaaaccaaacatagatagcaacaataattacctctacttagttgtaagctattgatgtgcacaaagctaagctatgagttttgagtgaatggcatatatgatgttagaaaaaatgttgggggttgacccgtgcgtatatttgtatatggttacatcaacgaagaagtgcaatacaattgtcgcaacatctaagaaagaaggttgaaagttggtgctagctgtatttctagtaatacgttcctaaaatatatcccctgtattttcttataggtctttatatgggttattgctaaaaaaagcatcatatccccttaaatctcaatccctacaaataagcaaagataaaatctctattttccaaaggaagaaaacaaattttagtgcattacaaatagaaacaaatcatcgctaccagctacaagtgacgataaaggctaccgctgtgtcctgctcggctgctcgggaagcggtgggatagaggactagcgggacacttggggtcttggggacgaggctgcaatgccacgccctacatctactcatcgacgagaagcctgatcgagttgagccggggaagccacgtcatccctgccgctattggcagagctacgtcggcgtaggatggagggccgctcggctggagatgctcttaatgacattaaaaacttaaacttatatgtgtaatgtatagatggaaatagttaaattctatgtttgtcttttcggtgtttaggtgtatatgtttcaattgtgatcataattgttgtgcaccgaaaattagcaacccatttgtttttaaaagtaatttatttttgtaagaatcatgtactaatttaactttgcttcaagaaaatggtcatatccgataaaactcattctggctaccacatgttttatcggtttatagtagtgtcatagttatagataccacatacctaatagtagtcgactaagctcggcaggacccaccacataccatgtattatacggaatcatacctcgtgtatagaaggagttccggataaggaaggacaaatatagttctatatggaaacggcaagtacggtctccctagttctacatagacagggggaatctatgggtataaatacaagctctcctatgatgtcacgcactgaagttcccctttccagctttaaaatttgttaaataaatcgcctaaagaaattgttgaattaacctagagctaatcctcaattaataaatgcatttaataatcaaattcggcgtggtggaatttttcttgagttccccatgctccaatacattaacaagacttttagtgcaattttcagagctctcgaaataattttaaccaattaaaattgagcacatgcaatttttaaatcccagggaaaatcttttcctccttttctttttcttttccctccttttcctcttcttgggccgtcggcccagtccaccccaccgccacgcgcaccctcctccttgtgggccggcccaagccgcccctccatctctcctcgggacgccgacaggtgggccccacctgtcggggtcgtccccttcctctggccgcctgccccacgtcggcaaccaccgccgaaaccgccgtgcccacctccgccgctcctcccgcacccacgccgcatcgcccacgcgtcctccccacgtcgccgccctctccccgcgtctcccggcacatgcgtgcgctcgaaaaggggcgggattcgcattttgaatccccccatctcctctct

SEQ ID NO: 66728 - DNA, 2171 bp, Oryza sativa
gtcccgcatttctattaaatattgcattgttttacaatatcatgtgggatgagtcctactactcagccatatattgtttaccttatgccattgctaactcgggtattaaaatgactagatgttggtttaggaaatgcttagccatgcttagttctactagtacacaaaaagggaatcacattaaagcatagactttgattattggcatagctttggtttagtgccaccgtaatggtgttggttaattaaaatacactacatggtgggctgtgggtgcatggttttgttagtcatgcccatagcgattaaggaccggttcgcgggataccctggaagaacttaccgtacttaccacaagccagcgtgggcaacggctgggcttgtagtgtagctttcctctagccgacgtacccagacgagggtgggcgtgatggagttggttcagccggggtgtccggttgatcggcttccggattcaccacggcatgaaaggggggctgcccgttgcctgctggggacgggggcgaaccctaaggtgtggtgcgatcggttagagggggttatgcgaagggtcctgtcacggcctctttccggtatgtcgtggtggcatgtcggtgcatgggaatgtgtcgtggggctgtgtcttgtgggtacagttgtacacctctgatcagagtaaaactattcgaatagccgtgcccgcagttatgggcggtcgaccagattcaccgtgattagtctcacatctagttagctaatggaactggttagttcaggtggtggtttgggcctgttgcaacgtggtgtagcgttggacagtgattggttaatattgataaatcactacagctgttttactgctttcaactactgcttttaaatgctagctttatgcaaatgagcctttagcctcctttggatatatcctgcatcatacctcctcttccggtataacttgctgagtacagtgggtagtactcagtcttgctctctttcccccacaccagagctgaagatcttcctagtgggagttgttttgtcgaagttggtttcgtcgctgccgtcaaggattgcctgtggagtggagtcgccccgctgcagaagtcaagtttccaagtctagcttgttttatcttttccgctgcatttgtaatcttttatatttttgtaagacgtggatctgtatgtcaacaattgtcgtttgtgtaccctggctggtcctggataggggtttaatacacattcagcttagaaattctggttcgtgaatttctgggcgtgacatatgaggagagggataagccagaagccaacacacaccgctagatccatcagagattagcctagacatcccccatccggtgcctatggaggccagcaagagggatctagcaccatctctgatctcgatgagttcatattcgaggaggaagactaccccgtcatcgactacgagttggttatccatgctgccaagtcgacgacagctagataggttattccaaatattgtacttgtgtgatctagatgaataaagagcaacaccggctttggccaacaagatttagggctattatttgacaggtaaggagcccgaatctgtataaaaatccttgtccccatctcttttacctcaatctcgcatataacctggtaccgaggatccccatacatacaaataccgtagtcgcgacctcaaacgtcgacaagttgtgtgtctatataacacctaaatcggcagcaggttgacaaatctttaagtgacatagcaatcataaacaaattgaaacttaaaaaatatataaatattcaagttaacttgtcataaacattttcaaacacaaaaataaaaatatatcagctccatcatttacccgttggcttatcagccacaggtcacatgcaaaatttaattttctggaagttaattttagaaatgattttaggattttctttgttgtagtttagttttcaacatgggcttttcaattgctaagaatacatctatgaaagttttatctataagttatatttggttgcttcattcatttttccatggtttatcaaccgttgagcaaacaatgagaggctatatatttcatatcgaatttccttccaaaaaggctcctatgtaaatatattacacaattaattttttttatgtctttgttg

SEQ ID NO: 66729 - DNA, 1718 bp, Oryza sativa
tcacgcatcaacatatcatgagattattagtaaaagctaagtacaccgatccaaccatgcttagcatatcacaagactaatagacaactcatctttaatcgtggtagagaataaaagagtaaattaaagtttgtactatgtattcttcaaagttttcattttatatcattctttaacaattcttttcatttacataacagctaactttacatttcaatttggaccaccccataatatccatctccaagttcagtgactcttcactctgcaaccactccgcacactaactctctctctctcttctttttccatccgatagttagggaaatgccagatccaaaaaggagtagcccggatctagtatgtccgctttccgtcgggtcggttcctacctccctgagtccctgcaagcctagcacccccgacctcaacgacgaccataacaatagtgtgcatgacgatacagaaggtgcaaagacatgtcggaaattagagggtgtgggtgcgcatgcaaagatggagaggaggaacgatggtggctcatggagaaagagcggcggtggcggtgcgtggagcggcaattagtgactactaatgttctaaaaagtttatcaccgacacaatccctaacctagattgttgcattttttttctctaagtattactatacaccggtcatcataaaaaaaagggaattgctaactggtcgcctgctgatttatttttgtttgtcagccctttcttggcctattggattttgttcaagattcgtgcacccaactactgttcatgcatcccggcccagataacacagcccccgcgccgcatgtcacgtcacgtggtcaagcattgtttcaagcaaggaatccggtggcattttttgttgtccacgcatctgagaaaggagaggcagaagcagcgtcatcgacgacgacgccatagctccaacgcagctccactgcgaagtatgtcccccggtcgatggctctgcaagcttcggaccacgagggaggtgagttcccccaatggtcctctgctggagtttgggttatcatcagcgtcggagaagaagaggaggtcgccggagttagaaaagaagcacctagagtacgaattacgaagcatatccggagatccaggatccgcaagatttaggtatgcatttttttcgtcagaagctttatcagttcaaaaaaaaaaaaactagtactagctccttttagagtatcttcaccttccttggcgtaaaagaaaatctgtctcgtctcctccgctccttgcgccatctcgcggctgaacaggggaggggcgccgatttctccatctggcgagcagagcagggggaggggaggggatcctggtgagcatccacatcctcttcctgattcatctctctcccgccgcgactacttttgtctggaatttgctttcgttcgttaaccctagcttctcttcagagccttaacctttgtttgttcccccaaaagtttgggggttcaactgaaccccccatgtcccaagttggatccggcccctggaggaaggtggatgttagattgtagggtttcttacctccttttgtcgaactagatgcattgttgtttgctgtagaatggacccatgagatcagtgtggaagagtggccagtcctcgttctagataaatccggcaaccgaaagcgcgcatcacatatttggagtcatcttttctactagggt

SEQ ID NO: 66730 - DNA, 929 bp, Oryza sativa
tgcaaaaatactcttattagccaaagtactccgctctcaagtttatgcgccaaagcacaattcactatcttgaaatatccattctatgttcatctatggctatatatttcaaatgtctacattatctccaccatctttcatagctcagacgatagtaattcatattttgtacttagtacacaagttctaaaatccaaaggccttttatctagctaggatttatttccttgcacctattgtctgaaagttttcttactttactgtaaccttcaatttacttcctcctgcagagagaagatcaagcttatcagcaccagttcatattgcacgctgcattagatgttgttcaggaccttgcatgggctacaaacacaatgtgagtagccgttgatctgtcactattctgtttgctgcaaccaaagatatcgtcttgtttctcctgtaactcttgtttctcctggcttcacacaacacgttcatgatattctgcattccttttcaggtttctgaagtcagtagacagatttgatgatcttgtggtgtctgtttatgtaactgctggtcatatccttttaaaattaagatatggacatagtgaatcaatactgggaatagaagaatatagaaatctgagaacttggataatgataattctaccagcactattttaataagaatcctgccaggaaatgattaaatgtgtgccgcaacagggatttttttgtttctcacgcctgtttttattccctatgatgatcataaccattagccatgctatctttctagccattcctccatcatctaagtattgttttttttttggtggggaagtattgttatttcttaacttccagtctgatacatactagatttatgttacttcatgactcaaggagcgaggatggaataaaaagtttcttccaggaggt

SEQ ID NO: 66731 - DNA, 1085 bp, Oryza sativa
atgtatcacataaccctgggttggtattatgggctataaagtttcacgaaactaaactatttatcattttaactttgatcggagaaacacctaggggtttttcggctagctccacaaggtggtgggctaaacgacctgggttcgaagctttaccccttctaattatttgatattaggccctttcctaatatttattttaactttgatctactacacgtttgaggtctacaatcaacaatcacatatcaaatttatgagtttttttatctgttgtatataaatgttacatccatataagtaaagcttcttaaaattgtgatataaaagtatgtcaaatttgttaatgatgtggttgtgtcaaaatttatatagttttgtgagactacaatagattgggttttataaaatctattctctctctctctctctctctcttaaaaaaagttcttttctatgaccattatgctgtggcacacaacaatatatcgtgagaggatttttttttaatggaatcgtgagaggaattgcaagttcaattttccaaacggccccggcccgagccaaaccgcttgagatctaaacaatcaatcaacatagggaaaacttgcagatcgatcgtgacgagctagctgtagacgatgatcaatggaggcgcaaacatggcatgagaattgagatcgaagacgtaccgccgttcagggcatgggaccccgcctcccctgcagcgacgaatgtcgcagccgcagcggcgcagccgttccaccgcctcgtcgatcaaacgctgccgccgtactagctccccgcgcgacaggttgaatagaaagggcagcctcgtcgtcgtcgtcggcggcggcggcggatcagcgtcctcctctctcgcttgttgggatcccatgtcgctgtgatccagccaagatctaatgttttacaagaaattctcaaaaaaaaaaaaagagaaaagctttacaagggaggctaaagtaaattcggcccatttaagtgttcaggcccatttaagacttttaggtgctgacgtgggctgcgcgtcgtgacccaatggaacgggctggcttgcaactccgtct

SEQ ID NO: 66732 - DNA, 2426 bp, Oryza sativa
gttccatcggcattgctgctgccgctgccgctgctattgctgtgttacggatttggaaacatccattgctcaccagttcataggagcagcatcgatctccactcgctgctcgacttcaagcagggcatctctagtgatccaaatgaagccttgaagtcctggaacaccagcacccactactgtaagtggacgggcgtcatgtgcacccaaacgcgaccatggcgcgtctagggcttaacctcactggtctaagcttgggtggccaaattagctcctctctcggaaacctgaccttccttaattatctggacctctcctataataatttctttggcccgttgcctcttcttaaccggctccaacaactgaaaaaccttatcctaggaagcaacagtttgcacggggctattccagtctcacttacaaattcttccagcttgtcatacctggacctctccacaaaccttctagttggtgcgattcctgcgaacataagcttactttcgaacctagagtatttggatcttgatcagaacaatctcaccgggaccgtcctgcaaaccataggagacattacgtcattagaaatactttatctttttcaaaatcaactaagtggaagcattcccgataagatttggcaattgccgaatcttatgcaattggtgctcggtgaaaataatttgtcaggtggaataccacaaaccctccataatatatcttctctacaaagattaggtttggagtacaatatgctaagcaaagcattgccacctaacattggtgatgccctctccaatctcgaagtacttgggtaacaatatgtttgaaggtcaaattccagcttctttaggtaatgcttcagggctacaaataataatgttcttaaacaatgcattcgttgggaaaattcctcctttgggaaagctttccaacctaaatttcttagacctagggagtaacaggcttgaagcaagtgacagtgatagctgggaattcttacatgcactagggaactgtagttatctacaagatttctcactatcacaaaatcagctagaaggacatataccagattcaattggcaacctatcatccaatcttcagagtctcgtatttagtgcaaacaaactatctggcatagttcctctgagtatagggaaccttcaaaacttaacctggctagggctagatttcaacaatctgactggtccaattgacgagtggattgggaagctaacacaactcgtacatttaaatcttggtgagaacgactttattgggccaatccctccatctattggcaatctcaaccaattagcaacactctttctaggagcaaatggattcacgggttacataccgcctagcttgggaaaccttcagtacctagtcaaattggatgttagtttcaataatctccatggtagcatatatacataaggagttattcatcagtgtagcaacaatgatagtatgtgcattgacccataacgatttagatggtaatcttcgacaactctcagagctacacctttcatctaacggggcatattcccgacagtttgggggcaatttcagagatagaaacaattcgcacggaccataactttctcacaggtaaaattccgatatcgttgagcaacatgaagagcttgagcattctcaacctttcccacaacaatttgtcgggtaccatccatatggccatagataatctacaagttctcacccatttctcacccagttagacctatcggacaacaacctcaaaggagaagtaccaactaatggggtattaaaaaattctacggcaataccactcaacggcaattgtacctctgtggaggattgccagatctgcatatgcccccttgctatactgatttccagagaaaacaaatacaataccacttggtcagagtattgatcccagtatttggcatcatatcagttttattgttgtttcactttttactcatagagaggaagatttcaagtggaaaatatttattgcggctctcttttggcaaacatttatctaaagtttatgttgatggaaaatctgacgcaacacatgaaggtctgagagatctgcttaattctaatgctggtcctaaaatcaggtccagaacgtgccagttagtgtgatcctacgactaacaagatagataaattaaatcacaaggccgatcggccaaggggccgatgtgaaatcgtgcgtccagctaatgctgatggaattcggatcaatggctatgtagctgatgggactttagatatgtaatataaaacaaactataatatcatcggctgagactaaataaaatataattgttaataatcctttctttaataaagacaatcttgatagatcgtgctaaaccgagataatataagattgaaactaataatgatagacttaa

SEQ ID NO: 66733 - DNA, 1073 bp, Oryza sativa
  unsure (1)..(1073): unsure at all n locations
ttatagtgtcaacttctccttttgacttgccttgactaacgacaattgtcaaattttgccgttaacagtttcttacaatgatctagctcgagctacatcaggcttcttcgagtaaaacctaataggaagagaaatctatggttcatagttactgacttagttctaagcacgacttagtagatcaaacttaactgatgcatcactaagtatgaaaagaaacataatatctagacnacaagcctttgattgattttcagggtggtggataccttagttaatctaatctagcaagataatttaaccgataccagtataaaccctaaaatgaatctcagccgatatgatcaaattaagatgctaatctagattaactaagatatatgataaataggtaggtaaatatatcaaccgatccagagtgatccaagagggcgaagtgatgtaaccttgaacaacatcaatgtagctgatacaatctctagggccggcgaaatgtaggacttgccccttcaccggagatcgaactgaaccgatgcagccttgcatcaggtgacaagtttcgccggttgataagtaaaaaccttgaaaaagagggtggcgatgcgccgagagtagttgtattgatctgtgagatagtttacaatgactccatgtgtacatatttatatccatgggtagatactagtccttattggataataaagaaacttttctaagataaaaaggaaaacataaagtccttatcggacactaaacacactctcctaaagataacaagaaactaatggactcttcctaattaatagataaactctgcatcctccttttgaactcggtctcttatggataaatttcctttaattcaattaatttccttaaccgaacccatcaagaatcagactactggcgactgttagtgcccatcggccgatttgtcacaccccaatccggcaccgccatacaacggcacctgacaagagcgtgtcgtaggaaaaacggcgcgaaccgcttcatacgaaaccacgatcttagtaccagtcccaggacatagcgctggtaccccggtgacaaat

SEQ ID NO: 66734 - DNA, 1806 bp, Oryza sativa
aagatgaacaagcgaggcctctgtactgttggcaaggttcaggaagtttggtcggtggatttaaaaagggggcgagggctggagtttaatggaggaggagatgaggatagctgggtaggcgtcgaggatgcagcgggagtggccctttcgcgggaaaggggaggaagaagaagatgaagaaggcaaccaagggaagtttggtggttccagcattctgtcaaactcaactggagcggttgggctgttgagttctgtgtccgaaccgaaacacacacaagcccccactggaagtggtttttcttcctgctccacttccagctcaagaatgatgtcccactctcttgacattctaccgggatgcaggattacatgggtttgcagctaattttaaaaaccttacattagttgtgttttgtcatttgaattctgaattcggtctgtctgcaatatgtttgctcatgatgcagaaactgtttcaaccaagatgagtatgactggtgcatatgggttcgtaaaatgtcacaatgcgtgtaattttgctttcagaaaatcttgtgcagttattcttaggcctgagaagagcaatctgaactacctagccatataggggattgatgtgccaccttatgcgtggtgttaagctaatgaacacaattcggtaaaatgattctgtcagcttttgaggttttagaccaaatcactgcaccataaatcacatgacgtcagtttatcacgctgctagggaagtgaagcaagtcatacactatcgtcctctagcatgacagaaatgtgcatcacaatacattcttaccagttttctatagattaggtacgcacatatagaatacggtttcaatgaaaagggtcatcacgttggtccagaaaaccatctataccatatagtacagttcgagcaccggatgaactagttactagatactgtatggaattagacagtgacgtaggatgcacaacctgcttgaaaaagggcaaagctatcctgcatttatcatcagttggaagattgcatcggtgggaagctaagatgtaacatctgggaatggagcgaaagcccaatatgcagtaggtgcagacatacctcacccaatggtgggtcatgtgaagtaaactcagcaccaaaccccttcttgagccttggtgtagtagtagtagtagactgtgagcaagtagtatttttcgcacacaggacattggctgatgagcgatcaaatcgacactgcaaaaccctactaagataaggattggtggtgatttgcaaatgaaaggtacgtaatgggaagaattagaccaacgcatgtttatgctctatgcttacattacatccgaaataaatgttgtgttccatacttccatgcttagcgattaaataaagtatagcagtcattagttattccataatcacaatcattcaggaacaccaattgtgtagcatttctccatttagaaaaaaaagaagaaaagatttgtcgtgttcagaacttcaggctcaacaatcttgcgggcgttttcttttgttttcggaaatggtgacactcgtttcagatggtgtcctgtgtcacacaagttatgtgtgttgcacagccattcctctagcagatttctctcgacgtggttgcgtggtctttgcaatgtcaagaatggtgggggttagccggttaggctgtctgtcatggatcaatcaccgtcagttttgcaccctaattgagcttctgcctaattaatatcgtccactaaataacagtgcttttcatcaaactgttgtccggtggatggaccagtcgccaa

SEQ ID NO: 66735 - DNA, 4444 bp, Oryza sativa
ggtcgaaagaaccctcccctccccccatgctgactccgccactgcgtagacacagcaagatcacaacatcgtgatttccccgacacgttttcaagttaaagtgcgcatcctgacccatcaaccatgggtcacctaggtcacagtcacattagatctgttccaccacaggtccaaccggagttataactttagattctaggcctatacaacccaaaagactagtctgatggatgagcatcattcctatcttttaagtcgtgtttctctatcgtcaattatcgatgtgggattacacccaacaccgtcgacggcgaaggccacgtcgtcgcggaagcgagacggcagaccgcccggcgggtggccgcgcctgcagcagcatatgcagcgttcggggatgcctggatggctgggtttgagttgggctagtcacctagtttcaccgtgggcccaattcggttgggatcccatcccacggcggaagcccaagtcgagccgagccgcatgggcggcgccgctgcccaccaccgcaccaggccaccaccacaacacctcggtggctcggtgcgcacgcactcgcgcttgcggccacgcgcgatgcgacgcgacccgactttttcccccctgcgcgtacgcgtgatggcgcgtgaggacggagaagatgagacgggaggaggaggaggaagagaaggggcccatccattccatcgcccgacgcggcccgctgcggagaagaggaggtatcgaagccatagctctctcccgtctcctctcctctcctctcctcccctcctccgccgatggggaggattccttccattccatccgcgcatccgctgcctccgcggaatccgagttccgcgtactgcgctgatctccggcatcggatttcggagagggtggggtgttctctccgctcggggttgttccactcggttctgaactgggagtgtgagtgtgcagggcaaggttgttgggatttcacgtcgggtagagactaccgcgactgtcctagttatgtcagtgccgttgtatttttatacaaagcggtagatctggtggaaggatatgaactgttgcagataattgttgattctgatttgtactggtgtgacatgtgcccccatgtgttcaacttgtgtagtacatgttttctgatgcttggattgtttattcagtctggaattctacttatgtttttctgatttgtacttgctgagtatctgtgcttctagaattacctcccatacaaaaattaaatttggagctctggtttattttggtactagtagcttgttgatggacctcttatttatatctaaactaattgaccgcatcttgtattgaactagtagtttctgatgcttcagatcggattgtactctacatgataagaaagtatggcaccagcaaacaaagcagagagaaaagcagtgctggatgctggagcatggatgttcaacgttgtgacatcagttggtatcatcatggtcaacaaggcattaatggccacacatggttttagttttggtaagacatgctataattcctcactcgtggttgaattgtcaagaatgccttgtccgcacgtcttatggatagttggactaaaccgaactatcgttgtgcagcaaaccagtcagattttttgtgctaatgatgtgttccattgtgtgtttgtgcagctacaacattgactggattgcattttgcaaccacaaccttgatgacattagtaatgaaatggttgggacatattcagccatcctatttaccattgccagaactcgttaaattcgtcttttttgcaaacttatcaattgttgggatgaatgttagtttgatgtggaactctgttggattctatcaggtgggaagagtaattttaaatccttctatattcaatgttagaatggagggcacatactaattttcgtttcatgcctcttcagattgccaagttgtgtattattccagtcttgtgcattctggaaatcctgtttgacaaagtccgttactcaaggaatacaaaactcagtatagtgcttgttttagtaggagttgctgtatgtactgtgactgatgttagtgtgaattcaaaagggctgctagcagctgtaattgcagtttggagcacagcactacagcagcatgtgagtatttgattgtgcacattttgacgtattccatgccctagtgataactgctctgtttggctcctttttaaataccttggcttctgaatgagcagtttcagttcaaattacgtcgcatatggtacattacatttacatattttccaaactgttcgtgtgaattcagtctgatttatctcattctgtaatctggatttctgtcgatatttgcttgcttctaactgctgtactgattactcatgttcaaaggaaatgttcaatagtaacttgtatctaaaagagttgcaaatatttagtcttactcatttatctgctaacagaaattttgtccctcgctgctgttttcacttttaatggtgaggttttggataattagcacttgttttattccagttatttttctttcatgctgcagtacgttcatcaccttcaaaagaagtactcgcttggctcattcaacctattgggtcatactgctccagctcaggcagcatccctgttaatactggggccttttgtggacttctggctgaccaatagaagagttgatactttcaattacacaacaatagttacggtatgtgattcttgttttgaatcagttctctgcttattctcttgtgaacttgttgcattacagtcccatttggctctatgcagctatttcggcattataaactgtacatagctgtagatgaatccgttttgagttagatactgatgaccatgaagagtttaccatatcctgtaaccaccagatttatctcctggatttggtccatgaattacgatttaggctggaaaggaatattttaagttctgttttgatataagtttacagcagctttaaagatattttttttgaacattgtattatccaagtgttattagatattagagtactggcagtgattcttttcaatcccttttgtgcatgttcattacctctctataatggatcaaccacctaactgctagtagttagtaagctaccttgcacattacagttgaaacttgaaatgtgtttttacagtatggtccctccttcaaatagtacagaagtatatgaatagttctttgttgcacaatagcaattttgcttcttatatatacttcatggagattaagagatacctagttgcctacactgtttcttctatctatgaataaaattttatggaatgagcatgacatgtatggttttttatcatagcagtgcagacctgatgttcccttgacttttacatattccttacatgagcaaactgggactaatgctttcttcttcactcacttaatttccagttcttcattgtattgtcgtgcacaattgctgttgggaccaatctaagccagttcatatgcattggaagattcacagctgtctcatttcaagttctaggccatatgaagacgattcttgtattgaccttgggttttcttttctttggaaaagagggccttaattttcacgtagtccttggcatgatgcttgctgtgattggcatgatttggtacgggaatgcttcgtcaaaaccgggaggcaaagagaggcagatttactcggtgcccagcgagaaaactcagaagtcatcacaatcagagcttgaccagaaggtctgaaacaaagttgtttcactatttttacagctccattgcttagcgagcattgagaagaccacgatctgatttattctttttttttctggtaagtttaaagatgtttctgtacaactgaaattcataccagacaaacagaatatggcaggaactaagcgcgacgataatttaatttgtaatattccattgagtaactgcatatatgatggaaagatattttcagctgtgatgttccgtttactaactgcgtacataaaatcgattggtcttcactttgatattagctattccagcttagcctggcagtatcaatgtatcatgttatggcacgtggagtcggtggagaagtggctgagcaacactggtccttttcatgtataccggctccagtaagcccattccacctcataacctcgtactcatagccttatgctgctatggactgcatccaagtaattgcagacatcaaacctcataccacgttattaacaggtcaatatgtcaacaacacaacacagcaacattgaagaggtttaagagaatttcaagggcgcctccaaggataaaaataaaaaaagaaaattccagggctataaaactgaactcacagtcttcaaaatggtcatcctattcaaaatcaaacaaaacacaacctaaacaatatatcaagt

SEQ ID NO: 66736 - DNA, 2393 bp, Oryza sativa
agattgactatgaaccgagtagggagatggcattgggcccggttcacctattagggcccagcatcctaattacgatgaattttggtactaagttcacttttgatccctcatttgagatcgagtttcaaacacatccctaaattgcaataccagaaatcttaacatctaacttataaaaccgagttaaagtaggtacttcgacagtatctatggctggtttcgctaacgtggcaagttgacccggtccactcgtgctgaccaagcgcttatttggcaaaaataaaagtgagccccacatgtcatctacaatctactcacctccccccctacctctcctctttctctccatctctccccctcattcctctggagttcgatgcatcaagtgttctggcaaggaacagcgcccagcgggtaggaatgacttggggatggttaggagatgcgatgtggtggtggcggctgccatcgcaaccatggcagcaaggaggtggagtggggttgggggtggctcaggaacgaccggaaacagggcagctgacatcggagacggccgtgaggtcgcataaaaccgcccaactcggtaacggtggagaagagagggacggcggcgaggtcactcccttccctcttcctccagatccgcgcatcattccgccattgccaacggtgtcaacaagcatgatgatgtggtcgatcaagcggcattccgacgagctcatcgctgacatccatgtcatcgaatgggttcagctctcagacccctcctctgtggcccatcgaatcgaccaccaccaccaacacccatccttcctatgcaaccattgtggcgctcgaggaacctagcagacaaggatgcatgatagaggctgagcgatttcggggcacacagcggtggcgacggagtctatgagagagttgtttgacccacatcggcccaccgtgatgtggagggaggagggaagtaaggctgtgaggtggaggcgatgatccatcgagagccagcggagtccaactttcatacatacatcataccaccattcatcaaaaccctctacgggattagtagataggcttatgatagacacatacaccccttttgtacttgtgttctccatatataaataaagcaacctccccaaactgacaggacgtaggattattactctaaggagggcttaaacctgtgtaaaaatcgtaccttgtctgattggcattccctcgataacacacaaacatgacacatgtatacaaagtttctattgtcaggatttttatcgataacaataatatatactataattacaaaccaagctagcccgtgcattgcacatgttattgttattgatattataattatccaaactttaattatacatattattaaaaaatattatcactgttattttagatagcggtatatacattagttacaacctatatattaatccacacacttactaaccaaatcttccaggttaatttttttttacaattcttaagaaaacaactaagctactaaattttatactaaattttagtacctcaaagtaccaagtatttggaggtattgagttttatactagaaaatgtacttctatactttccattacatttctaaggatggctaaattaccattctttttaacacgtgggaggtacgagtattgcccaatttttatagatatagataaatactagtgattgtctaaatggcaattgatctaagaactatatagagcaataatgataagagttaagacaactaaataaagtatgagcgccaagatattatgatggagttattgtcattgcacgagattaattagtgtgtatctcctctgaggattggcatgatccttctgaaactatacccaaaactaacagcaagcaaggatattaacttagaagttacaacacaaactttactagcttatacccttacctgccattacccagcttccggaaggcagcaccttgcgtgtgtgtcactcacacccagtcaagcaaaacctgatcaacgaccaaacgagttgcaacacaaccgtgatcaagattcgtctaacctaaacttgacttgatctagcttaattaatcgatcgatcccctaattagctatactagctcctgttgctcctcttcatcgatcatcccatggcgccattgaaaggcgagctccagttggccgagtagccgttcgccctcgcgatgctcaccgtcgacgccgagccctgcgacagctggtacccgccgccggcggcgccgctcgccatcgccatggcgtcgtacccgatgagcttcccctgctcctcgttgccgtagctgcaggtgtttccatggttggtggccgtgctgctgtgcccctggtcggccacgacggtgctcgccggcat

SEQ ID NO: 66737 - DNA, 1142 bp, Oryza sativa
agtactactattttatgcgccatagggcaacatatagaatatctaatcttcagttctacgagacgtacgaagatttcaagaaaaaaggactaaattagtacgggtcgatgacttagatcttggggatataacactatgactagtcattgattagttttaaggatcttcattaggagagcgattaagtttagatgagacaggtctaagatcagtgtagcagcttactgaaggtgcctaagtagaggtccttgtttcctgcaaccctccctatccttgcttgccatctcccatgctgatggtgcctgctcaaaaattatatgttaatctatattacaacattggaacaccaaaatatcactacaaaatttaagcatatacagttaacatgagccgtgtacatatatgttgacatagcttagagattagtagttcataatacatataaataaggacaacaagcacatctagtacattgcgtgcttttttgtatactactagctaggaagaaaacataaatcaattaattacctggttacaccacgatatttcgatgcaccacgagaaaatccactgctattcctgcatatttaattaatgaaatcatatctcagtgtgatagtctgatattctgggagtgataattccatatggtgaaacatcagttaccttcttaggtatgcaatatactcctgcctggtcatatgtttcatttcatctagctctttttcatagttacttatctgcagtgaaattttataataaaaaagggaaaatgcaatcaacaagtgcacaatttaatttttatatactgtattataagtggtgtgtagaaaactatgatctattaacaagctagctagaaaactaaaacgacaaacttatatgtttaatttcttactgggaaatttgttgttgttgttgtgccccaatacttcagagctgccaaatcataagctctcgctgctttatcctccttgtcatagccacctgagtagtcgtgatacaagtataatgattgtgcagtcactaatatagttatatacaatgaaaaaaaaactgaaggcgtttgcatgcataccaagataaactgcgcattgcggagcataacggtgtcattccggatagagtcattaggcgatggg

SEQ ID NO: 66738 - DNA, 4549 bp, Oryza sativa
caagagcaggtaatttactaaagctcatatgcatgctattaagattcaaaatcacgtctgaaaaaaaaatataaacattggttgacatccttgcatgttcgatctaagcgcatatgtgtgcaatagaacattagtgagaaaaattaataagcaaaagtattagcatgtttttgatcttttttcaattggttagaatatgggcaataccagaattagtaatatcgtatctatcaacaattaccaatactagtgtggctcctatttcttgtgaacaaaattatttacttcccaatcgtatatttagcttgttaacgaagttagtctaactccatactaattccgtatcatcaacatctaatttcattgtcctccttttcttagatcaatgaactttctacatatatagcctatacccaattacctttccaaaggatcacataaactatatactaactcaaagttgcatatatagccactgtctcgatcgagcgattgcattattatttatctaaattcgattgcagttagctagctatctagtatagaaccatagatctgatgatagtttatgttctcgatagatcgatcgcgcctcgactcaaaaaggagatcattaattttctaactaacggtgccttccatttgaaaggaatcagcaatccatcatcgatcagtatgtaggcatgtagctagccatagtagcatagacaaaccaatattgttctaaccttgttacacctcgatatatcgaggtcctttgcccgaacgtgtcgatggacttcctcggcacggcctctatcgcgccaccgcccggcgaatccatggcgccgctggcccgcttgttctccgacgatgtgctctcggccgctccgccgctggcgttcccgccgccggcgacgacgataggcagtgcgagtgcgagcccgtgctcatcgagagcgccaggctctgcgagctcgtcccgccggccgccgccgagaccgcgccgccgttgttactcctccccatcgcgtcggaggagcacccgaagctgctcgcgctcgcgtcggtgctcatctccgccgcctcgtgcgcctgctgctgcgcggcggcggccgcggccgccggctgctgctgctgcggctggtggccggcgggcacctggccgttgttccggagccaggtcttgatcatggagagctccatagtgttgctcccgctgttgctgttggtgctgctggccatcgggacgccggagaagaggaagccccccgccgcgtgatgatcttgctcggagacgaacgagttgccgccgaggaagtcctccagcttcggctcggtctcctccaccgccgccgccctcttgccgccgctggagccgacgagcatcgacagctccgaggcgccgccgttgtagtccagccccctcatgttccaatctgcgttaacatcaaatatcaagatcaaacacccatcactccatgtactactagaaaacgagagacacacgcgtgcatgcataccttgtgcctcttgagctcccctattgaaggcctccatgatgccatacgaggcgttgtgatgatgccccgccacgccgaggtgcgcgtcggccgccgtcggctgcgacgtcggcaggccatagaagtcgccggcgccggagacgtcgatggctgccggaggcgagctatcctggtgaggctgcggattctcttggccggagagcgagaagcccagccagttgtttgcagaagccatctcagggggagaagaagctgatagaacagtgggattggttttcttgctgatgatcagagcagcagtgaaaacattggtgaggatgagaggagggatgtactaagttggaagctgatacgggggaggtatagcttttccaggggatgcactacattttgggtcaatgtgaagatggcaggagagagaggccaagaaaaaaaatatcctggccacctgagaggaggggaaatgttctaggaggcctgtatttataagttaagaacagagtatagcagaagactagtcttaggctctgttcgtttcctggagttcccaactcccccatctcattttccgcgcgcacgcttttcaaactgctaaacggtgtgttttttgcaaaaagtttatatacgaaagttgcttaaaaaaattatattgatccatttttgaaaaaaaaattagcaaataattaattaatcacgtgctaatggactgcttcgttttccgtaccggagggatgggttcccaactcaaccaaaagaacagagccttagacgttgtgctggtagctagcaagtagttatgtttcttttgtttcgtcaggattctgaagctgaagggggcaaaaaaatattagaaatgttcacatttgagaacggatggagctagcagttgtttaccgtcagttaatacatatggagagcaatttaactcctaccaaatcaagaaaagttcaggcattcataaaccatacgggatatgacaattgttttgttgaattattgtcatatagtactatatagcatggatcaagttctccttttaattagtatgaatctgaacccaaacaaaagacgacatgcatgacatgtagatcgaggagctcgatcaatccaaatatatataccaatgcaagcagtggcgggaaagagctagctagccgaataaataagcttaacaagaacgagatcgatcagggacgacatatccttggatcttaatcaatctatcttagaccttactcgatcagagcttggatccgatagcgcgcaagcaagcaagttaagatcgccacactactatgtatgtatatacgacgtatgtacgtgcacgcgcacgcgtggatggattcacgctcgggtcctagcgcgcgcggacggttcgtcccgtccaacggcgacgaatccagcgaaagattcccgctcgcgccggagaaaagaagaaaaaaataaccgagagcatagagagagagacgaaacgctcgctgcctcaacaacgccggtcaaaccgccgcgcacgcacacctgtgcagaaaaaaaatcagtccaacccgcctctctcttctctgacatgtcgtgccgccggacgcgcgcgcgcgcgcgtgcgcatcgtcgttcgtctcgcgcccatggcccatctctctcgttctctctccactgcttccgagttccaaccagccattgcagcgcggcgggcaccaccgataatagggcacaaggctagccaagggcgcgcgcctaggcctgcccgctgatctataattatggtgctttcgaggtgaatcgctggattggactggtatgacgaccctgcatgcccagccgcctgattgactgtgtttttgcagcgtccatcgacttctggttttagcaattgcatgcatgcatgcaaaccggccgcccaccttaccttccgctccgatccggcggtgtgtgtgaacatgatcttggaagatgagatgatgggatcacatttggtagttggaatgctaaagtattggagtgtttgaactcgatccacacaagaagggaaatagaaggtcgtgaattcacaatttaattatcttcttttttcccttcacaaatatggagttgattttttttaagatatggtataattttttgaatcttaatgcaccgagatgttagaaaaaaaatgaggatttttggtaaaatatctgtgttgcatttttaactgtgcaggtgaaccagtgatgacatcccctaagagtttagaacatatcaccatgcataaataagtggcttaaattagcatattactcccttcatctacttttgatagtcatatttccaaatctgaaaaatttatttttgataggcatattttaatccaacaacctatcatcttaatgactttctcgtatttaatacgtgactctccattcttccatacaagattggctacatggacatcgagaaatgtaaatattaatgaatcgcttgtttacgaggaataactagtactccctccatctacttttgatagtcatattttcatatctgaaaaatttatttttgataggcatatttcaattcaacaatctatcatcttaataactttctcgtatttaatgcatgactcttcattcttccacacaagattggctacatgagcatcgagaaatgtaaatattaatgaatcgcttatttacgaggaatgactagtatcatgtttaaattgatgatgagtagaattacttatccttggtctgtgcgtcaagatgaaatatgactatcaaaagtagatgaagggagtagcatgtttaaatggatgataataagtagaattacttatccttggtctgtatgtcaagatgaaatatgactatcaaaagtagatggagggagtagcatgtttaaatggatgataataagtagaattacttatccttggtctgtgtgccaagatgaaatatgactatcaaaagtagatggagggagtacaaattaacagaccataagccattaatacaactattaatacctatttaaaatttccagtcacctaaaatctggacactcccttttctata

SEQ ID NO: 66739 - DNA, 5331 bp, Oryza sativa
ttcccatggccctgaagggacaggcgcggggttggctaatgaacctgccacctgcgtcggtccactcttgggaggatttatgccaacagttcactatgaactttcaaggcacttatccgcgcccaggcgaagaagcggacttgcacgcggtacagcgaggggatgatgagtcacttcgctcgtacattcagcggttttgccaagtccgcaataccataccatgcatccctgcacacgcggtgatctacgcgttcagggggggtgtgcggcacaaccgcatgctcgaaaagatcgcttccaaagagccccagactactgcggagctttttcagctcgcagaccgagtggctcgtaaggaggaagcatggacctggaacccctccgattccggtgtggcagcttcggccgcccccggatctgctgctcaaacaaggcggcgagacaggaggaggaagaagaggtcggcctattccgacgatgagggtcatgtccacgtcgtcgagggcgtttcgctggccacccgaaaggggaggcctgcgagcgacaaaaagaaggaagccgacgctccctgacctcggctacttggaagagcgaaggcggcgcgcggcccttcgagccgcgcgctaccagcagagcctgcggcgctaccatcagcgccacgtccgggcccgatcactctacgtcgacgacctcgtcctacgccgcgtccaaacgcgtgctggattgagcaagctctcaccaatgtgggagggtccgtatcgagtgatcggcgtcccccggccgggctccgttcggctggccacgggtgacggcacagagctgcctaacccgtggaacatcgaacaccctcgtcgcttctacccctagtgggggtcgggtgtcaggtcttgggctcgggccaaccccgcgccccccccccccggggcgtgcagggttggccgggggcttatcttttttctcttccgtatttcaataaaagcattttcgatttcctaaggactgtgtctgtgccattgtttccttttgaagaatcttggcttgaattagcacgctcgtgctcgatcctgtcctcgggggctcgggtcggctaaaatcgccaaacggggcccagaaccgagccgtgccccgggacgtggtgaactccgggggggaatcggcaaaaacccacaatcgggtcacccataaccctcggtcaccacgttcccggcctggccagcctcgacatgtggatctccccaggcactagccccgacccgagccatttgaggactaggacctgggcacgagcccttgttcaagccaagacacagaaggaccgaggcatagaccatcctcgtctcatacacacaacaaatagaattgacatagaaatttcctctttatttggttgcagattaaattagtctatacaagaagggggcccgaaggcctcggaagaagaaagaaaaagttattcaagattggcgggggcctgggggctcactctgacgcgcccgggtcaccagccttgtcgtcgctgtcgtccgcaccaccgtcaccgccctcctcgtcggagtcgagggcgaacgcgagccgaggggccgtaccctcgaagctgtggacgatgtggtcggcggcgtcccggacctgcgcgcgtgcgccgtcctcggttccggaagggaactcttccagcgctgcccacggggagaagtcagggtccgagaggcccccaagccgaacggcggcccaaggcccccgacggccggagttggccctccacttgcttgtccgacggtgtcaggatagcctcggggccactgcgggaaggccgcgcctgtcgccctccgaccccgaggtcgtcggcgcagaagccgagggcgccccgcgctgcctctcggaggaagagcgccctggagatgcggcccctagcgaagaggatcggccccgccgaaaggtgcagcggcccgtctactttgttagcgaggccctccgggacgccaaaacccgataccctcaggcccagaagatgctatacgctattctgatggctccgagaaaagcaccatcaccatatctccaggcgaagcaaatcggctcgcccagattcgtgcgctgttcaggtaatgtggcagtcttgaagagaccgcccattattgacagccaagttaccattaccgatgtgcatggtttgagaccgttgggtttttgcccaaccatggagaccggtcccacctgtcaccaggctttaggagtggcgtcatgcccgaccgcttcccttgagaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcacccacctcttggtctccccgaggggggggtcggtcggaccactcctgcctcgcccccgagggccgaggcgccccgacccctcgcgggttctactccgcgtgtatgggttaggtgagcacagcggggtctcacctaatcgcatttattgcgcctcggctaaacgtgtcacgccgcatgaaatacagtgcagtgcactcgattatccggtctgtgaccagtcacagaccggtcaaatcacgggttaggtggcgacaggcggtctgacgcacgcttcgccccatcccgtcaagacgagagcttctaggcactcgtccccagctggagctagcgtgttacatcccagagatggcacgttagccccgatcgatatatgccaggcttcatcctaaccattacaggcaagatgttgtgtgaagaagggcaaacatgcacgttgctaggctgacgcgtggtggacaagaatgaccgatttgtgaccggtctgacactgctcatgtcgtcagcgcacagccacgttcccacgacgcgcctgcccccggcagaagtggaggtaggtatgtgccgtcccatcagaaggacgttcggagggcaaccgtgcaaatctccgtccatttatgaagggaagaaaagtccagtttgaaaaggaggggtgcatgtggtatccccttgaagtataaaaggaggaccttgcccatggggaaagaggatgatcttttccagattcggaacctagaacaagtgagaggttggctcacacttggcccacttagataggagaggacttttggacacaaggccttctccagatccgatcccagagcgattgggggctggttgacactttgttacttgttcatacacaaatccaccaaaacacaggagtagggtattacgcttcccagcggcccgaacctgtatacatcgcccgtgtctcgcgtttcttcctagctggcgatctttccacataccgagagagcttgagatttcaccctaagcccccggccgaaccggcaaaggggggcctgtgcggtctcccggtgaggagccacgagctccgtcaagttggctatactattaaacttgctctaacttgtgtatttgtatgccccttggattgcgtgatgtgacacttcaacatatgtgcaatgagtgtttgtaagctactattgtgttttcgtctatgtatctttaaggcatttggtaagttaggcataatatgcaattaatttacatatatgtaggttaaaatacttttttgtttttattaaatattacgataacaaaagaagggagtggaacaaaaaccttcaactcctttcaacaaattgaaagagaaaatcaccatatatctctcataagttttttttatctagatggccacccataatagaaaaagagcccccctgaagggagtggagatggttcttctgccattattgcatggagcgatgtcgctctaagcaaaggtgaattgctaaaaattgtcacaatattttaggtatttttttcaaatataaatatactgcattgtactataactgtattacacagctactacattataactatagtgtaattacattataaattttataaaacttatatgtacaggttatatgaaactaagttataatatatacatttattgtatagttagattgtaattatactacaattaaactacagttatatttgatagttttcaaaaaaaatgaggtgatttattttagatattaaattcttaagcgaataggtgaaaacgtaaaacttcaaggctaatgcaaaagcatcaatgtttcttatagaactctttaaagaaatctatccaatatgcacgtacaggtacatttgaaaacctacttgctatattctgaaaatgcaagactagaacagaaagtgtcaatctggtgtgaatctcactctgagcatattatattcactccactgtttatctttcttgatcattccttggtactataatcaaatgatccaaacccactgtcttccccgcatcactcgggcctctcctctctctctctctctctctcttctctctctccgtatcgagaaacgcccagctaaccccaaagagcgagaaaggttaaccctaaagaaaggtcacggtgaccccgaataaagtaggggagctggggttgcaagctgtgccctctacaaggacacacacccttgtcttccgggcatgcacacacacaccagctggggacggaggaatgaacagtgcctacacgcacgcagcatatgcagagagagagagagagagagagagagagagagagagagagctaggagaggagtgccatgaacgtttctacggaacatgcctgcctgatcagccccagcttcccgtcctctcctcgatccctcatatcacgccccggccggggagctagccgtgcatgtgcagagctccaggaccatgcatatacatgattacagggagaatgttaataatgctatctcgcttgcaactagctatagttagctaatggctaggctggtcattgggatataagtagctacaacaggtgacctcgatcatcataccatctgccaacaacttgctcctctatgagtctatctccgcaggtatagaactacaaattgcatgcttgccgtcatatccaaacccatcatgtgtgtgtgtgtgtattggcaggacttaccaacagtactctgcgcaagctttgtttgtcagccacgctattttcacattcctcgttggttaccaattacgctgggtagctctacacgtacgcagaagaggaataaccatatgcagcaggtctctctacctaccaacttgcgaatctagcattgatcaatgtaaatacacagggctagcttccgtgattctgccctgcagagagaggaaaatgtcggttgctgggcacagcatgcagattgt

SEQ ID NO: 66740 - DNA, 2574 bp, Oryza sativa
gtataaaagtagagtcaggtatgagctctacgctatttagaggctagcatcatactccctccgtttcgaaatatttgacgccgttgactttttagcacaggtttgaccgttcgtctttgtcgacgtttgatgttgcaatcctggtatttcatagtatggggatcgttggtgctaggatatatgcgagacggagacgaggatttttatatagattcgggcccctgaattgtcaggtaataaccctacatcctgttggccggagccggtcgttgctcttattcaccataatcacacaagtacaatatttgggatagcctatctaactgttatcgacatgacggtttgaaggtctgactcgtagtcgacaacatggtagccttcctcctcgaatctgtgcccggcgagatcagagatagcgcttttgtctctcctgacagtatccggagacaccgtagggtactagccgtgcttatccctgaagtcgatatccggcggcgtgtcttggcgtatgtaggcttctatgtcgattgtgttaggtgttgatcctccatggtgggtgttgattctctcgtgtcctctctcctccaaagggggcttggggcttgtatttatacccataggtgtccccttgtccaagtagaactagggaaaccaatatggatacaatccgagtagtcattgtcatttccatgtagaactctggttgtctttccttatccggaactccctcgaggtcagtttccatataagatatggtatgtggtggatcctgccgagatttagtcaagtactattaggtatgtggtatccataaccctgatagtcttattcaaaaaatttaagtaattattaattctttttctatcatttgattcattgttaaatatattttgatgtaggcatataattttacatatttcacaaaagtttttgaataagacgaacggtcaaacatgtgctaaaaagtcaacggtgtcaaacatttcgaaacggagggagtacaatagttggagacaatatggactctaatcattaatgtatcaaaatatttttttactattctttcctttctttcaccactatgtaacaaaatttgctttaataaatgctagagtcgactctaagccgttgtcgtgcataacaaccatatttcttttttctcctttctctttcttccatgtcatcaaatttacttatatgtcaatagagagagaccactaataaagaacattgtacatgccctaagaatagattttaccctgggtgacaaaagcagagcgcacaagcggggagggggaggtaccggaaaacataggcagcaggtttttctccttttgggctggtcctggcttgtgccaacgatctaaaggcacgggacgcgctttgcaaagcgatggatgtactgtaacggccaatgtccagagttgaaaaaggaaagcaaacgtaccaattccaatcgcaccacgcactaataaagcacatgagtcgtcaggggcgaagcaggatttgagattagaggggtgtgggggtaaagataaatcatgagatcgaataactaatattgatagcaaaagatgtcaaatagtcaccatcaataacaagtaatgcgtaaagtagtcctttaagaaaaacttgaattttagctatttaataatatcattggaagtatgaaactactctttattactaaattcttttaatgtaaactattgaataatctcacaaataatattgaataatctcacaaataagtatcatctattttactttgaaaaagacgagaaatcacaaactaattttgtagatcatatttcttgctaatatttttagacttgctaactaactaaactgataatactttcaagctacacaaaataaattagataaatacttatcttagttaaccttaatatagagtaaaaacatggggtgtaatggtggcagtgtttgcatagggggtgttggcaccctttggcacccccctagctgcgccactgtgagtcgtcttcctagtatagactgttttttttacaagagcacagtagaaacacgaacactcgtaacacgtgcatgttcactcttataaatacatacatgcacacccattcaaaagatgattttaacaacggaagtaattaaaaggctctcagcgtcgaccagcccagacttccggtgaggcggtgactacactctggctctgccccctgaaaacaccattttttttaaaataatcccaaacaccaaagttggtaccttgtgaatagggatggcaatttaacccgtttatccatgggtaaaaaccctaatagagttgggtttgttctacatttagtacctatgggttttttattgggtcaaaacctatacccaacgggcatacgggcacgggcatgggtagtcactacccatgcccgcttcgcccgtttacccgcgaaaatcaactgacatgtggtccctcagtcaaattagtataaatgccaccatctagtattgatgaacttgtaatgcttgtattgttgaacttggtacaactctaccctttctttaaattgtgataatgtctctctgcttgtg

SEQ ID NO: 66741 - DNA, 1959 bp, Oryza sativa
attgaaagtatgtgtatgattttttctagattttttggtgacattttttagttggtgtgcacgtgtgtacacgtgagggcctgtgtgcataggatatgttgccctattagatagagccatcccagtgacattctccttacttttcgaaggaattcgtcactcttcagcatggagtgccatttgaagaagatctcggctggagtacaaatatgttatttacttacactgcttgtcctgtggatggagttgtttgagttaaaacaactataggatgtttggaggtccattgaaattatcataggttatttggaggccagagcttgttaagctaaccttgtagaactctggagatctctaagtagaatgttgagcagattagctgtttattattccgtgccatgagattagttccaaatgttcatccttcagtaaatagaagcacgaaattttatctggatttattgctgtaacttgcattgaagtaatcatgtttggaagtaagaactcctatcatatccttctcttagccttttcatttcagttgttctcttgatgtcatcatgctagtaattaatttagcttgtttcaaacacagcttgtagtttgttatatcctagagaagtacatgttagttaatccttcagagttagtatagtgatagataatgttcatatgatagtatgtaagtgaacatcagtgctcaggcttatcagttgttttgtgtgcatttcccattgtgaaggtcagaccatgttacatgaaatcttccattcacatgcaccatcatgtgttcaatgttggtcgtgattgttatcatattgaaactagatttgttgatttattttttgggggtaatgctgactagctgagacaatatgggaaaattatcacctcatgtcatgtttcaatttttaatatgatagccatagttatgagtacaagcatcttctcctttttcatatggttctgtttatattacagtccacatcagcaagcattttctttccatatgtgatttgtctttagccttaagcaaaaaatatgcactggttcagtggtttatccaccttttacgcttttgtgctagcattgaaataatgtctatctttaattaattttcaggaatgggagaaaccaaagcctgggaggaggcctgatatcttcccaaaattcagccctatgaaaacaccattgccccatccattgccagctgatgatcctctggatgatgatgaggaggaggaagaggaagaaccacaacctcaggaggaaccacaggaggatgatcctgacaaggaagaacctgaggaggatgacccggacaagccaacggagtaattttggatgatgtgggttatgttagataaaaacactatgtttagatctgccatatccttgagagaacgtcataggtctcagggtcaggtttgacctgttagttctgccggctcatataggctgtagacacgtttgttttgggagcacccctgagcttttctaaagccatggaagttttgtctgactgatcacaaatatgcaatgttatatttctgcagaaatacttctctctctgcccgttgaatattcataccgccacaagctctttgccagataattgtacgagtacgacaattgtgtcgctctatagacatgtaatgctgcttggtattctgaattttgatggtatttttaactgttagaactcatcagcagttgaatttccagcactcttgccaaaagtgaaaatatttgatacagaactaggcatttaaggtgctcctcctggcgcactttgacatatgtctggtaaatatgatcacagcacggtgtaggaaactaaaaggacgccaattgtacactacgcgataatactgaaatcttgttatattctatttccttgtaaaaatgtaaaacaatggctgttcactcgaaattgtattcaggaggactgaagtgtta

SEQ ID NO: 66742 - DNA, 908 bp, Oryza sativa
gtcattcttgtcatgggatttgtttgacttttccgtttgctctttcaggaatgcacatggcttcattccttacaaattgcaagtgagcgctggacggatatcgacaagtctgcggtacattattaaggctaagctagctgctaagtattagaggggaggtgagagagagcgagagagagagagattggtgagtggggagtagttcttgtaggctgagtagtactagttttttcaggggcactgaaaaaagagcttgtagtttctgtcgggaacaccgattactagctgaaacatcatcagttctgttcttcttccattgttgattaaaatttccgtggtttcgatcttccgcgagaacacccagcagcagcggaacagatgagctgatagcttcttcgtcctcttcgctcgtgcatgtcacatctgcatgcctttgttctgctccatgtcagcttcagcgtcgtggtcggcgtcggcgtcggcgtcggcgtcgcaggcgacgtgctgccctgtcaacaagcatgtcgagttcgtcaggttgtcagtcacgcaggcaatcgaggcacgcaggccttgccggtcattgccggagcccggagacaccgacctgcctcgtacggtcgtactgtacactcgtactcgtgaccaggttgccggctcggcagacgacgctctctttctctctcagccaaggagtggtaggatatgctgctgccgctgactcttccggcatcgaaaccggacggggagccggaggacttgggagttggcagcgacgcacgccgctgccacggtaacatgcggtcatacggtgtggcgtcgctgcctcagtgctgcaggggcagcagctggacagatgtgaaagtggcatttgggagttggggaaatagcagcagagttggctggag

SEQ ID NO: 66743 - DNA, 2081 bp, Oryza sativa
cgcacccacgcatggcacattgtcacaatgtcacgtttaggcacagtcggagaagagtggacacacacacacaatagctagtgatgagagatataggcggtgagggtctctttataaacagagagctgtgagtacagcaagtttaggacctgtttagatcccgccaaaagttttacaccatatcagtagcggagccataaattactaaagagtagggcttaagtagtgagttatttatctttttctaaatttacatggtgatttaacataatttagccatgattttgaaggcaggcctagggtctaagccctagctgccctaggtctacctccacccctgcaccatatcacatcgaacgtttgatcacatgcatgaaatattaaatatagtctaaaaaataactaattgtacatattgcgactaatttgcgagagaaatcttttaagccaaattgcttcataatttgacaatgtggtgctacagtaaatatttgctaatgactgattaattaggcttaataaattcgtcttgcagtttactgataaattctgtaattagttttttttattagtgctcgaacaactcacgtgacaccctatataatatccaatgtgatacgccaaaactttacacccttggatctaaaccaccccttaatagtatagccagctactagctccaattcatatataaccaatccaatagcttattcatacaatagttcctatcatcatatactacaccattaatatttattcacatatcttagaagtctatgctatagtttcctatagaagtctatgctatagttggctataaatctgtaacctctatctcctcttctctcttcttatccgtatgtgtttagagctgacttgtagggtagtattgtactcgctcgtataggccgcgggctgctggtttccaaggataataaacgcacgacgaccccggcctccttttctttcctgctatatatatacctcctcaccccacaggccacacccgtccaccccccgtaacattaactcctttgttcagcttgacactccattgcagagggagggtatagctggtgacagagagaaatgggcgaggaggccaattgcaacgtcgcgatggagtccgctgcgcccaaggagaacggccacaccaccggtggcgccgcggcggaggccaaggccgccgccgcctgggctgagatcgccgtcaccgacgccgcggcggtgccaaagccgacgccgccgcctgcggccgtggccgtcgacccccggcttcagggcatctccgacgccatccgcgtcgtcccccacttccccaagcaaggtccgtctctcccctctcggttcgccagtttgccatatgtgcaaatacctagtggtatctgaatatctgcgcgcgcggcgtgcatgcaggcatcatgttcaacgacatcacgccgctgctgctgcgcccgggggtgttcaaggacgccgtcgacatcttcgtcgagcgctaccgcggcatggccatcgccgccgtcgccggtaaacactttttgatcagtactactctttattgtcatttgattattgtttctgtcgcgcggagccggagaggtgggcagtcaggggcggagaggcggtgttctgagattccgtaatatctttgcgcgagatctcccctggtcctctcctggtccttttgctcccccatgccttgtcgtcgcccgcacgcacatcgcctcccgctgcacttttccgcgtaactaccacccccggcgccgttgctttcctcgggagaataatactagtagtagacgctagtattatcataaccacttcggtgatcctctcacagcgacaggacacacacggcctcacggcacagtgctctggccggccggagccggcaggtaccggctgtgttatttccttgaagttctcaacctctatctcgtttttccgtacgcacgcttatatttttttataaaaagttagtttctatatgaaaattgtttaaaaaaatcaaattaatttatttaaaaaattttagctaatacttaattgatcatgtaacaatatatgcttcgttttgcgtg

SEQ ID NO: 66744 - DNA, 3069 bp, Oryza sativa
tggggggaacccaaggcccggaccatcggacggccccagcatcgcctgcgtgtgatcggacggtggggagggtgggggattcgtggtaggcctaaaattgattttttttattttatttttaccccactggaggggggtggctcactgatgtcatgcatgtgcccgatctgctgtcgttttcactggaaagtactgcttctgagattttgctttgttgtttgttggatactctgtctggctccctgcgattccttgttcctggtttgttttccttctgtttctcctcctccccccctgttttcgcttattattttaacatatatctcattccttgttcttgacttttaatactactatcagcttggcaggttgctagttaatgtttcattcctggttgtgactttggtttgtttgaccagggattgaggctagggggttcatatttggcccggcgatcgcgctggcaattggcgccaaattcataccgttgcgtaagcccaagaaactcccaggtgagtgaggctcgctctctctctgaaaaagtgttgtgcaaatctgtttgctggtgatataagatatgattagctcgcgctggcagcctagttaagtatgcttagttaccttacctgtttataaaagagctgctctgttccattactctgacaacaaagctgtgtcactagtccatccctttttatgctgcccatgatgtaatctgaagagatatgatgtactttctgtctttgcactttccatcacatgttctattagagtatcagatagacacatactgtcgagggtctcttttacacattttgtattggagtatcggataaacacatactgttgttgttttttacatacgctgttgtgttgtgcaccacctttcttgtaaagtatgattgtgtttgccttgcttatcaaatcattttttgcagtaaccgccatccctgacatctgcttttaatttttttctacaaacgtgaaaggcgagtgatttctgagacgtatgttctcgagtacgggaccgattgcttgcagatgcatgttggcgccattgaacctggtgagcgtgtgctgatcgttgatgatctggttgcaactggtgggacactttgtgctgctataaggcttcttggtacgcactacttcttaatctgaaatgcattttaaatgaaacccttgatccattgtgatactatatgcaactagtagtatctcaatagagcttggcaaaaatgctgacaacaatcttgcaatgactatttatttttctatgtggcttctgtgaaatgcagaggtcttttccccgttcgcacattcacaacacgctattcttctggcctgtaacagtgaagctctcgattgtgccttgtgatcccgtgacatgtttgcagcaagcactagtgcttggcagtttgccacaatatcaaattatccagtaccgtgtcttgaaactgtgcccacactccgaacatagtttcttcacactattaatccaaatctatagtactgcaggaatagtgtctgaaataaatcgagtagtcatgaaaagtaataaccaacgacaggcatccgtacctgctagtggtgaccggtggaggaccatgatatcttcgttgcttataggcatactgttgtccttaatgcgatgtgactctataatcaagacaatccttgtttgaagatttttgtttggagagaatcttggctgaagatatgtcctatggagtttgcttgaggacatgatttgattttgacactacatgtttcgagtactcctgtcgtagtgaatccagtaaccccacctcattttctttttcagagagataaccccaccgaattactccaggccagtatgatttgtcaaaacacaacacaggctacatcacaaaaattggtagcggcaattttctctttgttactaacaaacaaagcacaatgataccatactaaaagtttggtagtgtcaaattttcactcttgctggcctagccttggcagttggcactactaaaattttgtagggtcttttcaactgtatatatcgtgtttttttcatgttttaggccatcagcaattgcatttgacatgcttcctttcttttttgtatctaaccaacctgtgcttcaactattaaagaaaaagttgttcttttttttagctttagactgttcgggcacttcactggatgaattataatatctttgtcccaagaacgaataactggattttggcacgactatcttacctagaaatttgctttccagaacgcgctggagctgacgttgttgagtgcgcgtgtctcattgggctcccaaaatttaaggtattcttattgtcacattattcacggttatccatatattctttgacaaacatttccgacatctctctacttagttgtcactttatgtagtattttacatactgctctggagcatggatccacattccaaagatatgaacgcagttccatccaacagttttgcacctgtagtacagtattaactttctcagatgctttctactctacctgacgtagcctgttagtgccatatagattggactcttgagccaatggtttgggtttagatagcggccaggaacaactttgccatactaaatagcaccatgtctattctgctccccacattgagatactcatatcagtaccagctgggcatccatagatttgaacaagaccactcgagaattggtgggtaattgttttttcttccaaagcaggactatagtccttttttaaaaaaaaataaataaataaaagaagccctgtttgtgctatcctaagaacatattcaactgtggctcttctgctgcatttgaagcttactatttgcatcctgcccctcatctgaaagtttgctagggatgaaaaatattcaggtaggagtaaaaccacagcactgtctacactagtttcatctggtcatagtgattattttgtttgagttgacataccttgattcatgttacaacttgcaaaatgagtgctacactgccggcatcttaccgaagtcaggatagatatcatgctggttcagaact

SEQ ID NO: 66745 - DNA, 1890 bp, Oryza sativa
cgcgggttaagagtggtgtttgggtgaatctcattttaagagcccttttgaattgcaggaatggaaaaacggaggaataggaaaaacgtatgattgataggcagtataaaacagaggattggaaaatacaggaaaaacacaagaatgaccgtttgattggaccataggaaaaacacaggaatcggatgagagagatagactcaaaggaatttttccaaaaggttggatctcttgctaactttcctccaaaatctctataggattagtcattccataagaattttaaaggatagtatatgattcaatcctttatttcaaagtctttcataggaatttttttttcataggattggaatcctttaaattttctacacttttactacaaatcaaaggggcccttaagggtggcattatagcgaagccagtttttatgagtgacatatatgcaaatttctcctcaaacgcatgcttagaataatttctactctgtattgttttatttcccattatgttccacatgtcattgatatttcaatccaatattacatttttttccccgcgttctagaagactaaacagtgtggcgtaccagaactttgacaattaacacaaacaaatatcgcaaaaggtcgtgaaccaaatacacccaaaacttgtgctctgctaatgtcactcacttgtcaacaaaccggcgtgcagtaatgcgccatcgatcgagctgtcctagcaaatcgggagcaaatccgggggggtgcagatttgctgaagcacgcacatcacgttccagatccggcagagctcgacactgcctgcccccagcgtgcatcattcttccgtgattgtatcaaaacatcagtggccacctcacttgccaccacaaaaacccatccttcttccaaccaaacctaggagcaagctaaagagatatctgaggtttcagccatgtgaaaaaaagaggaaaaaaaagaaggatcgttatcgccttcataccaagatccttgaaatgcaactctgctgctgagattggccttttgatttgattacggttgttgataggggagctaggaaaaggagatcagctgtgtggtgtgtctgattacgattagacggcaggtgatagtagtagaacagtggtgccacaaacccacaaggcgtggattcacggttgaaacgtggtgtggtgcgtatcgttgcactgctccgtgggatcacaatctcgacccgacaagtacgggcactaccttcttgccaatggatgaagtagattagcaagtcacatcaaagatttagcaacaccatggcctagattacctcggcgggttttattgatgaaagcaatagagatactcttgtcccactgattgatttacgtgaggattccaatagttttgccagtttgatcagattttctgtcccctcgaaatttgattacttcaaatttgaattttcaaatattttttaaaatatcttcttagagagagttgttaatacccaaatttagctcctagagtaagaaataggaagtcataatcaaatttagaaataactcagacttgccacacgaggctagtgtgacaatagccattgggccggtcagacgacggcaagggcggtctgaccggcggcatgtggtcggtcagaccggcaaggccgactctgagtgaggtttgtaagttcttagattttcttgctaaggcttgggattttaaaatcctaattggtttctacctaattgaacgtggaaaaaactctgggaaataagtctacccctcttataaatataaaggagctaagaccgattgaaacaacaacaaatcaatcatcaaaatcaatttatttacccaaacctctatattctacatctccctccttcctactacctatgaccta

SEQ ID NO: 66746 - DNA, 2848 bp, Oryza sativa
tcaagttagtacgtaagttaattttttaaagagatttcttatacgaccgttcatgtatttccaaaagtgaacgaacttaaaaaccgactcaaatacagatctgtatttctaaaaacaaacgaacttaaaaactgactcatacacggatgacgtacctaagtaccaacaaaaacatcttcaatctttataatagttttactgtgagaatttgcttggatatatatttttctagaaaatcatgagctgcaattagaaatccgatcatctcaagttagcatgcaagttttttttaaaaagatctcttatatgactcctcctgtatttccaaaagtgaacaaatttaaaacccgactcaaatacaaatatatatttccaaaagcgaacgaacttaaaaaccgactcatacatggatgacgtaccaaagtaccggcaaaaacatcttcaatttttataatagtagagatatagaaatatcaataaatatatgattttattgaaataatttttaagattatttatacataaggtcttcatgtttgtaacacaaatattttagaagttattcgttgttaagtttttaaagttcaacatcagttttatccgcaacaataattaattttaacctagagaaaatattattttttattatgtagctactaatactactagtaaaaatctgaattgtttaagaagctaaggaatttaagatgtagctagacttgtactctctccgtgtaataaaaaaatctaatccaaattggaatatggacatagagtttgaatcgattcaaatttggattgggttttatatgggaccgagtactccctccgtcccataatataagggattttgagtttttacttgcactgtttgaccactcgtcttattcaaaaaatttgtgtaaatataaaaaatgaaaagttatgcttaaaatacttttgataataaagcaagtcataaaaaaataataatttcaattttttttaataagacgagtgataaaaaagtgcaaataaaaactcaaaattatttatattatgggacggagggagtagctaacagaagcttcacacaaacatgacctataattctctccaagtttcacgcgaaaaagatgatcagcaacagctgggcaattatacacgcaagacaaatcgcttctgttcttccacctggggtgctgatccgctgctacagcgttgctactggcaatatggaagccgacggcgacacctcgtttttggccgcgctggacttgctggtacagctaatgatgctggcttttgacgggagggcgagacagcgccgagagagaggcagaagcagggataacaataagcaagatcttagcgccttccgtatcagaatcgctggaaatgactcctcgtcaagattggccatggaacgatgttacattaattgacagcaacattacagattcagagtatagtacccgctacaatcaatgcaatgaactggtaaaaaaagacagaaaaaaaaaaggtgacgaaccgaatggggcagcagcaccaactttagcggaagaagatttgggaggattttcatcgggtgaggatcgatcttttgacgatgatgatggcagtgactgattcctgatggtgaaaacgttgtccgtttaccattttgtggttatttgcgggtacggaacgaaatgcgggtacgtggaagagacggaattaatcatggaaatgatttcaccatgaaaatggcacaaggcagtgatcacatttgtgtcttatgcctgataacgaccggggcctcctttggatttggatgaacttctgtaaaaatcctgtaaaattcttataaaaatttggtgaatccgattagtaaaccgaggaaagaatgagactggtaaaaggaagagttgattggttctggagaaaaaggttcggtacgtatatactgttgactgttgagcaattactgaaagaaaaggaccaaatgaaaagtccctccttttacgttgaaaggctggccaggctaggtttgtagattcttgagcaccttccatgtccagaggagctttactggaattattctactgattgatactggatgaatgggaaatgtttaggccatgattcatcacaaattgctatgcttgctagaatctaaattgtgggccgtgggagtcatgataacaaacacaaggaaaaattaggcatatgattgtaaagctgccaatttgaagcagggaacttttttttttccttttgacgctaactatctcattttgtcatattcatctctcttttccattgggggtggtacaaatggcggacaaaagtgaaattattttaggcctactggcaaaacggagaatgatatcgctagtgacaaatcaaagttgtcccgttgaaatatgccaccgcataattccaggttaaaaaggcctccacattgctacgttgacatgacctataagatgtaactttggatattctattctaattaataccctcttccgtcacaaatatatggcaaattttattatatgacattgtgacttcctgatttcaactactggacacggtaaacggaattgctagattaccgttgacagttttgggggaaaaattttaatttttagaccattagatttgctttaagattcgtgctagaaagtatgagaaaaaataaataggcaagtaaactttcaatttttagatcattggatttgctctaagattcgtgctagcaagtacgagaaaaataaataaattggcaagtgcagctgctgtgatttaacctcacgcccttgagtttgttgaagatatatgctaccaccacgccaacaaaatttgtaatagttttattccagat

SEQ ID NO: 66747 - DNA, 3665 bp, Oryza sativa
gcatcggcaccaagctcgagcttgccacccaagcgatatagcagcttcgacttcaatgaaacaataccttaatgccaaaatgaacaaatagatccgacatccacgaaggatattagcccaagctaccaaagaaccacttcttacacacagctagcaacaacaaccatataaagagattgtaatgtgttgtcgttgccaagttttgtcacattcctacagtgaagcggcttctactctactcaacagtaaccaaatgacaatgatggtcacccgccgtaaagcaagaaacgaaaccaacgcggcgaaggcctcgtcaaacaccctaggcctgtagagcttcggttccattgcatgagtccaccaatgaccacaattgcatgcgaaaggtttttggtgctaggaggggtcagcgccagaacaatgcctccaaggaggggaatgacgcctaatggcggtggcggcgtcatgccgtcccatggcctggcaaggcttcgctagcgattaccaatcaagaccccacacaaccatcctgcacaacggccattgttggactaccgcgccatcccttcagcgctcaagcccagtccaccaacccgcaactcaagctggctcgcagggctaccggatcagccaccgccatcccatgttgcacgagccagcgtctccccattttctcgaagctccctatgactaaaactaaagcagtcgagcatagaaggggaggagccctttagagaggaggactcttgcctggcaacagagaagatgaactttccaccacctaaccgcttccctgcttgataccaaaagccgttgaggtcaccactggcaactgacaaccaccgctggcgcttgggtaaccatgtgtgacccacgtcagcttcctcctcgtgcaaaccaccgccagccacgacctcacactgtgctagtcatgttgtcaggcatggccgcgtgtcgctccggctaaagcccctctggctcctcaatgcatgctaccggtcatcggagccctcttctgaacagtaccactggctttccctcttcgccgccccgtccgtggcagccgtacgtccccaaggccacgagctccagcctcttacctccagggggggagggggaaggccccgccgtcgtccttgcagccgcgtggttttctggctgcctgcttgggtggcagtgaggcgaagaagggaggaggtgctgggtggcggtgggggagggagacaccacccatgtcgcccaaccctagagcgacacgagggccccattcctggtcactccgcggtagcaataaagttgcagtggaaactgggcattaggacaataatagaaaattggcgtgccatttgacgcgccttattttagttagcccgtttgtgcaactgaagaaaattaaatattttttaacccctagtagataattataaatccattgtttttgtcaacattgtttagggcatgacagaaatttgagaacatgcaaaggcatgaatcagcttatagagcacacaaccatctgtgtaaattgcaaaagtcagtcattctattttgatttctataatgatttgtgattaaatttcgtttgtcttgtcatttgatttttttattattaattattctagtagcatttttgtaacgacaaatctttttggttgcttcaattatctaccacaccaatatttgataatgccaaagctcatagagcagaacatcgtctatctaatttataaaaaaaaatatttttttctatattgatttgtgatttaatttcttttgtatggtcatttgattttttcttttggtgagaagccttttttttaccataaaaattttctgttggttcaattaaatggtacaattttgagagaaacaaaagtcatgtgatgttttttctttgtgagtagccttttttttaccaataaatattttccgttggttcaattaactaccatattgtaatgctacaattttgagagaaacaaaagtcatgtgatgttttgtttgatgccaaacttttacagtgggatttgtgactgataatgtagcacagttgggaggccacttgaatctatataaggtgcttaaatcttcttttgctttattttttttagaaatggatccttggtttgatatccatctatatatttttcattttaaaatggtacttttcaatgtattgatacaacaaatctactactatatgttataaaatagagtatagatctttaacttagaacttgtatttctttgaaatgttgtagacccaaccatctgtttcagatatcagattaggccatcacctccctagtcaacgtgtatgacacggcccagctgccacgttggccggtgggaaccaaacctgtgaatccagattaaccagtcgagaatgggcctggcattatcaactcacaagagctttctagagattctggtaagtagatatcttatcgacacgtggcaaaattttggagttgttcagctaagttatcaggctgccacgtggcccaataacatgctagaattctgaccctaaaatcggtataaagatgagggtggcgatggcggatggcttggatggggagaaagcactagctctcattgttgcctcctactagggctcgagaaggcagagagttctgcgccacctctaccatgaccaggccacatgtcctcaatgccgtcaagtggcatcaccacttgccgaagaggcgataggaaggaagacgtgagaactgtggagccatgggcatttctaacatttaacattatctctcttctattcaatcaaaaatgaatattcaaatagatatacgttgtgagagcgttttccccaaagattgacttttgccatatctagaagttagaactataaattcaaaatgtcctaaacatttttttggaaatatatttgatgtttcgcataaaattaatttgtgcaaacttttgaaagttctaaaatatttagtttaaaaaacatgcatgtatatttgttttgaaaataatcttcacagtctcttagacttagattatataaacttattgtaagatgacttcacatatattattcacaggagagtatatcattactaaaatctagtaaagccacatttttttatgacaataatgttctacaaaaatatacattcattaattttatgtaactccctaattatcaaatatattactttgaaaatgtgtatagtgaaatcttgagggctcttttgaaacatatggttagaaaaaatggaggaatagaaggaacatataattttgacaggaatataagttaaatcagagaattataaaacacaaggaaaacataggatgcttgttgattacgtcacaggaaaatgtaggaatctaatgagagagattgaatcaaagaaaatcttttaagatattagagctcttactaactttctcttttctctaaaatctctataggattgttcattcgataggaatctgaaagaaaatgatagtatgtaattatttgtatcaaagttattcataattttttataggattttaatcctccaaattttatttattttttatacaaatcaaataggccctgatcaaagttactactccttagagcatcttcaacagtctctctaaatttgactctccaaatgtctatttaaccaactctccatttcatt

SEQ ID NO: 66748 - DNA, 2835 bp, Oryza sativa
tggagttgctcttaataaacatgtatgtacgtagaaatgtcgttgacattttgattagaaaattcaacgatcaaaaatgtgtattggatgttactgtactaaacaataattaaaaaaaacaatattgcgagtatctaaacactattgcgcccagcttttaaaagttggactagctaggtacatggacaccccacagtatcaacttcttttcggaaaaacggcaaagtactgcaataggcaaatcaatgctgtggcaaacaaacaatctagccttgcacgtacacggtaggtcactaatatatttgctgaagcagcagctagctatacgacgtcctttacctcctccaaagcacaggccatgttccctcccaagttcatactactactagtaccagtgtaccacaaatcacaccagaccaatagtatagggttacggttatatacttccttcgtcccaaaaaaaacgaatctagaactggatatgacatattctagtagaggtatgtctagattcgtaatactaggatgtgtcacatctagtactagtttggttttttagggatggagggagtacgtacgtagcgctccagattcgcctatcgagctccgtcctctgaaccatatctccatgactccatccacccatatgcatcgtggcgttgcgccaccgccccacctcgcacgtcgtcgcgtagctcgaatccactcaaaaacgctcgaaacatacgtacgtcggcctcttcccgtggccggtcgttgtacccatcgagagagaaaggaattagtactaatcaacaccgcacgccaccactgcgaaagatatgatgcggcggatcaggacggcttcggtcattgaacaatgagagctagagagtagagacccctagctatagtataggtagctaactattcttagtagcagctttgccacttttggaacctagggaaggaaaaaggggtcgccgtgacgatcttccctgggatatcgtgatcatagcggcatcatcatcgccgtgaaaacgaacgagctgttgacgacggcgtccccccgtctcacgtccttccttcccactcgatggcgctacggaaaagccccggttgtggtggggatccccacgcctcagcgtcatagggtctgtttgagcttgatagttgtagctttctcttaaaattttcagctgccataagctcttcaaataattcagatttttatttagattttaagaaattgtagttgtagatactagaaaatgaattagaaattaaaaactgagtttctcagtttctctatattctcaccagttaattttttatcggctgtttctcagaattttaagctatctaagtaggatcctaatatgtttagctcggctttcaatcgatcgggctatggctagaaacgggacgggatgggatcccctgatccgcgctgccagtctaaaggcgcactcatgtcgtccatcgttcccatcattgcgagctccggtgaaaaaaaatatattttgatctaggactagcagtacgtatgtactactctacgtaccacgatgacgcgacggggaacggagtggaccatgcatgaaaaaaatcgatttcgcgcgcggccatgtggtttactacatgtcatcatgttggatctggccctatatatatatatcttggtagttccatcgagcagttgcaatatatgatacaagttgcaagtccatacagtattcgggaaagatataatactggtatgccaggttattaatttaatccttggcaaatatacgaaccggggaaaagttctgttttagattatcacaagctaaaagctaagctatagattcaccggaacaccaccatggagggagggatactaattgcttctgtggaccagcatctaacaaatcatcatggagcagatcgggaggactacggagatattctctcgatcgttggcttagcacttagtagcagttccaaaagctcgatgatgacgatcgcaaagatatgcatgatagtataaatcaaactccccggagaggctctcatgtagtagcggctctgctgctttagagcaagtttaatatagtcaattattagcttcaagccttcaaataatttatagttaatttaatagtcaattcatataatagttacctataaatatatattacactattaatacataacccccaaatatcatacacacattatgtcttaaagtctatgctacagctcgctggctataaatctgcagctcgctgctcttctgtctcatttatcttctagatatgtgtttatagttgacttatagtctgttgttacacctgctcttagctaccagctttcgtctttcattatattttctctgtacgtacgtcttccaaacaacattgtctcgtctcttatctatcccagactgaccccaccggacgatgaaacagttggatcttgagtagcagcaatcaagtgatcacgtcaatctatcgagatcccacgcagtggctcataatctcacatggcggcctgcctcgcactttttccttatccatgctaagccccctgctcctcgcagaaaagccggcagcacggttgcttttgccctctttaaccatcacactcttcttccattcaccacctcggttgtttgtttggtcgcgtgcatgagacctggctcgcgaagcgtacgcaaccatatccaatccaacgagagactcgtcgccggccaacagccggcgtccatgcctccaccgtgcaaacgcataagttgcacagtgtttaaatacacaatttgtttgtggtatactcgtgcaattattgtaagtacgtgaccccgacgacgcaatc

SEQ ID NO: 66749 - DNA, 2049 bp, Oryza sativa
tcatctcctgtttgccgctgcacagcatgatttggatgtgtatgtggttacacgtttggccggataagcccatatgcatgcagatgcatacatgatttcctaaccacgcgcgataggaaatattccacctggtttaccacgattcctcattcaatcctccgagcgaagtcacaataagcaatgtcacgcgtttcacttgttacaccaggatttctgaggagattcaccaaggatgttgacacttgaaacaacacgatcgatagtttcttacccccccccccttcattcacaaatatttcataaggtcatttgatgttttagaataaggttcggtcagactcttgagaagttgaacgtataatttctcaaaagcttatttttaaaattatatggtgcatatgagttatgatagtacttaaaaaacacatccacaagtgtgttaagcaatatatactatcttcattttttaatatatgatgtcgatgacttttaggcatgtgtttaatcatttgacttattcaaaatttctgtatagatttaaaaaatataagtcatgcttaaataacttttaatgataaagcaagtcacaataaaataaatgataattacattttttttaaaaaataagaggaatgatcaaacatatctttaaaaagtcaatggcaaaattattgctagatttctaatcaccttcagcctagcaccttggaattacagagggatgatgtgcgacggcgatttctagcagtggcggcatcatcaacaggctcatcttctctgacgatgttgaagtcctcttcttctttgacagtgtagtgcgtggcaacgaagttaaaatttagggtttcggaataaatgttgaagtgggatggcttacccggggagggggaagaaaagggttttcccgggcctagagagatgaccatgagcgacggcggtatgcaatggtgtagtcggggtgccaccagagctgcaaggatgaaggttggtggttggcggggatgtgagctagggaaaggggaggtgcaagggaagctataggttaggagacggtggtggcagtggtgtttctgtggtgcgagtcaccggagttagaagatgacacgacaaggaaatggcgtcaccgcttggcttggggaggaggagatggggagggagagaaggacagtcaaccaaatgaggctcaccgcacaaaggtggggaggagagcaatatcgcagatctcaatctgtctaacttactctcagggagaaggataacatgataagtaaggaagatactactgtccacgtacaaaagtcgatagaaccataactgtccaaaaaattgattgaaatctagggtattttcaggtgaccaaaatttacaagtcctatatctcaaatgcttgttttgaagttatacggtactcggtgcttatgatactacttccatttcaagttataagacgttttgactttggtcaaagtcaagctgcttcaagtttgtagaaaaaataacaatattttcagcccaagataaatttattatgaaaatatattcaagtattgatttaatgaaactaatttgatattataaatattactatatttatctataaacttagttaaacttgaattagtttgactttaaccaaagtcaaaacgttttataacctgaaacggagggagtagtacttataagaaaaaaatgcgtatgcgttgagaatgcacattcaatttagtactccctccgtcccacaatataagggattttcagtttttgcttgcaacgcttgaccactcgtcttattcaattttttttgcaaatataaaaaatgaaaagttgtgcttaaagtactatagataataaagtaagtcacaaataaaataaataataatttcaaaaaaatttgaataaaacgagtggtcaaacgttgcaagaaaaactcaaaatcccttatattaatggacggaggaagtacgttgtatgcgtgtggtgtaccgtgtattgcgcgcgcatgcctgccttatttgctgaatgatggagtatttaaagcatgcatacgcc

SEQ ID NO: 66750 - DNA, 716 bp, Oryza sativa
tcgagtgtttgcttggattagcagatctgcttagtaaggtaaggcgtcatttgccgatacgaattaggcattgttatatgatgtacttccggttttggttgatgcgtttttgctttgagcgtcattgaaccgagcaaatcctgatagtagctgtcacctccaaattagtacgccatcatggtgtgtgatacacctccacctttgggtagtgcgctttatggagagcagtaatgcgttccgttttaagcatgggcaaacggagcaaaacattgtatcctcataggtagaggttgttactaaatctaaccgctttaagcggttaaatgaacggtattgagaccagacaggttggtgcatggtaatatcattggtggagaaaccatctttcctcccggttcgtaacccccatttaattccagttatttaaccggggctacaaatccgggactaaagatcgctatctttagtcccgggtgaaataaccgggactaaagatcgatctttagttccggttgttaacaccaaccgggactaaagataggggattaaagaggagataacagcagtctaaatgccccatccttttttttttctttttaattttctcccaaatcaagtaaaatgcgtatcccaaattaaaccccaaataccaaatcaaggtaatatcccaaatctacatcacaaatctttaaagttacttatacacacaaatcaaa

SEQ ID NO: 66751 - DNA, 2645 bp, Oryza sativa
catccatattgcctccacatgggaattaggaaggggtatttacctatgcttacgggaatgagaatagaagtgactattggctattgcaatttattgagagggatactgtgatatggtttcaagttaaatattttaaggtttgacgaacaaggagcttgcttcctcattgatatactcatggacaactaactattgtctacaaaccttcatttcattacctgtgtaatatatattcttactttcctactcacatttgtttttcttgttatagactcttgaattgccatcaaaatacccgaatatctttaccaaggcacctgtaaggttgcgatcaaacattctcctctatggaccatctggatgtggaaaaacacatattgtgggagctgcagctgccgcttgttctctgcgattcatatcagtcaaaggtccagagctattgaataagtacatcggttcttctgagcaatctgtaaggactcttttattttttatcgctgtgatgtaccattctttgtcttatgcctttttctagtttcagagacatttgaagggctagtaactgtgacatttcctgcaccttgtattactcagacctgtcttaatatcttatcttatctgtgtagctgtagttatagaggacatagaagaccattgagattaatatggttctgatattcttcttttacatggtcatggttctgattttaataatctgattccaggttcgtgacttctttgcaaaggcagctgctgcagcaccttgcctactgttctttgatgagtttgaatccattgcaccccagcgaggaacacagagtgcaggagtttctgatcgtgttgttaatcaagtaagttgcctttaccattactgaatataagttttggatcggtctatagttccaaaagagcattattttttcttgttataatcaagatcatatttatatatggtttgtctgcagttcttgacagaactagatggtgtagaaagcttgactggagtatttgtatttgctgcaacaaggttagctctcaaagcataagaagatgtagttggtgcagcatgccaatcaattttaaatggactgcaatgaccagtcgcaaaacatcaagaattagtcagcatggaatgaaatgctatgaagactgaaattttactgatgagaataagattggaactaaaatagcttgattgttttcctttaatttttaatggtttcatctttttccttatgtgcagtaagccacaatcaattgatgctgcactcttgcggcccggaagatttgaccgtttgatcttatgtgattttcctggatggcatgagcgtttggaaattctgaaagttcactctagagaggtgagttctcatttgccattttgtcttttgttgatatttttaatcacgggttttgccatctgtgaactccttaaattattgatatcttaacattctcattgttattgatgatgcattttcatttttaatatcttctgttggtcacaggtttcactggcaagtgatgccagtctggaagaggttgcttctttgactgaaggatttacaggtgcagatcttgcagctattctaagagatgctaagctggcagcagtgcataaagttctggaggacagaaataatggtatctcagacacacagccatgtatcagcaaagaactcctaatatctactgctagggaggctagaccttcgacatcagcagaacaaaaaatgcagtatgacatggacttcggtcaatttgtatcgtctaggaagtctgtttcaacgaaggtgcggttcatgctccattttttggcatataaacaatgcgtttttcaactgaaaattccaataccgcatcttattgatgctcccttctgtcggtgtttgatgtttcttgcaataagattcttggacagctactgaaatatttctttgcaggcaagggaatctaaaggaaaaaaggtcacgctggcttgagtctctctgcattggacaagtaaggccacctcttcgatctgttgtcttcatggttcttaggaatccatgagatatgaatttgttgagcatttcaatgaaccttgatgtttccccctctttgaatccaggtacaattacgttatgttcattggcgcagaacaagaatggcgagcgccttttttctgctcggcaaatctcagttttgacttaccaactccacccctcttctttgagaaagggaaagaaactcattttgtagattgtagtgcaggcagcgaggggctgtgatgatgtatagcattgtgccaaattttgatacgaatggcttcttcttgtgcagtacgaaatagaaatgctgacagaacgcgtgtagcgtttgaatgaacattgggggaacgtactgacgtatctaatgctaattgtgtcgatatactttatctgtttcacattataagaaggttttggttttgaatagattcatgcatgaatccatatatgtgcttcatatatatgttgaaattcatataaatgttaataaatcttgacgagggacagagaaacaaaaacgtcttataagataaaattcatataaatgttaatgaatcttgacgagggacagagaaacaaaaacgtcttataagataaaatggaaggagtaaatct

SEQ ID NO: 66752 - DNA, 2918 bp, Oryza sativa
acacaatttgtaatctgaatttgaatcgagagggacatacattgcccttttcttttcccccaccaaaaaaccaggatagcgctaccaatggcagcgatcagaattcccgtctgttctgaccgcccgatctagcacgtgcggttgagatcgaggctaagtacggtttaacgggtacatttccacccagcccctccatttacctcatattatcgaaatcccacaagcactcagaggtggggtggggccacatcgtcagtgaaacggacgggtatagggttagggagttgggggatcgggaggaagagagtagggagacgagaggaggaagaagaggcgggcagcgaggagggaggagatcggcggcgagcggcgagaggggaggagaaggtaggttgcgatggcgtccgggtggggcatcaacgggaacaaggggcggtgctacgacttctggctggacttcagcgagtgtatgagccgctgccgccagcccaccgactgcggcctcctccgggaggactacctcgagtgcctccaccactccaaggaggtaatcctcctctctcctctctcctcactcctcaatccatctcccacccgcccttctcggtttatttttgatggatatgcccgcctcgccaaccacctagatctaccatttacagttttcttgaaggggtggatatggattgttcttgggattaacatcacccgctaattgggggcactgcatttgattggagtagtaatcgtatttcgaatccattctagtatgatatgattgttggaggttgggattccatatgctttcatttccattctgttgtactccctctggtttcattttaattgacgttttggacaatgacacggtctacaagatatatctttgatcttatttttctattataatatatataataaataaatgcatgtttacttttattatagtgctttaaaagacaaatctatatatgttgttctagttcctttaaactaaatatttttaaagttattgatggtcaaagttataaaagtttgacatcaatcttgttcaaaacgtcaattaatatagaaccggagggagtagacaaggttgttaatagtattattggtctctccttgtctcttaggatagcccaatttcccatttccaagtgatctctgaatatttcggagtgtctgttgttgcttggataactagttcagaaaatccctggttggttccagaatgtgactagaatagaattattcattagcataaaggcacacaagtcgtaatactatttaacaagttcttattacttcttggcatgcatgatatcatcatattctgaattgtttcttgtgttttaaagggatatatgcttgccctgattccttacagcaaaataaaatttatggattcatgctagtgcatagcttccagtcagtgggagaaatgaatcaggatgcaacagtactctgaattatattgttctagatttccatttcattctattagcgattctaacaaccaagatgacctgatgcggaaatgtatgattctctccaatgcagttccagcgcaggaacagaatctacaaggaggagcaacgtaagttaagagctgctattcgtcgtagggaggaggcggcaaaggagaaggctgagggagctcctgctgtttcagctcagcattagccactccgataaaattcatgtgtgctttttgtttgctgtcaaaactttgttctactgtgatgctaagagcaaggcaataattccccaccttcatgttggactacacaaactcttttcccctctcactccatgactttgatctgtatcaaggcgttgcataaaccatcatggtgatgaagttttcgtgcctgttttggataattttgcgataatgatggttggttcgatcatcatattttgcacgtttattgctatcgctcttgatgttcttataggattgacagcgcaacattggttttgtcgattgtacttggaatggtcttctgactgttgctttgcatgctcgttctattataattcttgatggccacttttccattccatgcttgggttctgaacttgaactcgcgatcacataaccatggggatgatcttgtttttcagcatatttcgctgcaaatgcaaacagcatgtggtgacggcaataaattgatttcaaattttgctgtgcaatcatcccctgttgcatttattgttttttcccgtttgattcagtagtcttgtgtgttgactcgtttctactcatacatattagcaaaacagggataaacaagtccctaaattatcttccattgtttcctaggtctcaaaatcgtcttgcaagtgttaattttaacctcaagatatcgctctataagtcaattgatctcacaaaacaaggctacaacatttgtgcaaataaaatataattaaaataccgaaacaaaagaacgaacaacatagctggatagcccccgtcatatcacattttatttcaaccaagcaggatacacattgtttctttattcccaacgtaactaaaccaattttaatgaaaataaaagaaagaaagaaatgtcccttatcccttttacatcctgcattatactgttaactgtatgaatctatctccttctatatacagctcgaaggactgattttcagtcccagtagctactaaccagttgctaactcctctagtgaagaacgcctaatgcccagttagagactattacagaggtattccaagaaacaacaacaaagaaaaaaaaagtgagcttggcgtacttcatggcaaaatggttaaaagcatgtatcatttgatttgctttccgcgcatatagcttgatattagtgcagctgtgcaggacttggaggcgccaacttgtgaaaaaaaagtattggcagctgccaagtgc

SEQ ID NO: 66753 - DNA, 1828 bp, Oryza sativa
caacttcctaaagattgtgtgatcaaatcaaacaaaaaaaatactatgatgactcgacatacagcaacaaaatgattaaaggtatacataaagatctatacttagttaccttcattgcttctgtgtactttttattcatggcatgccattgagattcaagatcaccaccttgagattcaatggggcatgtccatctcaaataaaattggggccaaagggtaggagcaagtgctgcagcaggtggcactaggggaccattatgctttaatggatcatagaatggattacgatgcttatggaagctgccaccagaagctcggagatcagccaagtacgtccacatgcaatggcaagagcttacagcaccagattgctccctttctcgctcacttgcattttaaattgaagtcagatatgcacgatattttccaaacaagatagatcaagaactataaaagaaaggagtcaaacattgcttattaccaagagacaggtgcatacatgaacaacaaactataattttctggacaagcccgttttgggaagacacagtcaaaagagtttcggaccacatctagtggactacacagcctaagaatggtgtaacaactaacattattactggcaaactattaactatattgttcacatgtagccagctaatacttcaaaataatgtgagaaccagacacattagaagacagtacaaacttacaacagataaatcatgacagatgatgaatagaaacatttcactgctctttcttttcccccctaattgactagatggcaatatagcataaagccttccattcgtgagtcatgacatcatggaaaaccgtagaatcttacaatggtaatatgaaaaaacgaaaatcatgtaccctcaaagagagactcagtctcaaacagacccctgcaactaatgtttcaatttacctaagcatgtcactctagtcagaaaagaacttccattattttggacagatgaaaacatgagcatgtccgcatgtctttatttgattgcttcctctactcgttcacttatattcactcaatcacaaaatatacatatgaaagtagctgcaatgagatatctagattaaatacctattgcacaagaagttcccaaagcggcatgacaacacacaatccataaagtcaacaaggaatttctgcagtgaaaagcagttcaggttataaaaattcatgaagagacctagtttcagcagagtaatgcagctgcaaaagaggagacgacttacagatgagaactcaaatgcagatggatacaaacgtaacaactgagaaatacaatccagccactgaaaaataagatatgagtgttctgaggtgggttaatacaagttttgagtgatacagaaacaattgatatcttaatcacaagatattcactgcgagaattgccaaatggataatggttcgcattgttcataaggaagattattaaaaagccagaatgcagtcacttgaatgtagtagtcactatagcaccgcctgttattaactaataatttcaatataaaaatggaaaccatctgccatgcatgatttgcgagggcgtgcaacttaatcctaaatgctgagcggtcttcagactcttcagtgctcagtttgtacaatacaactccagaagagtattagcttatgcttaccctcacaaaagagtataacatctgccatacaggcaataaggaaaccaattacagaatcagaaaaggttgattgtgtatgagaaaataaaagaagaaaaaacattattcatttagctcactgttggcagttgctgatgcttgtttatgaattg

SEQ ID NO: 66754 - DNA, 9910 bp, Oryza sativa
tctcagcctgcacacgagccaatccgcagcaagttggcagataaataaattctcattagacagaataaattgatccacaaacaacgtgtgaacattcttaatttcagactccagccaattatacatagcatacaacacttgagatgcaatggagaaggacccagacaatatatcaggcaaggcacaaataataattcaaccaaacaaattaaaaatatgaaatatgtttcagttaagatactacaagaatgtaaaacaaagacttaaataatctaaggtcacttacatgagtgagaaaggaaaatcctcaatttcaatctaaacggagggtgtacaaatttacaaaatcaaaatgggtatggcatcataatcttacctcctcgacatgctgggcatcaccaagcatgcagaccttcatcttggggcgggggatatggggcagcttgacggagccgctgaaacgcttgtccttttgcgggtcatagttcttgagaccaatctgaagctcaacggtctcggtgaacttcctgcccttctccttggattccccaacaacctgggagatggcttccttgagaacctcgctctgcaacttactgcaattgatcacgcaagctcagcacgtgaattttgttcaggaaacaaagaacgagcatttcttataccgatcagtaacctatattcagacataatctagctagcgccactgatctctagcgagaagcagaaaactctagatcatgcaaggtgtacagctacgtgatcccagtctatctcgagatccatcgctttaatgagacataaactaaacaaatcgtccgaattccatatcatcttcttacatcttaataagagctttgatctaacaaagcaagcgcgcagaatcacagaaggccatagcgacagaaactaagcaatagaagagattcgttaaccgtaagaagggaagtagagattgggcggcgggaatcacctcatgatgatcggcggcggcggcggcggagggtcagggagcgaaacggcgcgagaggagagaaggcggcgagtgaggatgcgtgctcccgacctagggtttttgtggctgcatgctctgtgccgtttcgaccgtccgatcggatcggacggtggagattgacgccggtgggcttcctttcgtcgtgggccgaaacataaagggcccattccacatatggcggtcgcgcatctcaatctcaaaaaaaaaaaaaaaaggaaaaaaacctccactacgcaaatcgtcgtcgtcttcctccgccgaattccccaccccaccggcggcgcgaccgggcggagatgtaccacccgacgagaggcggcgtccgcggcggacgggatcgtaagctctctccttctcctacctttcccaaatccactcgccgtgagatctcaatcgctggctgcgggccctaattctgccgcgtaatttttttacttccgtgaaacactcgctagggtttcgatgctgttgctagggactcgctgtggctgtaaggttctagttgttgatttgtcgatgctccttcctcgcgtttgattgcatctcgtccggtcttacttgttggttccaactcgtccgtgttgcactggattcgattagctagttcgtctcttgtgtctatgtggttagtgcgtaggatcttaccttccaactcatctgtttgcttgtatgatcttgcatcaggaggaattctgtgtctgccatattgttattgaatcatgttcctttgaaaggttataagatggaaactgcacatggcgcggtcacgcacgtatgcctgcccgcattcagcacccttcggcacgcgtgttcacctttatctcttctctatccaattgataccaagttcctcattggtatccgacattgttttttagtttaaaaacaatggtcataagatgaatggatgaccccattgcaagggatcctcgtgtgacagactgacagtcggatcatcaagggacaacaactactggggttacaacgtactgctgccaaaattaccttaatgaatggtggcatggcaataccagtcatcaggatgaaacatgacactataaaattagtattagcacttctatatgctggatgtatgagctttccaaaatttacgcgagtttttcgacttttgtgggcatatactatggatatgcatttgtttggtgcaatgtacggcccttattaatgtgctcccagctctaggatatcatgtatatagctttaggatatcatggaatattcaggtttactctctgtatttcgatgtgttttatgctttataatggtaaggttcatcctcatgctgcatgagcaaaaagctgctagatacctacaagatacaatgaggtgagaaaatgatccaaattacattgattacaattgctgcatctgaaagagaaaatcatcactttttttttggggggggggggggttcatttataggcttgtactatataactactttgtatatgataaactcactagattatcatcacttatgggcatcatcggtgccctaattgtataaccttatgcttactattcaactttacaagcgctataaataatgagtgcagcccgttagctcctccaattgcacctgtggttcttcattttgtactatgaacataaagctaccttttctcaaacagaaaagcgtgcactggactactcctacacctgccaacatgaataggcctacattttgatcgtttgtttttgctataagctcttctacatgttgttctgttccactgccattgtgtcatctccatcttgcactttgcattgtagcttacgagcttttttgttatatgggttgaacatacaattattagaaaagctcagtaaatctaaatacttttctccttttgttccttgcagaattcaaatgggatgatgttaaggttgacaagcaccgagagaattacctcggtcatagcattaaggctcctgttggaagatggcagaaaggtaaatataacaataccccttgtttacatccacctttgttggctggctagtccttataaaacaatggttttttactgctcgacatgaagtggtttttcttcttcttcttcttcttcttttttatgtcacatggtctaattaaattgttaaaaatatcttatctcttactgtagtttcctacttgaccttgatttagctgtactgttagtctactagattagtgaataccagttgtcccatgtccagaaatcaagagtggctaatcacatctccctcaagttgttcaggttaacactatcattttgtgtataccgggacattacctttgatataattgaactggaatattatgtatttttagtgcgacaagtgcgtaactgttgaaacataagcaggcatttgtcagggttagcacgaactaaacaaaagcgctggcattctatttattgaccttctagctgatacaaataaagtgctatggcatccttttttattttatggattccagatacaaattaaaattagtcattcatgtttttcgaccttctagttatttatcaactggaagaaatgttggtcttgtgagcagtgaatttgtgaaccgtaggtgcattcagtgagttcaatattggcatgtgttgttttgttaccagctcaagtgagtttgtaattgtaccttagaaacctcgttttggcttgataatagtaggctaatagcaatagatctccttttttagctgggcttggccaaatgttttgataagccttcaactaaagtggattggaatgtcaatgcttgttttacttttttaagtcctgttattttaatgtataaccctgtggattctaagttattgatacgagagactgattatctcggccagggaaggacctgttctggtatacaaaagataagaaatctgactcagaagatgctctcaaggaagaaatcaggagagtgaaggaagaggaggagcagtccatgcgggaggcacttggcttagttcctaagcgtagtagtcgacctaagggcaaccgattagataagcatgagtacgcagagcttattaagcgaggatcaactgcagaagacttgggtgctggacatgctgaagcagcacaagtgcagggtctaggtttatacaagtaagttcatgctgcaatagtttcaaacccactttaaatcatccttattatatagtggtcatataatcgaacttatctgaaaagttttttctagtgatatttgatgaattactaataatataatcataatgcacattatctcaggggtcctcgcagagaggaagaatcgagctcctttaaccttgatcctccagaaatggtgcccgctgagcaggctgacaaccctccaccggaaaccaaaccggaacgtgaagattccgatgatgatcgtaggagcaaaagggggcgtgaggagaggggaggggagaaagagcggaagcgagaaaggcactcggaaggaaaggagaggaggcgtgacaagcaagagaagaggagtcggcatgagtcggacgacaggtcgaagcgccaccgcaaagacaagcacaagaggaggcatgactctgattccgactagttactgcggctctttcaacctgtctcactgtatcctgccatcatatttcatgccttgctacgtttgcttgatgatgatgtagttgtaaaaacagcttgtatactcttcttgaatacattgtctgtttttaacttgcacatgagaaatatgttgaacctgtaacatcagcggtgcattttggcaatcttctttctgcctatccttgtcttgtgcatttccatcttcacgggatgttaagtgttacggtgtgtagttcacatcaaaattagaagtttaattaaaattaaaacgatgtgacggaaaggttactccctctgttccaaaaaataacaatcttatactggatgagacacatcctaggacaacgattgtccagattcgattcgttgtattagtatgtgtcccatatagtataaggctgctatattttgggacggagggtgtgctctgcttattagttatttcttcaacgatccagtgaaaaccattcttaaatttaacaaacgtttaacacgttaagcggctaattatccaaccagaatttcccaggaggaacacgcagattagcaaaggaaaaataaataaaactagctgagtcaactctctctgtcgtcatcttcttcgtgtgtgcagtgtgcgagtaactcgactcgacgaagggcaaatacgtaactttctcggcaggagaggagttgggttgattcgcagcaaaggcacggcacggcacgcacgcactcgaattcaccttcaccttcagcgcgagccgcgagcgagagaggaaaagggaagcgacgatctctgcccttctagaaggttcgcctcgtcggtccccttccccccctctcctctcaagcttcagagccctctctctcccttacacgaggcgagatctgctccccttctcccgattcaaccaaccaccacctcatctccgattccccctcttcttcttcttcttcttcctcttcttcttggtggggttagtttctgaatcgtctctactgctaacctccgactctgatgccgcttcctcttcccttctctcctaattcacattctattcggatttcctttttgagggtactctagtctcactagtggagtgattgattggttgattggtgttgttgttgttgggaacacaaattagggtttgggatttcttgactggacgacctcgtgcgatttcgggaggcaggagccatgaacggcaataagcagtccctgatatacagcttcgtggccaagggctccgtcgtgctggccgagcacaccgccttctccggcaacttcagcaccatcgccgtccagtgcctccagaagcttccccccaacacctccaagtccacctactcctgcgatggccacaccttcaacttcctcgtcgaccgcggcttcggtaacacccctcttcttcttattcttatctttctgtgggaactgaactacagtagttagtaattgtgatatctgttgagctcacttgggttattttgggggctgcagtgtttctcgtcgttgcggatgaggccgttggaaggagcgtgccgtttgtgttcctagatagggttaaggaagacttcatgcagcggtatggctccagtatcgacgaggagggtcaacacccgctcgccgatgatgcagatgatgatgacttcctcttggaggaccgatttagcatcgcctacaatcttgaccgggaattcgggtatgaagtcaccatatgctgtgttacctacatatgatgtttctttcttttactagtatcaaatgtgtctttaacatgtgtttttgtgtttgggtatagaccgaggctgaaggatcacatgctgtattgtattaatcatccagaggaaattagcaagctctccaaagtgaaagcacacctcacggaggtcaaagggattatgatggacaacattgagaaggtatgtgctcaaaacagtgctttctttgctgaaagaatatagtatattgtgtacggaaacaattgttgtgtaagtaaggtttcccaaaaactctggattatattgttctagacacctaacagttcccctgttctattcatgtatggccatatttctgtgtgatttatttctttgatgaagtaaacgtggatatcatgtcagggtatgatgtaaacatgtttcaccttttctgctcaatgaaaaatcgcgtaaacttgtttcacctttcctgctcaatgaaaaattgcaaatggaaacattttcaatagttcatgggccacatcccatgctgcttggaagttcctgcagaatattattactgtgtgcagtctatgttgctatgcatagaagtgctctggtgtctgttggtgtgattaatttacgaattgaacaagtaatgatgggatcttgagttttaaaataaagatcagtttttcccccctttttgtgagttagtacatactgttgtcattgtggtgatgaatcgtctgcttattgttttgcccacgtatttgaactttttttttgttacaaagtcttcactatgacagtatggttattggcattctagtttcaatatcttgggatataggagtatcattttagttatgctgactttccaatatagaaacccatgtctagtactcctacccagtatgtaattagtcagtctggcattttacaggaagccagagaatgcaaacaatatttgtggcctcatgtcattttagtatttaactgaatacagaaaaaataaactcctttcttgatgtttcatactactgactcttactgtcctggattttgtatagatattggaacgtggagagaagattgagcttttggtcggcaagactgaaaccttacaatcacaggtatggaaaatctgtgtgaaatttttgtttctgtaagaatgtttaagtaaccatgactaagtggtgtgttttcaaataatcttcaggctgacagcttccacaggcatggaagagagctcaggcgtaagatgtggcttcagaacctgaggtttaagttgatggtgggtggtgctgttgcggcgttgattctcttcctctggctgattatttgcgggggcttcaagtgctagaacattgaaagcctttttctttgttttgcattcgatgtgtttaccgtgtcgtgtgcatatataacgaccagcaaatcctgctttcgatatgcttcgtgcagagttaaatctccttatggacctttattccttgtagcctgttctcatgtttcatagtattacaataggggggctctggaaatggaatacttgtgtaaacaaaccttgtgaaaggagacaacttagctatctgtattatgtacattctgaaatgctaatagcttatttcaatctcattttcattggtcattctcagctggtgtcctaaatgttgattgcgtaccgcgcgtctgcgccagatcatttaactcgctattcatattctgcaattaatcgattctttgaactgtaagggtctatctcaagattaggatggcgcaccgaatttctgattgcatgaaagatatagtttatcttcacaatttgcaaagggagaaaggctatatatgttgatatgcactctgcttctatcaatccctcccgtgctatgtttagcggtgaagcaggtgtggatatacctcaactgacagcatatgatcagtcgaactgaatttcatacggaatgagttagactgactacgcctaatcactttcattgctgccctttttttttctccctcttctagcgttgcgaggtaaatgtattagttagagaattcgagttcctgttatataaatttataaaacttacggaacagaaacaacgcaaagggtgtttggtctagtggtatgattctcgcttcgggtgcgagaggtcgcgagttcgattctcgcaacaccccgttttttttttcccaattttgcttcaacggatgaccaattgcctgtgccatttacctgagtctaattagcagctatttttgacttttatttttcccaccttgtttgtgcatgcaaccgcgtatagaaatattttcacaagataggtatgtcttgtttgaaccaaatatgggttccggcactttgtatcgccaattctgagatatcaccattttttggtggaaataatagtagccaaaattgtctaagtacgagtctatacaacatggtacagattggaggttaaagcaaaaccagtttacttgtgtgaacatagttgtgctctggttagggtccatgtgataaaaatcatagggtacgtacgtttgatggttaaagaaggtacccgtggttagtggtgggtgattttaatgagactctttgacagtttgagcacttctctctgaaacaacgaagtgagccgcagatgcaagcctttagggatgtggtccagagatgtgaactccatgatctggggttctcgggggtgccatacacttacgataacaggagagaaagccgcggcaatgttaaagtgtgcctagaccgcgcccttgcagatgatgggtggaggggactgttctctacagcacaggtgtttcatctgtcctctcctagatcagaccattgccccatccttgtcaaattttattctgaagatcttcgcaggaattttgcgaagtgtgtccattatgaaatttattgggaaagagaccatgcaatctctgaagttatagcagaatcttggggcgtttccggagctaagcaggatctgagcgacattaatcaagctctgtttaggatgatgtctaaccttcgcccatggagtaagaaaaagttcaggaatgtcagccgggagattgagaaaactagaaagaaactatctgaacttcttctaagtaataccgacagcagggaaataagacgggtgtctgatcaaatgaacgaacttctgtaccgtgaggagatgatatggctgcaacgatctcgaattgcttggctgaaagaaggtgatagaaatacacgtttctttcacagcaaagcagtgtggagagcaaagaagaataagattacaaagctacgggatagtgacggtactgttcacaatacgacaaaagagttggaaagcatggcaactgagtatttccaaaggctgttcactgccgaccccagcattgatcattcgagagtcactagcctgataaagccgaaagtcacggatgcgatgaatgaggaactatgcaaaaccgtcagtgaagaggaaattgcaaatgccctgttccaaattggtccattaaaagcacccgggccagatggattccctggtcggttctatcagaggaattgggctatactaaaggacgacattgtgcgagcagtacaagaatttt

SEQ ID NO: 66755 - DNA, 7072 bp, Oryza sativa
agttctcaaaacatatgcttcctgcactgggcaattgataaatccttccagatgctccatcatgttcgggcaaagctctcctactgctgtccaaaatcagataaagcagaccctgcagataagtaactcctttgaagataaatatttgggctttccgacgcctgagggaagaatgaccaaaggaaaattcaaaagcctccaagagagattatggaagagaattatgctgtggggtgagaactttctgtcaaccgggggggggaaggagattttgattaaagctgtcctacaggccatgcctgtttatgttatgggactcttcaagctcccggagtcggtctgcgaggaattgacaaaactggttcgtaatttctggtggggagcagagaaagggaagaggagaacgcactggaaatcctgggactgtttgattgatcagaagttaaagggaggtatggggtttagggattttaggctgtttaatcaggcgcttctagctagacaagcctagagattgtttgacagacgggacagtctctgtgctagaattttgaaggccaagtactatccgaacggttctctcattgatacaagttttggaggaaatgcctctccaggctggagagcgatcgaatatggtttagaattactaaagaagggcatcatatggcacattggcaatggtaaatcagtcagattgtggaaggatccctggattccgcggagctattcaagaagacccatctcagctaaaagaaattgcagactgagatgggtttcagacctgattgatcagtccgggtcttgggataatgacaaaatctcacaccatttcctgcccatggacgctgaggccatcctaaacattcatttatcttcaaggctggaggaggacttcattgcttggcatccggatagactggggagattttctgtcaggagtgcttatcatttggcagtagctctagcacaggttaatgatggctcgagttcatccgggaatggaagtagcagagcttgtaatgccctttggaaatgcaatgcgccccaaaaggtgaagatttttgcctggcgagctattactaacagccttacaacattggaaaataagaagaagaggaagcttgaagtttcagacatctgcaccatttgtggggtggagtcagaatatgttgtccacgctttgtttcactgcccacatgcccggcaactctgggaagcgatgagtgatgatatgcagcttaaccctctcagcaacattcacaatggagattcgaaagtgatcctggacctgttggagcagtcgcagccgaaggatcaggttatgcttttaatggtactgtggcgaatctggcacacacggaatgaaatagtgcatggcaaaccagccccaggaatactagtgtccaaacgtttcattgaaagctatgtcctctcccttgctgagatcaagcaacacccccaagcaaatcctgaaaaggggaaacatgttgtggatgtggtcctaaagaagtcgcacagcatcaaacggagtcgagaacctgctcctgacaaatggtcgaagccgctcccaggaagcatgaagctgaatgttgatggctcattccaggagagtgaaggcaagggtggtataggcgctgtgttgcgcaactgcacaggagaggttatttttgctgcttgtggacatgttgatcactgtagcagtgctttggaaatggaactcctcgcctccagggatggtcttgccctcgccctacaatggaccctgctaccaatagtgattgagacagactgcttggcgatggtccatcttttccgcgatgctacaggagctaaatcggagctagcgtttttaatcacggagatagattctctcttggtgggaaatagggatattagctttaataagtgtcttagaagtcaaaatcttattagtcactgtttagcaaataagggccgttgtgacaagatcacacagttctggccggacaataagtgtacttttatctcacagtttatatgtgaggaggctaatgagtaattatccctttcccctgcaaaaaaaaagaaggtacccgtgagatgcaagacttggcaataatcttgtgtataactttgttatattcatgtggatatttgtgtgtgcatgagtatatgtgcacgtcttacttgtacttagaaaaacatcttaattgtatcgttacgtacctttttataatgtcgacgacaactaagatggtgacaacaatattggaccatgtgcgcaacaatgggataaagctactaaggacatctatattgtagtgaaaaagcaggtaataaacaataatatatgctttcttgttagcatacgttgtggtgcctaataatagctactatcaagtactccctcatttcctaaatgtttgacgctgttgacttttttaaacatgtttaaccatttgtcttattcaaaaacttttgtgaaatatgtaaaactatacgtatacattaaagtatatttaacaatgaatcaaatgataggaaaagaattaataattacttaaaatttttaaataagatgaacgatcaaacatgtttagaaaagtcaacggtgtcaaacattttgggatggagggagtagtatgcttgctaccaataataagcaggtcaaatatgttatttgtacacctcgaatacatggaatggatgaattttgtttgtgtacgggtccaccttatttaccacaatgggcatcaaattttgtagtgtgtatcaagttactattacttgataatggaacacactattaccaccaacctagacaagatacattgctgttgttttaaaggggataaattgtgtgtgtgtggtgagtggacggagaaggaggagggtttttgcgtgtgtggagctaaaggcaatagttagctctaagacatcataggcaactttgcgacggtgtaaaagcttggaagaaaaataattgtgattgtgcgagttacaaggctatgataaaaaaagcgatattatagaccaggtattttcttccaatttaactattagctggaccattctatataaattatataagactattaatttttaaagggttcttataaagaaaaattaattaaaaaactcacatgttctatagaaaatctgaagggcatggtcgaaagcttgtttataggtctaaaacttgtgtgaaatattggttcatagtattttttttctcgagtttggctggaaaagagaccattaagacaagagaataaaaatctcctaccaaggccataaaaaaggcaatgaagttgtgctcgcctcatcttaagaacgcgaagcggtagctcactgagattccagcgtatttagtttaagaaaagtagggttgttcggaggctcttatttctccagtaaaaggtagtccctttatttgtaccttgttttgaaaacgaaacacattgccctctagcgagcgctagaacaccacttacctcttttagagcacatatattgctatgttgcctcattatccccttcctcctctatggcgaccgctctccttggcagcgagctcccacaagatcatggcatattgcctcaatcagagcctccttagcagtagccggtcgacgaggtgtcagctatgagacttgtatggctttgatcctgttggatcttggattggtcgcactagatgttgcagcgtacgtgcagactcgagtagtggacgttagcttggttacttctttcctttcgtttcataaaaaaaaaacttcttactatcagttactttttactctttctcttatgagacggccatcctatagcctcctagggcacattgtcagcttcatcggcggtgataacctagtggagtattcatttcaggggacaacggcatttctgcttgataatcccctaatgctcttctattttcggtgaataaatttattgtatgcagtattgtttatcatacccaaacactcttttataggggtaataaaaatatgattttatttttagttagcatcaaattacacgtgggaatattttagttgcgaaaacagttactaatgaccaaaacaaaccttaaattatgtatatcctaggaagattgagctgtttatatggcaatctgtggttcaaggcctccagtccagacttgtttagttttaaacctaaattttacttctcaatctgaatattttagccatgttagctggattgacatggcgaaacaaagcttcaatgtgatgtagctggtatggcaagtttgttttgtcacgccacccaggctgacgcgacaacataaaattgtctgtgttgttttgccgtataatcgggatggcgtgattaaaagtttgagattttaaaaataaaggcttcattggttcgtctaataagttaaagcaaaaccaaaatttgaattttcaaacttgatgtagaagatgattttaagatatttataacgcatttttttatattgacttttaagtcattaagaacaaatataaaatttttatgtacaaattaatttttattctataacaagtcatttttaaaaataaaaaaaggttaaaaaaattaaaaaatagcccatcgagaggcataagtaaagtgtgagccgtggacgggccttgtcctattggggttgggccgcagcccacaaggggtgcctcgaacgtcgcatcccgtaggatgatccaacggccggggcacttgcataaagccgaagctcccacccctcatctcccctcgccgcagccacaccctctccaaaattcaaatttctccctcctcttccccaccccaccccccgctcccctcaaaatttccaaatcccacgccatatcgcacagattttgaattcccctcctcctcctcgccgccgccgccgccgccatgtcgtcgcggcaggacaaggagaagtcggtgaacgtccaggtcctcctccgctgcaggtacgcccgccgcgcgccctcccagatctccccagatccgccgcccctaacttcccctctctcccgcgcaggccgttcagcgacgacgaggtccgcagcaacgcgccccaggtcatcacctgcaacgactaccagcgggaggtcgccgtcacgcagaccatcgccggcaagcagatcgaccgtgtcttcaccttcgacaaggtcgcttcccatctcctcccagatctgccaaaattttaaatactggatgcctcggtttacctgctcttgtgctctagttttagtaccctttcaaacttttaaattatttggatgattccaaattctgcgaaatgcgtaccgaggttttcgtgattggtccggcgatttggacggtaactattcagtggctagggtttcttaggtgcattccaacgggctgaatctgcatttggctggagttggttcgcaattaataaagcatctggtttatacaagataatataagaaaaaaaaacaacacaggaatgtgtttccccttgttggagttgctgtggaatttatttcatttccggtttggccgcacagtacagagttctaatatgcagccgtttttctttcaggtgtttggcccgacagcgaagcagagagacttgtatgaccaagcgattatccctattgtaaatgaagtcctcgagggtttcaattgcaccatcttcgcttatggccagaccggcacgggaaaaacatacaccatggagggtgaatgcaggagagccaaggcaagcctacgctgctgttgctctttcatcatgtgtttgcctctaccaaagggttgcttattgtttgttttcctttcgtcgaaatacttgcagagtggtccaaagggtcagttgcctgctgatgctggagtcattcctagggcagttaagcaaatatttgacacactggagagccagaatacggagtacagtgttaaggtcacattcctcgagctgtacaatgaggaaataactgatcttcttgcgccagaggagatatctaaggctgcccttgaagaacggcagaagaagcccttacctcttatggaggacgggaaaggcggggtgcttgtgagaggcctggaggaagagatagttacgaacgctagcgaaatattctctcttttggaaagaggatctgcaaagcgccgtactgcagagactctgttgaacaagcaatccaggttaatccttacctttgtctttttaaactttggtttgctcatctcaagaaactctgtgtgcttattaccatatatgtaacatttcagtcgttcacactccctattctcaatcaccattcacataaaagaggctactcctgaaggagaagaattgataaaatgtgggaagcttaatttggttgacctggctggatcagagaatatctcccgttctggagctagggaggtaggtgtataaccagctagaatgctactatttcatttaacattcatttatgttttggatattttattatactattaagttagacacttgagcctgattgtagggacgagctagagaggctggtgaaataaacaaaagcttgcttactttaggtcgcgttattacagccttggtcgagcaccttggacatgttccttacaggtaagtggttaaaataccttgcaacagtaatctatttggccttttgtgctaactgattcgatctttcttacctttcagggacagtaagcttacaaggttgctccgtgattcactaggagggaggaccaaaacttgcattattgctactgtttcaccctccgtgcattgtctagaggaaacattgagcactttagattatgctcaccgagcaaagagcatcaaaaacaggcccgaggtgatctagcttcattttctcacatctacagtcaatgtgctgatagcagtgtggtgtgtaaacagaacagcttaaaatagtagtaatcgctttattcatattggctaaacaattgtacaaaaacaagtaaataattcaaataggaggtgcctagtacataccaaaattataatgggtttgacgagtacaagctgaaaatttttattaactccttaaagcttgtaattgcatagtgtggcctgctattagggctgcaggaa

SEQ ID NO: 66756 - DNA, 8107 bp, Oryza sativa
attcctgcagccctaattcacaatggttgcagaataacctcacaattttctctattcccagaggtctatgctgctcgtgaaaaggttggagtctacatcccaaaagacagatatcagcaggaggagaatgagagaaaggtaatcttttggatttaatggatctgaatggggaaatattcacaaacctgaaatatgtactgtcaacatatctgttatgtaactctagatgttattatggtattgagaagatttggagcagtttggctgatgatgctaacttttcttatttttcctttttaaggccatggctgatcaaattgaacagatgactacttcgttggaagcaaatcagaaggttcgtaaagtgcttgttgtgtatatttgatatttgttcttgtttaaaattgatcttttgcttgggtttcagcaaattaatgatcttcaagaaaagtacgactcagagcttcaacattctgctgatctaagcaaaaagcttgaagccacagaggtaatcatgattgcaagttagttcctttctccttcatgctattttgtgatcgaaggcttatagtgttgtaccatgatagaaatgtctggaccatacaagcaacttactatccacaaccaaagaagatttgaaacaagcccagtataatctgaaggagaaagattacataatctctgagcagagaaaagcaggttcgattctttgcacattttttattcctgcaggtcaattgttaataattctaacagtattttcatccatctgtgttgatcagaaaatgctttaattcaacaagcctgtcttctgagatcagacctggaaaaatctaaccgtgagaatgctgcactctattcaaagattggtaagctcttttggcttaattcgatgactattccaaaatgttgcttactatcatctttgtcattggttctaactgaatgattaccatgacaaaatagctcgaggagataaactaaatgctgcaaataggtcagtggtgaactcattccaagctgaccttgcttcaaagttggatattctctccactacccttgccacatctatagatcagcaaaataaacaccttaaatctgtggagaacttatgcaagtcttgtgttgattcccatgacacggtatgcattgctacttcataaatctccatgcctaattttgcaaattagttatgtgggctcagtggttccatattatatttatatgtttttttttgttaaatgtttaaggctacttcggagataaaaaagaagattttggcttcaaaggcactttatatgtcacatatggaagccttccaaaatgttgtgctcctgcataaagcaaattcaaattctacactagaggatatatcatccctatctgctgcaagctgttgcagccttgatcaggcaagcaatcttcttagttatccaacaaatacagaacctgatgctctttactctgtgactaccctttgattgagttattctcatggcattattgttaatgacagcttctagcttgtgtcgagggagaggcacagaagatatttggtgatatccagaatttgctagctgatcatcgaagcgaagtggcacatttcactcaagagttgcgggaggtcagttacttgatctgactgttaaacattctaaattgtcaacatacttgcctatgatcagctcttaattgaagtttgctcctgttattatgcagagtttccgcattagcttggataggacgaaggacatgtctagtttcatccttgggttgttcgataagtatgtggaggaaacttcgaagttgcagagccactccaatcacacacatgaagcacaagtcaaaagccttgaagatttccagaaggcttatgaggtgatcgatcccccttttgtctgcttgattggcaaaatttggttgctgtatctaacatcaattttatgcaggagcaatcaaaatcagaagaacaaaagcttctggcggacatcaccagtttggtttctaaacacgttactcgacaacgagaactggtgcgttgcatactttcacctcataaatataagtctggccaaccttttgaggcatgcttttgatgtgtgatcataattttgtatcttctcaagatgcttctggggcgtgtgaattcagttgtagtttggttttgatggaagcctggtgtattttcctgcaggtgggtggtagactaaactctcttggtgacgccgctcgtggaaacaaagcatttttggatgagcacacgtccgccatggaggtggtcacgaaggacgccaagagaaagtgggaaatgtttgcagagcaggcagagaatgactgcaaagttgggtccaacttctctgcagctaagcattgtcgcatggaaaccattctgcaggaatggtatgccttcagttgctgcttcttcgttccttcttcccattagtttgattggctttctctaactaatgatttgtactggactcagtgcatgcaccgtcgacactgctgctcaacaatggaaagcatcacatgcaactgttaacgatctatgcagaaaacaaatagctgaagttgaagcactcgtcaggcaagctcatagtttctcttaagctagctgttgctggttacaattggttaggaaatattgtttagtgcttcttcatcagatttccacttatcgagctagcatttcaaacaatccattcttttaataatcgtgtttgccaagtagcacataatttcacaacaaaagggaacacttctgaattcgttgtgaatgatggcagtggaagttttgaaaagtttaaaatctaacgagcgtctttatgttgtatatttcaggagtgcaatcgaaaccaacgagcagcacgaagcagagattgcatcttcccgtgccacggccgaggagcatgcgtccaacagcagcaaggacctactccaagatgttgacagtaagttctgagatctcatcacagttgcctacttctaaaacacggagttgcgtaaagctaatcccaacctgtgtttcccatatgctcgcatcagatatgctgcaggaggcgcgcaattcgtcgtcgagagtggtgtcgacggtggaagctcatttgggagagagccagcatctacaggagagccactccagccataccgccggcatcaacacccacgccgacaacgctttccagagcagctacaaggtgagcgagactagtacactcaaaatcttgtgaaccgatgacaattttcatttcaccgaccagagcctgatgaacaactccgctgttgcttgtgcaggactacgagccgaccggcgaaactccggtgaggtcggagccggaggtgccgagcaaagacgcgatcgagtcgctgcgagcgatgccgatggagtccctgatggacgagttccgcgagaaccacccctacgagccgagcaaggaccgcaggccatcgctcatccctcgctcgccgctcgccaccatcaacaactgatgaaaatccattggaaacgcaacgcaatgcaatctgtctctgtgtgtgtactagtgtaatcttattagccgtaagtaggtcatcaaatgctggcttttggtgtcctttggttgttgtggctcagtgccagtgccagtccagcttcttgttgtgggttgcgagctatctcagcttcccccggcgcccttacctaactttctttcacattttattattttgatgtaccaatctgttgcttttctgtgtgattattggagctgcataagagatttgttgagcattgcattccaaatctcatctcattgcattacacttaaccacacatgagaaacaatcgacgaggttttgtcatctaaattaaaaggaaaatgagatggcatcaggtgaggtagagctgcatctcggagtggttctcctgctcgatgacgtcgaggaagacggggtcgacgacgatgtggctgtcgatgctgacggagaagcggcgggaccagagggccacggcggcctcgccggcgatcttgacggcggcgtcgagctccatgtggcggcgcgcggtgtcggcgaggatggagcgggcgtggtgcgccagctcgacggcgtcgaggcgggcggggaggtggagcaggcggcaagaggtgggcggctgctcgccggcgtcgaggcgggcggtgccgaggtgggcgccgtcgtagaggatggagacggtggaggggccgtagcggacggggacgacgttggggttggtggcgtggacggtgagggtgaggccgatgtccagcgccgccggcggccggaagtggaaggtggagaggctgatggagatgagctcgaacgtcgggtcacgcggccggcacagcagcacggccgccgccgccgccgttgaggcggcgcccacgagtgccgagccccagctccaccgccccctggacgccggcgccggcgacggcgagctgtccatgtaggcgtattggggatttgggttagccacctttttcctttcctttttgcgcgtggccttgaggttgttttggcctgctccttcagagttggaatcaggttcttcgcgtgcagattttgttacttctactcaagacttgattagctttgttaatccgtgaatcgacggctggcatttattctggtagttgagatagtgaaggttaagctaagagtaaattgcgtcagcggtaaaggaacttgttaagtgtgtgcgatttagtgtaaaaacttgtaaaatgagcaaaccggtacataaactttaacaatcacgtgcattttgataaaaacactgttacataccaatgattcatcgtattttattggttgtattgtaaacataactgctagattaattgttggcaatgagaatgttttgtagtgctcatcagcgaatttttttgattagctggatcgctcagaaattttgttagttggcatacacttagttttgataatcattatttttttttcaattttaaataataggttattttagtatgataaccgagcaaacgcaacctatctaaaaccttgttcagaactcaagatgatctaactggctgctttttctttacatggctgaaaaagtatggtttaaaagagagatcttttaaccaaaatgtatgcactaaccaagttattagacccgtataattatttttcaaattcttgcactagatcgtacccacttaccaagttcgtgtactataaacgcaatttactcttaagctaattatgatttttaggtcccaaataactggacagagttctgtttagcttccttatttgatctgaaaattaactgggcataaacagagaagcttcactgcacctcttctacagcctcatttcagtgtcattcactataaaacaagtaaacagggagtataaattcttttacaataatcgtttcaataaaaattcgtgtacaataaaatgagcagtgttatgtgtatgtgcatgtactgcattatgaattcgccgattccttgtaaagaatagagagaatctacaacataagaatagagagaatgcatattaacacttgagatatgtcaggttatcagtgtagtatatactgcatattgacacttgagatatgagaagtagaagggattctcaagccgcatatgtggccctcaggtagtctatgatatcagcgctctcgaacatcttgacccctgtgttaggatcttcgatataaggagcctgccacagcagtaattcatgtcaagcgcaaagaagaaattttacaatttaaggcataacatttgatggttgccaacctggaaaatgccgtatttcttcaaaaattcctgtctcctggggctgccgcgtgcacagctgcagaaattttcagctaccagttactccaagagtgtagtgcttgcaattgcaaggctttgtgatacagggttgtgattttacagcaggaaaaaacactgatgatagctaacagcatatccagcaattttgtcattggtgtaacgttattgagtacctgtgtagcaagtgtggcaactctaattcaacaagggtctctcgtactattttacagaaaggagatccctgatgataaagcatgcaccggtcagattctggatctggcagtaagccacaggaaacggcaaatgcaaacgtatcaatatgcagaggattcagacctcatatgcccatagttctattggctcgggtggaagctttgcaggagtatacttagaaccctgtaaacaataactggtcagccctggatacggttcatgcaaaacaagactatatggcttgttcaatatgtaccttcccactacgtccactcattgcgagccctgctgttatagtctaggaaagaaagagcataaggttatttaaactgcacaactgactgttaactggccaaataaaggttgctgagtaggtgtgaaattcaagaaccatatatcaaataataatcgattagacgttatttcaacaaaggtaaaaggacagaaccagatcataacttactgttaatataccaagtgatagcataattggaactgttccatcacctgaaaagcaagggcaaatgcaggaggttagtaggaggccccagggacagggagatgtacagatgagagatgaaataggcaccatatttgtcggccaggtattttatgatggcatcagattcatacatggcaacccctgtgtttggatccacctgcagcataagagtaccttagatgatgataaaaacaaactgatttcacactacttcttccagacagaaagaacacccaaatatcctaagtgaagggaaaagtggaaaacagacacatcgctgtagcaaagtaaatccatacgacaaataaaaataccattttgcaaggtattcaagactctgcaaacatgaatacatggtaatggtgagattctgagcatgcttgtttgtcaaatatatttccataacatttttttagtaattcatagctgtgtaaaagtagaacagaagtaattgagtatatgacctaagaaactgaagaaattatggaggattacttgcataccatgtaaggaaattgttgctttccgcccatctctaaaacctttggacggaaagtggggccatttttagggcaggggtaaaacaaaacatcaaggtccaagacggccaccatctctctgacctgcaaattttaaaaaaattgttcatacatgacagaaggtaaagtgcaagatgcagatgtcgaaggctaaaaatactaacctttcggcagaatgggcagctgaagttgaggcagaattaatacagcaacaattgaatggacggtacaaattaagttagctatagcatgagagaatacccagaagaagattattgggtctgaacaatacatgtcttttatggaaagagagaaaagatgaagcatatatacccttcaaactcgtaaatctcgataggcttttctggtcgaggacactgccctatctttgatgactccttaaccttccgacctagaataagaaatgacacatatacatgtgttactatgtactggtttgaagtctgatctcagcagttgggctggtaatacagtaacaatatagtgtctgttttacgaagcaattgagaataaactaggtcgttgtatggtgcaaaatgacgaccttgtgtgtgcgttcatcgttggtatttgctttgggaaaataaaataaaaagattgtaccttggaaatccaaagcatattcatctggtgccacctcgtcaggagaaaccagcgataccgaatatctgcacatcaaatgaatccaaggccatgaatatatgaatcgagtaacaataagatttagaaacaaaattcagtaggtattggatcgaataaattcagtagaaatagaaaataaagtacccaagggcgaagactccggtgccgatgcggaagggaatggcgagggaggcggtgacgatgtcgtctgactggccgggcttcacctcgaatgtcttgggctccggacgcttgaattctggaggcggcgctaatgaagatgcggcggcgggcttatcagaggtggaggtggaggtggaagcagcggtggtgtcgtcgagctgcgcggagaggcgcgtggtcctgcgcgaggt

SEQ ID NO: 66757 - DNA, 2208 bp, Oryza sativa
tatgagggcttggtgaacaatgacaaccacatggctagtggtgcatctagttggcctggcacccgtttcggtcggtttgactccctcatgtgaaaggttggtggacgtggcttcttcttcttcaggatgttttccacccccaaccaacaatgtccacctatggctgccgttgccagcggctacctttcctatgtgcctcctctcttatcctcttttaaccctagatccgtttgcctccccgatgacatctccacataccttcttcatttgccaactcctttcctcttcgttttttctattacggtcgtggaactatggtcaatgcatttctcgtgccattggcccctagaaagtccgcttcactcttccctttcatccttttttgtgtaaactttgtgccaatactggcatgcctccatggttggagtccctagagccattgtttttaccgttgcttcaaccaatttagctctgccccattgtctaggagtgtgtccaatcactttagccttgtcccctcctttggatctgctcaatttagcatgctccatgtttaatagcttgggtctccatgttggttgaggtctagggctctaggctcttccggtggttgtggtgactagcgagttgtgcctttcttctatcagtgtgatctccatttatatccttttgtccagatccgtgttcttctacatctttcttcaatagccctccctcctttttgtctagctccctgctagtttacatcctccttcaacaactcttcctcttgtggggctccttttcccaaaagggcgttggagtttatcacgcttcttgtttgtctacatcttccttcaacagctcttcctcctttttttgtctagtttcctgttcgtctacatcctacttcaatagcccttcctcctttggggcttccttccccgaaaagacgttggagtgtattgaactagatgacaatttgatgaagtttgatcgaagataattggatgtgggaggcctagagaagtaacatttaatggagtgtggacccacaagtgcatcggtgggcattgatctaagcaataacatgataaagtgggattcttgatggcttggtgttggtggcgttaggcaatcacaaccttcgatcaccgggatatcgagctagcttccgagtagcagaaagccctccggtaatattcaatacacgcacatcatatccttgtgagcacctttaaaaggctggacccgacatatcttgagattgacgaagtcgatacggacacattattgttgatgggtacatcgcataacactaaaatgcgagcactcatgtcaagtttaggacttaacctagatgaacaggttctgtagcaagaaacctaaccagttgagttatgctcactttgcttttactatgtctctttgtcctttgggaaggttgtggtgactcccttcttcttttttttttatttctatgtattccttcactttattctttaggactcgtgcgcttgcacagccgaagtaggtcataaggatgtatggtttaaaaataatatatttaaggccgtgtttttttaggtgttgggaatacttcccctctgcatgtaaaatagagtgacaaattaacgcatgattaattaaaaatggattatatgatttttttacattaatttttctatagaaactttttcaaaaaaaacataacatttagtagtttgagaagtgtgcacgtgaaaaacacagtagcacaggttgtgaaccttagttaaaacttaaaagcacagcctaacaaaactccaatccttgattcttaccagtgattcttcggaatcttttcatcgttctccaatccttgattgcggtgttgtatacttgtattaggcatactccgcattagtaaagaaattgcttagatctgtttttgtataactggtggttagattcgcagcgttgaccagcattcatattccgaattccgagccgcgtgaaactaacgcgatgcgacgcgacacgtagaaatatccatggtcggccgggcgatgcgcagtgagccgccgcggaattgaatttggatgagcaacaacacaagacaagacagacttgttcttggttgtgtccatgtaaacttccatcatcaaaccagcacacgtacatattaggagtatttgatacatacgcgccttcacaatttgcaattgccaagaaacgaaacgcaacgca

SEQ ID NO: 66758 - DNA, 2729 bp, Oryza sativa
gccgtcgtcgtcgcaggcgtatcccatggggatggggggcttcctggtgttcccgccggggacgcacccggacgtggagcgcgccttcagggccgtggaccgcgacggcagcggctccatcgacgagcgggagctgcaggacgcgctctcctccgcctaccaccgcttcagcatccgcaccgtccgcctcctcctcttcctcttcaacaaacctgcctcccattccccctctcgcatgggtaaacctgctactcttcttccctgtgcgccaaatcatatatcctctcttcatcgcttcaatcacgcccagaaaatgaaattttcattttctttgtttgctgttctcatgtgagcattgaattccaacataaggtctatgtttggctggaatttccaattccttcagtgatagattggatgttcctgggagcaatttgttgcaacttactcgtatcatactgctcgctgcatcgaatctgaaacgatagagcacttattactgctattattaccagtttacagtttacacaacctttataactatacttttattgctagtacaactgaaagatagaatcatgcaagtacaattccttttgaagctttcctctccttctactacatgggaaattgggaatgtctgtttctttctgtaaaagcttctaccgtagatcattctcttctgtgcccatggccccttgctcttagattggatattcaccttttatgagtgttaccgcttcaactattgaaattctatatcaggattgcttacaagcattcgtgcattagtttcgtcaatgcagctctgccattttagttgtcaaaataagttactacaaaactgactgatttctcattgccacctgaatttgcaggtccagcagagttcgtgtcactgtggaattgccttgggcaatggcgggtgagtgccaacagtatttctatagttttatctacgaacacaacagacaaattacattcttattattgtaaagcatttagtttttggtgcctttcattgtgttttcatcattgcttcaactggacactaaattgtagacagcagtacagcccatccaacctgtctctcgctgttaagaaatctgcttaataatgcaagtggaggtttttatgtttgtattttttttaacaaaagaaaaacagagagaggaaataacaatgctactggagtggagacccagcaacctgtttctgtctggaagagctggttgcaattatgtctttgatattataattattgtctgttaacttatctaagcaagactttgcaagattatatggtgctcaattaatcaataggtgtcatgttgcctattcttctgttctttcatttagtgttacctattgggctaatttctgttcttggtggcaacatccagggcattttcgacagatacgatagggacgggagtggaaaaattgagaaagatgagttgagagaagctctacgcagtcttggatatgcggttccaccttctgtccttgagcttcttatcgcgaactacaacaatggagtctccagccgtggcgcgttggactttgacaactttgtggagtaagtatatttctcacacaaaacgaactcatcagtcagtttattttctgaatgaaggaatctgactattgtttcgtatgcctctgtaattttaattctgcaggtgtggaatgattgttaaggtatgccacttctcttccatttgcagccctccaattatgattggatcatgcaaagaagcagcaaagaacctaatgactgatttttttatttatttattttttggttccgcgtagggtttaactgaaaaattcaaagagaaggatacacgctacagcggctcggcaactctttcatatgacgggttcttgtcaatggtcattcccttcattgtcccttgacttcttcgggtgtctcaagacccaaagagctttgaatttgtacagcttttcagctatgtttctgcttcctagttggatttgtttgtgcaaataggccttggtgattttattgactctgtgccgtactgtgtacttagtaccattttgttttccctatagcctatatcgactgttacctgtgattgcgtctcggttctgacatgctttgatcttagttatcctcaaatgtaattgccttttgatgctaacagataatatgggagagtaaactcagcatctatgttcagtcaagttcttaaaagtctacttgaattatactgtttctgtatcttcaaaaatggggtcaaacggcgccgcatcatgatttcgatgctgcacgattcttgcgagcagcggcaacatttgctatcgattcaaggtcaaaccagaacgaacggtagttggcacaccaattctccccatgaacgaaactattcataaataacacaagcctcatttgcataaatccgaagtgcactgaataaactactacaaaatatgataacatatctcgatgttctcttgggtaagcacaaaactgatatcagtgcaagcagatctaatgtaaggacaagctcagttcaaccgcccagcatcttatcagcttcaatgtggagcaaaccagcttagaacaccctgtacggtttccccattgtgcttttgatgtacaggcacctcacctgcaaagcacaaaccataacaagttagactgattgtgtttgcttgttgggcttacactatataaatttcattacatgtaaacatcagaa

SEQ ID NO: 66759 - DNA, 6888 bp, Oryza sativa
aaatggaagacttgcctgccttgtttagaccaggaccaaggagacgggggatctgcttgatgatggcctctgatgctaagaaagcatggtacttcttggcaagcttcttcacaagcttcttgttcttgttcatcttcttaagggcctcaacatccatgtagtcgagcccaatcttctcagcctgtttaaatgccatggtgcagcatgttagtaggaagaaaattagggagaaacagtaccattagacagaataaagacagatattacagagagaaaaatccaaattgcatacaaccaaacacattagatgctaacgaaattgagtataacatatgttgacatgtaaagaaataagcaccagggaaacaaacaaccacattttaagaaatggtaattcagtaacactacatgtgttcaaattgagaaaatactacaataatgtaacctgtaaagtctgaattaaacaaaatggctacaacatcatatcttacctcctcgacatgctgggcatcaccaagcatgcagaccttcatcttggggcgggggatatggggcagcttaacggagccgctgaaacgcttgtccttttgtgggtcatagttcttgagaccaatttgaagctcaacggtctcggtgaacttcctgttcttttccttgcaatcagcaacaacctgggagatggcttccttgagagcctcggtttgtaacttactgcaattgatcgcacaagctcacattcagaatttgttatggaaaagaaagaacatttctgatactcatcaatcagtgcaccatactctggtataatctagaaatcagccatctctactgtttactaggcaaataaaacattctttatgatgcaacccagtgcttagttacataagcaatgctacaaaaaagatatatcaagtagtcacctttgttgataactatatacaactactggatccctctttggctcttgatgccactctgaaggtctatgtatgaaattcggcataaactaaagaccttttcctccaaattataaaactactggatccctctaaggtctatcttagatttattttttttgaaaaataaaagcattcaactgtctaacaagaaacgatctatgacaccagtatcccccaaagcaatgctactaccagactaaatcaacgaaaacaactaatcagtaagcaagttgggaggagtagagtacctcatgtttgcggccgataactcaacaacactctgcagtagaataaaatcagaaaaaaaaaactagtgagaagaagcgaggtacagcgcgtaaagacaatacaatcaaacaatcggaagaggtgaggttgcggatcgaggagggaggcggccggagacggagagagagacctcacctagggtttgggcaggggcggcgccggcggaggagaggcgaagaggggacgaggcagaaatggcgtctctgcttttatcgcctagagctttcggattagacgccacgtggcgatgtcctgagccgttggatctcgctactgggccttttgggccggaaaactatctaggcacatgcttaactgtggcccatgtttagtatgggcttcaacttgagttaattcggcctttggctgccgtacctctgaattctaaccaggactactgtttcgtctgctctcttcagcatttttttttgaagaaatcagaaatgtaactgcaaaaaatgagaaatgcaagtttaatttgtttttttgagttgaaggtgcaggatagacgtgggtagctttagtttacatcgctttgagtatggactttgtcttacattgaaagtggaatggaagatcactgtcatatgagttgctgtctggattaattatgagtagcaagcttagttagatccaatccacttactaatcgctatatgtacatatcacatgcattattagaagaatatttagaatagtaatatgcctgacagacaccttggatccatcattgatgatttgcaatatagtacatgtactagttcccttggaaacacagacagaggcatgtgttaagcatgatcgctgcttccgtccaattatatatcatcgtaatattcctataatcctatgtctatgtggtggcgatgcccatcgattgaagcgatcacatgatcgatgatcattctgatcacttaattcctgatctcaaactactaatgacaagacaatatagtgtaaaaaattaggaagaaaattaattaaactgcatgaatgcatgcatggatggtcctatatataatacggttgttgcaggatgaggatgaggatgagaacggtgacggagaagctcatcggtaattcggtaggtagctaggttgacaagtattctctccgtaccttaaaaaaataacattgtattaggatgggacacattctaattttatattctacgtctagatttgtattacgatgtattatattttagtattagattatttttttttaacggagcgagtatacactagtacatctatctatccagcacgcacgagcaaaactgaaaccgagacgtacgtagaacaaagcagatcatgcattttcagcatgcattataatattatttcgttatctcaaactgaactcaatagcagaattttaattgcgccacatgcatgcatctccataattcgtccattttctttagatattggaaagattttcggtctttggctacaaacaagttgcaaccacttattacataattctttttttttcggggaaaaggaaatagattactcaggaattaaatcatctcttacaagatttgaaatcaaaagacatgtagctatttccccaccaaacactagacaagccatcgctacggccacttattatacgtaattcagcgaatggagagtataaaaaaacatcgaagcactagacaagaactaataataccaacacaaaatagataaatatttattgaattctatttataaatcttcatatgaagttggcaagtatctgcacgacacgtagcatatattagttccttgtcgtccatagcagaagacacagagcaatttaatttgatcgatcgatcgctagtaggatatatactattattctcaacgtgtatatagaagccgtaattatatactccctccgttttaaaatgtttgacatcattgactttttaagtacatgtttaaccattcatcttatttaaaaaatttaagtaattatttattctttacatatcatttgattcattgttaaatatactttcatgtacacaaatagttttacatatttcataattttttaataagacgaacggttaaatatgtgctaaaaagtcaacagtgccaaatattttgaaacggagggagtatatgcacgtacgatcctgtgtcgtcgttgccgcgtcgagcatcaggtaatagcaatactactgctgcctgtcgggcgctaaaatagaaatgaaagagagaggccatgcatgcatgcaaatgcgatggatgaacacccaccgaatcttcaattctcaacaaatactgcactgcatgcaccatgttttccttctgaattataggtatcggtcaattttgaatagtcactacttgatctgaacttgcgaagatgctcataggggtagagtttacgtacgtgtgtttataggggtgagtgtgcgtgtgttgtgagtctctgcgttgtaatgtatatatattttttttaaaaaaacagccccatccgaagggcaaaacaaaaacaacaagcggcagagatccaaacacgtgggcgccgactccgcatccgcctcatccacgtgtcgtgccactatcccttcatccgacggctctccttcctccggcacgatatcggacggctgtcccgccaccaagctcagacgatgacaccctttccccctccctaaattaaccaaatcaaaccaaaccaaaccatgtttgtcatcgctaatcaatccacgtgcatcgtgttcgaccgacgtcatcttgcctctcctcctcctcgtcgccatcgtcatcgccatcgtcgcggtctatatatggaggcgaggcgaggcgaggagatcggtgtcgtttgttgctgccagaaagaaagcccaagtctgagttggaacttacttggaagggagagtagtagaggttgcgtcctactgctacttcttcctcctcgatcttcctctacttgaggagagagagagagagagagagagagagagagagagagagagagagagttagttttgggtggatttgtgatggggtcgaacgagcagatccaccgggacaagctcatcatcgacacggatcccggcatcggtgagtcccttcctcttcctcttcctcatctcattgcgctcatactagtttcttcctgatttgatttcaattcttgtgtggaaacatctcctctcccaacgacaacaatggagtcatggggatagaaacgagaggccatagatagatagatagatggataagatgaggagagcgaaaaaatttcaatctctttttggtatcttcccctcctgatcccctcctcctcacctcacctactcctccaagaaaggagaagagaggaaggacaaccaactgaaactctctctcacaccactcatgtggtgtggtggggttcctccttctcaatccgccgtttggacggatccccactatccggccttgtccatgaaaacgatggatggatcctgcatgcacaagcaccaaaaagttgcaatcctttagggaaaagtcgcaatctttttttcttttcttttttttttttggcttaagcgactggtttgtggttttgtgcttagcgatgcgctagaaactggtaaattgaagagctgctgctgatagttcatgactattgtcgtaattatatcttattagcatcttcagtctaatggtaaagcacctagttagtgccaggactgtgtgctaatgcggccgacaagtgtcaacactacgccatgattcctctcaagtctcacctaggtgtcgttcgtgggggccacctcttcatactttaactacagtgaagaaccgttttgtttcctgatttttgcctagttgatggttaaaaaagagcagctttacgagtgtgtgtgtgtcacactttcaacattttagtgtaaattgagaagttacagattcccctttcacatacattcaccttttcctgatcgtgcaatagaaatgcatgacatctgatgcttgtgctagccaattccaattgaccttcttatgttcaaattctaaatgttctatttaaattggacgcaaaacaattcaaggttaaaagagagatagtttcactcctgttgcaaaactacatccacttcttgagagagagagagaccgatacggcacaaatactagacagataatttgaagaagattttgttgtgaatctattgcctcaaactatgtgctttctgatttctatgtcttcagaaaatacatctgaatttcaaccttctaggaaactacttcttgctaattcttttccttacaaactggttccagatgatagcatgacaatccttatggcgttcagagctccaactgtggagatcatagggctcacaaccatatttggcaacaccaccacaaagaatgcgactcagaatgcgctcttgctggtgagatttgagatggttgaatatcctttgttatgtttcttgctcttggcctcttgttaacagcggcatgtattgaaaatgacagtgtgagagagcaggacatcctgaggttccagtagcagagggcagcgcagagcctctcaaggtacgctggttcacgatatgcttatacagttatatgtaacaatgtaagacttagcgtgtacgacgagcaacatgaatcttgatacatgttctcccgcacaaaccgatcttcatggctgctttcaaatttgatggcttttccttcgtttatgcttgcttacattgtcaaatatcaattttaaatggctcttgagtgctgacttgattagcgtcaatcataaatgtgtagctaatgtgacatcttaaaaataagacgaaacagtcttcctagtttattggatgtacagggcacaaccttcttttttttttgcccgtgggagttaaggcttaatataatattcatttttctatttataatatagattgaacagtttacttttatttgcataagcatcaacattttatatgccaccgattcaattaagaccgcagacttccgatcatactacatttcctattcaattccagtcaacgccccatgcttatctggatgagcttgttaatgatgtgctcttgtactttagggaggagagccacgtgttgctgactttgttcatgggtctgatggcctggggaatttgtttcttcctgcacccactagtaagaaggttgatgaaaatgctgctgagttcatggttaataaggtctctcaatttcctggagaagtttctatactcgcattgggacccctgacaaacgtggcgctggtatgcttccatttacaggataaacctgtttagcatgttgctttatatgccgtgacagaggataagtctgtctgtgttctttcttaggccatcaaaagggacccttcctttgcaagtaaggtgaagaaaatagttgtactgggtggtgctttctttgcggctggaaatgtcagcccagctgctgaagcaaatgtaatgtcattattgcatattagactagtgcttgtacatggacagaaaaaatacattgacacaagtattaagttttcgctgcataactctgcagatatatggagatccagaagcagctgacatagtttttacctcaggagcagatgttgacgtggttggcattaacataacaactcaagtctgttttacaggtcttgttccttga

SEQ ID NO: 66760 - DNA, 19575 bp, Oryza sativa
ctggttccacctaagaacagaataaggactggtttgttctgggctagtaggcatcagacctgaggaccaaaacaatctgttatcttattatatgtaataggaggattagaagtttgcttcctagctacaagcaaaatatatgtagtaaattgaaattctgcatacgaaagacagcattattacaaactgtttcagacatttgtgccacagatatacatttcaaattcggaaatcagtttgccactcgccgtgttactgtgtgctaattgtgtcacaactctctcggttgttggttgcgtttgctcagtaattgcttgaagctaaaaagtatagcagcaccacgcttgagtagagtaactttttgacttgatttcactacatggtgagagagatagcatactggtaaaaataattttcatcgtcagattgcagatgaaacccagagcacaagcaaggacaagtaaagctggtagtacatgacacaagcacaagcacacagtgtattattattgattaagatatggtgattcttctccgatacaagcattacttagtctagtagttgacatatattaaagattaattctttgagcaagcatgcatattcccatacaagctagtatcagcatacttaggtagattgctggcatttgtaacagggaggagcagagccagagtacaatacttaagtcttcttcatccagctgttatacatgatgatataatccatcatcatccatgtgtgttttacttgaggatgtacttgagcacaccgggtatatggatcctgtagaagtagtcctcccaatcgatggtctttgggtcgaagttgaacatttcatcgtcttgagggttcctgctcttccccatcctctgcctcagcctctccaagtttatgtcgtcgaagcttcatatataatccaagcatgcagtaatgattacttgttagtagtaatgtacaggtatttgtatatacgtgtataaaagtagagaaatacgtaggtagtacgtaccatcctttgaagaaggcgaaggggccgtagacgtcgacgaggtgcatgacgtagcggtactggcgggcgaggttagagtagaggcgggagaagaggccacaaaggaggaggttcaccaggtggaggatctccaatggcagcctgtacttcaccagcatgtacacctgcaaaaatcaataccaacttgtaattcttttctatcttttggatctgtttgatcgtgtgcatcgtaattatacagacattaaaatgtttatcgtaattgtatcatcttgacaacacacttcaatgaaaagcttctactccgtcagtttcatatcctttgattttttttattcaaattttttttaactttaactaaatttacagagaaacatgtagtagtattcctcacacaaaacaaatatattatgataatataatcaatgtttacatttaatcgaactaatttggtatcgtagatattgctattttccgataaacttaatcaaactaacaaaaattaactaagaaaaaggccaaagcgacttataatctatagaagagaaataccattaaaaaataaccttgtaattcttttggatcgatctgtgtgtttggtaatgtgcattttaattatatatcatcttgtcgtaatagactgaattcagtaacaaactttcattattaaaaaataaaaaaaaaagaagagtaaattaattaacctggaagctggcgatggtcttgaagaagtgcatctccttggtggggatgacctcgccgcgcttcccaaccctcggcttctccgtgaagtgccgccgcccggcctcgtacagcaccgagtacgccgccgggttccgcagcgacgagctcacgtggtacaccgccggccgctcctgcccggcctcgccggagtgcgccaccgccgccgccatcatcgcgttcaccaccatgtcccccgggatgacgtccatcaccaggtccaggtcgcccaggaagcacgacaggttctgcttcgcgtacccgatgatgagcgtgtcgatcgtccgcgtcccctgcatccaccccggcaccgggtcccgctggatgctcgtgatgatgctcggccgcaccaccaccacgccgccggcgccggtgatcgccggcgccggcgacgagctttgcagcagcatcctggacagcaccatctcgcccatggccttggtgaagacgtaggtgttggaccacccgaagtggcgcgccctggcgagccccagctccttcatcgccttcctccgcgccttgtcgtcgtcgtcttcaacctcccgacgcacgtcggccaccagccgaagctccgcgtccacgtccaggtgcatcccctctcgcagcgcccacccctcctcgaacgccctctcctggattagcccctcctgctcgccgcccgcgtaagctgcatgcaattaacttcaatttaattactaactgcatctatatatatatcgatcgagcttaattaatcagctgatcgatcagtggtgcagtgatcgagtgacttgactgaccagtggagacatggaggaagaccttgaggcccctgcatttcttggccaattggcacagatgcttcactcccagcacattcacatccagcgacacatcatacctgcatgatcatttcatcatttgcaaggcaattccattccattccatttcatcaattaatatataactgaattgaatggatttgtactatatttgaatcgatagtaccgaccgacctgccgtagaagttggtggtggcagcgccattgacgatgacgtcgaggttgtcggcgaggtgttgaagcaacgggggatcgaggccaaggtcgtcgtagatgatgtcgccggcgagggcgaccaccttctcctcgatgaatcgcgagaatcccttgccgtgcttctccttcaccacgctgaacagctccgtctccgtcacctgcacagcacgcatatgttttcctttttcacattaattaatttattaatcgcatcattttaattaatttcctagtgcgtctataagttaatctgcggcatgtagtttcgcagctactagctgtaaccagtagtacaagtgtgcagttatggtagtactaattaactattctttctaggacgtaagtatagtatcgtagagctaatacacagtgcatctgtgcatgcctcctcctgttaaacatgttgtcagtgtcaacatgcatgcaggcctcatgcctgtactcatggcaacaaacacacgatatttttcatttctttttactataatgtaccgggccttgtcagtaaatgttactggcagtagtggagtactaatttccggcgacagatatcggactcgtcttttcgcttatagttatatttattagttaaaatttaaatttttaatttttaagtttattttgtattttttattaaagtttatttttcagcctttacttttagaccaataagaacatataaaaaaaatattattcataaattattttttttataaatatgctgtttggctttttcccgaataagtaaaacgatagagccgtattttttttaagataatgagcagcttcgggcatgtgcattacaaggtgaatgcacaccgcaagtggggccttatatgtctgcatatgcagagtacagctagctctgcattgagtatttgagtaaagtgttgctgtgtaatggatggatagctggatatattggaccatacacatgaaaaatacagtatactagtaatgtgcattattatgcacggtgcaggttgcagcaggatagtacgcacatgctgcagtgaaattatttaagcaaggaatgaattcgactgcaggcaacaagcaataaccaaccatgcatggatatatatcgatcagaacagcatatgcatatgcatgtactatgtgcagctataggtagattacatatcacagtcttgggcgtggattaatttttagttcacgaaaagaaaatttttaggtgtgatattgaacgtttgactggatatcggaagaggttttctgacataaataaaaaaactaattttataactcacctggaaaccgtgagacaaatttattaaacataattaatccgtcattagtacatataggttactgcagcaattatagttaatcatagtctaattaggctcaaaagattcgtctcacgatttcatgtaaactgtgtaaataatttttttatctatatttaatactctacatatgtatgtgtccaatgatttgacgtgatgtttttgaaaaaaaaattaaggactaaacaatgtttcgatcgagaggaaaaaaaaatcgtgggatcgaagagatgaggcaacagctgcaacagcaaacctgccgcatgggccatcacctcattattactactgcataccttactgcttgacactgttaattggtgtgaattcatttttgactatcatttttttaaagaattacaatattgtctttatgaacataactagtatagttatatttagcataaaaagtaagtagtacttaaataacgaacctgtttagattgatgttattttaaactgtatcattgtttgataaaattgataaatatatggtatttagtttattacctagagaattccggcaacaccacatttagtctatcctattaaaaaggcaatatatgctgtcaacttactcaaaattttttagcatagcaaaaatttgaaaatgttcattttagcagtattctgaccatactcaataaattaattttaaaagatttttattcgtttggacgcccacgcctcatcatatgctagcttccaactaataatgcctacattctgctccatctgaaccatcgatcccttctacggatggctcagatcagacaaacttagaccaacctaagattcgtactagtcagaagttaatttttttaagacttcaccgtatgtcactgggatatgatgctctgcttggtagctctacactgatacacacgtcgaactgtttttcattgcggtaaattatcaacattcccatccttgcactctgtcacaactatacccgacactgttatttttcgaggaataaaataacaggataactataatgatttttaaaattcaattatatttatttatgttttccaagcttttaaattgtattttctaaattatatttatttcaaggaatgaaatgacttagtaaatatacgcttcccgagcttctaaatggtagtgtaaactttgttataaatgaatttaaatttgatttgcaattttataatatttaattaatttatttttaccatcgaatgatattatcacgaatcatcaacctattcagcgtaaaaggacatggctgtcacctctcacatagtcacatatcgaatcaatcagtaggcatgagaaagctacacggtttccatgcatctatatattgctaataacgagctgaatttcagctatatatgtactagtactaatacatgtttatttatgttcaaaagattagtcatatcaacacaactatagtatgaattatatataccgttgtagtaacttgtaagttcagcggactacttgatcagagcgagtgcgtgatgactttctatttttctaacattttaacagtaaaattagtagatttgcaacgcagtaggtgagcttattacctactgcttgtaagtgatagtgattggatgtgtcgaggagtacaagataagaagaccatgcagacaagttggtttcttggcagaccggcgaaaaatacagtaacaggccaaccaacacatattattttaacttacagaaactgatggagcaagaaaaaaattgacagcaccaactagccaatcaactgcagccatgtacgtattttaatactaggtgatatacgtctccttttaaattctacctccatttattttcaacagatgacacagttgaccatttttaagtttatttgactattggtccattctacaattaatatttatacaaatagatattatgtatacttaaaatacttttgatgacagatacagtggtactcttttcactttaattgactaaataaatgaatagtattgttagtcgaagtttgaggaaaaagtcagccgtatcatatattaaaaaacgaagataatacgaaattgattaagtacgtataaaaaaataggaagagatgcatggatggatgagatgaatcaacctcagattggacgcgttggtttgcagatgcttggtcgatggcgcgaacgagcaggtagatcttcttgacatcaggctgcaccctcagtatcttctccacaagaactgcactcatatgcagcagcagcagcaatgagctccatcagcaatgagcattcatatccagtccttgcaagaacaagaacaagaacaagaacaagaacaagatctagctagctagctagctactatatatatgcacacacaattaacgtactcttgccaagaaagccagttgctccagtgatgaggatgctcttgcccttgaagtactctatgatcctttctgcatccaacctatcagaagccatcattttaactaatcactgcagatagctagatcagctagcctctccttcctccactcctcctgtgtttagctagctatatggagtatatagcttaattagggatagagagatggcctgtgatatatgtgtgtgctgcttgctagctagctgctggcttatgaatgagaaggagcagcagcaaagctaagctaagctaagcaagcacctgtgactgtgagtgaggcacgcaagagggaggctcatgtgcagatatatataggcaattagataggcaaatcgatctcttgttgcttccaatataagctggaccaattcggtcaaaaaataagtaataaaaaaggagcaggattatcgatcactagtgcttgatcagacgatcacctaacatcctgctaggcgtgtcagagtattactggatcatctgtgcatgtgtgcccggaattactgaagagttaatgcagcaggagggagatagcgctgtccatatgcacagctgcagccgaagggagagttaaatggttcatcagtacacactcctgaaatacgactctctttttttcattaaaaagaaaaaagcctcaataaaatggttggtctttcacatgcggagtagcttctatggatcggtttttaacccgttctttaagacccctgccccatagaacaagaacctacccatagataagaacctacccatagatcgattcttaacatatatttttacgggagtcaacaagtaactttattttttaacttaggtctgaaatttgctcccgcgaggagtgcatcgaggatctagggatgatatttaagcattttaaccgctagattacaagtactttcgctccactgctaaattacatcacatagataactaatatcaatttttaatttgagaaaaaaaatggttacttaattacttcagtatccatcatatataccaaaattcaccggtatgagtttgataaatactaccgttgtcctaaaatgaaactttttctagttaggctgtgtttagttcacactaaaattgaaagtttggttaaaattggaataatgtgacggaaaagttggaaatctgtgtgtacgaaaattttgatgtgatggaaaagttgaaagtttgaagaattattttgaaactaatcacggcgttataaacttggataagttcctgtctatatttataaataaaaatgagtatctctagatttatagctagaaacgactttatttttggacggaggtatctttgggtgtgtttagttcacgttaaaattgaaaatttgattgaaattggaacgatgtgacggaaaagttggaagtttgtgtatgtaggaaagttttgatgtgatggtgttgacgagaaaatcgaacacaccagcctgggagatctgcttatctcctgtgcaggtccaaatcttgattagatgcgagcgtgccagtcagtttgatcctgcaactgacaagatatgcaaatagtagatcaaaacagccgatcggttgacaagccgatggagtagttctagccgatagccgataatagccgatgccgataccagccgatagcgatagggtttaagcaatcggctatatgtccaacgtagataatgatatgaaagcaatcggctgatgaggatgtaataaaataacaataatataatccgatagaaaccaatcggctagaaacaatatataataagcactgatctgaaggttaaagcatacatcggctggaggtccgatgtcattaaatccacaatattagattaaacaatgaaatctatgttgcgatcggctaaatctaacttatatgtatatgcaatccttatgagccgatgcaacgtccagataactcatcggctgaaaccccgatgaaacccttattggcagtcaaaaagcaagctagagattatggttctaagcatgacttagtagatcaaacttaactgatgcagcactaagtatgaaaagaaacacaatatctagacaatcaagccgttgactgattttcagggtggtagatgtctaggctaatctaatatagcaaggcgatttagccgataccggcagaaaccctaaaacgagagacagccgatagagctaaattgagatgctaggactagattaacatagacatatgataaatagccaggcaaatatattatccaaaccagagtaattcagaggtcgaatgtactgatgcagtcttgaacgacgccgacgtagacgatacaattgcctagaccgacggaacattggacttatcccttcgccgaagatcgaacaccgatgcagccccgcgtcaagtgccaagtcccgccggacgataaaataaagtagaaaatgtaaaaggtggcgatacgccgaattgtattgatcgtggagatagattacatagaccttgggtgtacatatttatatccatgggttgatacaagtccttgtcggacaagaaagaaactaacctaaagataaaaggaaaacataaagtccttatcggacactaaacacaccttcctaaagataaaaggaaactaacaaactattcctaattaatagataaactgccatgtcgcatcctctttaaactcggtcacttcgggataagcttcctttagtagattgatttccttaaccgaatatagcaggaatccgactattggcgacttgataactcccatcggctgattccgaaatgctgcagccgataatgattataagctgatgacgtctttgccgattaccaaatttcactgttaacagatggacaagttgaaagtttgaagaattattttggaactaaacacggcgttataaacttggataagttcctgtctatatttataaataaaaatgactatttctatatttatagctagaaacgactttatttttagacggaggtatctttgggtgtgtttagttcacgtcaaaattggaagtttgattgaaataggaacgatgtgacggaaaagttagaagtttgtgtgtgtagaaaagttttaatatgataaaaaagtttaaagtttaaagaaaaaattaggaactaaaccaggcctttgttattttttttttcgccggtcggcggcgtaggaaaaccccgaccaattatattaagaaaatgaggagatgttacataaaacaaccaacatgtttgttgtgaacacatcccaatcctagaacaaggaaaggtttttgccggcaaacgcctaactacatgtatacatggattttatatctcttcaatcgtgatgcctccaaagccagcagctcaccatgcccaccattcttcagaaatgcactaggagacctcggcgacggtctgactgactccttcaaatatcctgccatttctctccttccaaatcatccaagtaatcaagatgtttgtgtatatctttgttatctaaaatatgttgtttgtgtgtatcttctttctattggttgtgaatttctgattggtcaggaaaatcactgttttgcaataagatgaaaccatgaatgccgccagaggaccacattcacatgagcactgcagtcttgcctcctcctgctgctgctgcaatttgcaatgctgtatgtatgtagttgcaacgaaatgatcaaatcttaaccactgcagcaaacaaattaatcacaacgtcttcaatttaacaaaaggagtatgggccaactgaccagttcatacataatggtgctttccattgattctgatctctcagctgcctgccttaatctgcagttgacttcagtccaaccacactgtgttcgacttaactcgagcactttcgggaaggatcatttaatcttattgtacgtgctgcattcttccttcaaggcaatggattaattgaccactgtgttattatctgatttttgtccccactaataatcagaagaacaaaataacgacaaacaaaaggtatctgttacacctacctaatcaaacaaatgtaattctagaacttgttcatttgactagtttgaagttccgtatccgtatatccggattatccgcttcgaactgtatccgtggtttctttttctttgaagcgaacggaaactatccgctctgtttgcttctctagtttgagctatactagctaacaaaagcctggtttagttcccaactttttcttccaacttccaactttttcatcacatcagaactttcccacacacacaaactttcaacttttatgtcacatcgtttcaatttcaatcaaactttcaattttgggcccagcgaaaactttttttgtccagtgaaaactctcaattttggcgtgaactaaacacacccaaaaatggattcggaattcagtatctgcatgtagtactccctattaggacacagaacagtaagtggtaagaatgcatgtagtgatcaatgaacagcagcgtgattactccctactatgtcttgcttatatgataagcaaaattatttgacacatgctaatatgctattcaccctgctgctggttgctggcatgcatgccacagtaacaaagttgggctggattgatcggtaagcagcataaattaaaaaccaagtatatccatgggcaatgccattgggtagattggtgttgtgatatgttctacattaattatttaccatacttgggaggctcataaaattgtccagcattcagcaccctaaaggagaagtgaacactaaactgaacagggctggtactgaaaaactttacccgaccaacaaataatggcaaatcaacatatagctgttcaaccttcagtgtggaatatctatagttaattgatccatatgtaacaatcagttatgggtgtagcatatgcatttctgcacaatgagctaggtaaaccaaaatcatctttttatttggagcttcagttcagagttgggccatgcattatgaaaaacagagttcagagttgatcttaactgaacatggccaatcatgcaaaactgcatttccctcttgctatgttcctggtatttcctgtcacaaggcaggcaggaaatcaggaatgtatccctgggatcatgaaatttcagatagtataacggatcttgaggagtgcacatcgaaagctactgctagggttggtaaagtacaagaggaagaaggtgcagctctttgaatgcctcttgttgttgcccttgccattcttccactcctcatcactgaattcacaacttactattgctatgtcctttttatactactgataattgatctttacactgctttatccatcggtcctgtaataatcttgttcatcatcttaccagcacgatcaccaccgttctatctatctgttggctgcttggcataattctatttgcatttggtgagtagtagagtttaagttgtactgctactcaacaaggctgcaaaagaagaagacagagaatgtatgacaaagggtgttgttgtcaatgagtgattgcacgaaaccaagcatgtcgacacttgcgagcagcagctggattagctaacaacaagaggcagattggttacaacagcagaccctttttcttgatttcagcactggagactgatagttccatcagtaccactcaagaaactttagccaccaactgcatttcatgcatgttggatgtctgcatggatcacatcatcaaaaagattgaatgagtatgttagattgatactaccagtgcaattctgaagatactgttgtagcaagccccagtgtgtggtgccagtgaagcagcagcagcagcaagtaagacggcatgagatgcaaatgctgctagacctactcggcgtgccttgcatttattggcattattaggccggcaggggaaacagatttcctgaaaaataacaaccgcctgccaacaatgtgcatccaacttgcgctcctttagcttcaacattacagtaccatctttttttctttctcgagacatgtatatagcattgcgattcaaggggtgccattggctgtcagttttcacctctctctgcttttcttcctacctactcccctccattaaaaaaaacacttgatttcaggttcaaaatttatccaaaagacaatcgattcctatcatcttatatctatccttaatcgaagttttatcccttcaatacctcttacttaccagagagactatggtatttcccccttactagtaaattttcttaggatgactgaaaatataaatcttttcaggtcaaagggaggagaaaaataacataattccacttaccgggaccctgtttggaacacaagaattttgaaggaatcacgtgcaaattccgacggtaaatgtaaagacaaaaaaaaaatctgaggtccaagaagggaaacaatttgttgtaatcgcctccaaatttagacgtataataataataaatgaaatgatttattccatgacagtagctagcccaacgctattatacatttattctcctaagtaggaacaatgtacgagtatttaggaccacttttcctaagtctagtagtattatagtacatgtatgatgaacgagtccacctaagcttaggtatagccatcaacaagggccagttccaactgttcaagtggcacaatgcatgtgaccttgatttattgctgttctcaatgcctcagcagtgcagcaattgccttaaaataaattcagtgttgtgtgcagctaaacctgaatctgttgtacattgcagggagtaacatgttgatgttggccagctaatgcagaaatgctaccaaacctacaggttccgttcatttgggttcataacaacggacacaactcacccatttttcacctaaactccccagaaccagttgcaaatttgcatgcagtgtttcaggataaatttctggagtagcttgcatcaaccacaagagatataggatatggaaaatcataccagatgatggaaaggctggattgtagatgtgttcttgactgttctggtgcatgtcaatccaaaaataattcaacttgacctgagcaagatgataaacaaggcacggttcacattcatcccacaacacatggtttcaaacagcaattatatcgatattaagtatcgctttgttctcaacaacataccacaagccgccctaatcaaccagcaaaatgcaattttcgcgaaattgcacagctgttgcatttctaaacgaccgaaaaaaactatagctgagacaccagataacaacagatactacaaattgctggaaacggttgtccccatcacagaaactgagagcgactactcagtaatgaaggtgccaaagctagatcagcttgttgctaaacagctacagacatcccagaaacaaatgactccaagataaaagctaaacgagcatgttctacaactccaaaggcacagtagttgtgtaaacatgcagctccactgtcgcgccagtttaatgtttagggtaacaagcttggatttgctgctccagctgcattggaaagcaaaataacagatcagttctataaatggttaaggtaaatttgcatcgtcaggtcataagactagtaagatttgacagcccaagaaatcgaaaaatgcaagccagaattaaatgaccattttccattcagaaatgagaaagggccaaactggggaggtaaaagatcaggtctacccatattatgagaagaaaaatacaagttggggaccaaacaactctaggcctcttggaattatcccatagatatatccacacgcaaggatgggataaaataaaatagttataagacaaacaaggtttttgagtgcgatatctgtaagtcataattattaccacaccaagtggtaccacgtaaaggcttaagtacaaatgtagcactggaaatgacaaagaaaaaaaaccaactttgtaaagaaataaatataccatgttcatcttctgccaactgccattatctcgcatgctatttaatgcttcacagcaactataccactgtactacctcatatatgtgtcatgaaaagactaatgctattcattcagcaaacagactaatcattgttgattgtttttgtgtgttgcacggaaagtaacagtattaattccatcatatccaaccatctctacaatttaatgttccaatcataaagcaaaccttacaaatcacttccaaaccttacacaaaatcacttacttttaagatgtccactccaactcagtgcaacacaacagggagtataggatgtaatttgggaacgcaaggtaatacctgaagcatagcctgaaacttgttacgaagatcatagaattcagtcctcaccaaatccaaagtcttgaggcacctgataatggaaaaggcccaacacaaagaaggggacaattgtcacaaaaataacatattttattttaggctattacataaatgaagatataaagatcaatataatgtagatttagggccgttttggtttgaggccaattcctgccctaccaagtatttggtagccttgaatagtagtacttggtagccatttggattggaaccaacttttgctaaatctatggagttgagataaatctaccctaccaaaaaaattgtagtgccaaaacttgcccaagaattggcactacaaatattttggtaggatttcaaaccaaaatgaccctactttactgaatagctgcacaacatacagagaggatggaacaacttggttccactacaaatatgcatgctaaaatatttgggggcatattggacaacctgcaaaacgcaagagttatccgtcatgttgcaaccaccccaatgaccctactagcaaaaatcaaagaagaagcctcagcctgggtaaaggcaggtgcggtcaagcttaaggagataaaaccctgggaataatcgactagcagagtgtagtgttttttgggctggtgcgcgagcatcacatcccctgtttttccctttcccttttgtaaatgttttttgtcatggcccttctgctttattaatacataagtggcaaagcttttgccctttcttcaaaaaagaaaaaaatactgaaaaatctaccagttctgtataagaatcaaactatttcatttcaaatcaaggcatgcctgccatagagtttacattagtcacaccttttaaagtgattctattatcttggaaattggagtggagcaattacaatcctaagtcaacaggcagagtagaatcagccagttgttgctttccatgaagatatgttacaatagaaaaaataatgcaagaaattacgtcaacattataccacagaaaacactaacaataggaaaatgtaagaaaagagtgcactagatcatcgttaagatatgcatataacgatatgtgcaataatatgataaaaaaatgggaatactgtattaataggtactaacccatctttgctcctctgttggcaaaactcacggaactgaatgcaagtgttcttcactttctgagcaccaacactgcaaacatgcaaggatatacagtcaggaaggctcctcaaatgctttaatggaaagacgagcaacaaatttgattatatcttcaacaatgcaatattatcattgacctactagaaattctgggacgatgatattactatcagatttgcatgtttttattgatcatttccgtctggcttgtgagttgcctactatcaacaagatttaatatttgtagtgatgtgtatgaatgccaattggtagttccagttctaaatatataaggagatctaacatgaagaaccatggtgagttattttcatacataatttgattctgtagaataacactccagtacataaatatacctgaacccaaattgaataggcgaaaggatttgtttgtcaatttcttatttaaatttctgtttcaagaaaaaaaatctaatctggataaactccagacaacctgtttgaataggttcagtgtacccttacaaaatgtaccttaaaacatcattctgaggatatactgataaagagcaggattaaattctaggtactattaagatctggagcaagaagaaaatttgatagcacctgcagatatgaccaagtaaggagatctccaaaattcagtaaacaaatctcaaatggaaacatttttcttttgtagccatcaggaagatatcttcgggtatagggaaattagggatctcgaggaaggaaggtgtaaaggtacaaaaccatgactacaccaaaaggaaaaaaaaaaaaggcatttaaacaggaattttacatgctgtgtcatcctactactgtttgtgcatatggtgcatagaagctctgaaggaccatccatggtgaagtagtttatggtctatacacttaggaataccattagacccttctctcactaatctatgatatattctctagcagtctaccttttaatgaccaactaatctaaaatgtgataacactccgggtttgaaaaataacaaaaaatagaattctaagtaaaattagatacaatattcgtaaatatgaagcatttcaaactataggactctcacgtgtaaaccaagtcattttggaatggaggaaagttcttcgaaccattcaataagtgtgatggaacagaagcatgttttcagatctatgtcaaggaatgctggaacaatgaagcatatgacaatcctccttgaatagatctggagcaccacaaggaacaggagaatatgaatgctactatttgaaccgtctgatcaacatgggagcgggactgaatttgtcatatctacatgatagaatgatacagctatcaaacggacgacaacccatcccaaattgctcagaagggcaattcatatgatagaacaatgtgaaccgctgctcttcgaactgtccaatcactttgggtggaatggaccatttttgtcagattctacgccataaaagatgcaataatcaaacatatgacaatcctcccaaagttgactacatgcttcgcacaacgctttaaattctcccattcgaaagggatctcatacccaatttcgtgcgccaagtgacaataacagcaataattatccataacaacataaatttccatatccagaaaaggacaggggaaaagctcaccttgcgctgctccccttgagctgatgcacatacgagtccaccctgtcaaaatccacatttggcttctccctgcacacacacacacacacacacacacacacacacacacacacacacacacacacacacacacacgcagcaatcaaatctcccaaaccaaaatcaagccaatccccaacacgaacacgaacgatccgatcaaaagcaagcgaaacagttacacgcacagctgcctggagagctcgcagatgatccgctcgccgtcgtcgcagaagagcgtgacgacctcggagacgaagtccggcgcggtggagtcctgcagcatctgcagctgctggaactggtcgtccagcaaaccctaactccccaatacacacaatccaacaataacatcacacatggaaccccaaaaaaatctcgtcatccacacccggaattccgccaaaaatggcgcaaaaaattcgtaaaaagagcgtgtgaagcgcctcactcaccatggcgaacatgttgttgacgagggcgttgagctggctggtcagcgcggcggccgccatggcaagcagcagcggcgagctcctcactccgatcgggaatcggcggggcgagcaagcgagagagcgagagagatggatggaatggaagcgtggggattgggaatcggagcgatgcgacgggtgtgatttatatggggaggagtgggcattggattcccaaaggcaagttttaattttcttttgtgctgttgtgagctgctcttggaatttaattttaatttctacttaatttgaattgatgagcatgagctggagttggaacaataatcgcataaatttggttagattttatttccccagccctttcctataaaggaatgagcccttggtataggaatgattaaatgtgtatatttatttcatgtttaatgccggtataattcgtgtatatctgttcattactgcgatcacacagctatgtgtatgaagtaaattaaggtgatattaaaaaactactacaagtaacaagacacccaaagctgcctttttagttgactttagttcatctcaagcaacagcttggaggttttattgcataattaaaaagtaacaagtggcattttcacttgaaaaaatgtgccaaatctttacaattcgtataatttatgtaattacaaataacaagaaaaatagtagactttacaaattgcaagaaaaatagtagactactctgtcagtctcaaaaacataaatacttgagatttttacggatattaaagagatagtaaaattaaataagggattgttgtcactggttgagataagtaaaataggtgaaaaaaagtgatagatgattgtgtctggttgaggtgaaaaaaagttgctatgccttagcacaaattttaaattgtagaagttttaggaggggtgccaattaaggaactgtataacatcatgtgcactgcagtttagtgaatcgaagagcaaacatgagtgatgttgaagcagcaatctagttggtggatactataccaattagttaaggaactataacatcatgtgagtaccaattattttaccagaatctaacaatatcctatgattgcaaatgcaatgtccacgggtcgtacaatcctagatattcttatgcgtgctaccctgaattgtaaattctagcaataacgtaactataaatattcaaacttactagtaataatccataactccatatatgttttgcggtttagtgcattattgcaaatcaataacaaaagagaagaagcgagtactgataattagcaagctcgtaggtttaactatctgttgctgttagtaaaatccaataatatcccaacaacgtaaatgttatgccaaaggggctgtacaatcccatatattaatattttgtctatgacaattataagttcctacaaaaattataaatcccgatagcaacacaccgcgatagat

SEQ ID NO: 66761 - DNA, 17674 bp, Oryza sativa
gcgtctcgcgtattcccaaaaaaatgacatgagcaacatagctctggaaaaaccgatatgaataaacaaacattacaagttcacaaccaaaatttactaaaaagaacaccattcctcttttctttgtgggttaaagcttaaaggtacagttgagaactcaccgaggagccagtggcaatgagcaaagtgtcataggtaaaggttgcatcagctgaactggtcaatgtcttggaggcaagatcagccttgacaatttcggtgctcaggatcagctcgatacctgcaacattacaaatggaaacaccgtatactctctcattcagtttgccatcaatctgtcagaaagactgcggtattcagaaaatggtgacttttagcaattttatttatagaggaatatttttggccatttaaattagctggcattcctttgtttactcgaaaaggatcagagatcagaggatagaattaatgaaacgacacttgagttataaaatactactactggtacttttcaagttttttgaaggtttggttagcttccaagttagtactactggcagtctggcactgaaagcctgtgaattaatgtacggcaacgggtttgtgaagtgaccagaagaactcatggataaccatttcaatttgcaatcaacaaagtactctggcatgaagatcgaacagcaactgcagattgcaaattatatggaaaagaaaagagaaaaaaaagcagtaattgtacctttctcggaataccattcaggcaagagcctctctccgccgctcccgacgcaggtgtggaatcccggaagtctggctgcatctgtagagagaaagatggatcggaatgaatcagcagcaagaaatggaagagagtaattagtagtatgttgagaaaataaaataaatatgcagggcaggggaggggaggggagggcgtgacgtactctgaggaaagaggtatcccttgctgagagcaggacgctcgtagggagccacctgcagcagaaacacgaagaggaaaaaaaataattaggaattactagtccagtattcattcaggaaggaatcgatggatggatggatggatggatggtttaccgattccttggagatgatggcgagttccccgggcttgacgccctgcttggcgaactcccgcgcagcgtatccctgcacaaatcaaaatgaaaatgagttcatcgatcgtgtgagtgagatgatgtgatggccatgagaaggcaagcgcgtattgaagagagtagaggaggagggtggcgatgttaccgcggcgacgcctccgccgaggatgacgtaggtgaagtgcttcgcggccgccatgtcggagtcggagtgggacaagaggagggagacgacgatggaggggaaggaggacaggtgtggtggtgggagcaagggaggaaagcgcgcggcggaggcccggctctctcgctcgcttgctttttatacgaccgaaccgacgatggagtgacgaggcattagctcgatcgatcggaggaaggaaaggtttgctgcttccgtctcgtttcctctctctccgttcgtttcccccaccaaaccaactaattttggcgcccacgcggcgcgctcttgttcgtcaaacagcgagaggggcgagggcggctagtctcgccggcctagtcgcatagtacataccggatctacgacccagttgaccgttctcacccccacccgggaaaaaagggcaacaacgaatgcgcacacgccattgctgacgcccggtaattagagcacgattgatcaattattaatactccttcattgcaaaatactatagtaagataaaacacaatctgaaactatgaatgtgaacataagtacattcagattcgtgatcttaagtagtggtgtatttagtcttaggttgtttcattttagaacggaaggagtaaatattacaaactatcccaaaagttatcaaaggttaacatttatgcttgctaattactagtcctcctttcgctttcaacaccacggggacaaccaacgctactctactcctttcattttctaacgcaacgtcacagccaacactaacctccttgtgcaacactattacaataattgtagtacgatcttaacctcagtggacagacagcgtcagatgggaacacctagtagatgctcaggatgcctaacctcctctccgtgtccaggttcacgatgcacatgccccaccactgcagcaacaattctttaacccaattccagcacgcaccggccggccaaacaaacacgggattgggattcccccttccttgtctgtttacacgggcatcatcaccatgtcaacatcacaacgtcgaccgactcatcggttaatcaagactaccgaaaaaaagttagccggcgccaaaacatgacgcccgcgaaaagccatcgttctacacggcagctaaatgacggttactcagctcagtctaattggtatcagcattcagtggctagtcaaaataaaacttacgcccttacacccatgcatggaaaaatcgtccatgtatcctcatctaactggctcgttacattttttccattgttaaattgcaataccaatcccgtgtacagcaaaaatgttacagtcccattgcccttgggttatggatgggaaagctagttaaaactcggaacacatacctcatcaaaggcagtgctttctaataatatggtgctgcctctgggttgaggtttgaaggaccaactcgatgcaccacagcagcacataaagttcagaacatttgtctttcacaggcttgcaaagggtggaagaacctcatgcgtacaatgtcaaacctgcagaaggcacacgaaatgaccacatgagagcactggtgatacaagaaatggaaccgttctccatacagtcaacatgaaactggtgataaagaaatggaaccgttcttcatacagtccacatgaaaaagagagagagagagagagagagagagagagagagagagaacaatcccatggcaaacaggggataacacaaggtaataataaagagcaccactggtcactggatgcttggttttcctacaggttgtctagcaaagatgacctcctaaagtaaatttagaagtatttaggtctaacccaacaaaccattatgaaattagctttgataaccacataagtaaagcaggctatattcttaatgttgttgcaactggcagtattatcttaatgtatgtactatattctttccatccacaaatataatcacttctaggattttaacagaaaataaggtttaggtgaaattaatttgatgcccctgggactctacttgatagggaaaataccatgcctagaaatacaactaagtgagcaataaatgcagcggtggttggattgggaaagtagtactccagaaatgtacaaatttcaaatgctagaaatgcttatatttgtggatggaggtagtaggtaactttagaaaagggaacaatttaaaaaaattaatgttcacaagacatctgtgccagttaaggattagtttgcattgtatgtattttgtaggaaaacaccaagcaaagtcacttgttcaagacaatccccaaaacaaaatgaattatgaggttagattatggtatcaagagcagaaaaactgaccaattgtttgagcttatgtctttggaactgtaacgttcaagatcttcacatcctgatatggtttgtcattcttgtcggtcttgaccttctcgatttgcttttaagtttaaaacaaaacatattaggaagcacaataaaggatatgaaaattcacacacagtcactaagttggtcaaaaaggctggtacctgaacaacatccatccctttcacaactctaccaaacactgtgtgtttgttgtctagccatggagttgccacagttgtgataaagaattgggacccattggtatttggtccagcattggccattgaaagagtaaaaggcctatcatgtctcaagctgcaagatagccgccatagctgtcagttgtcactataagcatattcaaataggattattcatatggattgtgttctcttcaacaacaataagcacagtgcatgcaaaatttacatgactatacagatatctttcctggaccttgcatagacatctgtcatctaaacggtacataagatgaaaaactgcattgttttctgcaaatgagaaaagaaaaacaggaaaaggcatacaacttatataccttttgtgaaattcatcttcgaactcccttccccagattgattgcccaccagtgccatcccccaaagggtctccagtctgaatcataaagcctttaatcacacgatgaaatatgagattatcataataaccattccggcaatgggtagtgaaattctccacagtttttggacactcttctggatataatctcaagtgaatatcacccatagaagtatgcatcacctgaaataggaaatactcatgtaaataaatgcgacctaaaaaggaaaaatgttcaaagactatcccaccaagatatcaaatttccataaaatcaatagtagcaaattaccatttttagaaatgattgagaaaacataccaaattatcagggagtgatgttgtagcagtcttccctaaatctgatacagccaaaagctcttccggtgggggtttttcattgaaaacatccctacccttggttgcgtcttcaggctcctcaggttctctacgactgtataatgaaaaaagaggattgagaagcgggatattaaaatttaagaaaaaccatctggagagaaaggagtctacagaagcagcatgcggaatcagccaatacgacctatccaaagatcattgaattgatgtacctaaagagatatattcgatgcttcttgaaggcacagcatagcagcgttgggtcagataaaggctccttgctgtcattgacattggcagctactgaaggaatttttctaaccttcttattccctttatcaccttggtatagagcaatcctcagaaaacgttcattgttttctaccttccccaggattcttgaaaccttatttgtgtgcaaatttataatctgcatatttatgggaaatcagaattaatcatacagaaatatgttcaacaatagcaacatgccagatatttacatgaactcaacagctagataggagcataatgaatacaaaacaagctgctagaaagctaatacaaaacatgctgtttaactagcagctgatccataagatggaattccacaaggacaaatattttcttgagcaacatttatcattccgaacataaaaaataattatataaataactgaagtacatataatgatatcaaacacatactacataaaagaaaagatgtgcagtaaaaaaatagcatacctttatgcccaaaagggtagcataaataagaaaattgctgctctcatcaaatacagcattaggctgtggaacattttcggtcttttctatttccttctcaacagccattcttcgcccaaaatcaatagcatcaagacgatacatcgggatatcacttttctgcagatcttgtgccacctataattgacagcattcagttggggattataacagaacatatttatctgtaccatgcattgtacagatggaatttcttacctcaagggactcatcatatacacgtcttagtttcccagttttgaaccaaaatacccgtatcctacgatcaggggatgtaacaacaaattgagtgccgtcattgctcatctggacaacacaagctcgtttatcagagtaatcctgtagctctatcaataatgaagcaacaaatgcaaataacttgagaatcaaatagaagaagtacctcaatagcagacacgctagtcttgcattttgcgatttcaaatagatttgtgtctgtttttaaacgaaagttcaccctgcacaaaaaacaaaagcaatatgcattgataagatgatggattgatgcattcaccaagagggacagaacagctgttagcacatataaatatagccattacaaaaggaaccaacccagagcttatacactgccagagtgacaggtgaaatgaaaaaacaatccataaatactaaagtaggataatatgttattataagaaacaaaagtgaatcagaaaagattttaagttaagtgcatcttcaccaaacataatagtacctaactttttttaaaaaaagctggttcgttgattaattagcacctaggattgttccagctgcagacttaacagaaaaggaaatggtaggtgtaatcatggctcaagtacttggtggttcagtgcaatgttttgggaagacaaaaccacaagctacacaaacgttgaaaataactccaagagagaaacaacatacgcgtcttctggaaatttgagggtagacggagaccagtattccaagagtcctttggcatcagcagatatcacaacatcgtgaacatggttatatttcataacctttactgggccagcatgaatctgcataaagaggcagctcatgcagtaagaatcatttagttactttaattcacaagaaatacacatcgacacacagaaagcaacaacagattacctctttggagatgatgggatcgtttgaaccagaatgagtatcatatatgtgaacaaaaggtgtattacgatcactaacagcgagttttggtttaacatctccttgtcgataaacccactcaattgcacccggaacgaatgggagacgcatcatgaacatcatgtcataattcacaacgtcatatatcttgacagaccaatcgctggagatcgtgcagcaaagtaggccatcaacactcacctgcattactgaatcacgctataatttgaggttgttcatagttccataggcaggagctgtgactaagagtagcaactagcaagataaatagactaatatatattgcgaatgcaaatgttttccctggattagggaagtcaatataagaatctgaacactcacagctaggccttcaatgggactgagatgagatcgaaaatgtttagcaaattcgatcccagctggtttcttcttccaaaatttcaaatgtcctgggtagagaggagaaaaggatggtaattaagctcccattacatgaaaatgaatcagcttattattgaatcataccacaggatttgatcaatccatagatctaaaagtttttcaaccaatactattacgcaagtctatcaagcccgtgattatggttcagtgaaggactatcccttatgtagaagggcttgacatttccacaagataccatccgaaatctaacacatgctgccacaagctaacaaactaccacaaaggcacaaaccactagtatcgcacactgaatacggtacgatgcagagacgtgagcgcgagagattaccatctgcgctcccggtgatgaagtagtcagcaggagagacggcgacgtgggtgacgacatcccgatgcatatagctcttctcgtacctgcaaaaccaagccacggccgtcagcctcccagccgacgcaccccctaccaaatccgaacctgaaacggcgaggagaacactcacatggccgcggagggcagggcgtcgaggaaggcctgctcgaactggagcgggcgcttcttcctcggccgcggcggcacgggagccgggccgatcatctcctcctcctcagccgccgcctccttccccacggcggcgggtgcggctgacacggcgccattgccgttgccctggtcgcgctccacctcggcgtcgtccgtggcggtcgttatcgtggagctcgccggcgcatcgctcgccgtcgccatctcgaggtggagctccgctagggttctggggatttgggggagagaagtctcgactcctcgagaccttctgctccggcgacgaggagcaattatttgtgttacgaaactaataatagggggtttccagaaaaacaagtccctactctccgcctcgattctagccgccaatggccgatctgacggacacagtgacacgggggattcaaatgaaaagtaaattcttctcttggggttttttacgcaaatgtttacaacagccagcccacaggccgtaacccacggcccatattaaaacggtccagtaggcccaacccagttagacgaattcctcaactggatcgagaattttctgtcctttttttttccgaggattattagggagttttcggattcgaaagctccagtacaccgaaccatctccgcttccgcggcgcgagccactcgtcgctcgaattgcccccatccacacagcttcccccgcgcacgcgagagggaggagctcgtggcgccggcggccatggccggagcagccgcggcgagctccgccgcctgctcatctccggctccgaacccgacaacgcgatacccggttaggaggcgcgtgccgcggcctccacttgtggcagccagtcgtcactgcaccgcttcaccttttcccactacaatctccatctccagctcgggtctcggccaggctcgtcctcgcgatccgtttctaaaccctcgccttcgatttgcggctgcggcggcggcggcggagggggagatggctgcggaggcgagcgccgcggcggcagagggggcgcaggcgaagcccttctccgtcctcttcgtctgtctcggtaaatcacaccaaccctagcttcttatcgtctcagcgatgggccatgaactgattggggaaccgcttgatagcgccactcgatttgataattgtccatgtggattgaagttgcctgtgattgcttcgtcccgctgattttgggtgcttctgcgactatcagccctagtgtgtccgcaccgtgcgtgcactaattcggggacggcattttatctctccaatttccccatcgcgtttgcctgatttctccattggagtttgtccgtgatagtattatgcacattgggaagtgtgggagtttttctggctgtacgtgatatggttatcaagttttacggatatgctcgcatgtgctagtattagtaagcaccaggatgggttctcacagtttttgttcagctcaattcggagattttggtcagttggaataccaaaatgcattctctcaagggttatgtgtgcactgtataagttgcaatttggtttagggactatctgctttcagttgttgcattattctgatcatttgattacgacaatctgttccgtgtagtgatatatagctcagacttcacagcttcaaatttctagttgcttggtttatcaggacgagctgtataatattgtgtcaggtgcttagtacatgtgaatttcgacatctttccatgtacaagcaatgtagtgtttgctttatcagcgtataagattgtgcgctaccttctttgacatgtttatttgtctgtgtacgtttgcatgttttcacgtgcattggtgcgtctccccctgtttttcagaaaaaggataaattcaccccactgccttatcttacctatgtgtattacagcctgaaacgtgtggtgtttgttgcctgtgttgatgtaaattgtgtatacaggcaacatctgtcggagccctgcagctgaggctgtgttccggaacctcgtgagcaagcgtgggcttgagtccaagtttctcatagactctgctggtacaattggttaccatgaggttgtattctgtaataccatgcttgtttgtacattgctctgttcagcgatgacatcatcattgatgaggtgttgcttggattcagggtaacaaggcagactcaaggatgagatcagcttcaaagaagaggggaattgaggtgacctccatatccaggcctgtcaaaccctccgacttccgagattttgatcttatccttgcaatggataggcagaattatggtactctctcaactcctctcatctgtgtttcggtacctcttttttttattatgttcagctgccttatgtgcttttatttggagcaatgtgcagaagacctactcagttcatttgagagatggagacacagggaacccctcccagacagtggacccaagaaggttagaatgttaatatgttataagagttcttgactcatttataacatgagattatttccccaagttctgtgtgaatttgctgagtccaattaattttccacaaaattcctgtattgcaaacattccattaatgttcatcctgcatatacttgtttgatcatttctatttttaattttgttgtcttaaccccagaacctgaggtcttacagagtttaggcatctatgggaacccaaacagcatgttatatgccgttatatgcacaatctgaagtatccacatttgctttctcctaatacatgttttcccctaaaataatcggtgatatgaccaattgaccatgccctttgtctttcaatatgacatggaaggtgaagaattaatatactgcaattattatttattcccctacttgattttctccaacattccttagcatgtttcacttacagtgaagtgcactttctaagtttgtttcgggcaaatgctgaatcatcaatttctacaaagtagtctcttgcattgctcttgctccagctgatgatggctactttgttctagcaacttgactgattcaccatatctacgagttagatttcttttaccagataggcagatactctcttatttctggtagaggggtgaccacatagctgcttgataatggatagtgtctggcctagcgtttattctctttctgacacccttatacaactttacagtagttagttatctcatactgcaatctggaagtccagttaagcccaaactcaaccaaaccaaaaaaaaaaaatggcaatccaaaaattagtcacccatttggtttgtggccaataaatgggcattgccaaaatatctggcttggttgaattgagtacattgccaaaatgcaacatgggtaggcaagcgaaacaaaagcccaatttttccaaaattttgacaatacctattcctgacattgccaaaaatttggcaaggctaagaatggataagaaccaacatgccatatggttaagcagttaagctgatgttggtattcatgcttgaaaactaacacatgaaatgttctttttacctttactaggttaagttgatgtgttcctattgcaagcgtcatactgagtcagaagtcccagatccgtattatggaggccctcaaggatttgaaaaggtgagatgatgaagtgcacgattgttttgaagtctgcaaattacatgttagatatgttccatttttctgactgaagttagatatgtttcattgtttgacccagtggggatgaacatgagcatccatgtgtgcatgacagcatgaaacaataaaataatgttttctgttcaagcatagtattttatgcatgaaagtgtacctccagtactgacctatgatcttcattagctctgcccaaagtctttgggcctgtttggttggtgccctcactagcatgcttgagaagcatagaagaagttgatgaaaattcttcagcaaggcttctaaaacatagtgtcaaatcgtagacaactttgagccttacttagtcctttgcacaataattaattgctctaaaattttcacctttgactatcaagatcataaacagaataacatagagtgtgatccgtgaagaaattttgaagtgatccttttttagatatatagatgaactcctgggtttaaggcattgttcaaagtaatcccaatggggtagtattagtagctaagtaatattatcagcaaaaatgaaagtcggatttatttaagtttttgccaatgttccttcatttccttcaaataagactgttgctgaatgcctgattaatattctttcatgcatttgacttaatatggttcttcctcaaaaccattaagtgtactcatagttccttacgtgcaagcaacgatgatgttgtctgttgtgccgattatacgaggacaagattttacatgagaaagatatgcgtgatgtacattctccagtagtaacctatctttgcacaatgtttttcaggtgctggatctgctggaagacgcatgcgagtcattacttgacagcatcgtggcagagaatgcaagcgtttctgcttgatctcaatgaagctatctggaggcaatgtaagcatcattttttctatgtaaccatgatcagaatctatctatgccatttgattgcgattcagataaccagaaacactcacatcagcatgcatgtacccatgttcatacaatgtcaggctggagacatatacttatatctttcatgtacaccatgatttacactgtaataaaatcaccaactcgaattagagaagctgattggcacggactagttttgttagtaacacattgcacatacatactgtccagtgacgtcacgtcaccggcggtagcattgcacgtgcaggaagaagccacccctcgccggcggctggtcggccatccacagcctcccctccttctccgccctcgccctcaccatgaactgcgcgccagctccagctccgccgccgccgccgccacggccgaaccaccagtcgtgcacgtcccacatcacgtccaccacctcgccgtcggcgagcacggcggcgcggttgccgcggaacccccaccccaccctcctcacctcagccaccctcttcccgtcgatgctgacccgcacctccccctcaccgccgccgccgccgccgcgggtcgcgtgcaccgccacctcgtgctccgccccgccctcccggaacctgcaccgcgtggtgtgcgccgtcgccgcgccgcgcagctgctctcgccggctgaggacgacggcgccaccgccgtcgtcgccgaaccggcgggagaggtcccgcgccgcgccgccctcgccgaggagcagcgcgagctcggcgtcggcgacgacggcgaggtagtagtcgccggtgggctcgggggacgaacccgacgcgtacgtggcctcggcggtgtcccagtggacgcccacggccgtgccggcggcggtggcgagggaccggctcccgcgcttcttgtgcagcacgtggtgggcgcacctcgacgacggcgagagcgcgtcgtcgaaggcgacggcgaggccggtggctccggcggcgctccgcgtccacgtgacccggatgaggagctccttcccggagtgcagcgacgcaccgtacaccgtcgtggtcgccgcctccagcgagcgatccagcgcgccgccgccgccgccgccggagtcaccggccgcggcggcggcgatgccgaccgagctgtcgccgaagcacgacagctccctcatcgcctccggctttggtttttcttccggcgagattagctgctgctgctgcaataaaatggaatgcactatgtattgcgcacgtatgcgaggggaagaagaagaagaagaagaagagaccaaaaaagaagatggatttgattcgagacgcgttgcgttttgatctgctactctacttgtgatgccaaagtcgatgaatataaatttgttgcgaatttcttccttcttgtttatattggcatggtcgtgtggtgagcttgcagagagaggtggcatccgaggaattgattagtcgattaaagtatgcacgtcaatggccagcggcaaccaatatctgcaggtctggtcgatttaaggatggatctcatcatctcctatagatgtatggttggttggtgatttggacaaactgtacacacccaatgctagctgctttggccatctgattgataatcctcatgccattggtggcactgctacttccagtttttctcttgtatcttaccacacgagatcacatgagatagtgaggtgttaaccttgacatgctgatgcttacatcagttgggaggacatgctttcacggaaatttttaatcaacacgcaatcgctagctgtatatcaaggtccagttcgattatgggcaagtgacaggacgatcgtatcatatattctgagaccgacctgatgctcttgacaccctaacccctaaccatgcaatttaattagtatattccattgagatatattgcactgtttgaagattgctacagcgggatcaccatttagatccctcctaatcaagtggtgatggacagagtaagcatgcatgatgatttcttgcaataatccctgtaacccaactatgctgacagcgtgttcctgcctaccatcgcttcggcacatcatgattctgcatccgtgcaataatctttcctagtcttgttctaacacttttttatgctgatgaagacccccaggaagttggttatgtttggttcttcacaaaatccggtttaatgaaattttgctgtttttctttttaaataagggttatggcatcaatgatgaaaaagaatattaataaccctcgcacgataaaaacgaaagaaaaaataagtcaattttgcctcccttgctattggttgaatctgatttgtatctctcaagtctgaaccgtcgtaaaactaggtatatcaccgtctcctctgatactaaaatcagtttagaatgactcactcggctattttgagattggttttggttgatgtgatgcccaatcaaaaaaaataaaaagtactacctccgttctagaatataacaactattggctatgaatctggacacatagttgtctagattcataggtaaaaatacttatattttaggacggagggagtagacgtgagccctcctcgtgtaagtgactattctatccgtcccaaaaaaagacaaaccctggtttccgtgcctaacatttgaccgtccgtcttatttaaaaaaattatgaaaaaaattaaaaaaacaagtcacgcataaaatattaatcatgttttattatctaacaacaatgaaaatacgaattataaaaaaatttcatataagacggacagtcaaagttgaacacggaaacccagagtttatcttttttttgggacggagggagtacttcccatcttcatagggccacatgtatacatcctctccctctcccctctcttcactacatgactccatctctctctggcagctctcccggagaggactcaaaacagacttttcccaaaataaaactaacaaatatgtggaccgtattatgatgggccgacgctgtgaaaatggaaataggaatgtaggaggaaggaataagttcaccattagtccctcatgttgatgtcgaggttgaatcacatccctaaaccgtaaaactaggtacaacacatccatcatttttcaaaaccaatacaaaatatagtcctaagataatattgaaagcggttttgagtgacatggcgctgatgtggcacaagaagaaaataaaagataacacgaaaccccacatgtaagtgaaacaacgatcttttttttttatcccctttctcactccgtcaggtggcggcggcggagccgcgtggacgacgaggcaaaccatacgggcagtgtggatgttgacatggctggtgacggtgatgctcaagccgaagcacgatcatcgagctgtttcacttacatatgggtcccatgtggttatttatttatttttgcttattgtgccacgttatccaaaaccaccttcaatattgtctcatgactatatttgtaccgattttaaaaaataagggatacgtcatatggtttaaggatatgatttaaactcgacatcaagacgagggacctaaagtttacttatttataggaggaatgaagccactgcagtgattctaacgcctaagcagatgcagatactatttcaattttttctggttgatcttttttattgaaataaaatttctagctgaacattattattactagtacaattttttttttctaaatattactagccatcgattgtgccacgtgatggccggaccaccgcccacttgcacttgctttgtcgttgcctcgccggccatccccggaaacgagcggccggtggacgcggcggatactcttcttcctcctcccctctcctggtcaggtcactggccagtggtcacagctcgccggagaggaagacaagcttgtggtggtcgccggccgattggcaatcattcggcaacgacgaccgatgctggttcagccgccgaacgccgtggcggtccgggcgacggcggcgggcaaggagcccctcttctcgttcggcgtcatcgccgacgtgcagtacgccgacatccccgacggccgctccttcctcggcgtcccccgctactaccgccacagcctcaccatcctgcagagagccgtccgctcctggaacgcccacaaccacaagcatcccgtcgccggcggcggcgtccgcttctgtgtcaacttcggcgacatcgtcgacggcttctgccccaaggacaggtcgctggctgccgtccaggccgtcgtcgccgagttcgaccgcttccatggcccggcctaccacatgctcggcaaccactgcctctacaaccttccccggagcaagctcgtgtcgctgctcaggatgccgtcggggcgcgcctactacgacttctcgccgttcccgggctacaggttcgtcgtcctcgacgcgtacgacttcagcgccgtgggatggccgcgcggccacccggtggcggcggcggcgaggaggttcttggacgagaggaacccgaacgcggacaagaacagcccgagcggcctcgccggcgtggaccggcggttcgtgatgttcaacggcgccgtcggcgaggcgcagctgcggtggctggacggcgtgctgcgcgggcgggcgcggcggcgggaggcggcggtggtgtgcagccacctgccgctgcaccccggcgcggcgtcgccgtcggggctgatgtggaactacgaggaggtgatgcgcgtggtgcaccggcacggctgcgtcgcggcgtgcctcgccggccacgaccacaggggcggctacggcgtcgacgcccgcggcgtccaccaccgcaccctggaggcggcgctggagtgcccgcccggcaccgacgccttcggccgcgtcgacgtgtaccccgacggcctgacgctcgtcggcgccggcaggatgggcagcacagacatgcggctccagctccactccccagtgactgagctcagctagctaagctaaatcctctctgctgccgccattgtgctaatgcaactgttgtaatagtggcaatgtgattgacagcacgtttcatgcatccctaaaaaaaaataatctagtgtccaattgatgtctcgtcgtcgtccatgtcgcgcggttagaaatcaaagtcgttccgaggaggaagacgagaggcagcgtgggcccggttcggcatagagggggatgcggtgttgaccagtccaatttatccacgtgtaattttgctatatatttatcaataatttttctctaaaaaaataataaatattgtaaattgcatgtaactataatgtaacttatatataactttcatataattttgaaccgttatatttgtttcaagatttgtgcaacagtgcaagtgaggaattaaaagtcacggcgtgtatacatgtgagatgattcgtctctacgacctccgtttcaccgaaataatatattacggagagagttctacaagtccctccgtttcacaatgtaag

SEQ ID NO: 66762 - DNA, 3992 bp, Oryza sativa
acttacattgtgaaacggaggaagtatattgtagttacatgcaagttacagtgtcattacatcacaattgcactaaaattatactccctccgtcccataatacaagagattttaagtttttacttacaatgtttgaccgctcgtcttattcaaaaaaatttgtgcaaatataaaaaacgaaaatttgtgcttaaagtactttggataataaagtgtgtgtgtatatgtgtgtgtgtgtgtgtgtatatatatatatatatatatatatatatatatatatatatatatatatatatatatatatatatgcgcaagcacaccgtactgcggactctagcgacgactagcatcactagcctctccgaggtgtgcatatgcaccatgcgactgcctgggcaaagaagaagataagattgatatgatatacacgacataagaaataattaagtagtactaaccacatgtattctggtgtctcagattgtacacaggatctgatcgatctcgtatggctatcgccgaatgcattgtcgccatcgaaaaggctttgcgcgagatcgacgagtgattgatgccgcctgggttagttcaactattgctgcatcgcaccgtcgactagtcccgtcccgtcgcgccgttgccttggaggacgatgacctgcatttccgccacacgatgttgccgatcggtctacaccgccgccgcgccgcgcgtgcaggccgccgcgccgggatcacgccgtcacctgcaacgcagccatggatcgacgatgaatctcgctgctgttgcggaatcgacgatgaatcgccgccgccttctccgagttctattatatcgcggtctctcctagtgacctgattttcggatccgatgcactggtggaacgaggaattgtactcaggtcattccggtttccgtggctaaattaaggggtacgtaatttttttcttgtcaaaaagttaaacgggtccgctcgttaatccgatatcaggatccatcgaagctaatcacagatcaacggtggatgatagcaggtgtacatactcccatgtgtgtgtgtgtatatatatacacattaacatcaatataaatgtaggaaatactagaatgacttacattgtgaaatggagagagtatgtcacaaagaaaataaataataattctaattttttttgaataggacagagtatcttttttaaatttttaaaactttcgaaaatttgtgaacaaatgtattggtgatcccatccacacatcatacggcggttggctcatttcctttccaagaaatgggccggaacggacagttggacgtggaaggcccaaaatcaattgggcccagtaaggagcccaccctacgttgcgcggcggataaagagggggagggcgacgagcgcctcaagctccaacagtagcgctagcttatcccctcctactcccccccctcatcctcctcctcctcgctcgcccatggccatggccaccacctccgtcacctcgctcgcgatggccatggccgcggccgcctccgccgacgccacccaggccccgcacaagctctccgccctccccttccaccacctcctcttctcccgcgcgccgcccctcctccgcgcctcccgccgcctccccctcgcgcccctcgtcgcctcctccgacgccgccgccgccgccgaggccggcgtcgaatggagcgagacggaggaggccgatgagggttcccaggaggaggaggaggaggaggtggtcgaggagcaggcggaggcggaggaggaggtggtggcctccgtggaggaggaggaggaggaagcggtggaggaggagttcgcggcggagccccccgaggaggccaaggtgtacgtcggtaacctgccgtacgacgtcgacagcgagggcctcgcccagctcttcgagcaagccggcgtcgtcgaggtcgccgaggtgagcctactcgcgcgccagcccacaatcaatttcccccttcttctttttaacagaagaattgcaagatactattgccaattgcataaattctcaaggctcagtatttccaattacccaattattgtttttatttaggtcatttacaacagagagacagggcagagccgtggatttgggttcgttaccatgagtacgattgaggaagccgacaaggccattgagatgcttaaccgctatgtgagtgcatttctgaattgtcgtttcttaatccattgaagtattttattttcacaattttcaccattcgcacatgctgccgttacacataaaattggaagtaccttgataactgaaacaatttatattatctgatcaaagggtaaaattatactgttggtacatctcatttaggttaaccattgtgaaatgttcccatacccgatgaactgcgttcagtaaaactgagctcgaagatatttctgtcatagtgataaaatgatagtacagaagaaattgtataagttgcacagtgttctcagctgctggctgataaatttatgttttacaggatatcaacggaaggcttctgaacgtaaacagggcggctccaaggggctctcgtgtggagagacctccaaggcagtttgctcctgctttcagggcttatgttggcaacctgccatggcaagtggatgactctaggctgctgcaattgttcagcgagcatggagaggtggttaacgcttcggttgtctacgatagagaatctgggcgttctcggggatttggttttgtttccatggcctccaaggaggagctcgatgatgctatttctgcccttgatggacaggtgaggacggcaccatctacattaagcatacacttgaatatcaccattataacgagtatggcaaatatggaggctctataagctaataccgtttcttttatgcttcttttattatgctcaattgttcatgatggattacaggaattggatggccgcccacttcgagtgaatgtggcagctgagcgaccacagcgaggcttttgattccatatggcgttggggagcatgtctgcacgtttgaacaagaatgctaaagtgttatgcgttaaggcggaagctgatggttgtcatttacagagcgcgcgttagcttcctgattttgagtcctcccgtcctttttatgtgtcttccaagctgatgttatgttaaattattctcaaaaatatgagttcaactttccaagtaggatatttataatgatgatgtccttagtattttttttccgtgataatccaaaagttcacttgtcgaccatatatctgagaaaaggagcaaatgcatggcagcagccagtgcttacccctatgcattatgcttattttttctctttcagaaatgttgttctctggatttgcaagaaccaaatactttgataaactattgttcatataatgcacaggaaaccacaatagtcatggacactccaatccctttaatgtcacaaagctgatcaagtctgcaggatacgttacatctaagccaaccgtgttgtgaagataacaaatatgtcatgcacattgtagtggaaacaccattagaggcaaaagagatcaacacaagcacatacttccatgcttcatgacgaaccaacatccaacattgttgacaagcaccaagcgattcacacatacggtaggaccaatttatgtacaataataacatcttgatgtaactgggatcacgcattgaaggttttacattcagcagaatattatggtagtgcattcagttagcctgcagctgcgcatccttgcttgtgaggggcacatagcgcacagccgtctcatctcttatgctgaccttgccatcctggttcttgtccaccactttcagctcctggaacatagtcccaactgggatcaccattctgccaccgggctttagctgctcaatcaacgcctgtggaatctgcggtgcagcagctccgacatggatggcatcatagggtgcgagctctggccaaccttctctgccatct

SEQ ID NO: 66763 - DNA, 6199 bp, Oryza sativa
aactgctcgcccttctggtccaaccataatcgcgaagcaagctgttaggtaccctgtgcctgttgaagttatcaaagatacgtaaataagcaatgcgagttgacaaacatgtatagaaatttgctatctgttgagcatttcagctaggaaatattaaacaggtcggcagtcctgaatcaatatttaattccataaatcagtatgacagaaaaaaagatgaaagaaaccaacattactactgaatctttgtggtatagggtaggggccagcccatcatagaccacatgaatacataccctcacggaaaagctgtgagatgaagctaaatattgttttttccacatatgttggcaaacatttctgcatttcaaagcctaaagtgtgcagtgataagtacatctattagataagatactactccactgacagatcttgggtaatgataaacctatagttgaagttgtaactcaaaaacaaaagcaattctatattttggcacttaagattcataacatagttttgtgaatgagaacatcaaaactcaaaagtgtttctgttgtgatgatacataattgaaatgatattttaggagcatagataaaacgttgaagtgattgagcgaaactgaatatatgagatacgggagacctgatccaacatccagagcacgcatgccaggctgaaggtgcttctccaggagctccaagcaagaggcgtgcatgtgaggcgcagaaatggtggcgttgtaaccgatgggcatcgggctgtcgaaatagggagaagcaccaggaggcacaaacagccccctgtcgatggtctccatcacctgcgcgaccttgctcgacttgataatcccgtacctctggagctgctcaaccattgccttgttcttgtcgctagccccgcttgaccacagtcggtgctgcaacagtatcagcaccaggagcaacatgaaacggttcttcccagagaaaaacagcaacatgagagatgaggcatatgagattgaaatcaatccccttcaacgctctaaatggcactcgacaactatggttggcacatacactgaaatttgttgtagattatcttatcttatgtgaatcaagatcatcatcaaatatcccaaaggtacaaaggaactagtaacaattaacagtcggcataaaattctaattcaattcgttgtaagtccataatcaaatgttggaatcaggctgccggtggtgattagaattaacaataactgacaaggttttagcctaaattatggagaactctccccataatttcgctaattactagtaccacaagaactcagactagcgagtaatatagccttattaggactggatcaacaattaagcacagtaaaatcacaattacgtactagcaattaaagaagatactcacggagcccgcagatgctgaggatgatttggaggaggaggaggagaagcaggaaaagatgtagcggagtacctccatggcgaaagtgagagaacactcgatcgggtggtctctcctggtttaatcttaatcttggggccgattgggagcgcgcgggtgggtcgcggtgcagctgcctttgccggtgcagcggcggagacgtgggggatgtcgccgcgggaaccggattcccgccgcggcagtggctggtggctggcggtggtggtgggggattgggagagagagagagagatggattcttctcaaaccacctagcgagagagaggtgtaggtagcttgtgggccgattttatgggcctaatccatgggccggaagagcgttcccatgggctaggcctccatgtggccgctcgtcatgccaaacctgaaaccggcgccgtttcttcccaacacaatagtctttgttccggtaaaaaaacgcaagagttttgtttgagaaaactaaaattgatagatttttttaaaaaaaatcattacagtctaagggtacgaagtacgaacaaatgaatctttagaccagcactctaagaaaattgttatgtatgaaggacaccatttataaatttaagaagcgtgtgcaattttttctaagagaagggtatttttttactcggcctctatatccaactggatatatgcagcattttttttaaaaaaaatactccctccgtttcgaaatgtttgacgccattgattttttggcacatgtttgaccgtttgtcttattcaaaaaatttaagtaattattaatttttttcctatcatttgattcattgttaaatatatttttatagacatataattttacatattttataaaagtttttgaataagacgaacggtcaaatatgtgctaaaaagtcaatgatgtcaaacattttgaaacggagggagtagaaacttagtttgaaattcactcctatggagatttaaacttaggaccttatgtgctacacagaagtgtgtgcaaatgaaaattgaaaattagaaaatatcggacaaaattcatacttaacaatctttttcaaattaataatcaataatcattacacagcgtaaacataatcgagctagattgcaaaaaatacgagcatgcaatcaaatcaactacaggtgattaaattaacgaactgcttattttgttacgacgtcgatcaatcgcctccaaacggtagccagttactgttgtaaaacacacaattaaatgagcttagagttcgtcgtggtggcggtgctcctcgtcatcatcatcttcgtcgtcgtcggtgaccttcttgatcttcttgggcgccgggttcggcgaggtcttgatggggtaggatgcttccatggcgatgccgcagagtccctccttggcggacacgtcgcgcttcatccggatgtagcccttctcaccccagtctgcgccccacgagttcctgacgatccagtacttggtgccgtccaccgtcgtgccgtagcccaccgccgccacgccatggtcgagctccgtcccgcatttcccggcgaacaccccctccgagtagaactggaagtgcgagccccccgcctcgatcgccaccgacaccggctggttcgccaccgccttcttcagcgccgactccgagttcgccggcacgtcctcgtagccgtcgatggtgacggcgggggacgacgccgcggagctcttgcaggagctctggcgggcgcggtacgggtaggcggaggaggcggcgacgccgccgtgcttggcgatgtactggaacgcgttgtccatgaggccgccgtcgcagccggcgttgccggtcttggtgtcgcagtcgacgagctgctgctccgacagcgcggtgaggttgctggtgcggatggcgttgatcccttccacggcggcgatggtcgagaacgcccagcagctgccgcactggccctggtccttgaccgccccgacggcgcccttctcgcgccagtccaccgccgccggcaggtcgcgggcgccggcgtacatgaagccgctgcgcctctcgccgcggccgcggaacatgcggtggtgggagacgcgggaggaggcgtaggcgcggcggaactcgtcggcggtcatgtcgccgaagcggttgaggcggagcttgtagggctcgtcgcggcggttgaactcgtggatgaggcggacgttgtccttgaacacgttgaaccgccgcgccttctcgccgaggtcccgcgccacccggtgctgcccgcgccaccgctcgtacagctcccacagcgcctcctccgacgccacgtccttgtcgccgaactccatcgcgctcgccgccggcgccgccgcgcccagcagcacgacgacggccacggctaccgccgccgccgccacgacgaccactactctacccatcgcaacaacacttgtgatcacttaattgtcactagctagctagcttagtaggttgaattagcttgtgaggtggtggtggtagccatggaggtcaggggcttcttatatagaggaggatatgatgctggattgctggctgcatatgtgcaaggtagaggctagagccgatcgaatcaaggcgttgcttgccggcaacagtttagtcatcataattaagaggtcaggtactacacttgtaatggttgattgctctcgtgagtgacacacagtgatatagctaattttggattatacttgtgcaccaatgcttattgttgtatgtgcagttttcagaatctagaaggcttgcagcagtgcccaatcaattggtggatgtgatgtgattatgcagttgattataccatcctcagggtttaatcaccagcagagaggtcatgtgattaactcgaacagaaagatactagcatagagtagcatagaatatgttgatatggcactaataccagtgcagtaattattgggaagtggatttttgtctttcgagtgtacattatctcgttttgtgcatgtcattaaaaagttatcaaaaaaattaaaaaaatttatcaagatagatcaatatatgatatattttttttaaacatgcgagttaaaattcgacttatataattaaaaaaaataaatttgaccgtgaattacgcattctattcatagtcaaatttgttatttgtttctacttgtataaattgaaattgaatttgcatgtttgtgaaatgacatatcacatattgatcaatcatactaatttttttaaaaaattttgatgactttttaaatgacatgtaaaaatgaggggatatcctcttaagggatgatttgaatttccctatttattgtaactttggccgtgtttagtttcctccatattctcaactttctatcacatcaaaaacttttctacacacataaactttcaacttttttttccaaactcccaactttcttcaaacttccaacttttttcagaaaacacaccctttacttaattggacggaatagcagttgttggtggccaggtactgactactgaagatgaatttaacactgaatacacgtaggtacttggacatgctcgttttttaattcatcgacagatagaattaagcttaactgcagtagttaattgataaagcagccgattgattagtcgtataaaccaagtgtttctgttagtttcgcagtactaactagtactacctgcgatgctgcgaattaaggggggtgtagattatgcgggaaacgcacaaataaagaattagcgaggcgtttacgcgacggccatgtaaatatacagatcaagcttgtgcgacactatcgatcaccaatccacttactcgaaaattaactcagattctaattctgtcaccacttaataactgaacctgaactaagctatgttaatttacagatataaatatgcagagctgaatttcagggccagatatctgggaaaattttggatcgctcgtcaagcaaagcaagtagcagaaacaaaactgaaaagattaaaaattagagtattgtaatgccccagcttagccagtcaatttaggtcaatcctaatgttccttgattgtggcgtgagatttcttcaacaagtaacctgatcgaagtcgaagaaggaaggaaggaaaggaagcaagcaagcgtgttgatttcctccaggactggttccatcaacagctgatggcgacatggaaattaaagcatttccatcaacagttggaatgttggatgcatatgtggctctgcatgtcttaatgtctttctctctgtgctgaataatgatcaggagatcggaatcgactaattaataccgaaatgccaatctttacgcatgaatctcatttatcatcaggtccgttcgtgtgtttgtgttggatcggcacaactgtattgattgattaattgagcttcctttcagattcagatttcatcagccacgctggtacatgcagcttctaactaactactgtctactaccagtactgcattatgcacaagaaagtgaattacgattttttgtttttgacataaagagctagcattagcaagataaaatcctgaagcaatagaaagattggaagcataagatctatagcttggggaaacaaaattctgcattcatcgttgtcactgaaaatctgggggcaaatgagaatggctggctttcctagctctgctttctcacatggatcgcttcgagtggcacgaaacccattattcaggctacgtttcgatcggttcccagactgagcaggatgaacaagcaacatcatcagcgaggcagcgacattctgcaag

SEQ ID NO: 66764 - DNA, 4702 bp, Oryza sativa
ttcatgcaaagatgccacatcatcatccactaacaatcatcacatttaaacatcatgcaaacatgttatatctttatagtttttataatttaagagtttttcaaacacaaacatgttaaattatcatacaacataattcacataatgtttcgatgtatatcttcatactaaattcccgcagcaatgcgcggggtttcacctagtttttattatacaagctgctccttacgagataatcctaatccgtcaccgcatctatctgaaaataaataaagcggtaaatcaggtagcaccgtgaaaaagatcacgtttatgttgattattttgaaattagaaggtcttcataaaaaaaaatagatggtcaaccggttggattgaatccctcctgaccacatgaatctctcaactcatagaaaaaaaacatcatcattagataacatttcataatctcattcatgtaccaaccacacatctccatcatcaaatagagtaattatccttctgtgccaggtattcgaaaaaaaataatcctgatttaccagagcagttgtaaacaattttagtctttcatcatttatcttttggctcatcaaccgctaccaaaatttttaaaaattaaagtttagttttcaattttttaaaccaaagtttgtttttattagcttttgaatcgccaaaaacaaaaatataagttttttatccataaaaaaaaatagcatgattcatatttttccacgtcttatcagcaaatgagtatatgactaagaaactataagcagtataaatatttaacgtctaggactgatcaaacttttaaaactatggtaatctcaataatgtctcaaacaattagttcaaaaagataaaagaaatcatatacgtaaaattttgctcgaagagtaatactcctctactcatattagtacaatatcacaaacttattgtagattttataaatttaatctaatacattttttatcttatcttaaatgtcaaatatattaataatagccatgtgcgtcattagacggtagtacgatcatacataaaatcccagtcaaagacagggaagcagagcagagcaggaggaggaggaaaacttgtagcaagtgatcatttcatttggtcgcgttaacttgtcgtagcatcaggcacgccacatgctacatacaacaaaagcgatcgcatgtgttgttcgcgtcgcctccctctcacgacaagcaaacccaacccaaaccaaacacgagccggacgagacggagcgctccctccctctctgtcgcccgcgacgccgcgaagccgcgggcgccaccgccgccgccgccgccgccgccggagatggacggctccggcagctgggacgccatagactggaaccaaatcaaggtcagtttgcttccttccttcctcggtggtgcgcttcatccctcccttcctcctgcctctccatcgatttctctcctcgctctcctgcctgcgtcttcgcgggtgtggctgtctgcgacgactgcgcttgcgggaggggagctggcctgtgggtttgggatcctcatgcgcgggcgcggggccaccgcctgccgcgcggagaggcttcatcttctctcctctcctctcccgataagtgcgcgagtcgttgcggggggcggttttgatttggagatagggttcggttgctgttttgggggtgatctccgatttcacgttttgtttctattgatgattttgttctctccgctttctaggagccgaggccgccgcggagttcgtcccggggcatggaggacttcctcctcgaggatgaggaggtttacgcccaggtaatcgcctccttttcccccacatctgtgactgaattcctccagtttcgatgtgcaagcttcatttcggacggaaatctccgaatcagttgcgtgacgtggtgctttactaaccttgcaatatgctttgtcgattgccctttggattaactcatcaaattcattcattactgcctagaatgattcgccggactatcctgattgcaatgcacccatccattccctgttcactgataataagtaggccattcacaattgacaattctcctctcaataacacaaccggggcagcagaatctgtcacaatgggcagcgcatttctagtgctattgttcaactgcagcagtacaagtagtacaccaattgcctatcactcataatctgtaggccattcacaattctgaatgacacaaccggggcaggataatctgtcacaatgggtagcacaattttagtgctatggttgaactgcggtggtacaagtttaagtagtacaccgaacgggttctaggccgcttacagtggagttaatggaagcaataatgtacctagtctggatgtacattttatcagggaaacttttacgtaaacactaacgatttttgcacattttcacctactaaggcacaccaattttctgtgcgtaatctagtgatcatgatttcccactttcaaattttgatacatttttgcggagcctgtcggcttccagatcatcaccttttcaagggtatttaatcttggatagttgtttttgagccttttggttcttataaaatcctagggacaattatactccatgagtttgtaatcaaccaatgtgtttcagactgaaaccaaaagccttacacagacagaaacagctgcttctgacttttgctcttttacatctctaatttggtccctcttatatctccttatttagggtcatggtgttgttctactaaacacagatgaggctggcattctttcagtgacaaatttccgacttctctttgtggtaagcaatcatattattagttttatcacaattattagaaacaattcgacgtgatttggatgcctcctgcatgtctatacaagttcattctactatacaacattctccgtttgttccttatatgttctctcaatttttttccatcgatttgaaatatgaataatgtcttgtttgctttttgagtgggaatttagtatattatgacccctgtttttttttttggcttgaactaagcattctaatgatggacagactgctccctcagtcctttccttttcatattactcttgttcttcttttataaatgctaccccttttacagagccaagccacaaaaggcgttatagagttgggtaccatcccactaactgcaattgagaagataaatgatgtaagtctataatttccttcattgggaagttcatgttttcaagtcttcttttgggttcatggccactattccattttctttaattcattctataagtccttagaaaatattgattctgtggcaggacgtaaagcttcaacccttgccccgccagcatgataagaagcagccccgtgaacttcttcaagtcatcggtaatatatttttttctttttttactttgtaagtcagctttgaacacaattcatatatttacagtcctacttaatcatgactgagtagatcttggcagaaatttgtaaataatctgtcttgagaaggtattcatggtgtgcctgaaaggatctatgttgacatagtattaatactgccagagacctctattacatgtcctcttgtaattgaatccatctttcgttggtgggatatgaattaaaaacaataattatcttcttgaaccattctgtgatttctgtgcgataatgccattttccttgttcttttaccatagtatcgccatttttattggtgatttttcagtctatgtatgtgttaataattttacctgacatctaaagtagtttgcaaatgtatcttgttttgaccttacctttaacttgatctttttttcatccaggtaaagacatgagggtcattgtgttcgattttcttcctaaaaccaagcaggtagaaatcctgtttcattctaatattcttttgtattatattttgttctattctccatttgttgggtgatgcatcgttaaaacctcatatggtctcatactttgttatgtcatgtattttaatcttttgtgtttcatttctgttacttatcttttcagaaaaacgaagtgtttgatgctttgagaagatatagcaaacctactcatctgtgggatctatatgcattttcttgtgatccctccactgtttatcagaaatctgatccaaagatgcggctcttgaaggaataccatcgcctttttaggaaatggttcccgcatagtggatccgagttcgaaaaagacttgcgtaatgaatggtggagggtaagtaaagtaaattccacctactcactatgttcgacgtacccatctgcattgattgtgccaaggagcataaggtacttttataccattcataatatcttgtggtaattttattctcttacacatgctcagcaccaacattttttttattatctgttagtgatgaagatttattgcaagcttcttctttccgatccggcagacgcttgcctgttatttcgtggtgtgaccctggtatgcatgcttacgttttgccaataaatttcatcattattctctgcagtcttatgctccctatattttggaaaggctgatgactgttggtgaatggtcttatgaattatgacctcattgccattccttttatatttatatagttcataattgttccgctactttcagattttgggggtaacactgtaacatcattaatataaagtat

SEQ ID NO: 66765 - DNA, 1042 bp, Oryza sativa
atagttgatgcccggccaagagcaaatgctttagcaaatggtgcaaagggaggtggctcagagtcagcatcaaactacccaagatctgaggtatattctgtatatattaactttttttatataccatacaatttctttacaattattttttctctgtttatctggatcctggaccaggttctctttttaggaatacaaaatatccacacaatgagagatagtctttttcgccttagggactatgttgatacccatggatcagtatcatcaaatggaacatcatcagctgtatctcttgttggagaccgggtaagcctatggtttgtcttgttgaactaccacttgcagtatacatttccttgatctaaggttagattatgcttgtgccaggccagttgtaggcttctccatacgtgggcttggtgccagccttttcttacgtatctgaatccattacctgcctccctagctgcaatttacattgtttagttaaatatgtactatgaagtagcttcttaagttagaacttgggaccctttatttctgaattagaaatatagtacacattatgaattttttgactaacggaagacatgtaaagttggtccggataagtcccaagtgttacttttatcatactgaaatgcctataagttcattaatgacaaaacagaagaagaggagattgacgatctttttttctcacagagaaatcgtggatcaacctggggtggagggaatctgaatagcatgacacaattttcttcaatgttaggggagtggctaaaccatatccagagtatcatggtcggtgcttcgtggattgctgcacaaattgtccaagaatcagcttctgttctcgtccattgcaggtttttttttcttcaccagcttctggagatgctctaattgaattggtttacttattagtaaagggagaatgcagagaatgttttttgcacctacattcttacctgggcacctgacatttagttgagtctgtaggctaggtttgtaattgctggctgataagggctgcagg

SEQ ID NO: 66766 - DNA, 998 bp, Oryza sativa
tgcacgagttctgatttggaatataagcatctataaatagttattctacctgtataatgcatcatcctttatgttacaattctttgaagtctgaaacggtcattgttctttgcaggggtttatgtgaagacattctcagctaatgtcaagaatgatcaacctatattgacaataagtccgttacattttaagatgcaagaaaaagttgctcatgatggtagtgaattaggaagtcaagaagcgaacatttggaggaaaactagcatcccttcagaaaatagagatccctttcaggaagctcattttggtaacaatgatgatgttctgagcacagatgttgataacacttctgaatccatattggaacataagattctcattaaacagtggcttgttgggcaacttaaagatatgggcttacacgttgggaactctgagataagtccagtagttttaccaaccaaagttttgctccattttgaagcagtagaccaaaagcataacaggggaaaagaatttctatacctgctaaaggttggctttgaaaattctagctacagcaattcgcaaggcaatgctgagctttcttggagcattcaaactgatgatctagaaaacttggaattaaaatttgggaggttggagctgggtgagcctgaattttttaattctgtattagatgatgggttcagcaatgggttcaagctgactcgatcttctttaggctggatggagaatgcaatgtcagatgtcacaaaaagtatttactttcattgctaagttccttaattttatttgctctttttatctcgtaaagtatcacatttcttatttcttaatccatgtttatcatcattttctttgtaaagggctatctgttctcttatcgtcaactagtctgaggttatttgaccagctaaagctccccttccctggtcatgttcttgtccttggacctcgagtaagtaatagtatctggtttgctttatgggttgtat

SEQ ID NO: 66767 - DNA, 1464 bp, Oryza sativa
agcacagcatagctgagaatcacccccagttcaacacctttatatttgaatttatgcacatacttcctatctgctgcttgaacacgcaggagagcctttgtttgagcttcttccttcagtgcactttgcttttgcacatcctggctggagttttctctacgttttttgggtgccacagcaacttcagttcccggaacaagttgaactaaaagaattaaaagcatgacaaacattagaaataaatacagaaggtacatgacctcaaatactgaaggcattttttatgagaaactaaaagcagcatgacatactgtaacacagtgcagcaagcaaaattcatgatgcgttagaacaataatcattggggttttgtcagaaggtgctaaattaggttaaggtacagtcggatggactaccagtgtacgcaaaagctacaatctaatagcagtatacaacagctgataccatttcccccatcttaatgaaatttggtcgccgttccttcggccgacccggcaaaaaaaaaaaaagctgataccattgtaagaaattatttatagaggcttggacaaaatatgtacgaacttatcaagctcatctccatgcttttgttgataacatgatttcatactagcgtaacatcctggatataagaaggtacatacaatttgaagtagtttggatgaaacagctaggtcactagatacaaagtgcgcatgagcggaacattccttagaaagttcattcgaatggaactatggtttagataaaataatgcactggatgtaacacgaggataattcagataagaaaaggagccatacccagtgatttctttggagaagatgaggtcacaacaaacttcacaatattatggccgtccaaccacaatgggaatttcataccctcgtaaacaacgccaacctagtttgaagaagagaatttaaatagtaaatctttacacattagagatgattatcacttggctaatcaagcaaacaatgtatataacagaatagtacctgagtcaagattgtttcttcagccaaatcagcacggctctccagtatctcccaatcatcctcgctgaaaggttctatacagactgaatcagctttggccagggagcgagctacactcaactgtgcaactgttccatcaggcaacgagatgcattctgccagctcttgagcaacctgcaaaccccaacatttgatcaaagatttcacgctggaaataatccacagcctactgcacagtgtttacatagtagcaacgaatacaagcatatacagggtcatcacaatcatcgaaaattctactcgcagaagccagattgaccgaaaagcagcaaaaccccggataattttgaccaggataaagcgagcaatcatccatcacagatgctaaaagtaaatacaattctaggatgggaataatacgggagtcggggggggggggggg

SEQ ID NO: 66768 - DNA, 3103 bp, Oryza sativa
ctccacctcctctcttgtatccggtcaaaaaaagtcaaggggttttggattttcttttaaattattttatttttggagaagcttatatagagctccatgaagaagaaatcgcacttgtactcatgcacgttggatcctctcttcggttaacataatactttaaaaataattgaaagaaaaatatttttaaaaaaattataatcaaagattctaaagtttgatcttaacattgtctaaaacgacaagtattattaggtcggagagagtaagtcaaactaaaagctaaaatttaaattttcaaacttaaatttaaagatgattgtaaaatatttttaatgtaatttctttgtagtattgacttttaattgctatgaataaatataaaaaaaatatctataaaatatttttattttctaataaaccgtttgtttattagagaatatggtaatcttgtaatttctagagacatggtgaatgctactccctccgtcctaaaatataagtatttttagatatgaatctggacaagccaaaagttactatattttagtacgaaggtagtatttatcttggataacccggggactgtcgtttttgtccattctttatgcaagttttttttggggtccatctatatatatggcgccacaaaatttagtccaaaacagtcggattggacttcacactgattaacaccatttcaaacacaaagttgaccattaatgagccttggcaatataacaaataagtaactttattataatacacaatataaattaaatttacgatagaaaactaacaatcacaaaagttacacttaaataaatttaaaatcacatatgtaattttaatgtattttcactgtaagttctaaaattacatatgtaattttaatgtattttctttcactgtaagttctaaaattacatatgtaagtgtcctaaaattacatatgtaattataatgtattttcactataagtttcaaaattacatatgtaagtcccaaaattatatatgtatttagtatgtaattacaatgtaagtggcatataattgcataaattatcactatattgtaattttcattaactacgatttactttgaggatagaacgaatagcatcttgtgctcagttggtcaaaagcctggtgctgtatgcctgtaactcgtcgatcacgggatcgactccccgccaccgcaccgcaccttaatttttctcggaaagcattagcacgaattttgatatagatcctagggtctaaaaatcgactatttttttacagaaaaagtggcgccatatttctagcaaatctgttttttttgagcgtattgcgtccaaaattcaattaattattcattactattgtacaaatcacagtcaaatactaactcccggagttttatatgatttcgttcggaattaattaccgagaaaagaatgctgtacatgacaaaactctttgctcccaccacatctctttgctcccgatttctctctcttcctgaatcagacaaggttatgtaattatcttcacttcatcagatgtaaaactccacattaattaatcttccttccttttaatgcttcgacagcatatgctgatcacttgttcttgcagattctgcttccagtgtcacctcgccggagattagcattgtccggcgatgatatcgccattgccggtcatcagttgcagatttcacctacggaacggtggcggcttcttctggaatgttccgggagcaaacaccgggaaggactcgccgccgcgggccctcgtccccgccgcctcgtcccttcgaggttcgccggcggcggcggcgccgcccagcagtggcccgccgaagaatatcgactggccggagtacgtcagcctctccgacggcagcgtcgacgacgacgaaggggcggcgttcgtgggcgcgggcgcggcgggattattgcggctacgggcggcactcaatggctcgcgctcgccacctgggttcgccaagaaaggcggcgccctcgccgccggctgctcggcgccaccgccgcctcctcctggcctcgccgttgccggcgccggcgccaccgacacgtaccggccggcctcctggtcccacacgaccgacgccctccggttctcccggacgtacgacgtggccgactggaacatcgggttggatatcctcgtcgccggaggaacaggcggcggcggccgaggtattgccgcctccggagcagcgttcaccggcggcggcggccgaggcggcacgttgtgcgccgccggcaatggcggcggcgcgagcttgtggaggcgcaccgggctgctcatcacgctgctgccgctctgctcgtactcgtcctggctcgccacgctctgcgcgcacgagctcgggagagaggacgccctcctcctctgctccttggcggcggcgctcacgctgctcctgacgctgccgttgccgctggagctcaggtcgccggcgtcgtggccgccgcggtggcgagcgtccaccggccggaggacggaggaggacgcccgagctctcgccgccgctttcatggcctcgttggtgtcaagcttggcgagcttccacgcgctgatcttcacttgcttcttggctctgtttgctctctcagcatttccagccgtgtcagggtcgatggttgatggcaccatcccagcctccaggtgtgggatcacttcatcctgcattgcaatcattcagaagagaaatagtacagcgctactccctccgtttcattttagaagacgtctttgctttaatcaaagtcaaactgttttaagtttgataaagtttgtaaaaaaattagtaacattttcaacccaagactaatttattatggaaatgtattcaattattgatttgatgaaactaatttagtattataaatattactgtattcatctataaacttagtcaaacttgaaatagtttgacttttagcaaagtcaaaacgtcttataacctaaaacggagagattatttagcaatgttgtttgcaagaattcagataaatatgttctttgtaatgctatttgcagcttgaagattcatactgatattcattcagatgatacaatatctgatt

SEQ ID NO: 66769 - DNA, 828 bp, Oryza sativa
ttcgccttgatcgcccgcaagttcattgaagccagtgaatttggttatcacaaagaacttctgaatcctgatcaatggcggcaacgaggatgaagaatcaagaacgaacggatggctcaccttcacggcctgctcggctgatttgcgagcatggtcaacatgctctactctcctaatctcattgtatagcttcatcgggaaggcggccacgtcggcaatggcgtatacaccaggaacgctcgtttcgaagaatgcatcagtctggaagacacatgcagatttgaaatgttcagctaattcgaaggtataagcaagaacaagctcgaaagaaggttcagttgctaattagggtgactcaaatggacaatagcctgaaatacaatcatcacgcaacaaatgtagcagatagagcagaatctgaaagatgaacagaaaccggacaaaccttgattccacccttctcctctgcaacttgacccttgaagagatgagtcagtggcctgccaccgacaccgacaataacaatgtcagcttccagcacgtttccattctttagcttcaccgcagtaacctgccaacagaaaaaaaaaattaacaaggtgaacatttgccttcacagcaagatgatactggactaagtggtaactacagagtgctcacatctccattggcatcagcatcaaaaccaacagccacggttccctttatgatatggattcctttgttagcgtagtatccctcgtagaaagcagcaaggccagaagtgaagagacggggcactacaacagatggcatctccaatatgagatttcattggccaaatacgtt

SEQ ID NO: 66770 - DNA, 710 bp, Oryza sativa
aacttttttttcccttttggaaggcagaggggaaaggaagtgaatcttttgtaacttgtccatacacaaatccacaaaaacacaggagtagggtattacgcttcgcagcggcccgaacctgtatacatcgccgagtctcgtgtgtcttgcgggcgagtgatctttccacactcggagagagagagagagcttgggattgcaccctaagcccctggtcgaaccggcaaaggggggcttgcgcagtctcccggtgaggggccacgagctccgtcaacgtgggtatgcacgtgttccgtcgttttgtgggttctccatgtctacccactcgatgaagttgcacattggacgatatgtctgcgtaagatgttacaattgtgtacgaagaagttaatttttttatccatttgaacttcgaatagatgaagcatacctgatcaaagttcgcacattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcattagttgtgtgctagtgggaaagaagatatgaagaggttgccttcagattgtcaattatatagcgtcgttttcagtgcaatatatgtgaactcaatgagat

SEQ ID NO: 66771 - DNA, 2715 bp, Oryza sativa
  unsure (1)..(2715): unsure at all n locations
gtagagagagtgagatgcctctccaccaacagcaaatttatgcatctccttggttcgtatctgtatctccatcagtggcctcatcttcccaggttcacttacatcgatggccacatgcaagctctggtaaccattttcttttggccgtgtgacataattttttgtccttcctggaacttctttccacatagcttgaatgatttcatgtgtcctgtgacaagccctagggccccagtctaacgagctgccatcacaccgaggttctaagattacccttaaagctagtatgtcatttacttcttctggttttctgccatcttttactagctttttcatagtactgaaacggcttttataccgcccttgaattgagatgtcnnnnnnnnnnnnnnnnnnnncatcatcatctttcagtgcctgaagcaactgctccttgtacgaatctattaagagcttgttctcagtctcttggctcctcaaccattgatcaatatggtcatatgaatgcggaaacaaatagcgaaatgaaagatcctctagctccagtgatagattaccagctccaacagcatgggcaagtggggcatatatcttcaggacttcaagagactttatccgctgaagatatctcgggaggcagtcaaggtgtctcatcatatcgagctttagagcaagttccaagataactgctcggatgtcatagtaagaaagacaaaactttctcaatgcacttgcactttcatcatcaagtacatcaagctttgaaggggcatgcttaagccgtaaactctcgtgcagcaaatgagctgtgctgatcccaatctcagatttgacatccctcatgcttattgctcctgcatcaagtgcttccctcagtattccggctgaaataacttcggcgtccatctgccaccatgtgccaaaaaaaactggttagatcttacagtttaaagtggataaataaaccagagatgcttaactgttctatgacacaaagaagtgtaagtataaagtatcttatgaattaccagaacaatacaaggaaatgaagagttagaaaattctcatggacagaagccaaacgacaaataagggatagctgtttcgtaacaagtcctaaccaatattatcttttttttcgccgggctggcgtgaagagccagccgagatttattaagagaaaaggaagaacaagttacaagctacagcaaagagctacatgccggcaaagccagcaacacacttttacatggctgcctgccgctgcgtcaaacgcgagacgacacctcccggcagcgagctaccaccactactactgcaagggctcggttgactgctgcaagcttcctcctggcaccaagcccgcagctccccacattccccactcctcctccatagtcgcacacagctgcacaaccgacattattatcttttttttttaaaaaaagaacaagtcctagtcattaggaatgtcatttttttactctggtaatggaaactactaactcatcaatgccagtttagctatgataataatgtcctctactagttgtacttgtggtaatggtagaaataagcacccagatgaaaactgcgaagcaaacaataataattggtactactaagtactaacataaaactaaactgacaatcgtagccaatgtgtgtatgacaattactgccacaccagcagcaaaatatatcttgcttccagagttttgattacaatgggaattatgtgacgatgaattatcctttgctagaagcaaagaggagttgcaccacatggttttaaatgatatcgaggtactagtactactttatccataagaccataactcatgtggattgctaagcttaatgagatgaatgaaactactaaatttgcaatgcatttcacccaattcggcaagtcgagctacaggatgcaatcattcgattcgagcaaactacctggaggtcggcgagggaggcggcgatagcgagcgcgcgggcgagagcccggccgccgtcgccgtcgcggagggcggggagggcgagcttgagcgcgcggaagaggaggcgcgacgacgacgaggtggccaggccctcccccatcctccccgtcagctcgttgaacgcgcccaccagctccgccaccagccgccctcctccctccgccggagtagacgacgacgacgacgacgacgacgtggatggagaagaggcggccgccgcggcggctgcttgggcagggaggcggaggcggtggaggcggcgcgggcggaggcctgggcggcgcgggtggggatgctgccggcgaccgccgccgccggtggggattgcggcggcggaggtcgtcgcggcggtcgccatgggggaggtggtggggcccactgggagggatgaattggaggcgacgtggcggtcgttgactcgttgtgtgctcgaagcggatgcgtgaagtgaagtggtgtagcgtagcgtggtggcgatgattggcttgcactctgccacgtaggatccgctcctccgtggcgattctcatccacgagttcgtcgtttttttttccatcaaattgatactccctccgttttataatgtaaaactttgtagtattgccctcatttctctgtggtcacgccccacaccggcagccgcgtcctccgtcctcagggccggccctgggccagtgcgggcagtgcgaccgcaccgggcctccaaaaattaggggc

SEQ ID NO: 66772 - DNA, 3656 bp, Oryza sativa
cgttaactgatattaacagaataggggcaaagtgaatattcatttgaaaaaagtaaggggtaaaaacataaaccctaaaaagtaggggcaaaatcacaattgaaacatgaagtaggggtaaagatgcagttgcccctattattatttgttttttttttgtccggacgtgcaagtgcaagtagtgtttcctcttctgcgacatgcccaagtagagtttgggccaaaagtgtgtgatggatggaattcgtgcgaccctcggtccagaaatgtaacatgctttcaccgccttaaaatataacaatttcgaactatttatctcaatgtttttttttaaagatacagggtcaaacattagtactatatttttgaaactgtattgtattctctctgtcccataaaaaataaagctagaatgtgttgtgtcaagatttatatgtaaatatttatatttatatatatactaggaaaaaggcccgtgcgttgcaacgaatgaagtctatttcaaccgttttattgattttttttgtctaaaaagtatatgggatttttatttgataattgatagtattgatatctaatttggaactcttatcgggatgatggtcatatcatgtacattgctttcttattgcctgacaagaattctcaaccaattatgagtatgactctcgtcccaagttagcatgcgtgattttagaaaggatttttcttatacgatttttatgtatttttaaaagcaaacaaacttaaaaactggcttaaatacggacgacgtaccaaagtatcggtgaaaacatttttaatttttacaataggaaagctcaaagttgttggcgaggacgcatgagagagctgcctccttgaactcttgcagcggccgcagaggacaaagttgtgcaggcacggtctgcatcaccctgacgaatcgtccgatccatgcatgcgtcctcgtgccacgggttacgctcgtagccatggtctccgtcgcgtctatggcagtggaacgtcttggcccgaacgccgcttttaaacattggtggcggcggcggcagccagccggccaccaaaaaatcagcacacggtgatctactattacgttattatcacacgtcgctgcctctcggatatattatgatgatcgtatatcgtatcgagccttgcgttttggaatggatcctattccgtttctcacacaagaacgcgatccgattgaaaattgaatcgggtgattttgttcgacagaaatgaaaacgttccatgctttttaagtagtagagaagagaagatataaatataggtaatgatagaattagaaaccaattcaaatacggatgacgtaccaaaatctcggtaaaaacaacttcaatttttataatagtatagacagagattccggtcaaaaaaaaatagtagagatagggatatggtttagttaagatgaatttattgtgggagttcgcttgaatatatatatttttagaaaatcatgagctgcagttaggtgtctgatcgtctcaagttagcatgcgagttttttttaaacatatttcttatatgattccttctgtattaccaaaagtgatcgatcttaaaaactgaatcaaatacagatatgtattttcaaaattgaatcaaatacagatatgtattttcaaaatcaaacgaacttaaaaaccgactaatacacggatgatgtaccaaaatatcggcaaaaatatcttcaatttttataatagtagagaagagataggatgagatgagacattctagaatttttttttgtttttaatttttttattaaaagttttacaaaaataattttccattttgaaaattgacagaagtagtcgccttaaaaatcgccatcccaaagggcggcgaaagtgacgtggcagacggctgttcgctctcgggcgacggccgtcaacgaaatttgcaggcggcccccttgctgccctccgctagggcgattttgtactgtgcggggggccgcctgcaaatgggcagcgagggggcatggaaatttgcaggcggcccccttgccgccctccaataaggcgattttctactgtgcggggggccgcctgcaaatgggcggcggggggcctggaattttgcaggcgcccctttgcagccctgggggaggacgattttatactgtactttatttgagaaatatattttttttataaatatcaatagttatcaaatctttttatattgaaaactatactagattaaaatctccaagactggtaaaatacaattttattattttttagggcctatttggaatgtcaccgtacaaatattttgttagtgccaaaatataagcaagttttggcactaccaaatctttggtaaggtaaaattgcatttgatcatatttggtttgctgccaaaatgtaaaattgtagtgaagaatgttctacataatctcaaatctagattaggtattaccaatgaataggcttcaatcgaaatcaaacacaagtactattcaaattacaaaaatattggtagggcatgtttttggtagcaatccaaataggcccttagtcttacgcatacaaaaattcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacacatccttggattgccctgtaaaaatagtaatgtaattcagtttgggtagtaattttgtgcaaatcatagcggattttgtaaacggttagacatacaacgaaatcgttgtctacattggggcagacaaaatatctccttccaaatgtttgttcagcaaaggatgtagccacctgacagcgatctctgcacccacactttggacgctcggaccatttaggtaaccctaatggattgttcctccagtctaagcttgcaatttccacctgacgttcgtactccatccaagcatgaatgaactgtatggtcggttcaggttgcgttatcggcccgccacttgaagtaactctgactgcgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccatgtggggagtcctaggggatttacctgccattctaaagcctcagcagcaattcgacgttcatgctcatcctttcgccttaggtagtccgatcttgtttcactacgtgtgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgg

SEQ ID NO: 66773 - DNA, 11881 bp, Oryza sativa
tgctggcgcgctcctacgacacccgcccgtcgtccatgacccggagtctccagcccaacgatggctggaagacgtggccaacttggtcatgacggcacagcaacgcctgggtgctggcggacggtccgccaccaccaagacctccggcgccgccactaccggttccgcgtcgtcaagacggagagcgcggcgagcggcggctgctgcacgccattcggctaccactccctcgtcggcgcctccgactcgggaggatcagcatgaagagccggatgcccgcctcgacattgagcgccgacgtagtgatcggcgtactccccgcgcaacggagggtgcctcttcgtccagggtgtcacctcgacatggacgtgaggatcagccctccgtgcccccggttggtggtgttggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcgcggggttggctaatgaacctgccacccgcgtcggtccactcctgggaggatttgtgccagcagttcaccatgaactttcaaggcacctatccacgccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgctgacatcgatgacggtgatgatgacctaggtttccaagaacctggggccaccattgccactgtcgacgggggagcgtgtgctcacgtttctcgccggagtttcaaggccatgaggcgagagcttctcgccgcggcccctactcatgaggcgacgcgtcgggcgcggtggtcggaggtggccctcacctttgaccagaccgaccacccaccgtgcgttgcccggggagggcagattgcgatggtggtttctcccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccgtggcgaccttaaagtcgcgcttgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggtgacaggccccggaacgtcaagccttcatccgcgaggaggtggcgaggcttctcgaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttacttttagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctattgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagtccctgctactttacttagcagcgaccccccaagtagttagtgcagcgttggttgtggagcgcgatgaggacaatcctcattctgcgcacccccactctgtgccgacttggcccgggagcaggcagggaggagaggcccccgagtcgaacggtggcctaaggcccccgacgaccggagtcggctctctgcccgcttgtcagacggtgctgggtgcccccgaccctcaggaaggccccgaggccactgcgggaaggccgcacctaccaccctttgaccccgaggctaaccctgtgctgattcgacccgggagagagcagggagaagaggcccccgagccgaacggaggcctgaggcccctgacgaccggagctggccctttgcccgcgtgtctgacgacgccaggagcccccgacccccagggcggccccgaggccactgtgggaaggccgcacctgtcatcttcggaccccgaggtcatcagcgcaggagacgagtgtgccccgagaggccactgggacgaagagcaccccggggatacggcccttagcgaagaggatcggccccgccgaaaggtgcagcggcctgtttactttgttagtgaggccctccgggacgccaaaacccgataccctcaggcccagaagatgctttacgctattctgatggcctcgaggaaactgcgccattatttccaagcgcatcgggtcactgtggttacgtcctaccccctcggccaaatcttacataatcgagaaggtaccggacgggtggtaaaatgggcaatcgagctttctgagttcgatctgcactttgaaccacgccacgctatcaagagccaagccctcgccgattttgtggcagagtggaccccggctccagagaccgtctcaatccccgaggccagcgcggacccctcacagctgcctcacgccgcccactgggtgatgcaattcgacggttctctgtctcttcagggcgccggtgcaggggtcacgttgacctctccaaacggagacgtcctcagatacttggtccgtctcgactttcgagcgactaataatatggcagagtacgagggactccttgccggactcagagtagcagctggactggggatccgccgcctcttggtgttaggcgactcccagctggtcgttaaccaggtctgtaaggagtaccggtgctccgacccacagatggacgcctacgtacgccaagtgcggcgtatggagcgccattttgatgggatagagcttcggcatgtacccagacgggacaacgtggttgccgacgaactctcaaggctcgcgtcctcgcgagcccaaaccccaccaggcgcctttgaagaaaggcttacccagccgtcggcgcgacccgaccccttaggggaaacggatacgcctgaccggcccccgaggcccgtcggagtccaggtctcgggacccgaagggagcgcttcaagctcccttagattgattgcgtggatctctgagatccaagcatacctcacagataagactctacctgaggaccgcgaagggagtgaacgcgtccaacgcatttccaaacgctatgtgctggtagaagggaccctctatcggcgcgcggctaacggaatcctcctgaagtgcattcctcaggaacaaggcgttgagcttcttgttgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccatgccaagcaaatccatcagccggcccaggccctgcagattataccactgtcatggccatttgctgtctgggggcttgatatcctgggaccgttcaaacgggccccgggcgggtttgagtatctgtatgttgcgatcgacaagttcactaagtggcccgaggcttatccggtcgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctcgactacttagaagagcgaaggcggcgcgcggccctccgagccgcgcgctaccagcagagcttgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgcctaacccatggaacatcgaacaccttcgtcgcttctacccctgaagaggggggggtcgggtgtcaggttttggctcaggccaaccccgcacccccctcgggtgtgcagggttggccgggggctaccacacatgcattacattcttatttctcttttttcaacatttcaatagaagcagtttcaatttcctaaaggttgtgtctgtgctgttctttctttttgaagaatcttgacttaaaataaggtcactcgtactcaaccttgccctcgggggttcggttcggtctgctaaaatcgccaaacggggcccagaaccgagccgtgccctggggcgtggtgaactccgggggggaatcggcaaaaacccacaatcgggtcacccatacccctcggtcaccacgttcccggcctggccagtctcgacatgtggatctccccaggcactagccccgacccgagccattcgaggactgggacttgggcacgagcccttatttcaagctaaggcgcaaaaggaccatggcacagatcatcctcatcgcgtatgtatagcaaaataaaactaacacaaagattttttcgtcatttctgattgcagattaagttaatttgtacacaaaagaggcatgaaggccttagaagaaagaaaaagaaaaaaagtaaagattggcgggggctcgggggctcattccgacgcgcccgagtcgacggcctcgtcaccaccatcgtctgcactgctggtgttgccctcctcgtcggagttgggggcgaacgcgagccgaggggccgagccctcgaagccgttgacgatgtggtcggcggcatcccggacgcgcgcgcgcgcatcgtcctcggtcccgggagggaactcctccagcgccatccagggagagaaattggggtcccgggcctggtaactcgctagcacgagttcgaccgccccccgggcgaggtccctcgaggatgacttgatggtcttctcgagctcctcggggagtcgttcgaggacccaggccatcctgttgaggtgcggagcgaggccttccagattggtggggcgcatcctcgtctggcctttccagaggcccgcttgccgaccggcgcgatccatgcgagagaccgagtcccaaagcatgtcgggcccaatctcgcccgccaagcgaagggcctcggcctccccggtggaggagtccagcgctcgctgcatatcggcgacggtgtgttcggcagctgcgaggcgggcggctaagtcgctttcgcccgcggccgccccaccgatatgcgccctcgtgtacagctccttttcccgcgcctcgaggtcagcagcccgctgctccagtgcggctctctcggcgcggacgcattcaagattgcggcgcgcctgctcctcctgcgccgcctcgcgaagggacaggctgtccgccagccgtttggtcgtggcctcagcctcctcgagagctcgctcccactcagcgagtgcgtcctcgcagaggcggagcgcgcactcctcctcggcgcaggcggcctcgtgcgccgccagcgtcgcctcccggagagcagcggcggcttcgcggtccgtcaagcctttctccacggcgccggcgtgttcttccagcgccatagcacgggcctcaagggactcctcgcgccgccgggacgccgcctcagtctctgttacccgccgctctcgggcagcggcggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgaaacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccggacccgtttgatcctgggcatcacccggggaggtgggcccaggcgatgtgcccgcggcctcgtcgcgagcctccccggaggctgtcgcctgagggttgcccgagggagtgggcccagttggcgcgccagcagcagctgttgcctcagcctggcgagcccgggcggcctcttccttagcggcttcctcagcccgggcggcctcctcccgagcggcttcctccgcttggcgaatccgggcggcctcccgggcggcctcttcagcttcccgaaggcggtctgcggcttcacgccggtcagattctcgcctccgctcctctgcggccgctggatcttcggcctcggactggccggacttggggtggcgggaggaatgcgacgggacatcgctgaagcagaagaaaaaaccagaagacgaacaaaatgagtaagaaaaaacttccttttgggagaaagatggttgcaatgagagtgagacgaacctgcgagggggacggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgcaccgccccgccccctcggggaggagatgggggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccacggagctaagattcagcaccctttggaccacgatcttgaagtcctcgggagcccaatcccatctggctccctggtgggtccgcatgtagtcttcaggcccagagtactcccaagcgctccgggcgcgccgttggagcggcgcaatccggcgacggaggtaatcgccgtacaccatggccccggtgagcccctgggatcgcaggcccgctaggcggtcgaggacggcgtcgtagtcctcccccagatctaccggcgcccgccagctggagacctgcgccgggggctggcttggaagtcggaggcgcgcttcgttggtgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgtccctcgcccagcatcactatctcccgaccggtggcggactccggcatgaagcggcgcggcagtccggcgtgcctctcgctcacgatgcgggaaggcggtagtacactgccgtcgagcagagcagagccccgtgccatgacggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcatacggcgcatgaagtggatatgcggttgtggcaattgaaatggattgtatcgtgcacgcgttaattacgctcgccgaccgaagcggcgttaccgtatctccgggcgagacaaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttccctggggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcactggtcgcgtcatcgacagacagccacggtcccgcgtcatctccgtcttcgggggaggtgggggtaggtgtgggctgtcccatcagaagggctcccggatggaaaccgtaccgatctccgcccattaaagagaaaaagaacagtccagtttggaaagagagaggtgcatgtggtatccccttgagatataaaaggaggaccttgcccatttagagagagaacttttttttcccttttggaaggcagaggggaaaggaagtgaatcttttgtaacttgtccatacacaaatccacaaaaacacaggagtagggtattacgcttcgcagcggcccgaacctgtatacatcgccgagtctcgtgtgtcttgcgggcgagtgatctttccacactcggagagagagagagagcttgggattgcaccctaagcccctggtcgaaccggcaaaggggggcttgcgcagtctcccggtgaggggccacgagctccgtcatctggcgcgccaggtagggggctcagcgtgtgttttctgagctctcagactcttccgtgtgcgccaagtttttcttgttcagcctaatggccgagcaaggaaaagcacacgacctctctccgagtgtgagcggcgacgacggggagccgaatccacgccgtcgagctcgtactcctccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcccgtcgtccatgacccggagtctccagcccaacgatggctggaagacgtggccaacttggtcatga

SEQ ID NO: 66774 - DNA, 1910 bp, Oryza sativa
tagcaccatatgaatgaaaagaactatgtagacgagacaaacacaagtagtactgcagtagtaatagcaaaagtagtactgctttacaagtttgtaagccaaaagaaacagtcacataaggactgaagaggtagaacactactgacgaggcctcttacccctgtccctcctaccctgcgccctaacgtgcccctgggagtacgtgagtcggtccgggggtatggcacggccaacccgtcctgcctgtacaggtgtgacctctggctgctcctgagtgtgcgcctctggagctcctccaagctgagaggagcctagtacgtcgtggtggtgtgcaccatgcaagtcgtcgtcgtagaactagctagtaggaccagtcctaccggcgtgagacgaagaggccccagtaccgaagatcccggctgcaaatcctgctggacaaggaccatcagtttcatacaggtatttaatagtattaataaaaagtaaagtaccgtgtggacgagggatcgacgctccgtgagaggaagagctggcgaacgcgctcgaagaggtggcgaacgcgccggaagtgctggcgaatgcccctgcggagctcgcggaagcgccggtcgtggctgtgaacgcgctcgaaggcagacgagttcctgcgatgaggaaacgtgcagttaaaacatggtgacatattcgtgcaaaagctgaaacaaaaatgaactaacctctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtcgaaacaggtgccgtaggtcgaggtcctgctccgacggtaggcacgcgaggccgtggttataccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatattggcactgatatcccgtgcggcatcggcctatgcaagatggaaataaaaaattcagtaattgtcctatattatgcaagataaatgaaataattgtaaaaactaatacaaattcgacgtacccccacgaagtagtctcggtcacggtgcgtgggatacgcgtccgtgacagcagcaacgtgcggctctggggcgtctggagtgaaggtcacacgcgcatgagtgcgaggaaggtaccagcgaaggtagtcacggtagttctcctccgtgtgtaggaagagctcgttgatcacctcctctgtagctaacacctagtcatcaacgtactgctgtacacgtggagcccaaagtgcgcctgctagctgtccccgtcgagtcaacctgtgaagagaggtaaattatatggctcgatgaagtaattaccataaaaattttgaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcaaacacgaagtccgggtaacctcgtctcacctggacgtgagcgtaacgacgctgcaataaacatgatcggaattagacatgttatgtgatgataaa

SEQ ID NO: 66775 - DNA, 715 bp, Oryza sativa
gtagacctattaggcaaatgtacgagcaactgcaaaaagagatgatcacatggttttgaatcatgtgatccaataaagattatgaacaggaatagcacagttgaaacaataagaatgaaaagacaaaattaaacaattcagaaaaagataataagaacacggaataaacatatgtactatcccctctcatgcttcctatgcaaatatactcttaattccgagtcataatatgctagccatcccttcttcctatatagttagtacccactatagcaattaatactataaagcttgcaatacgttgcaccacgtcatcgttaattctcgacatttggattggtcttcatggttccagatcaacggtgttgatatcttgggccagctccccatcaatgttttccattggcgcagccccacctcgcccacgctccatacccacagcggtccttgtggggaaaaaaaaaagcacgctcctaaccctcactaatcgttttctttttgctttgtacatgttccaatcaggtggttgattttgctagatttttcttcatcctgatatatgacaaggactattagttaatcaattggtttctacctattttcacaggtatccgtccaataggatttgcaacaattcatcgaattggtatatatcattccttaatgaagtggtaaaaaaaataaacactcttcctctctctttcattgcttgctg

SEQ ID NO: 66776 - DNA, 3812 bp, Oryza sativa
agaactttcatagtccaagtgttaccattaatcaatccagctaggtttgttttctgcataccttggggttgggatggactagtgcaccatcaaagcacacggctgcagagcaagttacgattgttgccaacctgctggtcttgttccaatcgaccacgataccactgcattgcataatctccttcccatctgaaaacataggaagaattagtagctggtaagaaatataattatcttgatctgaataaaagcttcctttacctatacttactaatataaaaaggagttgtacccctccaatcctataggccaaatcacatctatcaatccctaccgtccatccacgttgcacgcatcacaaccgtccctaccggctaccgctcaccgattccactccctccaccgcgatttctgcctgcactccctccaccgcgtgtttactccgcccccgcgagatgattccgccgtccactactcgctcctcctcgcgtgtccccgccaccgctgcccccgccggagtcgaggccgtcaccagccgctgctgccccccgccggagccaaggtcgtcaccagccgctactgccccgcctgagccgaggtcatccccagccaccgccgcactccaccgctgctgcaagccgccgccgccgaggtggttcccccctttcgccgaagataagctttcgttcgttagtctgctaatggaaacaatatttagttttttagatccatcctctcttgctccactggtcagtggtctcaggttgtaggcaggagaaggcgatctcatagcagggtgcaatggcaacatcataccatccctcgcaatgcctctggactaaagacgatactgctggatacatgttcctgtatccatgttggaggttgatttcctataagtaggttaattgcatggttgatggaatcttcatggcatcaggttctactttgcaaatttacaaattattttttcctctatagttctgtccctatggactgacatatattttgtatctgaaaatgcatttggggcttgatgtggccatgcggattcttgagtgaaatatccagcaagttccatgggtgctggaaatttgaatatagcatgacatccacaaacgggcttcaggaattaagaggaagccaatcaggacaagggcctcctgagctaatgttgtgtattgcaggtacttctttgtgtctcaatttgggcaactgttgtatcaaaaaaatttgttaatgaagctgatatctcaattgttgtgagttgttcctatgaatacatgtgcttgagcattaaagaaacaaatgtcttcagatatgcactttcatgaattctgagagaagatatggacctcccatagctagctatggagaaacatgcacagtttagacaaaatgtcagagtgcctaggaagacatgttgaagacatgttgggtttctttttccataaaataaattagtataccatttctacatcttggcaaaggttgtacttgataatcttttatggccactgtaggttagttattcactgttgtctctcctttcgttggagaatgggctccatggtgcaatggttgcagttgttggttttgaacaaagttttagtattttttgcagttcatggtacttattcaactataatagccctcaagacaagcatatattctgaggtaactcattgtctactaaagttgaaaatttaatttagttcatacttatggtacttattctgctataatagccctcaagacaagcatatgttcttgaggtaactcactgtctactgaagttgaaaaattaatttagttcatacttgaactggtttatcataaataaggttttttatgtatataaaatgtccagtggcgcaaaaaggtgcgtgattattcaaagatctaaagtaaagtgatcgatctgcatggtcttttgttcgtcgacaagaactctctgaagtttcattcccaggtatttttcctcttgtgatcatataaatgttatttcgattgcaatgtgagaagagcacatatgaagtccttgtggttgtaggaaaaccattgtatagatagtggagttcatctgcttatcaacagatatcatagttctttttttagacagtggagttatcttcaatcccactgaaagacaaatctcttgctttcagcttttcaagtgtttgtcaagcaattttgctctaacgttgcactattttcatggcaaatgtgtaacagggagttactaaaataggccatctcattattgttgatatctatactaatataaaaaggaggagttgcatccctccaatcctacatgccaaatcatcccaactcatctcatccatccattcaccaggtaaaataatcttatccattaatccgctgaaatctttcactgaatccatcttgggcgacctcgcgctatccacgcccgcaccaccgctctttccacgtgcccgacctgattactctgcccccctttccccgcgctatgccaccgccgccgctgtgctactcgctgccgcccctcctctcacgtgttcccccttccgctggactaccgcccgggacccaccgcagccacgcgcgtacgcgctgaccctgccgtgatgcctcaccaccacatcgctgcatcacgtagtcctctcacgataataacgctgccgcctattcctcccggacgacacatcctccaaccactgcgcacatcccccatccgcagtctgccgcacgcctcctctccccggaaatcgcattctcccgttgcaaatcacatcctccagccgcggaatcaccagaaatcgattcctctcgcagtctcgcccacggacgacacttctcgcattctctacagccgcggaatcgccggaaatcaactcctcccgccgcggacgacacttcttgcatccttcccagccgtggtggtctgcccttcagctggcggggctgctccatctccgtctccaccgtaatcgatggcccagtgttccccttgggccctccactgctgatgccgccgtcccggacctctctgccgccaatccttccatcctggtccgctctgctgccgacacatccacccttgccgctgccacttctcccagaggaggcgaacaatgaatctgagaagaagtcggtggccttttgtcctttttcctgcgcgacggagaagcaggaaaggtacaagaccggcagctgctataaatccaaaaacctcaacctgtgagttctcttcccagtgtctctctcatcaaaggtacagtagcagcgatagcgtggataaattgagcgagggagattattgtgtacagcttctcattgttgtttgatgtcatgtatagcatgcttttatcattttgattggatgctaatttagtttgccatacttaacgaaacaactcatagttcatatactttttttctctgaacttaataaaggaaacttgaatagaggattagaaggttatgagtgacccgtagttacttgctgttgaaacaagaaattttgctgaagatcacttctcttaataaaggaaacttgagtagtgcttggttggtgtgcagaatgggtaaaatgataaaagctgatttaaacgggaaaatgtctatgactgccttattgggctatctacaccgataactgtgttgcctggttattccacatatggccttcttctccctgggtgaatgtttatagccaactgccacttttgcttggctgacttttcattaccaagacttaaaatgcttccaacgggcaactggtggtgaattgatagaattatggtgatcttttttatcctagctgg

SEQ ID NO: 66777 - DNA, 1271 bp, Oryza sativa
acagttgttgtgtccactgcccttgcatttgtacctgcatagtaacctaagttcacattggtgggttcgactgttctccagtaaattcttgagttagaaatttccattttccatttcagagcaggttccatttttttgtgagagaagtaatgcagtgagataggggcctctctctccctctccctctccctctccctccctccctccctccctctctctactttgcccaagaaagcgcacgagcaagaaggaattcaccatccctccaagagttggagtcattgatataccctccaccccttaggcataatggttgtaggaaaaatgtgcactactcaataatttgcagctccattacgcctttagaataaataatattttgcaccactatcacagtatggattttggtttatgctatgtaatgtttactatttatcaaatataattagtgtcagtggctacttcaatttaaagaatgttgtgttatgtatcttctcgctttaagatatcagcgatatcaatctaatgttcttccactatttgttacaatgataaatagatttttgaagcaatcctgttgaatatagaagaccattgtagctcttgaattgttttcttattcggttgcctttctctaatctgttcttgtgccaggaatctctcatgtttcttatacatagcaattcatctatatggaaaaagcatggcaaccctttaactaaagttatttttctttaaaagaaatccttactgtggttagtcttttgacgaggctatgtgaaatgacttttttttttttgcttttggctatttctgtcattaacaaccttttcaattcaatagatgatggaaagcaagaatgttcagaaaatatgattatgcctgttctgacagtttattataccttctaattttaaatgtacttcctaaatttttaaacgtgccttgcacgtgcacgattcctagtcttaaaaaaagaagcagctggtaattggaggggattgtaattgaaattgatcgttagcagcaatctttttaccaggtatcctggaggaaatgccgacgacggaacgagaagccttccggatcatgctattgtctgctacgcttgcgacgcccgtgatgctgacggtgcgagggcccgtaggcttcctcctgacagtgcaagggatgacagtacctgcaggttctgaagaaatcgcgcaacaaacagagcaaaaaatttcagttgttttccttcttcctagtgacatcggctagggctgcaggaa

SEQ ID NO: 66778 - DNA, 8740 bp, Oryza sativa
  unsure (1)..(8740): unsure at all n locations
taaatatattgataaactattcatcttaactattgtggtagtagctatctattgtctcttgatgacatggtataaatttatagccagcaacgggctacactattaaacttgctataaatcttctcaatcaaggggataggccttagtaaattcgtgcaaagtctctgtaaccctaaggccttgttgggtttagaggggattgaaaatgattggaggagattgagggggaataattccacaccacaataggtgtggaataaatcccctctaatccctctctcaaagggattacccgaacaaggcctaacccatttttttcctcccggcactccacaaagtggtcaatgtgttgcttcccgacacctccttgaccccgcctattgcatcgccaccaccctggcctcgccggcgggacggataatttgtgtgggggagacgacaagggaggtggtgggtgttttctcttctctctctctcccaccaataatttatataggtaaggggactgtgtagtgtactcattatcatgaaacccctcctaaattcctaatatcttgcaaactttcaactattgaattactttaggcccctttgaattggaggataaatggaggagaggccttagtagattcgtgcaaagtctccataactctacggccttattcggtttagaggggattgaataggattggaggagattgaggggaaataaatccacaccataataggtgtggaataaataccctccaatccctcctcacagggattaacggaacaaggcctaacccattttcttttttcctcctggccactccacaaagtggtcaatgtgttgcttcccgacgccaccttgaccctatcgcgtcaccaccaccctggcctcgccggcggggcggaatacgccaatggcattggcaaggtccccccagccaacctcctctccctccctactccccctctctctttctcctcacagcggcgttggtgaggtgcccccgccacgccgtcggatccaccaccatcggtcgccgcctcctaaccgcacacttgctctacccctgccaccaacaccagtccacaaccctcttccatcccagtggcttcggcaccgcctctagagccttgccgcccgcccaagtccaccaccgcccacggccctccctccaagcccgacaatctccctccttccttctcccgtccccaacccaaccttgggccctaaaccctaattcattggcaagtcatcggtcgtcgaagttggtggagaaggggtcgtaagagcttgaggtgaggtcgccagagcacgaatcatgtagtgaatcctaaggttaaagatttgcaagattttggctacaattttctatcaacaggcatttagcacttctaataatttaattccttcttgagaaaggctatgttgcaatttggtcgttattggatcgggtcgcaaaagcgttgggcctagcggcaatgggctgtcacacgcacccacgcacgagataggctgtggtggtgggccaatagtcctacgtggcacgttgacctagtttttatccaacgtggcactacttatgtggcaacaccgtcaagtaaaaaaaataaaaactccaattggacaacatgtaagtgagatgaacctttcttcttcctctaaaaaggacccacatttcattccctttccactctctctcctctcttctatctttctcacaacaatcacactgacgccactctatggccgtggagctcgagctcttccttgtagtagtccgccgatctgcgcacctcgatgattgctgcttctcccctgcggtagcaagtccacacctcttgagcatcatggtccatcagttcgtgccatcccctcctcatttgtggtcatgcctccctcatcaacatcactactctcggttgcatgggcctgtgaaaggacgatgaatgggccatttagaggcaatggtagaagggcgactccatctccaccttccgttgtcgcgacatgctcctgttaatgccaaaatttggtaagattcttagtggatttggtcaaggaaagaggtcaatcaatgatggaagtttatctagaaaagaccaagttcaataaggaatcatgaagaccatggcatgacagtttaattctatctattaattaggcaagatttaatagttttccttttatcttgaggaagtgtttatctagtgtccaatcggatcaggacttgtatatttccttttttatctttagaaagttttgtctagtttccgatatggactactacccacccatgggtataaatatgtacacctggggtccctgttatatatctccacagatcaatacaactactctcggtgcatcgccaccctcttttctgatatttttatttatcaccggcggaacttggcatctgacgcggggctgcatcagcttcgatctccggcgaaggggtaagccctacattccgtcggccctggaaattatatcgactacattggtcttgttcaaggctgcatcacttcgacctcttggatcactctggtttgattgataaatttggtcgatccgatatttcaactctatcgttaattacattgtgtttattgtgtttagagatgcatcagtttagttgggactgtcttggttaggtatgatcttctgacttagctgatatatctctacaatcacaatggtgctttagatagatttgctatatccatcacattagagagatttatcagctcattgattattagattattatttacaatctcgtgctgcatcggttaggttcattctaatgttttatcggagtgctatcctataaaattatctttacattggacttcggctaatgcatattttaatcatcgagcctacattcaacattctatttcaatatcggccgattggttcattggatatttacttcgtcatattatcatcagccgattggattgattgctcaagttcttccatcatatttatataatcatttatccaagtgtcaaaatctatatccgacatacaagcgatagttcaaaaccctattgacatcagctagtatcattacatgggcttgttagccgatcgactctttgatcattaatttatatatcttgtcagtgcaggaccaaactgactggcacgccggcatctcatcaaaatttaggacctacgctcgagtgttgatttaaaaacacggtggcctgggagatctgcttaactccggtgcaggtccaaggctagcctcgagtgtatcaagggcgtgccagctgatttgatcctgcgatcagcaagaaagacaaaagcagaattagtcagccgatagccgatcgaccgataggccaatagcgtatcgttggtggtctcatccgatgtagttagaccacatcggctatggattgggtagatgagtgaatattaaaccctaatttgcctcatcgactgtaatactgtctatcaggtttagtaaagaagtttaagacaatattattaaaatatccgatgtgacagtatttagagcgaaaaagataatgtactagataatactctagtacagacttgtatacacaaatcaatctatatcaatatatcaaactgtgatcagttagtagtttagatagcccagccgataccgatctagcttgatataactatatgaagtgatccgtctatataagtggcaaatatacataaaactttagtaaaaaagcatatatactaggtaagatcggttgaaacttcgatgctatccttaattataattgtttccaggttagtttctagggttcaataaaagactagggatgatgcattacaaagtagataaagaaagctagagtctaaacaatcaagtaaacaatcacatttcaggatggtagatgccttaactaatctaatctagtcggaagatttagctgataccggcaagaaccctatagcgagaaccaaccgatagaggtaaatctagatactaagactagattagctaagacatatgatagcagatgaccatgataaaaggactaaaatatctaaagcgacataatagccatgatagcacaagccatcgagacatgttacctcttgcgaagcgaactcgtcgaaaagtaaaaacgaaaagggtggcgatgtgctaaagttgtattgaattgtctcacgtatttcaatgctagggggttcatatttatacctcgagtacaaacttagtccattacggacacgactcaaacctttctaaagataaaatacaaacaagaccatatatggcggtctcttgccaaaaccgacataactaatctaattaatagatgcaattgccttaatagagctctatctctaattggcaatgacgattatctcaatctaggcccatgccaactacacttcaatatacaacttccgtcgcatggccaacggtagttttagttttgacgacttcttgtttgcgagtttgggcatcattggtttcgatctcaggcgagaaagtaagtttctcaactccgcttgtatcagcaaaatttttactttctcagttaagtccgatatactagtgaagcttttactcgtgttgcctatctgacatattagctcattcttagatcgctttgttctcttgattagattcaatatatcaatcactctgaatattaccaatcgactagtttaaatctatcaagtttactattaatcttgaactttcttggttaagttcattcttctaggttataatttgctagttagatttactcaagtcaataagttttaatcattgtttcaatagagttttagccgatgagctatttgcttatcataatttaacttgctatatcggctaatttgtaagatttagcataatcagctagttgttgttcttattatcttcagtcttatactgtctcagttgagtctgatccatgaaaattgtggttgataattatagattgctaagtgattttttttaacttgctttagccgatgttagttgttttctccatatagagtaatggtaagttccaaataactcttggtacatcagcctatatccaaaagatatataattgttcagattctactttattactttcaatcttatattgtctcagtttggtatgatctatcaagattggttgtaatgaagttagaagatttacaaatatattatatcaaagtttcgaccgatgtttaatcttttgatatctaaattccattggttatagctgattgatccaaatttccatcggcatcagctgggcacatgatactttatcggccctgtgaccgattggccccacgatctattttttttttcatatctagttgtaggatcaaactaactggcacgtcttgaaaccgatttgataggacttgcattagagctcagnncaaatctctaaggccccttcgntgtgtgcgacgaattttgcgtcaacactatatttagtgagtttgttggttctacgggctgatttgatggtttccatctattccaagactctctataagtctacaaatatctcatatacatggatttaattgttcccaaataaaagttttaaagataagaaggtttcgatagactagatagtcctacggaaaaacggttgtggatttcgtatacgggcttcgttttgaacgtgagtacttgttggaaagctaatttgatggcccacatcaagtttctggtcccaccttcagatttctcatgagtttatctgcaatctaccaaatcagtcgatgaatgctgctgcagaagtttatttttcatgtccaaattatgtaacgcatttttgacaatcttttttacaatcatgaaattatgttgattctcttcttcatcaacaaatttagcaatcttttaactttttgcggaactcaacccgatcacaccaactcatggaaataattattcataacaaccagttgtaacacaaaaactattagcacattctaggataattgatctttcaacttcccttacaaggcaactctagagcatagatctttcaaatactaacattttctaaaataatttcatcattatttggctcaagaaagtagtgcctcattctctccggcaaccagcttgacgatgattgcggccttaccctcactgacacaacatctagaaggagtcaacgttgtacctagtgctctgccctgcaaaagtgcaagaaaaagatgtcatcatcggcctagagtcagtatcggcttcagagtcatggaatcggccgatgggaattatcaagtcgccaacagtcggattcttagtagattcggttatggaaattaatttactaaaggaagtttatccataagtgaccgagttcaaggaggatgtggcatgacagtttatctattaattatgaatagtctgtttgtttccttttaattatagggaagtgtgtttagtgtccgataaggactttgtgttttccttttatctttattaaagtttatttcttgtccaacaaggactagtatctacccatgggtataaatatgtacaccctgggtcattgtaatctatctctcaatcaatactactctcgacgcatcgccaccctcttttttgagattttacttatcaaccggcggaatttggcacccaacacggggctgcatcggttcagttcgatctccggcgaaggggtaagtcctacgttccgtcggccctggtaaatctatcggctacattggtgttgttcaaggctgcatcgtttcgatctcttggatcgctctggtttggttgatatatttttctacctgatatcttgattctatctctaattgcattgtgtttagagacgcatcggtttagttgggactatctcggttaggtttgatcttatgtcttagccgatatatctctacaatcacaatgatgttatagatagatttgttatatccatcacattagatagatctatcggttaatcgagtattatataatcccgtgctgcatcgattaggtccgacctactaaattgttgttgataatataaatcttgttaagctgataggttcatgctagtgttttatcgaggtgctagccgataagttatctggacgttgcattggcttacaaacattacatacaagttggatttagccgtttgcaacatgtttatctaaatcgattggattttatgtcgtcggacttttagccgatgtatgctttaaccatcagatcaatacttatcctatcatattattattagccgattggtttctattggattatattattgttatattttattatcatcagccgattgtctttatatcattatttgcattggacatatagccgattgctcaaaactctatcgacattggctaatatcggctatcggttggaattactccatcggtttgtcagccgatcagctgttttatctgctgtttacatatcttgtcagttgcagcatcaaactgactggcacgcccgtatctcatcaacatcttggacctgcactggagctaagcagatctcccaggccagtgtgtgttttttcgcatcaacaccgtgcccaacccgacccactgccatccctattcaccgtcgctgctgctccagcctcctccgaccgagcctcactggcattcccgtcgatgccaagattcgtcatcgcctccgttggattcgcaggagcaaggtgaagaccatccacttgtttgttgccgccgaaaagtgccggaacgccgccgccacctttgacccgacctcgtcgtcgtttgaagctcgctgtccgtcatcgttctgcccctcgatgagttcctcgtgtcatgctcttccttccggtgtgcgctggcggtgggcggcggggggaggagctacgcccgggccggcgagcgtcgaggaaggagctgcgcgcgtcctcctcctcctcctcgaacctgccgccatcgtcgttgtcatccattaccgccccgctctgctctgcgccactggctttgcacgccaccgcctcgccagccttctccgcccgtcaacgctgctccgcctcgccgtcgccccactttgcctgctgccgtgctcgaggtcgtcctcttcgatctgtccatgctcccaccgccgcctccctccctttctctcgtgtcgtcgccaccgcatcgccggccggccatcggacctcctctccactgccgaccaacctgcccagggagatgagtgagagagaggaggaggaggaagggagaggaggggaaagagagaccttgatgacgtggcgtcctgacatgtggggtccacgtgtgtcccatgcttactcacccaccacgtcggataaaaccggggtcaaaactaccgaaggacgtaaagtgaacggttttgtaagttaagggatgtcaaaaccggggtcaaaaccaccttgattttataactcgatgacaagttgagggaccttttgtgtactttttccttttaagtagttggttgtgggtttcagccataaaccgacccattaggatggcctgtaacgaggacaaaatacaaaacagtaaatggcccaccaaacccaatccgtgcagaggagcgctacccacgagctcgtgctctcacgcgggatgttgacgcgtgtccgatcggatgaaccaaatttatataaaacagtgcaagcgagttctcaaaagaaaaaaaaggtgcaagcggcatgggcctccattacaacaggcccacctattatctaaaggcccaagttaccacaggcgatcggtacatttcccgccaattcccca

SEQ ID NO: 66779 - DNA, 2093 bp, Oryza sativa
caatttggctatcgtttggtgcgcgcgcgcgtgcgtgcagtgcagtcgtcgattcttgaccgggacgcggtgcggcgcgtggtggcgctgctcgtcgaggcggacgaggcggtggatgcggcgtctccggcggccaccagcgcgcgctcggcgctgcgggtggtggattcgttcgtcgtgccaaggttccactacgatccgatcaagaaagtcttctacgagtacgtagatgccgcttcttcctttccttgtacatcctcttgagaatttcgctatttccttttcccgctttggtgttgaactgtggttagaattgctacattgacgaaattgagttctaagtctggctaaatcttcaatgattcaacaaagaatttatgtagggcatagattccaaaatgatgctactgattttcttttaaaataattaaacctcatttctgtgtgaagagaaaacttgttagatgtatagtattttttttttgtttggattcagtatattgtgcttcactagatgagattgttagcttcttaatgagtattgaactattgatttggttttggaaaaaaaatcaaatgacttgattttatgtgacaattaaagatttgccactccaatgagatgcagttgagactactgtatgtatggctaggttaacatgtcgcctgctccatcctcatgccaataagacatttagcggcaatatttgcagtggcaactcttgttagatatggaagtaacttctggcctactgcaccatggatgcacacatctactccctccgtcccaaaatatagcaacttttggctatgaatctggacacacagttgttcagattcaaaacgcttatattttgggactgagggagtatttaattatgagcatcattgattacacatagattctcttgatgctaggactaatgagcttaaagactgtcctattatttctaaccaagactgaattataagttataatgagttaacagccctgaaatatgctattatataggcataccagcagattagccatacatggagaagctggagataaagcagccctgtacagggacaggtatcaggttctgcttcagaggctagctcgtgatatatacttctctaagccagcttttgacactgttatgaccgaagatgataattgtgaggtatttttttttgtttcatgtcatgattttcacaaaatattcttagttcttgtatgtgaaattacttacacacttttttacatgtagataacttctattcagtccctaattgggtgcactggtcggagatggattatgggggtcatatcacagttggaggaacgtcaattctacttggaggatcttactggagctgtgccaattgacttatcgaatgctatatcctgagagcccattatttgtcatattgtagtatgatttatctaaaaattgaatagtttctttagctacctatgaaatatatataacaacaaaaggtctgctcaaatttgagtgataacatatcattaattcaggattcatgtttgacactaaaatttaatttgatccatatcaatctcttgcttactcagaaaagtgttatgctttccttagcacaaaacacaaaatcacttcaggtttcttcgttgaaaatactgtaattgtagcagaaggggaattgctttcaaatggcattttccaggtctgtaattcttatcaacaagaatgtgttcagctcttgtattgttgtgttcaatctgattttattcctatcatctgcaggtaaatacatgtggattccctcctttagaggatagagaagcatcactttcgatgcttatggggctagatttcttcggtggaggtgtcataccaactgaagaaacagtaagttcaaatatttctgttccgcatgtaatctgacttttcaaaataacctttactgattaattttatcaatggaaatatcaaacaggtaaggctatcaaccttagagaagaaggccatgaatgatatgtttgttatactttcagatgtttggcttgacaattatgaggtatcttcatttgtactaggccctatttcaaataaccattattattgggg

SEQ ID NO: 66780 - DNA, 1388 bp, Oryza sativa
actaagctgttggtaacctgtagttattttgacgactcacagaacccccttattattgttctgagagctatccacacaatatcatgatcatgatgcacactagtaatagcttcatgttaaattgaagaggctataatcaccatacctgtactagtctactgatgtgtattaacagatttttggtcggtggcatgatgcatgatgcgcacattctacttttttgtactaggcattatcttcctcattttatcaatttttttctgaacttatctgattctatctttagtgattccactgtcatttcagtcaatcttggaaaaagcttcatatactcactacccactgagactaccatatagtgatagattggcagagaagagcttgtctaagctatgccattaacctttttgagttgtcatgattaagaaaacacttaagtttgcagattgttcaattattatctgttctatctccagtaaataaaactgtaattatccagggtgaagttttatacacaagaaattgtatttttccggcaagacctcctttataggatgcggcggtcttgtctgattcccccaacaacagaagaaacaagtgaccctttcgagcatgtatgttaaatacccctcctttgttgttatttcaataagcatatattgttcaaagaattaacacatcattttcttttcagctggtagcaaccatcacccatcagagtcatctttgcccattgcctcttacagttcagccaatcatatggagctacgatcattgccttcgactctatcctactcctcatacggtatgcaatttaggacataagcctattcaggaccttgaaatgtgctctaaatttgttgcgatgaatgtgctgttgtgctcatttaattgcttgaccgtgcatgtgtgattactttcttttgtataactattacaattcatcactataaacaaaagttttggacgttctttgctgattttcttcctgaaaaacttcttcagatagtactgggcgacaagagcgaccagaaggccttcaaatacacaggaataacttgcttcaaccctggttcttttgctaacgatagcacctttgcagcttaccgtccttgcactaaggaggttgagctttctgcattagaaagctaatattaaagagatcaaaatgaggctcaccaatttggccaatttggtagcctgtaccatccaaactagcattctccaaatcttcgatgaactgcctatcgccttggacatcagcctgatatttatgacttggacatacaagttaaggtggaggccattttcatgcaagctaattcgaggagatgacataacatgcatgacgccatggttggtgtttctctcaagcaaactgatgctga

SEQ ID NO: 66781 - DNA, 1772 bp, Oryza sativa
  unsure (1)..(1772): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttttagcttacaagcagtttgtcgcccagctgtttgcggtagacctgaatgagacccgcgctgtcaatcgtctgcagcttctccttcagtatcttcctgtagcgatcgtctttgtcgtccaagcttctcatcagttcgatctgataagacggaatgtgtcaaggatatgtataagaatttgcgggaaatgaagagcatttcaacagttatcattgtgaatatatagagcttgtgattacctgtctctggaatgcttcgaattcatcggagctcaaggagccatcgctgtttgcgtcgagaagatgcatgagctccttagcatctttgcccccagcaccaaggtcttccatcacctctgtgagctcctcaatactgatccttccatcaccgtttttatcaagctggcagaaagcacggttcgtgcagttgctgtctccttgatcactagctgggaggtcacgaagacgcatagctgctaactctgctgcagccaacatgatagccttcagccttttagcctgtagaaaagaatttcaatgaatgatcattccaagtcatctagaaataatttgtctataactttagtcttttataagtcatagggcaatagattttatttcactgagttcatccaataattttttgccgggtcggccaaaagattcggtcgaccaattggctagagcgtatggctgttaaccataaggtcggaggttcgagctctccttctagcgaagtttttcaaaagttcatccaataattacaatatgtcattcacaattaatgacatattgtagatatggacgaaatccagtggcggcgtggatttatccaaaagtgatatacaacacaattccagttaaaagggtcaggatcaaataatcaatcatgtatcaactaataacataaaccaggccatctatgttgtaagctctgaagtaattagtaataggctactgactatttttaagtaaaaaggctctgtacagagtacagactatatgtcctgtatgttagtcagttagttcaaacatattatgcactaattatactgtgaagacatttgttgatatttttcaacttatttgagtaaaaacacttatcttactaatataaggggagctacctgcagtaatttgctaaagcaaagaatatgtgctctgttgtattgcaaaaggacagagtgatgacaatgaggaaactcacctctccaggatctgtaagtccacctttgtagagagagtgagatgcctctccaccaacagcaaatttatgcatctccttggttcgtatctgtatctccatcagtggcctcatcttcccaggttcacttacatcgatggccacatgcaagctctggtaaccattttcttttggccgtgtgacataattttttgtccttcctggaacttctttccacatagcttgaatgatttcatgtgtcctgtgacaagccctagggccccagtctaacgagctgccatcacaccgaggttctaagattacccttaaagctagtatgtcatttacttcttctggttttctgccatcttttactagctttttcatagtactgaaacggcttttataccgcccttgaattgagatgtc

SEQ ID NO: 66782 - DNA, 2180 bp, Oryza sativa
  unsure (1)..(2180): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcttcactttgggcttggagtactcaccactcatcgcgagcttagccgcgaggccactgccaaaatcagtgaagtgcacaccatcccagcttagcacctttgatcctggctcgcagagatcatcgcagccaaatttccctggcttgaagttgtatggaggcccaccgttgccgcagcacaccatcaacggccacttgatccctgaacacacaagaatgtgagcgaattcagatgcaatatatgaaactaccataaagttattcatgaatgtgaacacaattatccaaatgttctgaacttttaaagatgggagagtcataccatatttggtgtggttggcgacgaagtcgtacttgatggcaaacatgtcggtgtacacgacggtggcgttcttcagctgcaaccgcatttcgtcgcaaaggtggctcagctttttggtgaactgccgtgcagcttggttgtaattcgccagacagccatgggcgtcgtgctcacccttttctagcaccaccagtgcaggtaggcagccaagggcgccggtgccatgtatccagaacttcctcgcgccgttgtcgtacagaatctgtggatgttggaaacaaccaaagcttctgtcagtgtaactgcttaagagttactactacactcgcaaacggaagtttcagatgctgtattgtagtgtgtaatttacccgaatcgcgtctttgatctcactgacgatcttgctgaattttttgtcccagttatcagatggagtgtgcatcacaccagccacatcgttgtggccgatgtccatcatgtatagagcgttctcgaagccctccttgctcactggccctttctgccctgcaaataaatgcatgatgttttatcatcaatatttccaattttcagctactgtcttctatatttttttcaggtttaaactgtcttcttttttctcgcaattgtaaatgtaacagcacaaacttattcaagcagcaagcagcaaagcaaacctcgttcgaagagctccagggatctgtgcttgaagtacacaaactggtcgacttggacattcaaggaatagggagagacgccgtgtgatactgttgagccagccatagcgaagttgacaccattgctgtagtctgaaccaattgacttcaggtatgggttcagttcacgtgtattcaagctctcacctgaaaacatcatcatcagcgaccgggtagatttaaagggacattaaattactgtgacaacagcagcagcagcagcagtagcagtatttctatgatattgttttaccaccttcaagatccccatattgtgttaagcttcacatttgctaccacaccttactagtcactatatttatctaaacatggtcactacatttatcattttgtggtctaccagtaatatttggaacttatgtaaatatgttaatgttatgttgtcaggcttctggacagctaggtaattaaatcttggcccaaacataacgaaaggttacttataaccaagggctgctaagagtaatatgggcctcatccaaagatattgctcatgtgtccctaccatgtgcacatctcaatcatacatatgcatatatgtgatatcttctatgtctgtacttggggtcacccatggaagttaaagcttgcaactctcatgaccacataacgaaagtacagattctgcctgtcctaatgcaggaacaatgataaatggatttcccaccaaattctcagaagaaaaggggcatgcacagataatacactctttatcccaccaacaaaatgcatgtcatggatgggtctactccatgtgatttacagataatatatacatgatactatgtgagaatcattaactatcacatggtagcatgcatgtgtttggaccatactaatatgtaaattgcttatttcaaatgaagaactg

SEQ ID NO: 66783 - DNA, 4222 bp, Oryza sativa
ccacccatgtcgtgcactgatcacatcgttaatgacaatttcctagtgttgacccagcagctagcacgttacagtcacacaaggtaagagcaaaacaggaatccaaaaaacaaccaactatcatttcagtcaatcaagtgattggagtgcccatctgagcttccatccaatgaccatttggatcagtaatctaacttgggttagatctaagtacaagaaagtgcaagaatcagtctcctcaaggacctgggttgcaatttgcagacacaggtgacagacagggagaactaatactacttcttaagtcgagcagttcacatcaacaacccagacatatccatccaacccggtcacagagaggagcaagtcaaagatacagatcataggtttcctctgtcccaattggcaaaggagaaaaatgcggaaattgttaggcacatgctgctactgcttcggccaccaaactctccccattttttaatcccctcctccagttccacgtcggcggcgaccaaattattcggaatcactcatctcacagcttgctgatttgctagattttgctctaccaacccagattatagcaagatagttactcgaatggtcaacgaatttcagatgaaacagtataatttctagagaaatgggtcgcttggaggggtgaaattcgtggaaatttcacacgtagtagttcaaattctacagtaatcaactaatcatacggcttaagaagcttccaaatcaaatgattttgtacgcgattaaggactgggtttatggctaaatggcagcaaccaacaagaggcgaaatgattaattaatggagagattgattgaactcacagatgaagtcgatgatgacgcggccgtcggagaggcggccggtggggtggtggaagtaggtgcggccctccggcggcatgatccggatcccccccgccgccgccacgccgccggtgtcggagttggagtcgccgaagttgaacagcaccaccccggccgccgccgcctgctcacgctcctcctccgcggccgttgtagccgccactccggctccggcggcggcggcggaggcgtccgctccctctccggcggcggcggtggcggcgacgacggagccgaggttctgcctgacggcggcgcccatggcggacggcgagacgaacgcgagcgagagcaccatgaccgccaccaccaccgccgcgagcacgcagtagtactgcaggcgcaggctgatcaccttgttcccgcctccgcctccgccgttggtggggctcgccatggccatcgcgcgagctcgcctgagctctcgccttcgcggaggaagaagacgacgatggctgagtttctcttctcttctctctcaaaaaaagagcggtgagaaatgtgcgtacgcgtgtatacgcgtatatagtgtgattagtgtgtgacttggggtctcgtgtggttaggtgataattaggagtaattaattactagtagtagtttactaggactaagtgcacccgcaatggtaaagtaaggtgctatctataaaacatgtacacctcaacaatagactagattaatagtaaaccacttcaatggtatgtctacatgggtatctatagctctctaatccattgcctcgtttttctctatagactatctccatgttagtagataactttgctctctctcttcatttaatctcttctaagtaggaaaatatgctgacatggatctcttgtagagagcttatagataaccattgtgggtgccctaatggtgattagcgaatggacatcgagatacttagtacttcatccggttgataatacttgtcgttttggacaagggcacggtctctaaaaaaacaactttgactattattttccataataatatgtattgttaacaaatatatgattttattaaagtactttttaagaataatctatacatgtagtcatcatatttaaaagacaaatattttaaaaatgattcataataaaaattttaaaatttgatctcactcttatctaaaacaacaagtattatcaacccgaagaaagtattagtattatttagttggacatttttgtagttaagacttaagagtggattagttgggttttgaatgagatcacacactccctctcctcacttttttgaacttttcatagtttatagtacaagatacatgtttgttggtgtgtgctccctttgtgtcatattacaaatattgcaagttattttgagtttttcttaagttaaatttctttatgtatttaatgatactaatttggtgttgtaaatgttggtaatttattttttttcttcttatcgaacttggttgagtttgatttgggacaaatccaaaataacttataatatgagatagagggattatatcatttctttttttcctaattactttaaattttacaattgaaaatttacatttttttaatataggaggtgtatgtacatgctaaggtaatttgctagatattttagttaaggactaagatcatgaggttgattaattactgttaggacacaataattggagggagatggtgttgacgcagaggaagtgacggcggtatggcttggatttggacatattttggacattttcaaacttcaggggaagaagagtggacttaacaattgcattaacataatatgaataaacccacatggattatactaatgatgatttacagtgaatccaaaattaaataatggacgtctcagagctgtccttgtgattttttgccaatttaatggaaatttgcagaatcaaacaaaaggaaaaaaatattagtttttctactttcttgtattatacagttgtatagaaagaggttgtggcacaccaatcataactgtagaagtgtatggcatcttatatgacagtgacgtgcattatagcgatgcgtgtatatgaaaccagctgttaaggttgaaaaaaagtttactatcttttggactgatcatgtccggttatgattagcattcagcaggttttaattaagtaaatcaggcaaaaaaaggacctaatcccatttactaactattcaatttacgcttcctaggaacggatgaattttgccttttgtttttttagagatcgaactgattcctgcgagaattctgtagaactcctgtatatcaaaggagccctgcaatctgcaaataaagtacatatgtcaatgattttcttgaacagtatatagcatgagaaccttgtaatcctttagtactagcatggtacaaggaaatatttgttcaatgcaatggcaaagttgtaattttattacactttcatatccattttgcgtttttgctatcaaactgaggaccaacaagatcaaagtaccagagagttcttgcctgaaacgtggccagcttggtacagactccattcagtatacggttaaaacctgaaacttggatgcatctccctttgtttatattttttgtcagtagaggacagcaagttactttttatttgtttggattgtacaatactcttaatgtgtgtttagtttacatcaaatttgaaagtttgattgaaattgaaacgacaaaggttagaaatttttgtgtagaaaagttttgatgtgatggaaaagttagaagtttgaagaaaaagttaggaactaaaacaggccttagttcacttgtattttctattttgggtttgaactgccatactcactgcaaggggagttctgatttaaatttatagattcatctctatttatttatcaaaattaaagaaaagaattatacatagtattaacctgcacgtatcaaccccctaggatatacacacacaccccaagtgtacaaaaaaaataaaattttgaaattcttcatattctgttcttcctcaatgaccgaaaagggcctgaaatcaaatgaattcccttctgttggccagatctgttagtgattcaccttcaccatttcctttgggaaaccaaaataatcttaatttttcataaccgcgaatttttagcctttttgggcctgacaacgctggcggtcagcttgatcctaggaatggaaaattcgccacttatcactttagaagcaacgatctcgtttgcagcatcggtgaagtggaccccatcccagctgatgaacttctcaccaagcttacacaggtccttgtcattggccgtgcagcttttcttcggatcatagttgtaagggggccctccatgtc

SEQ ID NO: 66784 - DNA, 3114 bp, Oryza sativa
caatggctttcctgatttcagcaactatgggaggaagctttcgaagaatttcatcataggacaagtgcaaaacgcccattaaatcattgtgccctatgtccatggtatagagggcattttcaaaccctttgctatcaattggggcatcctcacctggatgacattcaccaaaattaagcaactttgtcactccaaaacaatgcaaataagtcggaaacccaattaattgcgcaaaaaaggaacactttgcttagaacaaaatgtcaccaaattaagatcaaaccgacctctttcgatggactccaagcatctctccttgaaaaatatgaactgatcaagctgcacatcaagcgaaaatgtggtttctcccggtgttgccgtcgagccggcgatggcgaaattcacaccgttgttgtaatccgctcccagtggcctcatgaacgggctgaggtggtgagtgttcaagctctcacctgaaaaacaatgtcatgtcacaccaccacagatcatcaggtagaaagttcagagttttttttttttgagagggaggggggatacgcaaggatagtgtatcgttgcattaagaggaataaagtttttgtacaaccgaaaacagacaaccaaaggtacattctgcaaatggtttgtttgcactttcagttgaaagataaacaagaactggcaaaaagatgggcagcacatgcacaagattccaattgcccttacaaaaggaaaaaacaaaatctaatagtgatttacatctcacttgtgctaaaacaacgaggtggtcctgaagaaacaaggttccatgcttaagaatgcagctgagctgttgagtgagatgcacttgagagctacatgacccggtactgcactggtgacctgtgcatttatttgcagtaaactgaaaggcaacacaccgtgatcgagaggcgaccggtacgtctgtcgcattcggtttactcaactaattcaacttctatttataaggtagtagcaagcataagaacaatatttttttttcaccttgctaaaaaaatctgtgatgcaacagctcttctttttttttctcatttataatctacagctaaattgaaaaggtgggtgagtacacaaagattagtactccatgcttagtagtacagtactaacatggggacgaaaactaaagcgtgactagctcataagttttctctaggacaacaaaaacaccaaggaaaaaaaaacactagtcaatcaagatgtaacctagtggcaagtaatccattcatctacttttgatagttatatttcatcttggcacacagactaaggataagtgattccgcttatcatccatttaaacatgtcactggtcatttctcgtaaacaagcgattcattaatatttatatttctcgatgcccaggtagtcaatcttgtgtggaagaatgaagagttacgcattaaatacaagaaagccattaagatgataagttgttggattgaaatatgtcaattaaaaataaatatttcagatttaaaaatataactattaaaagtagatggagggagtatttaagaagaaaatacgagcgtgcccagaaaaccaacacactcctacgactacgctagtaagtgtgcatctcaatcacaatggaacaggaggaaacaggagggcatgcggatgcatggagaaaagaatgtgtccgtgcagagaattgattgcccacggagtggaagagataccagaatagcgtgttgagctgagcacaatatctctttgaaactcgtggctccactcaggcttcacagaactggaccagagtagtcttttcggcttttcgcaaataccatttgattatcggtgaaatccaactaaattttgtcaaaaaattaaaatatactttgattttgttaacttgacttgggaaacctttcccaatttgacccagaaagtccggttttcgccggtttcgtaaaccccggctcagctagtatatatatatttcaatgaagtgaatgaacaactctagctagcatcactggaacggtagttgagcgagaatggcgggagttattaatgtcatggaagagcctgaaactggtggcaactggcaagtagaagtagttctagcgttcttgccttctcggcatgtggcacaggcaattaattcctctccatttagagagagagagagagagagagagagagagagaggagggagattttcttctgggaattatgggaatattaggcagaagagatcagacagaatgaaggcatcatattgatgatatggtgtgaatggtggaatcagtgaccacactggaagtgtcggaccatctagtagtactagtataggagacgacagagaaagttaggttcaagtaacagtgtaacacgctttccttcctccttcagtttccttttgctgatccgtgacagcttcctaatgcagaatgctggaggaattcatcgtgataaaagatagggtgtgtttcgttcacgctaaaattggaagtttggttgaaattggaacgatgtgacgaaaaagttggaagtttgtgtgtgtaggaaagttttaatgtgatggaaaagttagaagtttgaaaaaaaatttggaactaaacaaggccatagtactagtacaaagaagaagaagtctttttttacgaaattcatgcgttccaaacaaatcaccaatctaccatgaaagaacttgaattctgaactacaaggaacctttgacaatcacaagtgaatatatcaaacttcaccaagcagaggtaaagccatatcgtttcacttatacttatacttataaaaatttaaagtttgaataattttagagttgttgttttttcatcatagtttattttacaacatttacttttaaatcgctaaatatatatatataaaagttttacatacaaattattttttaattattaacaagccgtatagataagcataactgtaagcgatacaatgggctggtaccaccactatacattatgtaactgtcgcttgtgccttacgattgaagaagctattccctccgtcccaaaaaaaaaaaagacaaaccctggtttccgtgtccaatgtttgaccgtccgtttatttgaaaaaatt

SEQ ID NO: 66785 - DNA, 5206 bp, Oryza sativa
aggaaatgtcagtatgaggttctggtctcaaggtgccaacgacttgaaacttgaaagaatggcacatttgccatgtgcaggatataaacaaagaggagtagtaggtgagagaccgtgagagagaccctcgttgaaggtgcaaaggtgctctttacgacttgatcttgccttgctgttcttgcattggaagtacacaaaaactactccaaaccagtacactccgtactcgccattggcaagctaaatactaccagaccattcgactaaaaagaagataaaaaagaaagaaaatgggtacagtaacttattttttttactatctcatctgttgcctaaaaagaataaactgaactaaaaaactttaacttttaagttgattttaaaatattttaaacttttttcaacattaaattttaaataattaaaaacatatataaaaattttacttataaaatattttttatctgttaataaatcattattgtttataatcagctgttaagcaaccgtgagacaaccattcactgtccattcaagtagtcaatttgctgcgaaagggtatatagtctaatggttataagagcctcaatagtattttaggtcctagattcaactctttatgggagcgaatttttcaggatttaatagtattatgctttcagtggtaggtgacgtacccgttgtgtgttgtgttgtactgtataatcttttttaaaaaatagtcaacttgccactttggcagagtttattattattttttactgcagggtaagaaccccaagaggcaagtaggcaaccgcaaccagccaaccacaggagttaggacaggagacatgctcccaaagaggcaaagatagcaaggaccgggtcgcacaattttgacggctgccacgtgtcagcaacaccaccccgcgcgtgccgcgtgccaggagcgggaagacgagctgtccgcgtcgtgcgatccagcgttgctctctccatcccaaccgttaattaatcaacacacctgccttttctttcattctctcttcttttcctttccttagacaaaactccaaatccattccaaaaacttttttcttaaaaaatggcaaacctaccgtgacattggaccattttgcaaaagaacaaataaaataaaataaaatgattttcactccccttttttccctgaggggtggttgtcacgttctgatcaagcatccaggttccaagctggaacctggagaaaaaaaaatagggacgtcctaccatgcgagtgaaccaaacaaagatgtacaaagacctgcgtgatggtgatgctgcagttgttgcggttggtacaaaatttgaagaatttttttcaaagtttgtacgtaccaatacgacccatagtcaacactctaacaaaatgagccagtacccaatcctaaattcagtcggttgtgcctttcgagtcgttcatttttgggcccaaaatattgagaataaaacgagactataccgaccaagtattcaatatccttctttggatagggtttttcacgtaaattggttcaatctcaataaatttcttcaaacttccatcgttcatttttttttctagaataaaatatcagaatttccccgtaatttgtttcagttctaaacttctaataccaaacattttacatcctgtattttttaaaaccgaacaaattataaagggttaattagatatatgccattaaaaatttgccggatttgaaatatgccatcagtattcgcgtatttggaaccataccattgcaattttacacatattcaagatatgccactaccaatcatttatgaaaaaatttggaccaaattacccttctttccttttttttctccccctcctttcttccacagctcagagaactggcggcggcggagcggcggcagcagcgagcggagcaagcggctgcagcggtggagcgagcggcgcggcggcggagcggcggcagcaacgagcggagcaagcggcggcaacggcgagcggcgcgagcggcggcggccgagcgagcggcagcagcgtgcggcgagcggcgcggcgaagcgaccgacggcagcagcgagcggcggcggcggtggcggagcggcagcaacagcgagcagcggcggcggagcgagcggcggtggcggagcggcgagcggcagcgacgtcacagcaacagcgcggcagcgacagcaacagcggcggtgacggcgccagagtagaagcagcggggaaagagctagagatgagagaagagggagagaggtagaagatgagggcattttcgtccaatacatgtaaaatacgtatcttagtggcaccactgagattacaacaaatagcaatggcatcattccaaatacgtaaatattaatggcatattttaaaaccggcaaaattttcatgacatgtatctaattaacccaattataaattatctgactatagctagccgagtactaagaaagtgtggcaacttcaaaaatttatggctatgatctatgcaccaaacaaccgtataaaaaagtttaaactctcctaaaatttgacaaaccaaccgaccacaacctctccaccgatagaggtttaattaaattaaaccatgcttattattaagtaatctaacgatgacaataaaacagagttccaacttccaagccagtcaatatcacgctaagtagaaaaggactaattaaacttaaataaatcccaagccatctaagctcgaacactaataaaaaacagaacgcatacgcatttaaaatccaaattaatctgcacttcgaatcagatttaaaatttgagattaggattgggaggaggaggaggaggaggaggaactcacagatgaagtcgaggatgacgcggccgtcggagaggcggccggtggggtggtggaagtaggcgcggccctccggcgccgcgatgtggatccccatcaccgccgccacgccgccggtgtcggagttggagtcgccgaagttgaacaccaccaccccggccgccgccttcttctccgccgccacctcctcctcctccccgctccacacgtgcttccgcttgcccttgccccgctccaccccgccgccgccgggagcagccgccgccgccgccgcggctgagtctacggtggcggcggaggagcggacggttgcgccgccgccgtcgacggtggggggcgcggtggcgggggcaggcatgtagcggagcgtggcgagcacgacggcggcggcgacgaagcccatcacgcagtagtactgcacacggagaaggcccatcctcttcatcaccccgccgccgccgccgccgcctccgccgccgcagccgttcatcgcgctcgccatcgccgccggcgagcttttccggtggagacgagaagtaattaatccttcggagaaaatggaatggcgatgatgcgtgtggaaccgtgtgttttatatataaacacaggatgcaggcacatgtgtcactagcactttatgcttgggtttcaaacaatgtgtgtgtgtggaggagttggtgtgtttgaaattttattatatgttttctcttgctttttcttgggtggttgtcaattctttagcttttgttttagtactgatgataacaacatacatcaccaataaaataatttttagcacattttatttgttttttcaaaagaaagtcatgatgttaggatttactaaactgtttgcggtaaggatactgccaccctacggtttgacgattactgtgaaaaccaaacggttaccgcgaggtataccgtggttttgtaaaccctgccagatgccaatgttttccttcctataagcccctacgtttaaaaaaatcttgttattggatattaaacatatttaaactctcattactctttttttaaaaagaaaaaaatataagtactaaaaatatattgacatccgttacgttacaaacattaagttttcgttcgtcgtaattcaatcgatcaaagttaaaaataatatcggttagtactaaggctgtgtttagttgatggcaaagtttggattttggttgaaattggagatgatgtgactgaaaagttgtgtgtgtatgacaggttgatgtgatggaaaaggactgaagtttggatctaaacacagcctaacatggtatctgtgatgaaccatagtatatgacgacacatacttgcaccccctgcagggctcacaaaattcttattgaaatgcaaatgcaaatgcacacgcatacatagtatagtacacaacttaaatcatggtaggtggtgacaacatgaacctagctaagctatacacatgcacacacacacgtaaaagtctaccagaatcactttccgttgtcatgccagcatctttaatcatcatccagcttacttatattaacataatcagctgattctagaggcgcaataattaatgacggtgaggggatgattaaattaattagtagtagaaactagtgagaaagcaggtggaaaatgcacataaaggtgatactgctttagttgttgcaagccgtcgtggttgatcgatcagatcgatcgaacgttcgttgatcgtgtggttggtgcaacgttggtttcctatcttggccaaggaaagaaagctgacatcgcatggacctgagcttgttaccggcgagcagcgagcgagcgagcgagcaaccgcaacggcgacgccgcatccgccggcgggtcgggatcgatcgagacgcattccatccatcggtctcggtcgtctcgcctctccagcatatatgcagatttctcggtcggtcgccgcgaaaaatcttgtttgttggtattagtaggtgtgtggctgggctccgcgactttgatatatactcactctgtttcacagtgacgtagctagaatttatagtaaagatggtccatctatatgtaatatgtcaattaaataggtggtccactatataatttttattatattaactagcacatatactatagttttaatcttgatcaaatttttaggtggtccatggaccacagtgccacctagctggctacgccactgctgtttcatatataaaactttctagttttacccaatgtctagattcattaacatctatatgaatatggacaatatttgctagaaaatcttataatataaaacgaagaaaatatgttttttttcccaagcaaacccatcgtaacgtaatgcaacagaaaacggatgcagg

SEQ ID NO: 66786 - DNA, 7943 bp, Oryza sativa
ctacaattaattattagtacaccaaagggagcgcactttaaacaaaaacttaaaaaacactcccaaacatgaagcaaacataaactaataaacgccaacacaagataaagagtacacaattattagatcctatttgtgaacctccatctgaaattaacaaaaagctacatgactgttatctcaagattacggtatgcagactttaaaaacttaatatcttcatcacacgtttgtagttgtgcccagaaccgaagtcaatatgtttccctgaaaagaacctgcatataagatatagatgtcaaaagtcaaaaggaatattaatttaatggagaaattaagtaatgtgacacacttgtgtgcagggcttgtgcgattaaaatatatatgaatttcgtaaaaaatactttagatctaattttcaatttcatgatattaatccgctatacagactacaaaatcattcaactatattttcagaaaaaaaaacattaatgggagatatcgatataatgtcttcgtttggcttcttttttatcacatgcaattctccacgctacagtgaaatatacatttctggccgtccggggcatacaattagtcctaacattttgaagtttaataattagtaattggcgaaacaattcttcaaatgcacctttttttgttgctactaacattttgtataaatacttggggctgaagttacatttatgatttttctatacctcgatctcgtccaaaatttgaaaatatatccatgctcaaaatattaaagtatgacttgaaaccataagtccatatcgaaaacacgtttttttgtgaccgaagcaagtattctaacatggtgacggctactatatataccaaaaaaacaacatgacaaatacgtatgggatccaccgttaattagggtgttagttaaacggcctagctgtcggcgactgtaacagtgggacatcgtacagtactccctccgtaaaaaaaaaaggcaaaccacgggtttgcgtgccaacgtttgactgtccatcttatatgaaatttttttataattagtatttttattgttgttagatgataaaacatgattaatactttatgcgtgacttatctttttaatttttttcataatttttttaaataagatggacggtcaaacattggacacggaaaccagggtttgtctttttttttgggacggagggagtacatacgaagctgcccagcagcagccgccaaatgcacaaaaaaaacactttttcccctttttgaatacgaaaatcaaagaaatgccttggaattaccagtgctatgtactccctccgtcctaaaatataattatttttaaatcataacacggtctccgagatactactttgaccaataatatctataaaaataaaacgttttaaataaaaagagttatatattatgatagtttgtttaatgataaatctagtaacatcaattttacatgattgatctttttttattaatgattaaaattaaaaatgtttgatatattattatgctaaaaatacttatattttaggatattttgggatggaaggattgcctaattaaatcatgcggcaattgcttcaggagcagacaagccaatcaggcagagataccatcatgagattacaaaaggccatttgatcgatgtgccatcatgtacatgcacgaaaaaaaataatgttttatatattaccacatcatggcaatatatggtttggcagtagaaaaaggtgacaggtacgcgcctgaaaatgcaaatatcttcttctaatgatcaaggcccctgcctcagcttagtccaaataaacttactattaacttaccaaacaaatttaaacgagctgttcctttcagatctaccaaacgatgtagtttgtcgatggaaatgagaaccaatttggtagttagtattactttccagtacttaaggagtagttagcaagtggatggagatgatgacatataattgtatatataatggagacatggagttggtagtacggagtactcccttcgtcaaaaaataaatctaaaatttgatatgacacattctgaatctcgggtatgtctagatttgtaacgtggtaacggcacgaagagttgccagctctgaagcaaacaagtcagcagattagactagaaaaattaccagttcgcaagtcttgggtagcgatcgtgccgacgagccagatcacctggcgctctgcgtcggtctcacgtacggccgagatgctcaatcctcagcgtttcagctgagcgcttgtaaaatttgtaatttttttatttctccttcgatatatataaccttctaaaaatttatcaagtataaatatagtatgatagcgtgataacattatagcatgcatgtaattacgattaactttcgttgtaacactattttcatgaagcggacgcttaggaacatatataattccctcgtccgtacacacattatgatttttttattcctggtttgcataaattatgtaaagattataaataagttacattgtaattacatacgagttatgatataattacactataattatacaatacttgcatttgacaaaatgtatagcggaatcgaaagggaaaagtaaaataaaatgagagagaaaaataagaaacaaatatgggaaaattgggaagatatataaaagaagatgaaaatggtaaatacatatatgaatggaataagtctattttgcgtcctttgtatgaggagacagagccctcccttcaggagggactagccgaattcaggaacgagtatgaagagaaaggctacatcgaggctggtgaagactaccacacatacatggctgaggttcaagaatggtcgaagaaatattgggatctttattttaacacttcagagatggaggaggaggaggatgactgactgacttttattttaacactccagaggtggaggaggaggaagatgactgactgactaagcaagtatttatgtcatttagagcctgctcagtatttaggttgctgtgaattctcctactgggaatctaatataatttgctttgtttacatctatttgttttcatgtaagactggtttgttggctactatccatccatctatatcatatttacatgtgatccttgtgtgctagtattacaaaaaaggcttgtgatttttggtgttatgtttgtaacaaggcgcatgtattgatcttgcaagggtggtaacaatcagtgtacgtgacattttgattctggccgttgctctaatgtttactttcaggaattcctttccctgtaaaaaagaggtttttttttcctttcccagaatcctgtaaaaataaggatatatgttccctggattctttcttcagaaatttctagacttactgacaatgacaaatccatttccgtgcgataagtatattcagtaacagtatatatgaaaaaaaaattcctttcgatatttcaggattacctgataaatatttccatatggtatacctgtctttacaaatattccttgtttcttcctttagaggatataagacatgctacgaaaccagaataatctttgggctaattttctcatgggacattgttattgtgagttgtttcatttcattctcgtttatcatatactatagactatagtgcagggatgcactaatttgctagtgaactgtttcagctccaaaataatgagttggagcatgctctctttgccattgtttagagaagtagccaagagttattttgagacctattttttagcacaagaaaatagccctccaataaaatagccttaaattgtttggatccaagggttattttgagagctatttggcgtttaatgtaccttcccacagagagatatagagaaaagaccattttcagcgggccccacccgaaatagccccaattaacaccccttgggtgggatagttttttttttcgaggaaccgacgacaggagtttctcctgtcggaatttatagaagaagagaattggcccagttaataagggaaaccgggcccaaaaacctaacaagcacggttaattaaacgggaaaccgacaaaaacctatacagaaaagaaaaaggaagcaactaatgagacctcacacaagtcgtcgttgccgagcttgccaaaggcaagcagcttcaaacaacaaaatgcacgaggtctccacccaacattctctagtgaagcggaaaccttctgagcgaagccttcaacaagggaaacaacattaagaatgttgtcaacgcccgttcccaaaaggaacccggatttcacctgaagggagagagagccatcatgacgatgcctccaaggaggaaacggcaccgacaagcgtcgaaatcatcagcctaggaaagcactaggcaaggttttcacccgagactctctcaaaaatgctccacctcccaaccctcgtcgtgttgcctggacgtctgttgagggtcatcgttgccgagcttgcaagacaagcagctccgactctgcctcaacggtcaatcacaatgcagctcgaccagagaccacctcacacacaggaacccaactgcagcaaacctacgacgtggccgacgaacagcgagatagaacaccggaaaccaactccacacgccacccctaccacaccaaggagctccccggcaacgactggaagcagcctagcctaagaagggaggagcacctaagaagaggggagcgggcatcgcaccgccagagagcacttggaagaagaacaactggagaagaggagaaccggatctggagggaaaggacggatggagatggaggcgccgtccccgccgccgacaaaccgcagcaggtcggcagccccggccaggtccgcggcagctggcgccggagcagccgtcgacgccgacgaggccgcgccggagaagcccgtcgtcgccgccgcccggcctcgacgtcgggtcgggaccgagggccgctgcccgccgccatttcgctagcccctcatcggctcgccgccgccggtggaagtaccagattcggccaagggagggccggatccgagcacaccacacgctggcctgggctcgtcgccgtcgccgccgcccagcctggtcgtcacatagcacgcgccatcgccgccgcccggcctcgtcgtcgcgcagcttgcgccgacaccgccaccatcccgccagccccttgaaggctcgccgccgccaagtgagggccggatccgagctcaccggcgccggatccggacgtcgttgcgaagccatgctccacctccggtctcgtcggcgccccaaccgcgttgaccaaggagtgagggagatggggagccccgccgccgccgtctttgcagctgcccggctttgccggtggctgctcgggcggcggtgaggcggggggaggaggggaagggtggggcggcggcggatttcgccgcccgcgtcgtccctggggcggagcgaccgagcggaggcaacctaacttgccgttggtgggatagtttttttgggtgggttattttcaaatagccctcaaatagctcacccttttggatctttttggactatttgagggagggctaaaaaatatcccttggatcaaacagggcctttgtgggggtctcccctttatatttggctgcttttacgtggccttagtgtagtatattagtactttagtagaatataataaatctaacaattgatttttatgggtactctataccttctataaacgacctctgaggtattgttgattatgaatacctattttcagggtacatgtgctgctcttccttctccgaacagcagagtagcatatctgtagactgtagtgtactcagcagcttattccatccaaccatactcaataacatgctgttactccatctcaatctttgcatatagttcagtaacatctcagtttttactactaaatgggtccctaatagggataagctggccacaggcctccatttcaatctagtctaataggtttacatttatcatcatcgccccaatgggcacagacacagacgagcatccggacgaatcttcccctcgctttgagttgaaagcagtagagcatcttgaactggccgccttctcccctgtttgaggtttgtgtttaattcctgaaaaaagttggaagtttgaagaaagttgggaatttggaaaaaaaattggaagtttatgtgtgtaggaaagtttttgatgtgatataatgtgatagaaagttgggaatagggggaaactaaacacggccttcttttcattgagcccaacaggaaccgtcaatgaccctactgtgaatgaaccttggcttctactctttggtgttgatagcagcaccggattattagcccttgatgcttgtggctcttttcccaaacgtcctgaggattcttcctttccttttgagttcagcgcatgagagcagcttgaaccagccttcttctccactggtagagtttgtgtttcattcagcacattaggaacaatcaatgaacctactggaattgaaagcatggaaagggaagaaccttacttctgtactcaggagtcttggatgcttttggttcctccaactttgaagaatcttcctctccttttgaattcatagcaggagagcagcttgaaccagccttcttctccactggtagagtttgcattccaacaagcacattaggaacagtcaatgaacctactgacattgaaagcatggaaagggaagaaccttacttctgcacttaggaatccttaatttgttggttcctccaacttcacaaatctactcagatgaggaggtcgatggtttggataatctctgtaagtttggaacatgcttgttccctttcaataaggaacatgccataacattgaacaaggaacataatcaaatagcttctccttctcatcctttgtaaacaacacgaggtaggcacatcttttacgatgtgccacctcacgtggaagcttcctgagaggtcttcacaactctcaaaccaatgctttttatggtagatgggactgaccatttctgcaactccgcggaaataggaatccttacccacctgtaaatcctaattttagaatcataatctaagttttaagacaaaaggttgaacaaatgagatcaagaactcactttcaaaaagagtataattgggcatttgcaattcttttgggcacatatctggtgggcaagtcgaaatgcatcgtcaagagcatgattgccagcagaacaggtccataacatgtcatacctcatggacagatggataacctcctcattatatgcctgaagcacaaaaaagattgcttcctcatacactactgccaagtcagcccagttatactgatgtgtgtatcgcaatggttttggaatctctcctaggattgatcttgctatctgagaataacaaatatttataaataagaaacaatgtaaaaacatgaatatgaacaatgcacaaaattgaaatagaaagttagccagtacctttggaatactagatgattcaccaagactcatgctacaatctgctgtctgtctcttcaaagaatctctatcttgttgcccccctacaagatgtgtgtatctcaatggttttggaatctctcctaggattgaacttgctgcctgagaaacaaatatttataaataagaaacaatgtaaaaacaagaatatgaacaatgcacaaaattgaaatagaaagttaggaagtacatgtggagcgttagacgattcaccaagactcatgctacgatatgttgtctgtctcttcaaagaatctctatcttgttggccccctacaagcattgcaccatcctggaacatcttcagtgagtttacattggatcggacatactgagtatgtgtcatgccacaccgttcaggtggttggtttgttgccgtggctgctgatgtttgccattgccttg

SEQ ID NO: 66787 - DNA, 19028 bp, Oryza sativa
ctccacttttcccgggctctaaaccgtgccttctcccggaagctaagcaacaaccggttctcgagtggaacccggcgccgcctcccgcctgacacgggggacagccctgtcattccctcataaatgaatgatgacttgcgacagcccttcctcgagtgacgcttggatgtgacgggtcatacccacccccactccaccgggaacaagggcgacgtgaggacatgattgccctttccatcggatgcgacggtgacaggccggtcacagaccggtcacattcgatggacaggggttagctaggcgcgccgcatgtctgcccttaccgtattaaatgcggtgagggacagttggggcgtcgcatatttatggctgttcagccagtgctcccctctcgctctctccctctgccgcgtggcagccgggtgaggtcctcggggcgaagccgcgggagagcccgagggggtgacgtcatgccccccctggccgcttccacgactcgcgtgacgcgtgagtggggccatcttgcaaagtcgcgtggccggaggaaaagtaattcccctctacttcacataccccgggcccatatctccgacagtcttacattgtgaaacagaaggaatattagttaattagtcagtggttacgctatatagatgtaatgccaatatgccattaagtggccagcagtgcataatgcatttatttttaaggaaaatcagtgatagagataatgtacaaacacatcagcaacaaagaaaaagacagattgaacaaggactagctcggtcttgcatacatttgggatcgttcgaggaacacattggtgaagagtacttcttgtattccgtgtgcatgtttttttaaactactaattgataatatttattagaaatgtataaaaacaagtttatttaaaaaattatattaattcatttaattattttcaagtttaatctaaataacacttactatatcatccgctaacggctcacatctttctagttaaattgtctttcttcttctttcccttaccagaaatataagggagggggataaatctatttatataggtatattgttctttcgtccgttctttttaagttgtattttttttcacacgcggtagggatttattttttatatggctggtttttcgccctagcgtcgtcgccacgtcgatctgcatccccatgcgttccctcctccaattgattgtaaaaatcgattcccactattctctcattattttcccatgatatttccaatcaattaagctttaatttaccggatataatcttcatttaaaagtcatcatttttatcccgagtttatggttttgctccgattttgataaaaacggtaagaggaaatcgagcgtatcaaaagcgctcaaccaattttagaaaatcgagaaatattcgatcggatttaatggggacgataggttccaacattgtacggagagagattgtctccgtagattgaagatgacattcggctatacaaggtggtcctacagcttcacttatgggctacgtcaaagagaggcaggccaagcagatgtatgtaggctaggctaagcagatgtatgtaggttaggctaggactgaaaagaaaggacgaaatgtgcttttggctcaaaacaacgagtataatgtatgcgatccaaaaaaaatacttttattgtttgcaacgcacgagtatttttttagtacagtgataaaatgcaattgtgcaaacaaccgttcctaatttgacacgtgatgatcctgctacgtggattatggtaatattatctcaactagacattgttgttcatgagctctcatcacatggattaatacaaagtggagtcgaacactaacgtgctgcatgcatgaaaaatgaaaaatgcatcgactaaccaccagtgcacaagcatcattatggtgtacatgttcctccgttattttgacattttgaccattttaaagaacttatttgaagaatagaccttaaaaaaacgtcaacaaaaaagagactgcaatctcatcgtcatcttcctggcgctgataaggattccacgtggacacgggatgccatgtcagcagaccgcaagtgctgtataaaatcttatgtgcttcccttatcatcagtggttgagtagcatccaatctaacccaaagttgtaggttcgactcccggccctttgcccacattttcttttttgcttttttctcaccaatgagcatacttcaaacaaattataatactttcattctttttccacattattattttccaaaaatatgctccaacggtacattcaaaatatgtagtacctccaatttttttttcttatagtattatttcccttttttttgacagtattgtttccaaaatatttctttttaaaagcaccggaatcaaattcaaatatatttcactgcaagaattcgatttgcttctaaaactgactcctaccgcttggggaacagtgccggaagaaaagaataaaaggacggtaaacctgggaaaaaaggtaccggaagaaaaggacggttaaaaatgacaaaaaagagagagagagagaagtgaatccggattacttaggcggtaccagttttcatcaacgacggatgtaaatggaacggtccagatcagtggggcgtactgtttatagcactgtagcatagaatactgtttgtacggtcgctgtatcactagatctgagtaattgatcactgaaatggacggctgaaattgcttgcagttcttaagtcgcagtcacagctataactgcaactgatctgaatccgagaaaagtatagcctgctacctcagcgtgcaagcacagaggccacacgccaacactacaacaacattggttggtgctgctaggctccgttcgttccgggcgatctgggggactgagggagaaatgcatctcgtttttcgcgcgcacgcttcccaaactattaaacggtaagtttttttaaaaaaaaaaaattataggaaagttgctttaaaaaatcatattaatccatttttaaagtttgaaatagttaatactcaattaatcatgtgctaatggctcacctcgttttgcgtatcttctcaatccccttcttctcaaacacacaaaagtagcaacatccgaacaacattgaaattactttatattttcagcgatcaggcttttctcaaaatatatcaacttctccaccaataattatctttccaaccaatcataacttttcactattcactttttctacctacctccacttctcaaccaatcacaacctctccctatttaatgctactattttttaataacagtgtccaactataaaacttcttatagtttaggatagatgtagtagtatttagtatcaaacttatggggtgtttagatccaggggtgtaaagttttggcgtgtcacattagatattatatagggtgtcacatggggtgttcggacactaataataaaactaaatacaaaatccgtcagtaaaccgcaagacgaatttattaagcctaattaatccgtcattagcaaatatttactgtagcaccacattgtcaaattatggagcaattaggctcaaaagattcatctcgcaaattagtcacaatctatgcaattagttattttttaacctatatttaatactctatacaggtgttcaaacgttcgatgtgtcagggtgtaaaatttctgcgtgtgatctaaacatgaccttagaatttacaagacattggtgcaaaaacatatgtgtgccgtcagcccgtcacgtccatgggctggcctaagcgtttaacttgggaaaaagtatattttgactccctcaacaatcgcccgagtatgattctatgtcctccaactataaaaccggatatatcaactcctctaactgtcaaaaccaatgcaaacaatgtcccttgacggttttagaggtggttttggctgacgtggcgcctacatggtgttcttgactgagcctttgtcctacgtggcgtttacgtgggcattagaataaaaaataaaattaaaaaaaaatgtgggacccatatgtcattcacaaaaaaaaaattccaccgcatttctcagcctcctgttcacgcgaacccatggcggccaagctctcgttgctcatgctcctcgtcctcgtcctcccggcttccggcgatgacgccgcggcgcgttcaacgtgacggagatcctcgggcggttcccggagttcggcctgtgttcagctacctgatcagaaagacgcacgtcgaccgcgacatcaacagccgcaacacggtgaccgtgctagtggacaactccgccgtggactgactcctccgctgcagccgccaggctgccgcgggcggcgctcgtcgagctcctctccgtccacgtcgtgctcgactacatcgacgccgcgaagatcgccgcgctgccgcgggggaggcccaccgtgtcgacaaccctgttccagaccaccgggaacatgtgccgccgcaccgggtttgtcgccatcacccccgacggccaagggtggcgctgtcttcgcctccgccgcgctctccgcgctggtgaacgccacgctcaagagggtggtcgccgcggtgccgtacaacatcttcgtgctccagatcagcaacttcgtcgtgccgccgagtgtactcacgaggccacggccggcgctcccctctgccgccgccgctccagagagagacgagggatagagaggagaggaggaagggagagggaggatgacatgtgggtcccacaatatatatttttaataacatatgggtctcacatattttttttatttttattctaatgccacgtaagtgccacgtaggacaaagactcggttaagaatgccatgtaggcgtcacgtcagccaaaaccacctctaaaaccactaaaggatattatttgcaccggtttttgatagttgaaggagtcgatatacccggtttcgtggttggaggatataaatcatactcgggtgatagttgagggagtcaaagtatactttttcctttaacttgggtcagaaaagacacatagcccctagagagaatggcccatctaagaaataaggatatgggccaacctgagaggaacctaggccccctaaaatacagcccaatttagatgacaacgacccaccagcagatataatagccgtcgtgcacaccatctaagaaagaaaacttaaggggaaatgttcacttaggtacttcgtgtataagttaagtttcattcacgtccctcaacagtaaaaccggacataatgtgtcccttaagttttaaaaccggtgtaaattaagtccctcaaaagttttagacaacaattccatcctatgtgacatccacgtggtgtgttgacctaatcttcatgtgatctgatctttatttttacaacttataaatgtgcttttctttctcaaagttataggttggggtaaagattgtgctttgtggattagataaagatgtcacatgaagtcggctttatgtaggctacgatgctatatgcgtctgcactccatcgtctcatgttggagctttgtacgatacaatgtgctgacgactcaatctttatgtgagcatgaagctttatcatatatacttctattgactctttcagtataacgacatgggttgaattactcaacaatgcttatttatgttaggactcaatccacatatcacatacatagtaggtcatcatgtaaagttgtcctttgtccattgcacactagagttctaagggcatttacattgctatgcgatggataatgcatggcctcacaatttcatcgcaatgtcacgtcggacagtttatataaaagtttctgcatgaagcacattgttagtagtttgaaaaacatgctaacgggaattaaggagtagccaagttcaattagctctttagaatagacccttcttcgacacagatcaaggcgagcggctagggcgctgcctagcagtgtcctagcaggagctcatgcctcatggagaaggcaacaaataacaaaagatgtaaaacttggtgtctcttttctttctctaagcctcttctttacgggctctagctcctacttcctccgttttacaatgtaagactttctagcattacccacatttatatagataatgctaaaaaatctttaataagtcttacattatgaaacggggggtacttggctttacttcttcattactccataaacttataaaaccgttctatttatcagcttcctcttcctcaaatcttataatttgtacttaaaaacaactgctatttgtactaagaaaagtggatttctaataacattgtatgatctatcatattcataagattagttactataaatgtcaaaactcaattatcactaagtgggtgacgaccataacatatataaagggggtatattcattcttctcctttctcgttattccttttgcctatggtctctcattctcttagataaggggaaatcctcatgccacttaagctatggccgggggctaagggcctgtttggggtagctttagattctgagaagcagctgtttggtagccagtttctgagaatctggaaaagctctgaaactcagcttctccagcttctggcttcttagtttatttttcagaatctgtaactacatattctcagaagctgtggactgttaagggcagcttctagcagaagcagcttttgggaaaaacttttgggaaaagccgcagttgggacaagctctcccaaacagggctaagactaatttaggtccatatttaaaatatgattttttttgtcaatcgagataagtcaatttaaatcactcagggcatctttaaaatacgatgtactactccgttctataaaaaaacccaatcctaactacgaatctagatatatgtgtgtccagatttgttgttaggattgtttttttttaacggagggataatatacaacattatgaattttcttatcaatagttagcatgtgaattgggttagttccttcatacggagtactatatcgcaattgtgagtttgtgaatgaatgcacatgcacggttacaccgtatctgtcctcgtatgcgcatacgtattccgtagacgctcccgtcggggtcgaattcggtattcgtacccaaactcttcgtatttacatttctgccattctctcctctcctttgtcctttcttgcgcagaaggccagagagacaagcagaggagaaaaaaaaaagaaaaagaaaaaaagaaaaaaaaaacatagcgaagaggagcccgcgagatggcgatggcgagcttggcgaggaggcgcgcggcggaggcggcgctgctgcggcgggcgccggcggcggcgtgggcgtccgcgtggagggggtacgcggcggcggcggcgggggaggagagcgacgtcgtggtgatcggcggcgggccgggcgggtacgtggccgccatcaaggcggcgcagctagggctcaagaccacctgcatcgagaagaggggaacgctcgggggcacctgcctcaacgtcggctgcatcccctccaaggtatcgccccctccctcccgccccgtctccgcgccgcgatctgggatggatggctgcgcgttccccgctgttagctctcggagagctcgtagatccgtgcgaattcgtacgacgaatttgggcgttagggtttgcgttgcgcgggtgtttaggatgtagttgtttgatacgtttcggggtttgcaaaattttgatttatccatgtgaatgtcagagaattgggacctgctcaacaagctatttggggggtgtggtgatgtgaattttaatatggcccccatcggttgggcatatatgcgaattatacgccttacagcgtattagcaaaagaataatgttttgtgggtaaaactatagatatgagatatgtttttagcgatttaaaagctaatgctgaaaaataaacttcgatgaaaaaactttaaaattaagccttaatattcaaattcttggcagcggctgatttcttataatgaaaacgatgggggcctatggttcctgctcttcatgccagattgtcagttcagtgatgcgaattttgagtcttcaagttgtgctaggaatttggaacccgctgataatgttatcagtgctatttgcagctgggttttatattgaattgtctgaaatgtgtggattagttacagtcagttccttttcttctttgctattattggttaggaggtgatgaatcatttcgacccattctatttagctgtgccatcgatttattatgaattacgaagcacaatgggggtaatatgatgccgtaggcctgagtttttatcagtgggtcaactttctgatatcttttagagaaaattgcgaatatcattgccattttatagataagagctttgagtaatctgaggttggtaatctcattgtttgctctacacttgttctgctagtgtgcataaatttgcacctgtcttcattagctagtcatcattgagcatgtagttggaggtttcattattagatctttattgctttagttctgaggtccatggttggggccaggtctgtcatgacaaagggatttaacctacttgatccaacacaaaaattggaatatttttggtgctctaatgaagctagggatggataactggtctcgaaatttggtctcgaatgctcatacactatttattagccgatataatgccacattttatgatgttagtcttttcatatggggccagaaatattaattgaatatcgagaaggtagattcggtattttgctctttaagagtttcagcttatggcttcagtttttctcatctatagttgccactttctattctttactcttgtttatggttcaactctagataaaacactatgtacttcctttgaactgtactatggttatccttctggaatgcaactttagttgaacattaacatttttgttgatttcatacatgctgtatcttcacgcatgcttgtgaaattggtcatgttaaccatgctgaagtagatagatataccaataaattcttgttcaaatgctactgcataccctcctgaagtaccaattttgtacttagcttttgcagttatgtatttgtagctggcttatttgaaagaatgcaaattgcaagtgcatcatttcgatggttattgcattgcatcttatttgttttcttttatcatttcaggctctcctgcattcgtcgcatatgtaccatgaggccaaggcttcttttgcacaccatggtatcaaattctcaaatcttgaaatagatttgcctgccatgatgtcacagaaagacaaagcagttgctgggctgactaaagggattgaaggcctgttcaagaagaacaaggttgagtatgtcaaaggatttggaaagtttgtgtccccttcagaggtatctgttgacttgctcgatggtggtagcactactgttaaagggaagaacataatcattgccactggctcagatgtgaaatcactccctggagttacaatagatgagaagaagatcgtgtcatctactggtgctcttgctctttcagaaataccaaagaagttggtggttattggagctggatacattggtttagagatgggttctgtctggaacaggctagggtctgaggtcactgtcgttgaattcgcttctgacattgtcccgtcaatggatggagagattaggaagcagttccagcgtatgctggagaagcagaaaatgaagttcatgcttaagacaaaagttgttggggttgatacctctgggagtggtgtcaagttaactgtggagcctgcagctggtggagagcagagtgttcttgagtgtgatattgttcttgtatctgctggcagagtaccatacacctctggtcttggattgaacgcccttggtgttgagactgacaagggtggaagaatccttgtcgacaagcgctttatgacaaatgttaagggtgtttatgcgattggagatgcgatccctggacccatgcttgcacataaagctgaagaagatggtgttgcctgtgttgaattcatcgcaggtaaagaaggtcacgtagattatgacactgtacctggagtggtgtacacacacccagaggtggcttctgttgggaagacggaagaacaggtcaaggcatcaggagtggcctaccaggttgggaagttccccctgttggccaacagccgtgcaaaggcaattgatgatgctgaagggttggtcaaggtagtggctgagaaggagaccgatagaatcctcggtgtacatataatggcccctaatgcaggtgagataatccatgaggcggtgcttgcacttcagtatggagcatctagtgaggatattgcacggacatgccatgcgcatccaacagtgagcgaagccctgaaggaggcttgcctacagacctacctgaaggcgattcacatttaaatcatgatacagtttcaactgccatctaaaaatattccccaaagttttgaaataatatggaacgatgtggttaaaacatctagtttgtttaccatttcctcagcggaactgtgaattcgcaccttcacttcttattgtagttatattctttttccttgctagctggcgcgtctgttcctactccttaataatatggtaaaaacttaatgctgaatatgtttcttttttctgttgatacctgagacaagaataccacagaggctggctcccctagatcagatggcgcccttcatctctggaattttttgcttaatcccaattctgatagtctattttcagtatctttgttgggacataaaagatgtataattgtgtgcatgtcacaaatctttccatgattcattattgctcaaattattaaattctactgtaattacttgcagttgcaaacttgcaatatgtcttcagttctgcttggttactcaaacttatcaacgaaaccgcaaggtcaagggcgatttattgaaataaatatttggcactggattttttttttaggcaaatgttttgttgcttccagcatcaagcaaggcctctgcgatttttttagaaaaaatcccgtggaacaatactacacaggaatgaaatgaaaccaaactcctgaaattttatataccaacgacctgtttggcaacaattggggaggggcataatattagctctgggagttgagtgagggaattaatatgggaattgacttttaattccaatctcttgtttgggaatttgattcacattctctgtttgttgcgtgggttttgaggtacgaaattatatcggaagacatgataaacggtaagattaacgagagttggatcaattagtttcccatcctaatccctctaaatttcccacatcctccaatcaaactgagattataatgcttaagggtgagttcgagggataggggattgagaagattgggaagatacgcaaaacgaggtgagccattagcatgtgattaattgagtattaactattttaaattgcaaaaatggattaatatgattttttaaagcaactttcctatagaaaatttttgcaaaaaacacaccgtttagtagtttgggaagcgtgcgcgtggaaaacgatgtgctatatcactcattgtccatgaaacgaacgcactctaaatctcctaaacttccattccctcttttcaaaccccccaaccaaacaaactgcaaatgctttctaaaattgagtacgcaaaaagtgtaactatgtcacatgtcacacaacacagatcttgaaacagttatatcaaactttaggatccaaatttgtacgagttgaatacaaggaaacatttttatatctcctgatgttaaggcccgtattaaattaagcccaaaaacaaaatcacatctctatccaagattccagacaagccaacaagtagagtaaccatcacagaaaccttcaactatccaaaactcctcatcctccccccattctatcaccaagaaaagaggggaaaaaaaaagagagaaaaaaaaagagagagagaagagaggaagagatggagatggccatcgacacgccatcgccgtcgccgtcggcctcgtcggcggcggcggggaggcagacgcgcgcggcggagtcggtgcggctggagcaccagctgctgcgcgtccccctcgaggccctcaagtccaccgtgcgcaccaaccaccgcctcgccgagaaggagatcgccgccgtcctctcctccgccgccgccgcgccgggaggaggaggaggaggcagcggtgacgccgccgccgtcgaccacctcacctccctcgtctcccgcctccacggcctcaagcgcaaggttgtactcccctccccttcccttccccaattccccacctcacttcgccccccaatcagtctctcgccgaatccacacttgccctcgaaaagatcctggctcgttgatcgattgattctctattctatctggatcctacttaggttggggaaatcccatttcgttgctgatggattgattgattatgatgatgatgatgatgatgatgtcttgcagatggaggagggagcgcgggcggaggagctgcaggtgcagaggtgccgggcgcggctcaaccgtctcgcatcggcgagctctggcgatgatgctgagtgggaggaattgcggctcaagcggatcctggttgattacatgctgcggatgtcatactacgacaccgccgcgaatctcgcggagacttccggcattcaggtataagaatggtagtagacaggaagaacataccaaggagagattttccattggttgtgtatatagtttgttcactaacctcacatagtcacattagtggcaacaaagcaagcaataacccacaactttaccctttggccatatcgattgtttgccgctgaaatgatccgtcaagtttgttgaagttaactaactaatcttgcgacgaagaagtatgaatataatgctcaaattgcctgcgagctccttttaatcctttgatgaactagggcctaatgttgcctttaaccataattttacctgtattttatttgtccacattattcgatttccactctggttaagttttgcagtctcttacatgttatatgcttgactaccctcctgccaaacaaaagagaatgcttgttttaaaactatctcatctgtatgtgaatgcagatgacgtagcataagttaatctccttttatttgtagttaccgttattcttttattttaccaatgtacataattattggcgagtagccaaacatgttgctttctgctttttggatatagcatgaatacagaacattttttgtaatgaatcttaagagttaagatttgctttccgctagtatataagtggcttcagcaacaatgataatgagagcagtatcaattcatgctggagtcgagactgatcagtacatactgcctttaactcccataatccataattactcactggaacataatctgactagtcaacttatgcaggaccttgttgacgttgatgtttttctcgatgcaaaaagagtaattgattctcttcagaacaaggaaatcgctcctgctttagcttggtgtgcagaaaacaggtctcggttaaagaaatcaaaggtttgttttactgtgctatttcgtaattcgtactatattgattggtttgcttcaataaaaaattcagcatattagcaagatgaaatgattaatctttggcgtatgatgaaatactggtgtctggtgcttgcattggcatctgattattgatagctctgacttctaatagcacatgaatcatggtggattttgctggctcaaattcttaatcttgtaagctgtcttctttattggaatttggaggcgatttgttctacatgtcctctgttaaaaagcatcctaatctaaagaaacaggcgagagtgcatagtacatcaatgaatatgatgttagtgtacaacatttcttgatgtcattttcaaagaaacaaaataagcccagtttttttaggtgctgactggcgtatactactatctttatgttaacacaattgttagttctagtacattagggtgcctttgttatttgccctgattagagtgcttttgttattttccctgcagagtaagcttgagttttttctgaggcttcaagagtttgtggaacttgtcaaggccaagaacttcatgcacgctatagcatatgctcgaaaatacctttctccctggggggctacacacatgaaagaattgcagcgcgtcacagcaacattggtttttagaagcagtacaaactgtgctccttacaaggttagcagcattgtctgtgtactcttgtttttttttttttggtgtcactgcatgcctgcatcacgaatctgaccacatattttcattcaaatatattattatctatttgactatatgtgcattcttggagagtcctctgatatcaactcctattggagtagagctgcatcatagtcttcataccatgtgtttatgctcgcaggtcctgtttgagcaaaatcagtgggacagccttgtggaccagtttaagcaggaattctgcaaattgtatggcatgacattggagccgttgctgaacatctatatgcaagcagggctcacagctctgaagacaccgtatccttcgcctgatcattattttccgcttcacctttaccatttaatataaaccactagcattgtattacattctcttttttccttgaccatcattagattctgcttcgatggtaactgccccaaagaagaccccttatccctgcctggcttccggaaactagcagagccgcttccattctccaagcagcaccattcaaagcttgtctgctacataaccaaggagctcatggacactgagaacccaccgctcgttttcccgaatggctatgtttatagcaccaaggtaaaaactacgagctgaaccaggtcattacggtattatgccgatctgcgagttcatacttgaaaccgtcgttcgtagtgccacactgataatccgttgctggctgttcattctatcctacctcaggctcttgatgagatggccaagaagaatggaggcaaggttacatgccctcggacaggagacatctgcaactacaccgatctcgtcaaggcctacatatcatgatcacacaacgcgtgtggatctcatctgggaagacactgatttgcgcgggtgatctgcaccctgaatgcttgtacatagactgatcagaacattctctattctgttaagtttagtctgaattgtgatgcaaatgcaagaaccattgaaactacttcagtactgatttctgattacactttgaccttttgtgtcattgcattccatttccatcctttttaacctttttcttggtcaaaatgaattggtgaaatctatctcgaaagtaaattgattcatgcgaaaaatactgcactctattaaagtaggatttggaaaccttataaccatcacttttgatattaaaattaaatcagcatatagctgcagtatgaatatgctttacatgaaagggagatgacttgtacgaatggttcaaaacgcctttccagcctctgctcccacgaaagcggaaatccatgatgcgttttccaagcaagaaagcggaaaagagaaagtaaaccggtgccctatcctgagtaatgggccggaagagaagcaacgaaccagtcccaagcccaacaaacccagatgaaccccagccgtccgatccgaaaacccctagatcgaacagcccacaccgctccacctcctctataaagtcgatctccacatgcgccgcccaaaaccctagccaccttccccccacccctctcgccgccgcagccgcggaggcgacccctcccccgccgccgccaagatgcagatcttcgtgaagaccctgacggggaagaccatcacgctggaggtggagtcctcggacaccatcgacaacgtgaaggccaagatccaggacaaggaagggatccccccggaccagcagcgcctcatcttcgccggcaagcagctcgaggatggccgcaccctcgccgactacaacatccagaaggagtccaccctccacctcgtgctccgcctccgcggcggcgccaagaagcgcaagaagaagacgtacaccaagcccaagaagatcaagcacaagcacaagaaggtgaagctcgccgtgctccagttctacaaggtggacgacgccaccggcaaggtcaccaggctcaggaaggagtgccccaacaacgactgcggcgcgggcaccttcatggccaaccacttcgatcgccactactgcggcaagtgcggcctcacctacgtctacaaccagaaggcctaggttgatgcttgctgctgctcgctttgctctgatctgatgcttttcattcccttttatctgttattatcatgagctgagatgagctgctgctggttacatgttattcagattatatgcgttttgttctccgtttacaattggaaaactttgagtagtagcctcttggaatattattatctgttactgaattgatgatgcgatgtgagttcacttgtgttttctgattcctgttggatgattagtttgcgccagtttcgttgctctgatgtgtttttgagatctcactgattgcaattagataattgtttttctgcatggactgggatgcaattgtgctgattgctggtctcaatggaagtagtctccataattttttaatcatttctgctcatccgttcagttagatgtgcaattgttaatctgattgtatattctgccattaagcatagtgaaggttaccatagaaaattttattcttgtatggcgacttgattgtactgagtgccgatggtatggctcaagtagaagtggttgcgatcatttgcagattgtgtcacataagtagcattgtatgtgtttgtgaccattcttgttctgaagtttagggttgttacagagtttttttttttcttacaataacccttggcttcattgggtggtgcaatcttatgcttttttttggggggtggggggtggggggtgttgaatgatgcttcattctgatgattcaacccccaaactacagaaattatctagatttgaccaatgcttttctgaaatttctgtagtttggatatacaattgctctagacgtgactaatgtgtatgtgatcctttcttgatctgaaattatggggtgctggttagcttctactttgcagcttctcgggttttgcagttattcaggatctgtttgaaagcttgtttagcttttgccttttgctgctgtaggaacaagaaatttcattagcgtatgattagttaggtgttaactattacaaacttgaaaaacaggtttatttgaaaaaataagttatgttgcgctccagatgtgacagttaatctggtgggattaatgtttgtttttattgaagcccagtgaagttctactcttactgtatgctacgttggcttaccagccgtgtgaacctgacagtttattttggagttgattttgggtttttttttcatcaatttacttttcagttttagcttttaaacgagtaaatgtttttacccaatttttgttctactaagatattataaaatttataattatttatagttaagcaggagcgtaaaatggatcgtgcatttgtacgattaggttgttatctgttgttgcctattgctactgactatgatagcgttctgtattctggaatacatttgtttgtgattcttttgggttcctgtgcacaatctataacaggaaatggtaccgttgagcttcttccaacagcttatattgtcacgtacaacagcgtatatacggatataccttagactttttattattagaagctggttagtcttaagcttcctgaaaaccgtcgacataatagttaggagccttaagagcaaggtcaacagtgcagcccactactaccccaaatcttctatagccaatgtaatagccaattcatacaatagttgtttactatactattaatacttggtcccacctgttatacacatattacgtcttggagtccgtgcagttggctacagatctgtagcccactattcttatctctctttctttatctctttaaaatatatttatagttggcttatagcctgctattgtacctgctctaaatgagctactccagaagcatgggattaccaattatgtttcttataggcatgggattaccaattatgtttcttataggttatctctttaaaatatatttatagctggcttatagcctgctattgtacctgctctaaatgagctactccagaagcatgggattaccaattatgtttctcataggctgtgtttagttcagcgcaaagtttggattttggttaaaattgaagatgatatgactgaaaagttgtgtgtgtatgataggttgatgtgatggaaaaagacagccataatcttaatcttttcgcgtcaccgctgggtcggtatttttcttctctatggccagtgtacaataacggccacggcgatcgtcgatagatgttggctgctggctgtgacctgtgatcccaaccacagcagccgcatttattcaaagccctgagtgcgaattcaacaatactcttaaacgatgttttgatttctcaacattgttacatcgcgttctgatttatgaacatctctctatattcattcagccttttactcgtcttaggaactccgtgctcgtttttcttttttattttctagaattttggaggttttgttttacacactgtatgacaaatgtgaacgtccagagatgataatattgattaagcaaggccaaaaagattgtttgcagatatgctccaccgtggttgctgctcataactgcattactggaattgtggtgatgctaatcatgccatgttcttgctgctctgctatagtatgttgcagaaagtgttcttccctcaacttttccaatctctccttttt

SEQ ID NO: 66788 - DNA, 7742 bp, Oryza sativa
cctgcagcccgtccccaacttctagaaacaaacacatagtggtgttcccatgcatgtttcttcactcgtcgcatcttttgaagaccgaaaaatcaacagcgacccgaatgatgtaggaatgccaccaaggcaccaacgctaacattgaacactagatgttcctgccagttgctgaagttccacagaatctcactatgcaatcctggctgtgtgcggcacccttttttttcaacctttctatctcgtttttcacacgcacgcttttcaaactgctagacaatgtgttttcttaaaaagtttctacacgaaagttaccaaaaaaaatcaaattaatctattttttttaaaaaaatagctaatatttaataaattacgcgctaatgaaccgctccgttttaggtgcggagggaatgagttatcatccgggacatgcgaacgcagctggtgggtgatacgagcacagttggtgagagatattggctggtggcattccggactgtgaatctgtgatggcatcccgatggagtttcccaggcaacctttgcatacggacataggcgaataagaataagattagagataggactatctccctattcttactgctttctcttttttttttctccgctctttccttctaccaatgatgatctagcgagatagggattcaagtcctccaatacccacgctagatctgcacctgcatacggagccttggcgggagcagatgagagaggtggtggctgcggaggcagctgcagatgcattttgtggtaagagatcgaattatgaattctgccttgtcatgcattattttcctaagctatatatgtcattaattacgatccttcggagtttttttttcttgaacgatccttgtgggagtcggaagtgtatatacgcacgcacttaattgcatggtcaatttatttacgtcccggattaatttgtcaagcaagcttttgtatattcttattatatttaacagtttactcagacgaaacacaggatacatattttcacaaccaccacgtgcatagtccatataagtggcagagccccgaacatgaaggactctcgcttattccgacacaaagcctaagctcccacggcatccgtacgtcttgatatcgataagtgccacagtccccctcaaggcctcaagggtcaaggcagcgtgtaatctgtgaaaattaaaataagttaattgctctaaatattgaaaaaatgctaaccatcgattaattttgtatgaagaagactagaagagtatatacttgcattagaaaagccactagatgaagataaatcagtgcacataaaacgagaaagtaattaactataattaattgagttttaattatttaaatttaaaatatagatctatttgatattttaaacgaaacacatcatttaacatcatttaacagtttgaaatccgaaatcatactaacgaaaaccgagaaaaaataatctactccctcagtaaaaaaaaccaacctaattggggatttgttacaacttacaacatggcctattatgtcaaattggccatgtattggccatgttgtgtcaaaaccccaactaggttgggtttttttgatggtgggagtacatctttaaggctaagttattttattagtgctcaactcaaatgtccttttttttttcgtgcacgcttttcaaacttttaaattgtatatttttaaaaaaaatattctatacgaaaattgctttaaaaattcatactaatatatttttttaaaaaaatagctaatacaatttaattaatcatgcgacgatgaatcgttctgttatacgtccgtgagggataagttcccaggcaacaccagtctttacctccgcacttgtagccgacggggcggtcggccatgttgcagcgcttggggatggtgatggcgacctccggcttgatcccggcgaccctggccgtgttggacagcatcacggcgcacaggcagctggggctctgcccgatggtgtgcaccgccgagcagcagctgctcgacggcgccgactgcgggtcgtccgccgccgacacgcacggcgccagccgcagcgccacccggtcggcggacgccctcccgcactcgccggcgccctccgccgccccgccgccggcgaccaccaccaccaccgccaccgccacgaggatcaccaacctgcccgccctcattgtgtcaactagctagctaccgttctcttgctttgcttttgctcggatgatcacaacttaatttgtgtgtatgatcagtttagttttgctgctgtgcttactcgtatacaagggtgtggtgcttgttatatactagtgtccagggttcacgatcctgataccgggtcaaaattcgcaaatttcatggaatccgttgataaatcaaaaaccgataaagtcctaataatttctgtcgggaatttaaaattttgttttcttgaattcaattaaaaaccgagtcgtttgtgttttcgacctgattggaaagtccggatattgcgaaatccaaattaaattccactgaaattatgaaccctcacaatcccgacccagaatcaaaatccgctcacgagcagtatcatcggatttcacaaaatcagttgataaacagaaaaacaaatctgaataaattttgtcaaaaatttaaattttagtttcaatattttttaatttaagaaagacaaagtggttttttgttgttgacccgatccagagagttcgaatttcacgaaatccgaataggattccactgcaattcttgtgaacactgctagtgccattgtggcgcacagcacgcacctcaatcatgtcctggggtgaatggggagagcactgacggtgagcacttggcacttggcactcctttgatttctttgcatttgtggcagcatgaatcattagaggtttggtttctccactttggatttatgtaaggaaagcaggcatgaagctagatgtgatagtgggcttctgcctaggaaagcactgtacgtggtggctctacattcatcttgtgtgaacgcgctgcgtgcgcgcgcaacggacgccggccgtcgatttcacattgctcgctcttctctctgtggagcagatgacccacactcatccttataacatattcccaccgacctaaaatataataagtttaaattttatcctaaaatataaaatctagtaattgtaattttttttactatccgtagtaaattttacgatattttaggaaagagaaaacaggtggtgtgaaacatgatacatcgatatcatgcgcgagttgactatccatgtcatttgtcaaacgtatggttagttagttacaaaatactacctaaatccataaaagaatgcccgtatacatatactcctaaaacctataaattttttacatggttttcaatgaaatactttgactactaatttatttatattatgttataacaactatgaaaataaaaatcatatgaaaatattttaaagtatcaatctaattagagtaaatttcactttgggccatgtatatttatcagattgggacattggaccaaggttaaacatatgttttcacttaacatcatatttctttaccatactttataagttggaccagggtttaccacttgggccaccaggacagcttcggcccagcccatgtgaagcgtttgctcgtatggaggcgacgagtctaggtgcacgcatcggctcttggtggggagcagcgaccagtgacgacctccagggctgtgttcagatgccccttttcccgatccctcttcctcgttttccacgcgcacgcttttcaaaatgctaaacggtgtgtttttttaaaaaaagtttctatacgaaagttacttaaaaaaatcaaattaatccatttaaaaaaatcaacaaatacttaattaatcacgcactaatggatcgctctgctttccatgatcactgttccggatgggagctggttctagcgaacaaagccacatcgtgagctcggcacgcagacaccggacgccatggccaagggccagtttagtggacatcgatgccatcacgtatgatggcgtccagagggcacaatctgcggaatagctcgggtcgctgcttggcttcgtggaggcattctatactatatcagtctgttattcggtcttggagagacaaatcaaaacggtgttagagcaactccaatagcctctccaaaagactctccaagctaaattttgtcaattcttacccaaaaaaaaagtgctccaacggcctctctattcaactttccaagctatttggttggtcaaacctttccctcactagcctaatttggccagccaaactcactagccatctgtgggtcccacctattcccccttctctttcctttgcatccacttgtgcgcgctctctctctctctccctttgccgccaatatccctgccaccgtcgcttgccaaatcgacggcgagcagcggcggcggtgctcccgctggcatccatcgctcgcctctgccacccgccggcggtgctcctgttgccgttggcctccaccggctcacgtcagcctcgtccaccgccgtcgcctcatctcctcatcgagcggcgacgacgacgcgtggaagaagcccgcggcaacgaacctccttcctgaattattccctcggaagaagccatatggcctatttggttttgggagggggagttgcattttctattggaagctatattgataaagtcgactgtgatgtagtgccgatgaatgcttgtcacttgttattgggaagaccttggcagtttgatctaaatgcaacacatgagggtatgtccaattgctattcccttatgcataaaggagtaaatcatgtgctgaaaccaatgcaagagagtgttattaaagtggaggtatttccgactatgaagaaaaataaagaagtaagccgaggacggctttgttttaaggaagggaggatgatatgaccaaagcacctgtatcttttgccggtggttcttttcaaatttgtgtgaaacaagatgaagagaagaaaccgacaaggagtgctaccgatcagatgggcatagaagagaagaaattgatgggggtatatacgtgttggttcattgcacgtaccgatcttgtgtcatgctaattttccattagcatgtttatttacttaattaattgcagcataggagatttgtggtgttattaccaagttaattaggactaaacttaattagtctatgtttaattaggttttgggcctttgagcccatgccctttcctggtgcttgcgtgcacacatatatatgtccatgcaataggttacaggggaggttagggtctaatttgttttggttcgtcatcgaggtcgtgtcctccgccgccagggacgatggcgctcccatcgtcgatattctgctgattgttgccgctatcaacgacagtgacacaagtgtgtgattggcagtttttccctgctgagcacgtgctggagccaaggaggtctgcatcttcttctgatcgtgtgctttgccagtgcacgggtagataggtgtggtgttcagtttgcagtctttccaacctctgtaagctgaagaatttaggggctgtttggatacttctgcagctaaagtgtggcataccacaatttagatggctaagaaattcttggccacgaattaggcaaatgttggcaaagatatatgtctataacaagtagggtcacaaaataaaaaagtgtggcatgacaaagatgtggcaagcaaacaaacactaggctaaaagcatgtataaaggtagagtcagatatgagctctatattatttagagactagcatcctacaacagataaaaacaatatggtctctaatcattaatgtatcaaaatactttttcttactctcttttcctttctttcaccaccatataacaaaatttgctctaataaatgctaagagtcgactctgagccgttgtcatgtataacaaccatactattttctctttcttccatgtcatcaaatttacttacattaataaagaccattgtacatgccctaagttggttaaagtagcttaccaaagttatggcaaagtatcgtcaccatccaaacaacccctaatatcgtcgtttgtccagttgactagtcttgattaattttgttgctccatttatcacatcaatatatatatatagccatatatatattattggttgctgattggtaccgtgaaagagaggggaaagtcaaggtgctcgctgcagggtgctcatcacatccgttttcattaataatctaatcttcaactaaactttctatcgatttccaccacctctaccaaacaaggtattgaaattaaaaatcaaattcccaattaccacccctacttaggtattgaaaatgaagggtttccttcctcaattccatcccatggaaattcccaaccaaacaaaacagttaatagctccatctctctaaactcacaatccctcttaaaaaaatccctccaaccaaacaggccgtcatgtaaactcccaatcctctttcctcgagttgccaaacaaactgataaagaaattcaatggttaaatatttgctactccctccgtttcaggttataagatgttttgactttggtcaaagtcaaactacttcaagtctaaccaagtttatagacaaatatagtaatatttatattaccaaattagtttattaaattaataattaaatatatttttataataaatttatcttgggttaaaaatattaccttttttctataaatttggtcagacttgaaacagtttaactgtgaccaaagtcaaaacattttatgacatgaaacggagagaatatatatttaggaggggtttcatgataaggaataagttcactctaggtccctcaatttgtcgtccagtctgattttcgtcctcagtccagaaaaccggatacaaaacatccctcaacttacaaaaccatgcaaacatagtccctcagcagtattgaccctaggttttggatgatgtggcacctacgtggcgtctttgagtagatctgtgtccccacgtggcattgacgtggcgcttacgtggcaaatttgatcccaaaaaattaaaaggagtaaaattgaaaactgaaaaattaaacaaaataaaaaaaatgtgggacccacatgtcagtgggtcccacttaactctacctcaccctcttcccctctcttccaatcttctccaggtggcggcggcaacgcatattcttgtgtggcgaggatgaagacggggagggagcgggggtcgctgagggcccgtcatgcgcggcgtcgtcgtcgaagtgggtgaccgccgggcaaggcggcggcgctgcattttctccgcgcagcaaggatggagacggggaggcagcgggggacgactaggtcggtgggggctcgtcatgcgtggcatcgtcgtcgaaccggatgattgcaggccatggcggcggcggcggcaacgcatattctccgcgcgacgaggagggagcaggggacggtggggtttacgggggcgggagtgagggatgggggcggtcggtcttcctccgcgtagaagcgtggcgcggtttcggcagcggcggcggagcggcgggtcctgttcgccaatgcggcggctccccaaaccctagcccgatcccgacggcggcgatggcgactgcgggagctggaggtaggttggcgccggcgcgcccgtcgactacctccg

SEQ ID NO: 66789 - DNA, 5363 bp, Oryza sativa
gctcgccggccggcgaggccgcgagggagctcgatgaggaaggaaggatagccgggagagagagaaggaggcaccgagccgccgacgcaccgtcgtccgtggatagagaagaaggtgaggcccactcccactattttttctttcgtccgactgacatgtggcccatgtttttattttagttttaatttttttacattttgcttccagtgccactcaacaccacggaggatgatgattaagggtgtgtttgaggaggagattgagtagattgggaagatacgcaaaacgaggtgagccattagcacatgattaattgagtattaactattttaaacttcaaaaatggattaatatgatttttttaaagcaattttcctatagaattttttttgcaaaaatacaccgtttattagttcgggaagcgtgcgcgcggaaaacaaaacaatctttatcccttactcctgcgctcgaacgcagcctaagtcaaaccagccacgtatacgccacgtcacccaaaaccaccatctaaaccgctaagggcaagtggtctctacgttaattagagactatcacgttacaatagttaagacaatacggctctaaccattaatataaaaaaatactttcttactagtcatctttcctttattagactcaatgtagcgaaaaatttcgtaataagtgctcagagtcgactctataccgttgtcatgtgtagcaaccatctttctctttctttcttcctctctcttccacatcaccaaatatgcttgcattacaataaagagagaccgctaataaaaaccaatatacatgccctaagggatcttgtttgcactggttttaatagttgaggtaactgctgtatcttgtttttgggttgaaggacgaaaatcaaattcgtcgaaagttaagggacttcaagtgaacttattccttcatgataacgaggagtacactccacagtccccttaccttacctatataaattattggtgagagagagaagagaaaacacccaccgactccctcgtcgtctccgcgctccgctccggcctcccccgcacaaatcatccgtcccgccgccgaggatgccgccgaaacggggcggtaccatgaagacgatggcggcggcggcggcgggagccacgggcacagcgggagcctctccagtcggcggcggtccagcggggatgcaagtgctgctgcggggaggagggttacccgccttcgatcgagggagctagggctggaggcgacgacgggcgctggggaggatgtcgcgtcggatgatccggggccggctcggaagaaggggaaggtccagccggcgacgaagggagccaagggtaaggccgcacgagcggatccccctaccccgccgccgcgtcctagattgccgccgttccctaaatccggcgatcccatggattttctcaagtgggataaagagttcaggaggatctgcgctcttccaggttaatttatgcttaattaattactacttttctctttagccgatgtcactaggaagaaggaaaacaactgaaattttttgttctgtttgttgcgcgatttcttcagaacctgcaggtactgtcatcccttgcactgtcaggaggaagcctacgggccctcgcaccgtcagcgtcacggacatcgcaagcgtagcagacaatagcatgatccggaaggcttctcgttccgtcgtcggcatttcctccaggatacctggtaaaaagattgctgttaacgatcaatttcaattacaatcccctccaattaacagctgcttctttttttttttttaagataaaggaagcttttattcagatcaagataactacatttcttaccagctgctaattctgcctatgttgctatttcttcctatgttttcagatgggaaggagattatgcaatgcagtggtatcgtggtcgattggaacaagaccagcaggttggcgacaatcgtaacttgctctgcagccgtgtgctttgatggtgcactagtccatcccaaccccaaggtatgcagaaaacaaacctagctggattgattaatggtgacacttggactatgaaagttctctgtaaattccccttcaaatcttaataatatttggtcagcctcttccaagaccatgaaaattaattaacatagggtagatatgtttgcacaatagcactccagaattaacccttgttctttagatagctatgggtcctacgtaaactagttgacaccctgcgtgttgcggtgggcacactataaaattttcaaagtgcataaaattgatgcaaattttggtcatcgaatcagcatatgaaaaaaatagagatttacagtgttgagatagaattcgtgcctaaatgtccgtttttcaattaggaaagcaaccccaattctcatggttcctgacattctagcaataccaggctggtcgatttgctggatggctgcgaagatatgttaggtataaaatcaggattagtctcatggcaatatgattaattgaaaagttcaaaagtttatagaacatataaaaagttatctcaccttcagcagctatcccaaacgaaccttaatggctgccttcatctggataatctaggctacatgcaggccttatttatagcaactccaatctgtattacaagaaatcaatatatgttgaaactgaattcatactgaaatttgtgttttgaggtcggtagagataattggcatttgaagatgaatataaaaactgtacaataggaaagctaaggccaatactgcttctttactgaaacaaatctacagcaagcaatgaaagagagggagtgtttagttttgtttaccacttcattaaggaatgacatataccaattcgatgaattgttgcaaatcctattggacggaaacctgcgaaaataggtagaaaccaattgattaactaatagtccttgtcatatatcaggatgaagaaaaatctagcaaaatcaaccacctgatgggaacatgtacgaagcaaaatgaaaacttagatgttgttagagataaagaaaactatttacggtggaggaataaaaaacaacagctgagcgtggcctgcaattgataagttggtgagccttaaagaataatttagaaaatgtttttagttaggaatgtaaatttagagctttgtgcagtacatacaatcaatgtaaacactcatccacagcaattattagttgaacaaaagatggtactggggttacagggccatgaagtcactattgcttgcagtcggcctcccggggatgaaaacgatagaaaaacaaccttacgcatttttgcaaccattttttttcctcgtaaacagaaccgaaaatgggcatccacaatgttgcatatataaaatgaccttatggaacacagtagtatatttgctctacctttatgcattaggatatatagttgaaagaatgaatattgctatatgcaaccttaaggttaaggttagatcataagaaataaaaaaagtattttatgtattcgcaacatacatgttaccctttgtttattaggtgaatagagttttttttcgcagtgggcctcaccttaaatcaataagagaacatacacattgtagcatgtactatagacaaaaagaacgtaacaccgtgggactcatattatagctcaaatcaccttaaacatcgaggatgttctagattaagatggtgtcagaaatatggaaaaacagaactatgcaaatggaaatacgttgatattgatgggaaagcagtaattactgttggaaacaataaaaatataaactacatatatttaactaagtataattatataatatcaccaaataaatttaagtttattggatccgataattttgctggacttggaagcgctgaaatgtaaaataatcacatatttaacctaatataactatataatataaccaaataaattcaagtttattggattcaataattttactggacttggaattgaagcgctgaaatgtaaaatcacatatttaacctaatataactatataatataaccaaataaattcaagtttgcactatattacaaactgtttagacgtgtactcctctaaactatgaggcaaatagaaaatggactacatccattgaggcatttagaaatacgatttttatgtagttttccagaaataaggaaaaaaggaaatgtgtgttatatgttttcatttccatattttaaccattttaatttttattttcgttcatagcgtttttagatggttcggtcagtaccacattggaaatgtgcataggtagttcaggaatttccatgatcattttcacctactagttctcccaattaatatagtgcaaataatagtccccctccatgtattaacagacaataccattgacttttggtatgatgtttgatcatttatcttatttaaatatatatatatatatatatatatatatatatatatatatatatatatatatatatatatatatatatatatatatatatatatattatttattgacttgttttattattaaagaaactatggttgtgttcgtttgtagcagttcccaactcccatatctcgttttcagcgcgcatgcttttcaaactgttaaatggtgtaaatggtgtgttttttgtaaaaagtttctatacgaaagttactttaaaaaatcgtattgatccattttttttaaaaaaagctaatacttaattaatcacgcgctaatggatcgctcggttttccgtgcacatgagattggatcccaacacccaccaccaacgaacacagcctataagtatgacttatagtttatcatatttatattaaatttttaaataaaataaatagtcaaagcatggcctaattagcgcgcagatcaatcatcgcacggcatcgatctccgttggccttgtcacgcgatccatctccacgctgcgtggaatcttcataatccagaatgattttctaccaggagtatcttcgaaaaaagaagataatttttttaacgaaagttctattggtagagccgaagaaaaattacaagattataatctgaaagatcataaccaggaaaaagaaaaaaaagtatatcaccacccacacaccgaagatcaaatattgtgagtagcttgatatatggcttggatttgtggggcgttagcaaaagactttgggttgtacgtataaatttcagttttttagacctgactactgggaatctcttaatttaggtttcattcaacattatcattttttaatttctacacctttcattttctgcgcgtgcttctcaagctactaaacatttggttttttccaaaataattctatagaaag

SEQ ID NO: 66790 - DNA, 1575 bp, Oryza sativa
ggggaggaggacgaccggagggtcttactagagccactgatgccttctggcagtcgatgagactagggcactgggcggtggtggaggtgatgtgaatcgcgctctcgcactactaagcggcggcaacatgagggagtcgagagaaaggggatgagaagaagttttttgggcttggttgcctgcacgaatcttaaagcaatcgggtggtctaaaatttacaagatttataggggctttcagtcaaatgatgtataggcagtcccattattttttgaggtatatcaattatttcatgttttgctgtgcattattttgtctctaactatttttactcttgcttgatgttgcattgtttgtatttatactcattttttgtttggtgtcgcataaaagaaatataaatgcattctacaacggtccaagaccttccacgcatagcatactccgtatttttcattgtgtgtatgtgatctcctacaatgaagtttgaacagttcatggacacttgacggcccgtttggttggagggagtttttaaaagggattgagagtttagagggatgaggctattaagtgttttgtttggttgggagacatgagaattttggtaggataaggatggggaattgagggaattggataggggcaggtaattgggagggaattcctcctttactttgtctaagcaaatctcagccatccgtttttattaatgacgtaatctccaactaaactccctatcaatttccatcacctctaccaaacaagatattgggattaaaaatcaaattcccatcttaatgtcatcatccctatcaattctcaactttttcttcaaacttttaactttttcttcaaactttcaactttttcatcacatcgagactttcctacacacataaactatcaacttttccgtcacatcgttccaattttaatcaaatttctaattttggcgtgaactagatgtgttttatctatataattaattacatatgataaatttcagacgaagtagcaccattggaataatctttgctattataaaaattaaaaattaaagatgttttcgtgtttcgtcatccgtatttgagtcggttttaatatattgatgtgtcaagatgtttccgcggtccgtcattcgtgtttgagtcggttttaatatatatatatatatatatatatatatatatatatatatatatatatatacctactggattttttttcgtcgccgttttcttcttgcgtttttattttcaaactgttttttaatggtccatccagttgtttttttgttgccgttttcttcctccccggttttttcattgcggtttttttctcgcaccagataagggcttccggtttttcagttttctttcgtcaccgtgtttttccttcactaggccgaaccctagctccgtcgctacgttgaatctgtctatccatgcgtttcctcctccaatggattacaaaaatcaattctccactcatcgctcatcatttttcctacgattttctccttcgattcggctaggacggatttaatcaccatttaaccttcaccgatgatgg

SEQ ID NO: 66791 - DNA, 1048 bp, Oryza sativa
cgcgcgcggccggtggcccgtgcgacgggggcgcggtggtcgcccgcctgcgcggcgggagggacggtggccggcgacgcccgcgcggcgggaggggcggtggccggcgacgcccgcgcggtgggatggcggtggccggcggcccttgcggcgggagggcggtggccggcgatgcctgctcagcgggagggcggctggacgacggcgcctcgcgcggcgagacggcggctggacaacgacctacgtggccggagggcagcgggacggcggcgtgcagaggccattcgcgtggaagaggatgagggagaagaaaaggggaactttagtttgggttggcaggggcattttggtattttctaaaaattctgacaacacaatacacggtttgagcaacgtatctaatggaaacttaacgggaggggcatggaagggatcaaagcgaaatttcaggggtacacagaggatcgtgtaaaattcgagggtatagaagggattaggtgagttttcatgtgtacacaagggatttactcttaaaagattacaaaattttcgtgaatttaaataaacgataagtccattttacaccctcgaacttttatgcttgtttaaaatacacccctgaactacaaaaccgggtataatacaccctcaaatctggggggttaagtgtccggtattgaaagttcgagggcatattatacccggttttgtagttcgggggtgtattttgcataagcataagagttcgagggtgtaaaatggatttatccctttaaacaatataaaaaaatcgggaatctgtagcggtaattttaggttgtttggtctcacgggtataggacttgtctggtttggagccaatttttaccctaccaaaatcttgatagtaccaaaatattggtaaattttgatactaccaaattaggtagtatttaatttgaactattattaataaaatttagtagcaaatcaaatatacacttactattattgaagttactaaaattttggtagggtaataaattggtaccaaaccaaacaaacctat

SEQ ID NO: 66792 - DNA, 823 bp, Oryza sativa
caaaagattcgtctcacggtttccaggcgagttatgaaattagttttttcattcgtgtccgaaaaccccttccaacatccgatcaaacgtccgatgtgacactaaaaaattttcatttcgcgaactaatcaggctcttagatcctaaaaaattttagccaaaaacgtcacatcaaatgtttggacacatgtataggacattaaatgtagaaaaaaatcaattgcacaatttgcatttaaattgtgagacaaatcttttgagcctaattacgccatgatttgacaatgtgatgctacaataaacatttgctaatgatagattaattaggcttaataaattcgtctcacagtttacatgcagaatctgtaatttgttttgttattagtctacgtttactacttcaaatatgtatccgtatacttcaaaaactttacaaccaaagaattaaacacaccctaacagcatttgtcttccgttcatgtaaattggcccattcctccagctgataggcaattctttttgcaacattagttggattctctggtgccactgcataacgactatcaatattacgaacagaccacagattataaagggtaacaaataagcctgcaattatatgattctcctgacccgataacctatcaagtagccaaaatgccaagagtttattattattacagtccacccccgggactggaaattcaagctgcaactcttcctctaccttgctccaaaccgatttagaatatgggcgctcccaaaatctgtgcaaagcattctcatttccatcacagaatatacaacgtactccctgcttact

SEQ ID NO: 66793 - DNA, 9284 bp, Oryza sativa
acactttaattgtatagatgaatatatgttaagtaatatagaaatgatggatatatatatatatatatatatatatatatatatatatatatatgttaaaaatattgtgaaaaaataatgtgaagaaaaatgattggatgttgatatgtagaattcaatgaattatagatatgttgcatgcttgcataagcttgtttgtaattagggtaaattgaaatcatgctattataattttgcaaagtttaagatatgtcatcggtatctcaatgacatgtagaactcatatgagtcaatgacatgtggttcaggatggtatatcttaaattttgcaaaattataatggcatggttccaatttttccttgtaattattactagtggacgatgaggtggcatgttatcgcgctacatccatgaattttttcagtttttttcgattttttccggaattttgaatttggtcaaaattcatccaaatcatatcgccggtttcccctaccgtacccccgcgataagcgtgataagtgatgcgattatcacacgataagtgaaaccctggtccaactctaaaatattttatattttttattagatgtttctattaggtgatttattttttgaccaatgtagattataaattagtgtaaaattataatgtcattatagctcctaatagtcgttgtaccgctggaaaacgtctttttctagtatagacaaaaaatattttttacatgagttcttaggggaaaaggaacttacgttaaaatggtaaaaagcttagaaaaattgatgttttctgcatgctttttttccctaaacactaaaggaagcagggagtgtacattgcgaagaagttggattcttttgtctattatatcaatcaaattattattagtactgacggagcgtggggctcctcaccgggagaccgcgcaggcccccctttgccggttcggccgggggcgctaagtgaggttctaagccctcggtctgtggaatattcgcgagagaggcaatgcacgagacacgggcgatgtagacaggttcgggccgctgagaagcgtaataccctactcctgtgttctggtggatctgtgtatgaagaaactacaaagagttcgagagctagaacaagtttagactctagaactcgtttgctcctcctttccccttttttcttctccgtccctctctttggtgggcaaggtcctccttttataactcaaggggataccacatgctccacttctacctactcttcttttgggtggggacccaccctctcttgaccaaaaccccgttcgccttctcttggaagctaaaatatagcttgtctttgagtgtggcccagcgtcctcactcgtctgacataggggatcaccctgtcattccttcattaatgggcggagatttgcaatggctgctatccgaatgaccctccgatgggatgggtcatacctacctccactccgctggaaggaggtgcaaaatgggtgcgcggttgtctgcctatgacatgaccagcgtcagaccagtcacagaccggtcattcttgtccaccacgtgtcagtttagcaagctgcatgtctgcccttcttcatacaacgacttccttgcaatggttgcgatgaagcctggaatatatctgggcgggactaacgtgccaactccaggagctagcacgccggctccggctagggacgagtgcctggaggctctcatcaatccgacgggacggggcgaggcgtgtgtcaggccgcctgttgccacctaacccgcgatctgaccggtctgtgaccggtcacacactgcgaccggtcacggaccggatgagcgctgcgctgcattaaatgcggcgtggcgcgctcgtccaaaccgcaataaatgcggttaggtgagccctgctgtgctcacctaaaccatacacgtggcgtcaaaaccacagggggtcggggcgcccctgccctcggggccgaaacgggagcggcccgacccctcggggagacaaaaggcggggaggtctcgtcaccctcgggcccgacccgggccacgtgggtgactgcggctaccctaacctctagtcatgataccctcggccccatgtcatcgacagtagcccccggcgtcacgccagggcgatcgcccccctcgagggaagcgctcgggcgtgacgccattctttagatctggtgacaggtggggccggtctctacaggcgggtaggaactcagcggtcgcaagtcgcacgcattggcagggaaaactgatcgataataatgagcggcctcttcgagactgccacatcactcgagcagcgcgcgaatcgggacgagtcagttcgtttcgcctggagacgtgatgatggcgcttcggtcggcgagcgaagttaacgcgcgcacgatatgtcccatctcgactgccacggcctcgtgcgccgcaaacgggcgagtgggattagcagaggcgtgggcgcaagaaacgagggggcgagatagtgggcgcgggaagcgaggagccgggcagagcgttggcaagggtataaagacgccgaggaagagattcgtttccttcctctcgccattattccccttgccttcgccgcttgcgctctaactcttcgtttcctgtgccctaccctcgccgcactcgctcgttctcaagttcctcctctgccggcgtcatggcacggggctccgcaccgctcgatggtagcgtgctgccgccttcccgcatcgtgagcgagaggcaggctgggctaccgcgccgcttcatgccggaatctgccaccggccgggagatggtcgcgctgggcgagggacgcccggcgccacgttacccggggcggtccgtcttcttcctctcttttgcaatggcagggctagtcccgccattctcttctttcttcatggatgttctggagcattatgatctccagatggcgcacctcacccccaacgcggtaatgacgttggccatcttcgcacacctgtgcgagatgtttatcggggtgcgcccatctcttcggctgttccggtggttcttcaccgtacagccagtgtcgccgccgtcggtggtcggtggctgctacttccagccgcgggggccggtgctgagccgctacattccctgcgtcctgcgcaagaagtgggacgactggaagagcgactggttctacacccccctcgccgacgaagcgcgcctccgacttccgagccagcccccggcgcaggcctccagctggcgcgtgccggtagatctgggagacggctacgacaccgtccttgaccgcctggcgggcctgcgatcctaggggctcacgggggccatggtgtacgacgactaccttcgtcgccggatcgcgccgctccagcggcgcgcccggggcgcctgggagtacaccgggtcgaaggactacatgaggacccaccaggggggcagatgggactgggcccctgaggatttcaagatggtggtccaacgggtgctgaatctcagctccgtggaggcgtccctcatcccccaaggagtcctccccctctgcagcgatccagatcgcgccaacatcttgaccatcatgatggcggtcggggcgtcggaggagcgggctcctcgaggccacgatggcgcgggcgggagccgcaggggggaacaatctaccccaggagggggtcgtgcttctgggccccgcgacgggggcccggggggcagccgccctgccgacgcccgggggaagaggaagcaggagggtaccccttccccatctcctccccgagggggcggggcggtgcgtgctagcagcaggcgctcggaaggtgccgcgccaacgccgcagcccgagggggagcggaaaaagaaacggctccgcaagatgggggggaccgagccaagccggggaaacctcatctcccccccaaggtggtcgtttaaccgacctcctcgcaggttcgtccccgcgcctactacggccgaattcattctttcaaagcgagttttcacttacctgtttctttttgtcttctggtttttcttctgcttcagcgagatcccgtcgcgcccctcccgccattccaagtccggccggtctgaggccgaggatacggcgaccgcggaggcccggaggcgggaagctgaccggcgagaagccgcggaccgccttcgggaagccgaggaggctgcccaggaggccgtccgggctcgccaggctgaggaagccgctcgggaggaggccaggctccgccgggccgaggagtccgcccgggaggcggaggtggcacgcgcacgccaggcggcctgccaagcccccgacccgactccgcccgaggcgacgatgacttccgaggccacccacgactaggccgcaggcgcaccgctcgggcccgactcctcgggcgacgctcaggacgagccaggttcgggggacgtccccgagtccggcacgtcgatcggcgggccgagccgtgcggcattctcaccgaggcggctctctcccatgccttccgctgccccactgagcgcggagccccttctgcaagccttggccactgcgaacaccacggtgttggatgggttaaatgcccagatggaggtcctgcaggcagagcgggcggagctcgacgcggcgtgagcgcgtgtcgaagaggggcaatgctcggtggaggccatggtggaggcgggccgcaaggcacaccgccggcacacctgagagctcgaggcccgtcggaaggagctggcggagattgccagggaggtggaggagaagcgagaggctgccctcattgccaccgccgtgctgaacgaggcgcgggacgatctccgcctccaatacgggagctaggcggcggagctaggaaagaagccggcacacctgagagctcgaggcccgtcggaaggagctggcggagattgccagggaggtggaggagaagcgagaggctgccctcattgccaccgccgtgctgaacgaggcgcgggacgatctccgcctccaatacgggagctaggcggcggagctaggaaagaagctcgacgccgcccggggggtccttgacgccgccgctgcccgggaacggcgggcggcgaagaccgaggcggcgtcccggcggcgcgaagaagcccttgaggcccgcgccatggtgctggaggggaagacgtcgccggagaagcctgcttcattttgccgacgagatccagttgctgacgaaggtcgccgacttcctcacgcaactcctgaactgctgcttctacttgaggtctccaactgctcacttcgcgatctagcttgacgaccgctgcttgagtttcgccttgagcacgattcagcctcaccaaggactcctagatctccatcaacaccttgccgaaatcaatgttctgcttctccatcgcttcgacttgaagttgcaaacgggaagtatatcgtggcttctccaggatcgaaattgctctgataccaaattgtcacggtctcgaactcgtaggagagattcggtcgagtagagaagggaagagattgagagagttggcttgaggaagaagaagaagaagaacagaacagaattgaacaggagagagatggaattgaatttgagtatgtttgattacatgattcgatccccttcctctcaatcctgccggcttatatagcatcgcactacacagcctctctcactcactgacagtggcccagccaatcactactgggtccacacactcgcagggaaacgggagttgggctgcttctcccttctgggccgattcacaggctgggccgctggcttctgctttgaactccctgctacagatgttgccgccgtgacaaactacaggctatgacccatttgactaaggtggagtttattttccttttctttgagaggattggcagaaattttctcctttggttcaccgggtactaacggatggacactgctattgtttattctctttggttttatccttttgatcttatagcattagtagatttcagtttgtacgcagcaaacaccagtgaaggtgatttttgctactagcatagtagcaaatagttgaaagataaatgtatggatgtaatttatcacgtgcagcctttttgtaatcttcatagagctggtacataattttcaactcaagagtgatcctagtctggatatatcatttgtcctgtatgctgggtgggtgcggagttcttcgtggtttttgtttagagctcttgtagctgctaaattttgaattctgaaatgtgatgttgatgtatttagtgaatttggcatatcacaattgattctttgtctattttcggtgttatcttttattatctgattctaatgtttgctattccctttgttggaattttcaaagattgagacagaagatggttctgatgaggagtccgatgaatcagactccgaagtaaatgtggaaacagagctatcgaaagtcactgagatgcgtatcataccatctgatccttgtcagtgtatcctttttacagtaaattgtctgatgtaggagcatttattggttttccttgtataaatctacctctgatgcttgcatactaaattttgatatgagtgcaggtttacatgaaataactatcatttctaatgctctatgttcatttttcattagctctttatttttaatttattctcatgactgtagcaactaatagtcatgattagatttgtttattcttgaagagtaggtcttcactctagagggtactactttaagaatgtaatgtgtgcattctgttccttcacaagtaaaaatttgcttgtcttatgttattcagttacaaatggttctctgttgggattaatagctaatcaagaataaactaccttgcataattagtatcatactgcagatcatcatggcagatatattttttatttccagcagtttgaaatgctatttatttgaagaattgactaatactatttcttgaagcatttgtatcttctattatatattcacattatatcttggatccttgacagaagtttcagtggatggactctttgaagcattctcacattgtgctgaattgaaccccgatcctaatgctggtaagttttaatagttaataaacaataaaagaatgttctttgtttgatgtatgcctttttaattaccagagagtgatgaagagaatggctgggctcatagagatgaaggtgatgaagatatgactggtggtaagaattcgccctgttcatttctcttttgtgttcatccaaacgttatgcataatcttttatgtattatcttgcattcaggaagtgatgctgaatgtgagttttcagatgtcaacccgataggtcaaactgatgaacatgatattactcatgctgtagttgaggtatgctgttggtttgttctaccattatgttttatgctttatatgattctgtgaaacgattgcaagtgaaataaaactcttgtgttataagcttggttgtaaaggttttttcttttcttcgggctcctgtgaatataatctgtatttactacaacatatggtataggaattggtaatggcatcctctcacgtcattttatttagaaactacgaccatatgtatatttcttactgtttttgtcacataatatgttaaggtatagttaattcatatacagatataccgtgtgattcagggtggcagttgattatcctttcaaaattattataaacatcaaacagttactttctgaacagtttgatctgtatactaagataaaactcttttgttccttcccctgccaatctcatgagctaactcgaacaaaaacctcataatgtccttatgcagcttcagatcaatgaccaacgttttgaggatgcagaggaagcagaacatgagacgcatggaaatggacactaatgcaggtgccttgttattttcttctctgaagaaaaaaaaaactggtttgttgtacatcgccaatgatgcacattgttgactaaagacttattttttgtttgtttcttttccttcccttttgagatgtcacagattaactcctttgggccaccttgtaaacttgcatcaatggcaacgtatgggagaaaaaaggtcttgctactggtcaagaaaaatgtaagctgaaagcatgctggaggtctttgtatgcgttgtcttctgtaaaatacatgtatgatcatgcaacttcatattcagagatattttgacaatgtgctcatggaaaacatccatactttgtaagtgttcaagcttaattgtcagatttttttttatttacatccttgatcgaccaaagatgtatgctgatagctgagcaacaaacatttccttttctgtagcatttgctactgatgaatggtcctgtgctcaatgtccaaggacttgcagcagaatccgttagctcgttttattgctgtcagtattgttcttgtagacatttgttcatgatgaacttttgctcggttgagtatggtaatctgaaggttaagttattttttttacacgatttgaggcaatgggcagggagctctgtgttgaagggagtactctgttaaagcatgatttctttcgaatgtaggaatttgaaaacactggagtaagaaaaggcaggaattcaatttacacgttgttcaaacccatgctatgaaccctcaaggtttctatgcattggaattttgtagcgcagtcgtccttctatcccttcttccactgcacacaacgcgtccgcacgtctaccgaagggacacattaggtgatttcccacgctttctacggaaattgccaagtaacttctaaatttttttaatgatcgagctaaaagtataaaagtataaattatattagttattaacaacaaataaaattggtttgtcaaagtatgtttagagagaaatacatttagtatgagattgtagatgaaatatgatattctacactttaattgtatagatgaatatatgttaagtaatatagaaatgatggatatatatatatatatatatatatatatatgttaaaaatattgtgaaaaaataatgtgaagaaaaatgattggatgttgatatgtagaattcaatgaattatagatatgttgcatgcttgcataagcttgtttgtaattagggtaaattgaaatcatgctattataattttgcaaagtttaagatatgtcatcggtatctcaatgacatgtagaactcatatgagtcaatgacatgtggttcaggatggtatatcttaaattttgcaaaattataatggcatggttccaatttttccttgtaattattactag

SEQ ID NO: 66794 - DNA, 2959 bp, Oryza sativa
cccatgccttccggctgccccactgagcgcggagccccttgtgcaagctttggccactgcgaacaccacggtgttggatgggttaaatgcccagatggaggtcctgcaggcagagcgggcggagctcgacgcggcgtgagcgcgtgtcgaagaggggcaatgctcggtggaggccatggtggaggcgggccgcaaggcacaccgccggcacacctgagagctcgaggcccgtcggaaggagctggcggagattgccagggaggtggaggagaagcgagaggctgccctcattgccaccgccgtgctgaacgaggcgcgggacgatctccgcctccaatacgggagctaggcggcggagctaggaaagaagccggcacacctgagagctcgaggcccgtcggaaggagctggcggagattgccagggaggtggaggagaagcgagaggctgccctcattgccaccgccgtgctgaacgaggcgcgggacgatctccgcctccaatacgggagctaggcggcggagctaggaaagaagctcgacgccgcccggggggtccttgacgccgccgctgcccgggaacggcgggcggcgaagaccgaggcggcgtcccggcggcgcgaagaagcccttgaggcccgcgccatggtgctggaagagcgcgcccgcgcgaaggagagggacctggcggaccgcgaggccgccgtcgccatccgggagacaacactggcggcgcacgaggccggctgtgccgaagaggagtccacactccgcctccgcgaggatgcgctcaccgagcgggagagagctctcgaggaggccgaggccgcggcgcaaaggctggcggacagcctgtccctccgcgaggcggcgcgggaggaacaagcgcgccgcaatctggaaggtgcccgcgccgagagggccgcactggatcagcggaccgctgagctcgaggcgcgggcaagggagctggatgcgagggcacgcagcggcggggcggccgcgggcgacggggacttagcagcccgcctcgcagctgctgaacacaccatcgcggatctgcagggcgcgctgaactcgtccacgggggaggtcgaggccctccgcttggcaggcgagatagggcccagcatgcttcgcgacggcgtctcccgtctagaccgcgccgggcggtaggtgggtctctggggcgggcggactgtgaagtacgccgccaaccaggggggcctcgcccagcgcctctccgagatggccgggaccctccagcggctccccgaggagctcgaggagacaattaagtcatcctcgagggacctcgcccgaggagcggtggagctcgtactggcgagctaccaggccagggaccctgacttctccccatgggcagcgctggacgagttccctcccgggaccgaggacggtgcgcgcgcgcaggtccgggacgccgccgaccacatcgtccacaacttcgagggtacggcccctcggctcgcgttcgccctcgactccgacgaggagggcggtgacggcggtgacgaggccggcgacccgggtgcgtcggagtgagcccccaggcctccgccaatctttaaatagttttttccttctttttccgaggccttcgggcccccttcttgtatagactaacttaatctgcaattaaataaagaggaaatttctgtgtcaatttcttttgttgtgtgtatgagacgaggatggtctgtgccacggtccttctgtgtcttagcttgaacaagggctcgtgcccaggtcccagcctcaaatggcgcgggtcggggctagtgcctggggagattcacgtgtcgagactggccaggccgggaacgtggtgaccgagggttatggatgacccgattgtgggcctttgccgattccccccccgggagttcaccacgccccggggcacggctcggttctgggccccttttggcgattttagccggcccgggccaccaagggcaggatcgagcacgagcgtgctaattcaagccaagatttttcaaaaggaaacaaaggcacagacgcagtccttgggaaatcgaaaatgcttttattgaaatacggaagaaaaaagataagaatatgcatgtgtggtagcccccggccaaccctgcacgcccgaggggggtgcggggttggcccgagcccgagacctgacatccaactcccattaggggtagaagcgacgaaggtgttcgatgttccacgggttaggcagctccgtgccgtcgcctgtggccagccgaacggagcccggccgggggacgccaatcactcgatacggaccctcccacattggtgagagcttgctcaatccagcacgcgtttggacgcggcgtaggacgaggtcgtcgacgcagagtgatcgggcccggacgtggcgctgatggtagcgctgcaggctctgctggtagcgcgcggctcggagggccgcgcgccgccttcgttcttccaagtagtcgaggtcatctctgcgaagctgatcttgatcagcctcgcagtacatggtggcccgaggggacctcagggtgagctcggatgggagaaccgcctccgcgccgtagacaaggaagaaaggcgtttccccggttgctcggcttggcgtggttcggttcgcccagagcaccgctggcaactcctcgatccacgagtcgccgtgcttcttgaggatgttgaaggtcttggttttaaggcccttgaggatttccgcgttggcgcgctccacttggctattgcttctggggtgggcgggggaggcgaagcagagcttgatgcccatgtcttcacaatagtcaccgaagagttcactagtgaactgggtgctgttatccgtaatgatacggttaggcaccccaaaccgagcagtgatgcccttgatgaatttaagcgcggagtgcttatcgatcttgacgaccggataagcctcgggccacttagtg

SEQ ID NO: 66795 - DNA, 5050 bp, Oryza sativa
cgcgcgccgatagagggtctcttccaccagcacgtagcgcttggagatgcgctggacgcgttcactcccttcgcggtcctcgggtagagtcttatctgcgaggtacgcctggatctgagcgattccaagcaatcaatctaagggagctgggagcgctcccctcgggtcccgaggcttggactccgacgggcctcgggggccgttcaggcgcgtccgtctcccctagggggtcgggtcgcgccgacggctgggcaagcctttcttcaaagctgcccggtggggtctgggctcgcgaggaagcaagccttgagagttcgtcggcgaccgcgttatcccgtctgggcacgtgccgaagctctatcccgtcgaaatggcgctccatacgccgcacctggcgtacgtaagcgtccatctccgggtcagagcaccggtactccttacagacctggtttacgaccagctgggagtcgcctaacacaaggaggcggcggatccccagtccagctgccaccctgagtcctgcaaggagtccctcgtagtccgccatattgttggttgccctaaagtcgaggcgaaccaggtatctgaggacgtctccactcggcgaggtcaacgtgacccccgcaccggcgccctgaagagacagggagccgtcgaactacatcacccagcaggcggtgtgaggcagctgtgaggggcccaagctggcctcgagggcggagacgggctcgagagctggggtccactctgccacaaagtcggtgagggcctggctcttgatcgcgtggcatggttcaaagtgcaaatcaaattcagagagttcgattgcccatttcaccacccgtccagtaccctctcggttatgcaagatttggccgagggggtaagacgtaaccaccgagacccgatgcgcctgaaaataatggcgcaacttcctcgaagtcattagaatagcgtaaagcatcttctgggcctgagggtatcgggtcttggcgtcccggagggcctcgctaacgaagtagacgggccgctgcacctttcggcggggccgatcctcttcgctaagggccgcatctccagggcgctcttcgtccgagaggccgcacggggcgcacttggcttctgcgccgatgacctcggggtcagagggcgacaggcgcggccttcccgcagtggccccgaggccatcctgggggtcgggggcgcctggcaccgtcggacaagcgggcggagggccagctccggccgtcgggggcctcgggccgccgttcgactcgggggcctctcctccctgctctctcccgggtcgagtcgacacagggtggggacgcgcgaagtgagggttgtcctcgtcgcgctccacgaccaacgctgcgctgaccacctgcggggttgccgcgaggtagagtagcagcggctcatctggctccggggcgaccaggatcgggggagaactgaggtaatccttcaactgagtgaaggcccgctcagcctcctctgtccaggtaaacggcctggagcgtttgaggagcttaaataggagtagcgccttctctcccagcctcgatatgaaccgacttagggcggccatgcagccggtgatgcattgcacatccctaagctggctggggggcgcatccgctctatagctcgtatcttctcgaggttggcctcgatgcctcgggcagagaccaagaacccgagaagcttacccgcaggcacgccgaacacgcatttgtcggggttcagctttatgcgagcggagcggagactttcgaaagtttccgctaaatccaagagtaaggtctcttggttgtgcgtcttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcagtggagtcgacaatctgatctatgcgtggaagggggtaagggtccttaggacatgtcttgttaaggtcagtgtagtcgatgcacatccgaagcttgccgttcgacttgggaacgacgaccgggttcgccagccactccggatggatgacctctcggataaatccggcctccagaagtcgcgccacctcctcgcagatgaaggcttgacgttccggggcctgccgccgcactttctgccgaaccggccttgcgtccggccgcacggcgagacggtgctcaatcacctccctggggaccccgggcatgtccgccggtctccatgcgaagacgtcggcgtttgcccgcaggaaggagacgagcgcgtcttcctatttgtcgtccagaagatcaccgattcgagtggtcttggacgggccgtcgcccagggcaacctccttgaccgggaccttgtcgtacgtgatcatccgctgcctcggggcggctgggacggagggtctaagcctctcgtcgctgcccgcgggcttggacgccgcggcgaggtggtccgcgcgctgctccatacaagcaagcgcgactttgaggtcgccatggacggtgatggggccaccggggcccggcatcttcatctggaggtaggcatagtggaccgccaccatgaacttcaccaacgcgggcctccccaggaccgcgttgtagggcagactgaggtccgccacatcgaagctcacccgctccgtgcggaagttggcggaaccaccgaaagtgaccgggaggtcgatatgacctagcggccaagtgtgccccggcgtcacaccgatgatcggctgggacggtcggagcaccatccccgggaccttgatggcgtcgaaggccgcgggggaaaggatattgagggctgcgcccccatctatgaggactcgccccaacttcacattgcaaatggtgggggaaaccaccatcgcgatctgccctccccgggcaacgcacggcgggtggtcggtctggtcgaaggtgagggtaacctccgaccatcgtgcccgccgcgtcgcctcatgggtaggggcagcggccaaaagctctcgcttcatggccttgaggctccggcgagaagcgtgagtgcacgctcccccatcgacggtggcgatggtggccccaggtcgccatcgtcgatgtcctcggtgggtcccttttgcttggcctcacttcgccggttgccggagggagccgccggggccttgccctcacggcgctcctgcctcctctcctcttcccacttcctcgtccgctcagccaaacttttgaccgcgcggcagtccgcgaggtcgtggagggaggtgttgtgcacggtgcaccacttgccagtcgggcgctccctgctgggagcgccggcctccttctttttgtcgctcgcaggcctcccctttcgggtggcccgcgaagcaccctcgacggcgaggacatgaccctcgtcgtcggaatgggccgacctcttcttcctcctcctgtcccgccgccctgaccgagcagcggacccgggggcggccgaagctgccacaccggaaccggaggagttccaggtccaggcctcctccttgcgagccactcggtccgcgagctgaaaaagctccgcggtagtctggggctccttggaggcgatcttttcgagcatgcggttgtgccgcacgcccccctgaacgcgtagatcaccacgtgtgcagggatgcatggtatggtgttgcggacttgacagaaccgctgaatgtacgagcgaagtgactcatcatcccttcgctgtaccgcgtgcaagtccgcttcttcacctgggcgctgatatgtgccttggaagttcatggtgaactgctggcacaaatcctcccaagagtggaccgacgcgggtggcaagttcattagccaaccccgcgcctgtcccttcagggccatgggaaagaaattcgccatgaccctgtcgtcacccccggcgtcctcgatcccggtcgtgtagacctggagaaactcggcggggttgacgcttccgtcatatttttcggcgatggtgggccggaaccttgggggccaacggacgtttcgaaggctcgccacaaaggctctacagccaacaccaccaaccgggggcacggagggctggcccccgcgcccgtactgaagtggcgctccggacgaggaggcgccctccgttgcgtgggcagcacgacgaccattgcgccgacgctcgaaaccgaggcgggcatccggccccccacgcacatcttcctgggtcggaggcgttgacgagagaatggcagacgaacggcgggtaacagccgccgctcgccgcgccctccacctcgacgacacggagccggcggtagcagcgccagaggccttggtggcggaagaccgcccaccggcacctaggcgctgctgcgccgtcatgaccaagtcggccacgtcatccaaccaacgtcgggctagagtctctggatcggggacgacgggcgggtgacgcaagagcgcgcccgcagcttggagcacgccctggggcgtgctgccatcgccgtagacgaggaggcgacgctctccgtctcgccgtccttctccatcgctcgtgggcggcaaagttgcggatctttcgaccccctcgagcgcctcctcccgcctaagacttcggcgagaggggggcggtggagtacgagctcgacggcgcgggttctgctccccgtcgtcaccgctagcactcagagagaggttgtgcgcttttgctcgttcggccattgggttgaacgggagaagcttggcgcacacgaaagaggatgagagcttagaaaaacacacgcgccccctacatggcgcgccagatgacggagcgtggggctcctcaccgagagaccgcgcaggcccccctttgccggttcggcggggggcgctaagtgaggttctaagccctcggtctgtggaatattcgcgagagaggcaatgcacgagacatgggcg

SEQ ID NO: 66796 - DNA, 3147 bp, Oryza sativa
acccctcggggagataaaaggcggggaggtctcgtcaccctcaggcccgacccaagggtgaccgcggctacccaaacctctagtcatgataccctcggccccatgtcatcgacaagtactacctttgtttcaggttataagactttctagcattgcgtactactaatctaaaatcccttttattaatctattcttgttctatatcctttataaacaaatattcctagagaataacctgacaataaactaataaaatcctacaaaagcataaaagatggccactttgaatctttgattatgttgcacctcaaaaaaatatatatcatatattaccctaaaaaaaccatacacttttccaatttcagacagccaaaagaagagagagtgagagtctgagagacagcccattcagaggttagttagagttgggccgagcccatatcatctcctatataaatggcccttccgagcgaacctccgccccctccgaaaccctaacgccacccgcgccgccatccccgagcaccaccaaccccaccccccgagcgagcggagcggagaacgcgaggcgaggcgaagcaaacatggcggcggctgcggtgtacggcgccggcggcgcgatgaagggcgggaagctcggcatggaggaggcgcgggagctgcagctcaaccgcatccgcatcaccctctcctccaagaacgtcaagaacctcgagaagggtaatccattctttctctttttcttctatagtttcagttcgttgtcgttcagagaggattagattagatcggatttttttttgctgagagcgcgaagctgattcgtgtgtttatggttgcagtttgcgctgatctggtgaagggcgccaaggacaagcagctgcgcgtcaagggccccgtcaggatccccaccaaggtgctccacatcaccacccgcaagtcgccgtgcggtgaaggtattgaccagttgcagccacctctaattgcaatgcttgattgggtttgaatccatttgtttttgtggtatgtttcgactcatgggtatagctttggtttaggtggttaggaaatggattggtggagacagatgccactgtatagatgccagtgtatagatgcttggttaagctagatcctggtctaaattagtgctcttggttggtgactagtgtggattgtgtgaccattggaatcatttagtcaaaactatttgatttttcaggcaatctctttgttgaaatttgccttagttagagtacttcactaagtgttattgttgtatggccatgttcttatagtgactttcggctatctaaaatctgcaataaagactaccagcaacaagttgccaccaaaatgtaatgaaggatgaatgtttaagttttcgagtgaaagcacatggtatagcaagttgagtagaagggttactattggaggtttgtggtgaataagtttggtttacctgttctttgtcgacccaaccatttcatcacccaaccatttcatgcatggagatggatgggcagcgggatagcaagcgatggacactgtcaagctacaacaaactaggatattcctatgttattcacttctagataagggaatgatctagaggcaagctcagaaaacttgccgttacccccacagtctcatattaagggggcagaatatacagacgtttcttcaattttagtgttattattctccacatgtcataattttaaagatagccaagccaagttctgaagtcaagaaggtttagtaagattttgtttagcagggatttggaaggcacatatgttggtattctattggaatgcaagtgggctggcttttgaacccatttatgggctattcaagtgggtaaaccataggttggtgcacttaaatggcctataagtgggtttgtgggctggccctcttgtatcctgatagtttagtatgattggtaataatagcaatgctacttttaaatttaaggtttgttatggactagtgataactgttatgggatcgagtaccagtggcacaagaaactactggctagtctcgtagcttgctaggtactccctctgtcccaaaataaacaaagctagtacggggatgtggcacttcctagtcctgtactaggtttgtttattttgggacggagggagtatcatagtttgttactcctctggttactatttatctttttggctcctaacctacaaaggtcgcagtgtagtaaaacctcctgcccaaaatgtagctctctttggctttgaatctggatatgaacttgtctagattcatagctagatatagttacaccttgggatggatgtagtattgtactccctctgtttttaaatgtatgacgctgttgacttttagatatatgttgacaattcgtcttattcaaaaaatcgagcaaatataaaaatataagtgaggcttaaggtatatttgatgataaaacaagtcatggcaaaattaatgatacctgtataacttttttgagtaagacgagtggtcaaacgtagatttaaaagtcaacggtgtcatatatttataaatggaggtagtattagagaaggaatccattgataaacaagattagtgctcttcccactattatagcaaccataggctcgaagcctgcattgcgcaagagacttggttgcaaaaagacatcactaaactaaaggatcaaactttacgcccatttaagtggacatgtgagtttgtttcatgggatttattattatgtgaattcattgatttgttaattggacaaagtacatgatatgtttaacttgtaatgtatatcctttttgtgtgccaatcatcctgtacccctgtttacctatgctcatgtagttgtagcatattgttctgatgattgacagtttttttactttcatgcttatctttcatcaatatatcttcaggtcagtttatgcttgcaacagttaaactggacgctctttgttagatgaaaccactttggatgctagttgcttaagctagggaaatttgctgacatcttgttggcttaacttcacattggttgggttttcttgtgctaattcaggactattttgcgttcttttctgaccaggaacaaacacatgggatcgtttcgagttccgcatccacaagcgg

SEQ ID NO: 66797 - DNA, 3733 bp, Oryza sativa
  unsure (1)..(3733): unsure at all n locations
gccacaagccacgccgttcgccgggctactgcgcacgcctccaccatccccacccgccccccgccagatctcgccgcggttcgctgacgggatccatggcggcgccggggagccacacccgccgccgcgcgtggccgctgctgttcctcgccgtcctcatgttccactcgctcgccatctacctcttcacccgcggcttcctcctcacccgcaccgagctcgacgtccacagccaccgcgacgaccgcatcggcatctccccgggctgctcctcctggcccccgcccgccgtcgaccgcctcgtcatcgtcgtcctcgacgccctcaggtaaaatcaccacccctcgaatcttagattccccaagagagaaattaaatctcttgttggctactgcgattatactcagtgttgggttaccgagaaagtaggataagtttggagctgacacagttgtgcaatgcactgtcctgcaggttcgattttgtggcaccaagtacattctttcaaggtgatttactccttttatgtattactataatgctcaacgtgtaacatgtgagaatgtgatttgtaactctgagatgaggccatgattcgctgcagagaggcaaccatggatggacaaactgcaggttctgcaaagattggctgctgatgagaagacctctgctaggatattcaaagcgcttgctgatccaccgacgactagccttcaacgtcttaaggtgatcaactctgtttctgttgttgttaatccagatattcattcattcatcaacagagttaccctgaaaaattgttgtcctttcctcaattcagtgcagtataagattatcgcattatatgcattcatgaattgagttgacctgatatgctctgcacgattcagtgcaatcaaatggttgtaactttgtgtgttcttcaccccccaggctttaacatccttgctgtaaaattctatactcaggctctgacgacaggtggtctgcctacatttattgatgtgggaaatagctttggagctccagcaatagtagaagacaacataatgcatcaggttcttgtcacaatctcatcttgcatctaacattacaaatatggtgtcagtaaacttactcagtttattctggataactaaccgtggaagtatgtgttgcctattgtttctttgtactcaatcagtttgccaaaaatggaaagagggtcgtcatgatgggagacgatacttggatccagttataccctgaacatttcaacaagtcatatccttacccttcttttaacgttaaagatcttgacacagtatgtcatatcttttgtaccattcttttccttgttctgcagtgcgagtttttttcctcccataaattttccatgaaattaccagtaattgtatttatcgtatatatcaggtagacaatggtgttattgagcacttgcttccatcattacacaaaaatgattgggacgttcttattgcacatttccttggcgtggtaagttattgtgcattctcttatgccttagcttaaaaatttaatccttttatcctgtccgttttgaataaagaacatgtgagatcaacttcctttaggaccatgcagggcatatattcggtgttgactctaccccaatgatccagaagttggagcaatacaatcggatcctagaggtcagtcacctcatgcacaaatatataatgtggctttatgcttacctgcttatcattcttttaaatttgacctcattatgttctttattcccatatgatggccatattaactatgataatcaaatgctgctatatttaactcatacaggatgtaattgacacattgaaaagtctatcaacatcgggtggtccccatgagaatactttacttcttgtaatgggggatcatggccaaacactaaatggtgatcatggtggaggaactgctgaagaggtgatctatcttatgttttgttgctaaatgctgaagaggaacactaaatggtaatcatgtctacataactaatgctgttactattataggttgaaacatcgctctttgcatggagtccgaagaccccaccaaatgctgtcttgtctgttcttggtaaaaatttatgcaacgctgatctggtacattttcttatcctatatgttctgctaactaattatgatttgagctatcttgccatgtatggcgataatgttatgatcaggactaagttttcaaacaattataattaatattcattggccatattataacctgagttacattttttttgtctagaacacttaaactagaattgcgtacagaagatatttttctaatcccttgcttccatattgaatgccttactgttgtatatttggtttgacatctaaaaccgtagggcaaagtgattgactattttaaactctactctgactgtgttatgcatggctatgaagtactgcatgcagcgttttttaatgaaaagagtgggaatgagggcctgtagattttaggaatgtaaatttgaaataagcagtgattgatgtaatacagtttttggccaagatacatgttaatcgtagtacattttgtttagccagattttgcttgcttttatttgtgactgtagtaatgtgcctactaatcacacgtttatttcttttctagcatggtaaagaggtgtgcgtcagcactatgcagcaggtcagtgctaactgcattcttttatgttgatggcttatatgatcaatattgcttaatttttctccttgttcttagcttgattttgcagtaactatagcagcgctacttggtataccttttccttttggaaggtgtgtacgctttacttggtacttgcttgtttctgttgtttgcagtgtgtgctactatctggtttgactagagacactatctagttgcttttttttttcattatatatactgattcgacttgattttatttttcaattgctattgtccctacatccttccatagttgtagtacttaattcagtatatttacgaaatgtgttctattgtgccatatctagcattggacgtgtaaacccagaattgtatgctctgagtgctggaacatgggataatcaacagatcggtgccaatgattgtacacagcagaatgatctagaagcatggatgcggagatatgctgaagctctctgtataaattgttggcaggtaatatgaaagttcatttgtatttgtttggttgggtggattgctgaagctctacgctgattttcagttaaccctcataggtaaagaggtacattgatcgatattctgccacttctgttattggatttcgagcagaagacctgaaccatgttgcagatctgtattcaaaagctcaggcaaattggtcctctgtcctgaggtctacatgtccagtggaaacaagcagtcaggatgaattaaaggagtgcgcaaataaggaatgcacaagttcagctctgcggttgcaaattgatgcatactctgacttcttggagagcttnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66798 - DNA, 1665 bp, Oryza sativa
ctctggtggtgctcgggcactccagctgcaaaggagctcgttgagaacaatcgtggcgcgcgcatccttgtagcactctccgagctgaccctgatatgtttctcagcccctgatgaaagcaaaattgtcgggcatggactattcggggatggcgctggtgcaatcatcgttggcgcaggccccttggctgatggcgagcgcccattgttcgagatggtcgctgcctcccagaccacgataccaggaacagagaacgcacttggcatgcaggccactagcagcggcatagatttccacatctccatccagctgccgacgctgatcagggataacatccaggagagcttgctccattcattctgttcggtcggaaacacagatcctaaatggaacgacctcttctgggcggtacaccccggtggccgcatgatccttgacaacatagagggtgagctctaactacagccgtggaagcttgcagcaagtcgtcaagttctacgtgagtacggaaacatgagtggcgcgacgattgcgtttgttcttgatgaactacgccagtgtcgggagaaggaaaaacaagagccagaacagcctgaatggggagtgatgctggcctttggaccagggatcactattgagacaatgatcctgcgtaacccattgcctcatggtcttatggaaaattaattaccactatcatgaaaagaatgcaaagggaatcaacacgtgatgcaccagtatttcactacgctatgataattaattaatggatgacactgattgttcacgcttaagtatttccaactctacttgttgcaaatataacttttattacttccatatgtcctctggttctttagctttcttgatttgtaacaaaatttgaaatacccttttaccgtgtcatttgtcagtatagtcgaattattacctctgtcaaggccctggtaataagattatgtattttttttatttccaaaatcgcaagaatacactgatttggggaaaatttacacaaatataccgttgatgctcttttgatgagcgagagcgttgcagccatgtcaatctcgcacttcgggagagagaaaccgcgatctcgctaaatggcggcgtgaaggttgttgaaattataagcacataataatttaatttattccataaataaatcatgatattgcagatgtaaactagcatgaacgtatcataagatctataacatgaacaacacgaacagatcaaatatgcgcaaaatattaaacacgtaccgagattgcggaaaaacctgttgctcggcaagaattactcgcggttgcgggcgccgacgaaggcgcgcagcacgcgagcggagaggaagacgagccgtcgcggacgaacagggagcagtcacgcaaaacgcttttcaaaaaccttattgctgccttctcccggtgcaagacgtcgaaggcagaggttccggagacctgctctcccgattaccggtgcacgccggcgagcgggatggagtagtctacgagcgacggcgcagcacagagtaggaggcaaaccctagattggtttcgcgtatgttgcgtgaagtcaccggctcggtttatatagagataggtcgcttgatcagggcgcccgcacgatctccactccgctaaccgaactggattagtcgcg

SEQ ID NO: 66799 - DNA, 1735 bp, Oryza sativa
atatatatatgagagaaagtagtaatttaattagtgagactagtcttatccacattaactgcgattgataaaatcattacttaatgaattatagttaaattaatattatggagtacttattatattattatgttgttaatcgcaataacatatcacggcaaataaacttttagtgtaattctcatggagtctgatgaggacacaactagcttggatataaccaagactaccttatatattaatcaaccaaaggtgcatatgttctacattagatttacttgttatatatttgaacaaacgttgctacacaaagagttttgtgtgttttcgtttgcagaggtacttgcttgggggaagaaaaagaaaccgagcgtaacgaatgcacgaatgattaaagaaattgattggagaccaaaccaagaccttctccaagtctatttccatctcaccacgtcacttttggtccatagaagacaagagataaagttctatacgttttggatccggattcgggcctcctgacaagatcaacttaaaatggacctagccgctgatctagatggaatttcggggcctatgagtacttgttggaagtcttatggagtctactttaagatggttttggtcccacatcaaaattcctaccaagctgccgggaatctacaaaacaagccacatatctcatccagtccgaatccgatttgtgttttggccttgatagtgtcgtgggcttagcccaagggggtctgagcactacggcaaccctaggacgtccttaatcatacttaatcagtagtcgtcatcgcttagaggcgggttttgcttagattaatttgttaagaacagtttcgccactagatcagtttgtagaaccccaaattcgagtggttaatcattcatatgcaattgtgttgcaatctatcttattcttgcttgtgttcttcgattcgcacgtagggattatccttctcggccaggtcaaccgggtttcggcacggttgataaccagaggagacgtggtgctgcaattgcggggctcagtagcgtgttcgttcagaagccggatcgagttgtgtcgcgactccgcccaaatcgattgtttatcaatacctatcggaagatcgggagctaacatccctcatcagttggtatgagagcgcggttgcccgttaggtaatttatcttcccataaccagaaaattgccacacaaaaaaatattctttacctagacaatgtgacccgttgcattgttctattagattttcctttgttgaattctagattgcattgtcgtgttgagtgctggtttagttttagatttaattttaagttttgagtattgcatctgttcatcacttaggcctagggttcatcactcaagtcggtgtgagttgtacgtcagttttaggtccagtttttcatctcaacgattgttgctggtatcttgaaaaattgaatcctctcttcgtcgggtaaaaaaaggtaatgataatggtgctacaactactcaaggtatgtatatttatgatgtgccaactatgtctactacttatgctacattagagcaacccatagtggaaacaattgctgaaatacctttgtcacaaaataatttgcttgatgtttcttgtgataaagaagagttgtgcgatgctccacttatatccatgccacaactagtgaatggacatgttagttctatagtagagccaccatgtgttgagtttaaacatg

SEQ ID NO: 66800 - DNA, 7496 bp, Oryza sativa
atgctccatgacaaggtgaaactgaggacggtttccaatcaagaaggggaggatgatgaggacacaactagctcggatataaccaagactaccttatgtactaatcaaccaaagatgcatatgttctacataatatttacttgttatatatttgaacaaatgttactacacaatgagttttgtgtgttttcgtttacagtggtacttgcttgggtgaaggaaaagagaccgagcgtaacgaatggatggatgattaaagaagttgattggggaccaaaccaagaccttctgcaagtctacttgcatatcaccacgtcacttttggtctataaaagacaagagataaagttctacacgttttggattcggattcgggcctcctgacagcatcaacttaaaacgggcctagccgctgatctagaagatattttggggcctatgagtacctgttggaaaacttatagagtctactttcatatggttttggtcccacgccaaaattcctaccgagctatcgggaatctgcaaaataagccacatatctcattcagtccgaatctaatttgtgctttgggccttgtaattgtgtcgtgctcttagcccaagggggtgtgttaacaaccaaatttgataattcaagtatcggagatgaagataaaaccgaagcggaatccgagatagagatcgttccggaagcagagcaagaatcggctaaagtccgaatcggctacggttaggatcgctagagttcgagtcagacaaggttagccgattgagccgattccgacaatatgactcgatacatgacatcaggttgggttatggtgcttcatatggattgccatgcacggattgagtcctagaaaggcaattgtatatattaattaggatattctatgtaatttccttagagataagtttggacaaaagtctgccgcaaagacttatggtatcttagagtttgttagagataatagtcgtgtccgatatggacatattttgtaatcttgggtataaatagaccccgaaccccatgtaatcaatctaacacacgttcaaatacaatgtcggcgcatcgccacacttttactttcgttttgtttcgacgagttcttgctttcgggttgagctgcatctgtttcgatcttcaactagaggtaaaacttgttttggcggcttgtgttctcgggattagtgcttccatctttatgatactctaatcttgtttatgtaattcgtcgagttatcatatatcttatataatctctggcaatattgttatttaaccctcaatccgctaaaatctatcgctagaaggcggccgatcaggttaaataccaatgttgacttagattatatagggtatccaccactctatgaaacacccaacggcttgattgtcctagacattgtccttcttttcatacttaatgctgcatcagttaagtttgatctattaagtcgtgcttagaatctcaatctctagcctgctttttggttgctgattagggtaatatcggggtttcagccgatcttacctgatttagctttatgtttcatgtgcttaattgatatgcttgatctgccctttatgttaagatcttattacaataaagtatattaggcttctgtttggtatattttacttgctttaatatcttaatatagagtggtatcggagtattagccgatacatgctagatctatctgattggctatgctattagcgtctataatctcattgttaatatatatttcgatctaagtgatttatactgtctcggcatggcgaccgatctatcccaatcacttgatttgagtatatatcgacataaagattacatactgctaatatctacagccgatcgaatagatttagtgctctcttaattattaatgattgccaatcgattcaaatatgacatcagctcagagataaatgatatgtcatcggcgattagccgatcggctatcatttatggatttaaccactattatcctgtgtttgtttcttgttgattgcaggatcaaatcaattggcatgctcacgaacctaaaggcaagattttcagacctaacatccctgattagagtcccaacggtgtgctgcccagaaaattaacgtcgcgtgtagtgcaataatgataagttacaatatttatatattcatggagtcgcattagttggtacaacaatttggtaaatactaccatttttatgttctagcaaataggaaaatatcttacttattgtttttttataaaacaatggtctcatttagtcatgaacaataacttcgtgcacttgttttttaaggtctattaggagtacaatattttgcactatgtattgtgaggttttggagtgatgttttatttttttcggagttcctttaacattccatattaaataggacatcaatgcaagaaatattcctcaaatacgaaacatcatgcacaacatatagaatattgtacaaagacatcatgttcagtgctactcattgttgtggtcagtcggagtcctaaaactaccagcttgcattttctttgtctgtttccttgcacctgcggcatgtcgggagctaaaagagaaacacggttgggctcacggcgctcatggttaattctatgctggttgttgtcgttcccttctaaaccaccaacttcatcagtctgcaatgccgaaattcattagataccgaggacgaccctccacccaagctacacatcttgtcgtacgatgatgtctacggcctaaaccctgacattagttttgggtggtagcctacagaagcatagtagatatcaatcaaattgtcaaactagagcagagaacaataacataaactaaaatatacaaacctgttgacggtgcttgcatatacagaatttcattcggatgcaagagatattcaccaaatagccaatcaccttgtttcaacaaatccatataaccctgcactccaccactgaaagtcgtaccttgcattcatgttacatgtagtacaaagttattctcttaagttgcagttagagtcatgtatcgtagaaaagtaccgccaatatgtaatgattaacaatgacggttgtgagcgtaccagcataatccatgtattgtccttgccatgggttggtaccatttgttggtggatgcatgggagaaccacctgactaggccctgcaaatatcaggaagtaaatagttaaaaacattcgtatccatgcaaaattaaataattgaactgatagtagaaattcatccactaaaacataccggcctcattactcatgcgaggaatctccatgcttgtccctgtgaactggacacatcagaaagcatcaatagttgagaaaaataagaaaattgtgaaattacatggcagcggagacccagcgccgaatgacgcaaaccctcctttacctatagttgccctagaaatttgggtcatggtagggaccccgtggctagtccttgtaaatgcaattaattagcatgaagtgaaaggacatgtggacatattgaaaggaccttgatgtcgcctagaagggggtgaataggcaatgcggaagataaaactaaaaagggttggattgtctgataccaggttagagagtcctatggatcggattgtccaaactgagatcggattatttgacctacatagtaacaatcaaacaagtaacaacctaaaagctctagatccaattcacaagtaaggaggagagctcaactaacaacatgattggcgtggcacaaagcaatgcaacaagaaggtaaagagagtgaggatatcactaagatttacgtgatgatgtattttgcggagttcaaatccttgaggggattccaatctccgtcgagaagcttgcaaagagcccggtcttttttcaaccctatcctcgtgaggttgcacaaatccactcctcctttcactaagggtatctatttccttgcggaggtgagatccggccttcacaaacttctcttggccaaccacaagtagatcggtggcccaagaataacacctagctgtctaggagtcctcaacctccaagagtaataaacaccacacaacactttgacaaatcatagtgctcaagataaagaaaagtgcacactaggctcccaacctgcaaatccacactcacaaagatccaagtcacaaagaacaagggggatttgagatagagagggagagagctcaaaaatccaaagcacttagcacaaagctcaacccaaaacaagatttgaatgaaatgaatttgagcaactctagaaaactgttagtggggggtttataaagatccccccaaaatgtgaccattggaggggaatcttttagcccacgtcagatagtccgatactaaatcggatagtctgaaaatttaaatctccaaggcaatgagatacaaagaacgaatttccatgaaatatcggactttctgagacattggactatctgatgttaaatgggatagtctgatattttacaagcaaaaacttcatcctcaagtagagactcaggttccatgaaatttcgaggtctatgtttcatcagactatctgatccaacatcgaatactccaatacttagaaaaaaactcactcgagaggagttttcaaaacaagaaagagagtgaagttccatgaaaaatcggatagtctaatttcaaatcggtagtctgatgttgatgaagaaaaatgcaataacttttttactccgaagtccaattttgatgatcttggactttaaagaaacctagttagaggatatcaaatacaccataaaacatgagacaaaaccttcaagagatgttgaaaaacttgaaaagaaacacggtgtaagtgttgtgacatgtaaaacaactcgcagttggaatttgcttaggtttttcaactcacacaaagatgaattattttaaacactagtattcaaccaattatatgcatgtggtatccctcttaataatacagcatcctaaactcaaatgtaaaaaagcaaagttataccaataggaataccttcataccatacttggaaggttaccaacgtcaaggacatttgatcattgggaaaatctcatcttcttgatctttggcatttcatcttcaatttctcaaatgattgatgcggataatccatggcttcaaatggcctcgcacggtccatcacaacaaagtcttcactcgtccttcaccatcagtttcagttggtcggtgtcaagccccttgcttgctcttcaccaccgcatggtccatcgcagcagagcgtcacttgcgcttcaccgtcttgccataggtagtcacttcgtaccccctcatcttcaatctcttctctttaattctcatccatcgataagtccatcttctagcttcttcatcggactaatcacttgcttatacactcaataagcgcattagtcccttaattgtttgtcatcaattaaccaaaatccactaagggcatagatgctctttcacatatgcgtaacaatgttacccaatcgagccgaacacgtgaatgatgcaaatcctccttgctagtgtgaggttgcgacatctagagccttgggaggaaccacttgagacatgggacgaggcatctgaggcatgggatggaccattcgcgttccctctgtcatcaattcaaaaacatcatttagtcgtgcaacaattccaattgtcaaaaagtaagcatattgcacaaaaatgtcttacgtgcatacaacacaaactcaccctgccactgagaggtgatgggcattgagctttgcggggggtacctattcagggtgcgctacaaaacaatatattagtttataattgaatgacgcatattttatcattccataagaaggttttttacctagaactagggcaaacccacataggcgttccgagatttatgcgatcgttggaaaagtgggcacctcacgaaaagaaattgaccatcctgcatgagcagcaattgatgatcgtgtggaggctgatgggcgtgctgaggtgtacagctgggaagaggtagacagccgctccggcattggctcgaacgtccttcttgtagacatctaacgaatgtcggcacgacgggaggcacatgattcacttacttttttcacgaagaaagtcgaccgtggccataacttcatggttagtacccccaatcccatctctaaacttctcccacaaagttttggcctcccttactaaatcccctgcaatttcggtatgcaaggaaggtagtaacaagtttagaaagtgtcttcgcatgaagaacgaaacaccgatgcaacaaaatctttcaatctgaagtagtacagtcaagtgagccagggttgctagctgcatctcatatatttggtcaaggttggctagtccgcgcttgtcgagatcctcgggtgaaaacagtcggatgcgagtcagcgatgagtactaggccatgtattttcgtaagtgttgtggtcgtatgccttgttctctgccttgttctcctgaacaacatcagcctgcgcttgcgattatgcctctatccatgggctcatccttgagtatatagaacgacaatacatgttgtcagcttgtctcttttgccttcggtgaaaatagcatcaataaaccattacttattgctcgtagaatttggagtaatgtacaaaatgaacttatgtgtgcacttctggtggaaccataagtccaatgggaactgggacatccagatctaactccagaacttctactagcctattaataactacattgaagtagcaggatgaggatgaatggaagatgtgatctgtgaaggctaaaatatggagctcctgcacccttctatttatagagggagataccttggactataatggccaaatgggccacccatcccggcccggcgtgagcatgaccaggcacgggcgcacggcccaagatcagccgagtcggcacggcccgaccaacacgccgagccatgttgtgcctacacattggctgcaccaacgaccgaggcatgacccaataagactcgggtcatgtcgagctgtcccaaaggcacgacaagcccaccatggtccttctcggaataagtctatttctcctccctagtctatttgggatatgtcctaggaattcactttgactcccttaactagtgactgaatctgattcgtatccctgaaccacaataccggatatctcgatcccccccaactattaaaaccggtgcaatttgactctctcgatggttttggaaagcatattagttgacgtggcgcttacgtagcggtattgacctgatctttgttccacgtggcgcttatgtaggattagaactaaaaaatatgtgtggtacccatttgtcattcacacagaaattatagtgggacctaatgacatgtggggaaaacatgtcatcctttctacttacattcttcctcccacctctctctcccttatctctttctcccccccttccccttttcttcggctggcaccggtagg

SEQ ID NO: 66801 - DNA, 10482 bp, Oryza sativa
  unsure (1)..(10482): unsure at all n locations
atccccggaaaagagcaagaaagggggaatagagactcaccgccgccggcgtgcgcgggagtcaaccgccgtcggtcgccattacgccaacgcaggagagaaaagaaggggtggcaccgcgccgctgtgctcgccgggcgccgccgcacagcgctcgacggctgcgcgcgccggcgaaaggaggtgcgacggcgccagcgcgccgtgccgccgggccgtgcagccgccgtgccgccgtcgcaccatggctagggtttcggccgagagaagagaagagtggctagggtttggccagcggttgggggctcgggttttgctctcccgatctccccgcttggccgtctgatcgaaaccctagcgatcggacagccaacgtcggccggaccgcttttggcccaagagggggcgcgcgctaggcctctttcccggcccaggcccaggttgcggcctagagaggggtgagagcccgcatgtgcatataccagggccgccagagtccaattttggtccctcggggccgaaagaaaaaggaaaagagtctatttttagtccctgtttcagatgcatttacaattatagttattaaatgtgtttatttctaagcaatttgagccaacgtgaaaattgtttagagaatagataaatgtgagaaatgcttctgaacatgtattttgtatattttcatgcaaattacaatagaattttgaattgtttttgcatgatttacctccgtttaagatttgaaccgaagggttaatttttacagagtgaataacagaattttgtcattgtttatatgaattttatatagatcttttgctgcaaatagatgaaattgatgaaaattagtgtttctaaaattaaattttgaaccaacgggataatttcattttaggaacattaattatgtgctatgatgttgtaattttctaaccaacgttgataattgtaatgttatagttatggctctatgtgttatgtctattttctgcccaacggtgatgtagacttaatacataataattttaatattaattttgttctcacaatacatgattatctcaggtggctactccttgatgggttacattaaagatattccgaccctaaaaggatataactatgaagaatggaaaagagaactcgaccttgcttttatcttgggagaggtggactgggtgttgactaccccatgtcctatagaacctgcggaccttgtcagaggtgaaaaagagtcagatgctgaatggcaaaagagagagagggacaatgctcccctcatcatgtcgtatgacattgaacatgtgaaatggtccttagccaacaagaactgtttggctgcggtaaaggacacgattgagccaacaatattgggctcaatcccagagtatgacaccgtctctaagtacctcgaaagtataaagagccagtttactggttcttcaaagttttatgcgacacagctgataaagcagcttgtgacagagaggtaccatggaggtggtgtaaaagaccacattcttaggatgagcgacatggcttccaagttgaagccaatggatttgggcatctcagatgcctttttggtccatctggttatgacctcattgccaaagaactttgacaactttgttgtcaactacaaaataagtccagagaaatggaatcttgaagagctcatctctaattgtgtgcaagaggaggaaagaatcaaagagaccaatggtgcctccaataaccttgttaaagataacaaggaaaagagccactggtcaccccccccccctcaaaagcaaaacagcctcagcatctgcctcagtaacaacagttcacagttaagacaagatcagtgtccccactataagaagacagggcattgcaagaaagttcgtcctgacttcctgatagtgatcatggcaaagaaaggtgagaacattattacatttgtaaatgaatctcattatgattggttattctagatccacatgatggattgattctggagcaactattcatgtgtgtaattgtttaaagggattccgttcgatgaggactacgcaaagaagcgaaagatccattagagttgccaatggagttgaagcaaaagttgaaactattagagatcttcgcctagagctcgcgaatggcttcacacttttacttagagatgttttttatgtcccttctttgcaaagaaacttaataagtgtatccaaattggattttgatagatatgattgccattttggaaatggcaaatgtgaactatggtataataatgcatgtattagtcttgctgtgttgcaagatgagatttatttgttatctctttctgagaatgtgaatattgtgtcctcgttgacaaaagaaaagaaagcgaactcctgatgtctcatagaaattatggcactgtcgtttaggccatatttcgagggggagaattgagagactgattaagaatgtaattctttctccattggagttcttagttttagaacaatgcatagaatgcatcggtgcctaaaacaccgtatgagctatggatcctccgtgtgggggggagtcttgcagaggctaaagtatttaacctaaatcttgggaagttggaccccagaacaataggctgccattttattggctatcctgaaagatcaaagggttatcatttctactgtccaaacagttatacaaagtttgtagaaacgagacacgtcgtcttcttggattagggggagctcggtagttcgagaaattgatcttgaggagaggcgggtgtctgtacctgctccgtcgactcaggaacctttcttctctctacctgctgatgttgtgcctccaatgcatgacgttgcggtaccaacacatgttgttatctctcctgtggcaacaatgaatgaaagtgaggaacctattctacaggattcaacagaaattattgccacactagaggaggagctgcaacagcctcaaacagataatgtgccagaacaggaggcccctagaaggtctgaaatagacagaagatcggctatccatgatgactatcatgttcataatatagaagagtcgcacatggaggatgatcccacctcatatgaagaggccatgagaagcgctcgctcatctgaatggttggaagccatgaaagatgaaataaaattaatgaaattaaacaatgtctgggatttagaagaaattcctaaagaagccaaaacagtaggctgtaaatgggtctataaaaccaaatatgactccagagggcatatggaaaagtttaaagcgcgacttgtggcaaaaggcttcacgcaaagagaagggattgattacaatgagacattttctctagtctcttgtaaagattccttaaggattacaatggcactagtggcacattatgatttagaattacatcagatggatgtaaaacggcatttctaaatggagatttggaggaaaagtatacatggcacaaccgaaaggtttcgtcatgaaaggaaacgaaaatatgggatgtcgtctaaagagatccatttatggattagaacaagcttcgagacagtggtacttgaagtttgatgggacaataaagaaattttgggtttcaagagaatgttgaggacaactgtatttattcaaagtttaagaatgggaaattcattttcctaattatgtatgtggataatattctactggctagtagtgatgtcagtctactacaggaaacaaagaaattctagtcctcaaannnnnnnnnnnnnnnnnnnnnnnnggctttacatgttttgggcatagagattcaccgagatagaacaaagtatgcattgggactttctcaaaaggcatatatagaaaaggtgttgaagaaattcaacgtgtacagatgcagtgctacacctgctcctatagtcaaaggcgaaaactatggggcatcgcaatgtcctagaaatcagtatgagctcaatgaaatgaaaacaaagtcatatgcgtcagctgtagaaagcctacagtacgcgcaagtgtgcacacgacctgacttggcatttgttactaggttacttggaagatttcagagtaatccaggtccagagcactggaaattggtataaaaagtcttgcgttatttgcaaggaacaaaagacctcatgctgccttatagaaaatcagaatcgctctagatagtggggtattcagattctgactttgcaaaagataatacaaagtcaatatcgggatacgtgttcaccctggcagtaggagctatttcatggaaaagctcaaaacagaccatcactgcagggtctactatgtatgccgagtttatagcatgctatgaggcaacggggcaggtgaactggctaaagaagtttatacccggttttaaaggtggttgacagtattgagaaaccactaaagttatactgcaataacgaatccatagtaatgtacactcacaacgatcagtcaagtggtgctgccaaacacattgacataaagtactatgttgtgaaagacaaagtccgagatcaaacaatcagtctcgagcacattagaacagaaagaatgctcgcggatccgctcacgaaaggcctacctcccaacgtgtttaaggaacatgtagcattcatgggtttaagggaagccttatgaatcctggactatagggcccaaaagttaaagtatatgtttctgaatagagatgtgtatagtggctattgaatccatcgatgattaaccgtgatgtgtaacatgctctatatgcaaatctgtgatgtaatagaaaaaggctaaaagaaatagtgatatcaagggggagaatgttagatggatctccctccccttgagccgttctcaagggggccttgactcgcgccctgatcggaggcacccagcccaatggctggtgggcccccatcaccctgcgccatataaagaggggtggaggctgggacggcacttgacacgaggttcgccgccgccaactccaccccacaaaccctaatccgatcgagagggggcgcagccagtgacgggaacgtgccagcgccgcgccacgcctcatcgtcgaccgcgactcccactgctacaaccaccgtcctcgtcaagcagagcgacgacaacgacgatggccgggacttcctcctcatccaacgcgtcaaccggtcacatcctaaacccttttcccttaatctctattgttgttcaatcattcaacccaaataaaccacccgactagatgtaaacctagttgatccaatagacaaccctaacaggaaggtgtcgaagttgaggtagatgttcaccatccggacgcagcggaagccgtggccgatgttcttgctctccgcccacagcaccgactcatcctgttactccgggttggatggcagcagccgaacctgtttgcaccaacacacgtacgcgtgcagatgaacgaatatgtcagatcatcatcaaagactagtggttttgcaacaaattcacaacttgtgacgccagggcggaaatagtaagcatgtgcgttgattgctactgcgctccaaccactgcgttaactgatttttgacatatatgaaataaactggattaattaatgaacaataagtatgtatgtacatatagggtggctccgtccgaggtccgagggagtgcttgatggcttggctggtggccttgttcaccagcgcgaacgccaggtagccttccttgtccttgacactggcggtggacggtagccatagtccggctcgtggctcggtggagacgatatctatactaatataaaaatgaggagttgccccctccaatcttacaggtgaaatcatctcgatcaatccttaccgtccatctgcgtctgtcctgatccatatcctccatccatccgccacggattgtccgcttcctccttctcgcgcgatgaacttgcgctgaccatgctggactcgcgctcctcctcgccccgattctcctcgccccgcctcagtccaacggtgctccagccgatgctcctcctcctccaccctattcctcctcgcattccccgttcgcgccgccggagggtcgtccccttccgccgacgccgccatactccaccgatgccctcgctggaaccgatttcttccccttccgccggcaccgcaatccacatcacaggttcacaggtcctcgccggaaccgatttcttccccttccgccgtgccaccgtcgccgcaatccacttcacaggttcatcttgcgccgattggttcccgtcagatttgagtaggaactaaaggaaccatcactattcccctgaaccctaaggtaataccaatttctcctattttacatgtttttgtgatgtgtcaatttgtggatcaccatttgttttcttgatcattcacaattgccaatcagaaattggccatagagtttgaagattttaacatatcaatggatttgcatcctttcagttgatcctgtgcagcccctgtcaatggatttgtatcctttctttcttctgaacttttcagatcactggaggctctaaattttgcttgtaatacagatgattagcactactcactgtgaagccatcctactgttcttgttcgtagttactgaaaaatatataaagccatcctactgttctataggagaatctaaacccagtggcaacatcacatgcaaaacacctccatatgaaattaatccttctttttcttcctatttccttgcagatcttcaaatttgtggttccccgagtatatatatgcccaggttgtatgcttgaaggttgtaactcctagcgatggacggcattcctaaattaactgcaaatgaattaagaagacaaagagaccgagagcggtacgcggcactcagcgttgaggagaaggcagcacgagttcaaaagaaccgtgaaaataggaagaggaagaagtctgcatctacatcgggcacaggtgatgatatattcattcacttcttattatgctcacccctatttcgtggcaaacaatgctgaaacctgggcaaactcgattggattgtagttttgaatcagagcctgtgcctttctccacacatggtaatgtcttgtggaatcaatttataatatcaaattgttctgtgcgtctgtttttttttttggggggggggttcaatctaataatatatttcaacaggtgtgcttggcgatattaaaaatttgagtttgcataatggaagccaaactgtagattgtcagccatcatttcaacctgtgccttcctccacacccgtgtcttcctgcacacctgtttgcagaaaccgacaaacctaaggaagtactttttgcggcacacttgccgtatactgctgcatgcagctcaggcaatgtcacaggtatgatttcttcgttgctttacataattacagtgccttgctatatttgccaattgatttgttctcatcactaaaatggtgaaattggtgtagttatcatgcaggctcccaatgaagtgctttccaagtaccactgaaatggtgaaattggtgtagttatcatgcatgctcccaatgaggtgctttccgattaccaattgcaaattaggttatttcattcctaaaccatgcttcttacccaacattgatttgttgattgatatctcagttaattatttcaatggtgtgcgtcaattgtatatttgtatcttccttacaattttcctcgaatttctgtgattttgcagccctgatcgagttgcctatttcctttatcattttgttcaagtaatctgtagtagtataaaaccaaaatatttcttattggttccaaggcaggtttcctgctcaccaagcaagttgatgctttgtttcaggaaatataggacaaataaacagatgactgttttagacaagttcaccctattgatagcattaaaattagatgctcaagatggatgatagtaacaacaaaagcaagtggttaagtcctccaatgtttcatcatttacggaggagttcataaggtgaaactgtaaccagatttttgtgttagtcatgtatcctctttccaattttgcgagatcttttactgcatttcatctcagcaaatgatgtgaataatatgagccatttgatgatatttctttgcatacattttcatttaactactgttaggcttttaatattattaacagactgttatggttattccaacagtttactatatatcatctatactaatataaaactactattataatctgtaggcttgccccagtctctctcgcggcaatggtctgcgtgtgctacaatctgcatccctccacgcctgagtaatcccctccgttcccatgttgaccgacgcggccgccgctgtctcctccaaagcagcagcggtcctagccgaattggccatccccattgccaaacaccatcactggcgccggcagcctcaatccgcgtcgagtttttgtctccaccagcatagtggtctctacacatgaggttggtcttaggctgcaacttttaactcttattttccatcttttaatcgaactcgatgcgagcacgggcttaatgcattcaagccacagtctcaaagcattctgtatttatgttgatgttggttgattgctcttgatgtgcatgtcaggtacttggaggttttttatttccctcatgacgaggacttgttttctcttatctttcaggcctcgagtgacaaatcagagcagcaatcatgctttgttgtggcttttatctctgccgatctcacggcaatctatcgacatgcacatttgtattttgtagttggataaaaaaaaagtagcaatagttgccatctttttctctaggaaaaactgatttgtttatatgctttctcagtttatgtcagagaaaatggttagttgagcttgtctcctatactgaatgtgcttggggttaactgggctttcagtcagtaagcatggtaacagactcttcattgagttaagtagtccaataattattttttaaagcattttagtcagagtagaaacaattatattttttctctactgactgcatctggtatttttggtaattagctggcatcacgtacttatgtatatagtcatatggacatcaagcatgtttgtgggataatataagatgctctaggcagagtagaaacatttatattttacattcctttgtgtcatattttcccttttttagggaagggggcagatcactgctcaataataaatttattcatagtttatattttgtttaattagatgattgactatgaaatttcatcacctgttgtcgagctggagtccccagtgaagacctctgtatgggaccattatgctttcattaaattccatcaccttggaaaactggttttgggtaatagtaatccctgtaatctgtatattttggtgtgtgcctaattgtatgaattgaaagattgaattaagttatgagcactaaccaaatggacaggcttgctttcagtctcctgacttttgcctatttgtctctattcctctgaaatccgtcatgcatgtgcagcgttttgaggatttggctaaacaatactttattgtcaaccttgacgataatgacttctcacgtactgagaatcatcaccaaggtttttcattttttatcttatgaattactctttgtggttgcttaaggaatagtggacttctaactgaatatgataccgacgtgccttgcacgtgcacgattactagtataggtagaactatgagtcagagtcgtcgccgcgaagctagtcaactccgacgtgatgctcgccacccgctcacggcggcggtgctgcccttcaacgcacctgacgtggagctagccgccgggttccgcccctacgacgtcatcctcttctccggcgaaccacgctctagcacgtgctagccggttcgtttgccggaccgaagtcgttggtcgtgaggaagcctcaccagggcaccccgtggaccacttgccgctcctcgggctgcgccgccgcacttcggccctcaccgcaagccgctttcgttgctcccagtccgaagagaaaggaggagaaagagatgagagagagagaggtaggaagaagggaaggagagaggacgacatgcgggccccacatgtcagtgagtctcacagtatattttttctatgaatgacaaatgggtcccatacatatttttaaattctaatgccatataatagccatgtcaattccacatggaacgaagactaagtcaatatcaccacgtcagtaaaaccgctctcaaaactgccataagagtcaaattgcatcagtttaatagttggggtcgagatatttggtactgtggttcaagaatacgaatcagatttaatcactaggtaagggagcgaaagtgaacttattactatttcttatatggctggaaataagtctattttgtgtccctcatctctttgcgccatacacttatatggctagaataagtctattttggcgccctcatctat

SEQ ID NO: 66802 - DNA, 5897 bp, Oryza sativa
gggagtagtatttgttttcttgataggactggtcagaccggggtttgtgtactgttcagaccaaacaaaatattgtgaatagtgtttacaatgaacaggtttttttttgtcgtgtgaagctcttcagaccgaaatgcaacgtgcagtcagaccggctagcccaacggtctgaccggcataattatataattatgattagagtcggtttcgagttgtttattttgatactagtgattatctcgtggttatgacttctagataatttatatacgtgtgtaacattgttttgtgataatgttgagtcacgctatgaaaaaatttgtgctcggatattgtttcttgtttgattcatatgtaggtgtgtcttgatgcttcagaagagtattgccagtgatggattaggagtcaacttgagagaatatggcgttcagacgatcaagatatcatgcgggatgcttaggctaaagaacagtgcacgtgattagtgaagatttcatgtggcttacaagaggaggttgtgtgcatatggatgaggagttgaatttcgagggagtccaaatttttgacaattggagttagaagagttggatacttgtatgggaaggtttctgaatgcattagaagtactgctacgagttggaacgtggcattcgtacagccatctctggatataaatagaagaggggttgatgtctttgggtatcgattttggagtgagttgagttgagtgaatagttagggttttaagtttactcgaattttgagagagtgaagttgttgcactttgtgacacgaatagaagcaataaaggtatatctattttcaagagttctttaatttgtgtttgctcgtgttcagcagttacatcggcaagcatatagcggttagaccggcgactattcggcggttagaccggcggcttcctagcggtgtgactaacaacatcaggcgacatcaacgaaggcaaggaagttggaccggagatacaccatcggtcggactgatggtatcctggcggtcagatcaccgcatctacaccggtcaaaccgttctccatcaagtttgaaggtaacttttaattccgctaaaagtgttcttaattccgctaaaagtgttcggttctttatgttctactatttaatcctctttggtaggcttagttcttgttattcgatcctacgtaaacaaaaaagatataacgattggttgtcctagattacatgcaacattcactagtacaaaagtgatttttgcagatagcccaaaagaggttttcgcatgcagtagggcagcccgcatgctctggagagtctgcaaaaattgctatctttgcatattggggcattttcgcgtgtgagtgcttatgtcgtctgcatgcaaaaataaaaatcgcaaaaaaaaccaaaactctagcatcccagtggcggcgactacggcagcggatagccggattgagctgcctcctcctcctcccggccacctactcctcctccttgtcggcggcacacggcaggggacggggatggcgccactcccagtcgttgcctcgccggtggctgtggcgccgctgttggtatttcttaacaacattaatagaaatataattcccagcaatggcgtagaaatattcatggtatactatagttacatatcatatccacaagcgcatggatataccattgtagcatttcacctgagagtattccaagggtatcgtatttatttaatcccgagggaagatttataagagagaactatgctaataatttatatggtacttgtaatagtcagtccaaacaggagttaatttaattcatgggtatagtgacacgaagcagaagaactaaacactctcatacatactaatgctagactaagtggagaaataataataaaaggattcattcctatacctctattataaatacaactttagtctataatttctagtatacaatcatacagttaataccccctttacaatgccctcctggtgcttcgagaaaccacccctgattatcgagttcgttacaacaatccgtcatggccatccaactggtactaaatacggaggagtaccctccctaggaatataacttaggattatctactaatgtggaggaatacctgatgaggacatcaacaccaacgatacatccatgcctccacaagtacaacttcatggtcctactacacgcgctcatgcacgtcaaatcaactatcaagtacatttactcttaaattcatatgattcttatttatatcccggagacacgtacacttttgttttactcaggaaagtggagaggatcaaacggggagaggattcggggggatggattcggactgcagcacaacaccaacttctgacggccgccacaacttcatgcgaactccgatttgggtgtgcaagtacttcatggaaatcttgtcaagtatactttcaaatggatccagcctcatgtccatatcagttctggagcggccgcaatcttcgttttactaccgagtccttttctgtccacagtgctgcgtcacctctttgggtccaatgggccgtgtatcttgttgggtccattagagacgcgtcctagggttagagaacgaccccagcacccctgtggtcatcctcttcctcttcttacagctttctccgctgccaagaataatcgggttttgtttagatcaaagtgtagcatcgctactttgccgagttgatcccgtgatcgattagatcgccggattgcttgttactgaaccccacttgttactactgttgattcaatccaatatctttgattcgcaaattgagttgcttgttcatcttgttcttgctgattctcgattgcttgcaggaacaaataccctcgtggttgggttgatcgtgcatccgtcgagattcacggccgcctttggagttggtgtaacgattgctaaggcacaacatccttggatagttgtagtcggatcgccaacatcgcttcatccaatcgacttatccctctcatcgaaagatcgggacacactcgcgcacatcaatacccatactgagttgtcaccatcagcggtccacctttactgttccgcagcatataaacccaaataatgctattcaataatctaagaaccacgcttaaattactaaataatactctacaatcatcgtcacaacttagagtagtcattaacatgatcattatacccacaccaatgcatatcatgggtaggttagctgtacaattataacaagataaatatatcgtcaagtcggtacttgaatgattaggataaaataaagtaccacaattgtatatagaagaatattccataaatcgtacaatccttacaagagaaggaaaagctactagagccatacccaaactcttccgaaaactccgaggactaaggaaactattttattcctactccactagctctagaatactaactaaacttgagagagagctttgatcttcttgcttgagtatgtgttggagtggagaatgagctcctccttaaataggctgccaatgacggttgtgacggttagaaatgtcctaactgcgctgcaaccgtcattgaagagtgatctaaagcatccacgtggaaggccaggatgggtggcctcggctagggttcggccgaacctaagctggcccattcggccttcatttttagcaggtggattccttgttgggctttgttcccaatggcatgagagttgtgcttgtttgcacgtgttaactttgtgttgtcagcccatctattcagaagtctgccactcgacggacgacaattgattgtttgattattttccatcgatcttcctccattttatgtagcaaactctgcaagcaaataatatccaagtacaagtggaaatagattattctaaaacaaatatgtattgcaagcatagctagctctcctttattttagtaatattgactgtcgaaattggtctataacgaccgtcaatagccgccaccgccccctcccgtacgtcgcttgctcccagccgtgctcgtccttgtcggcagcggtgccaagctgccgccgtccgccgcccgccatcgtcacccgccacccccactgtcgttgtcgtcgtcgccgtaggatccgccgccggtcgctcccgctgtcgtgaggaagagagagagaggaggtgagaatgaaaggaggggaggaagtgagaagaagataagggagagagaaactcagagataaggtttcaattgtttttgaatatgatgaaaaggaaagaggatgtagctcagacttctgtgcggacctttaagaggcctgtctacgaaaatatattttcttgtgcagtcgcttaagaggcccgtctgaaaaaatagccctattttcctgtgcggctgcttaagagggccgtatgcgaaaatatattttcgtatatgggtctcttaaggagccgtatgcgaaaatgagggtcgatgtttgcagacacgtatacttacgttccgtctgcaacctattgaggtgctcgtccagataaataatttgcgtagtagtgattatgaagatggagcaatgggaaaggtagagttggatgtaatgcagcgcgcgttggatgtaattaacgtcaacgagattggatcagggaacaatgacgacagataaaatagttaattactgtttacttgctatatacgttcgttccaatgcccatccaaagggacatcttccatactgttttgtttctcggtcctctgtttaatttctccaaaatccttctttattcgtgtgtgatttttagatcctatgtttcaaagtgtcctacaagattgtagaccaaattggcataatcagataaattctgattcactcgcaacttcaggaagaaccacaatgctgattcaaggctctgaaaatcatagttgctcacgtgcactccgctgaactatgataatgatctgatgttgtgcatctcgcagcattattgctcacccacatcacatagacctttgacacatattgatattgtattgctctgcgccccatcgatcattactccaatagaacatattctcgtgaacatactagccgactaaggctcaaacataataatcaataagcattagccaggatcccaagataagtgccgtttcttaatgaaacatttgcatgtgcactcttaccagcctatagcacaatctcgcagatatgttccatggaacataggaaaatatacagtgaaaagtgaaaaccagaacttaggtttaaactcgtgtaaactccatttaaaaattcatctaatttcaccaaaagtaatcacacatgtagataattaagatgatgttagagaaaatcctgtccaaacactaaactctccacttcttaataaaactcatagagatcggcactataggtctcaaaacagttaagactaacacctatagtgtttgttcctcctccgtaggctgaaaacacataaaaccaacacctttaaacaactataggtgccggttctaaagaaaaaccagcacctatagtactataggtgtcggtttttttaaaaaagggtacctataatttattataggtgtcggttataggttttagttttctaaaaaaacggtacctataccgagctgagccagtgagccgatcaagcgccggccttatccatcgtatgcatgcctcccatccttatcttatcccttaatttgcaccccccccccctctccctctctctctcgctgtctctgattcaccgtctgtctctcgctctctttgtctctctcgctctctctatctctctctcacctctctctctctcccttgctctctctcgcttgtctcggcggcaatctggcggaggcagcaccggtggcgaccacgcccttccttctgctagatccggccagagggga

SEQ ID NO: 66803 - DNA, 2460 bp, Oryza sativa
tgtttgatctttgttgggatgaagtgcggttgctcgatggatcgtctcgagccgatgcagcgagctattttttttgttcgtgtagcctcaaaggtaccggttcctaaaccggcgtctttgaggacacctcaaaggtgctgactaataggtgctggttgggaaaccggcacctatagcccttttttagtagtggtatgtcacgtataaaaatactaaattttgaacaattatttttatatctcacaaatgaaatcgagtaatttggacaatatttttcacaacaaacatctcatctttatatgcaattaatttgtttggtgaatttaaatgactttttcgttggggttcacatgagtttccatctatttaaattgagtatccaccacatatttaccactttttctaaatgtctcggcacctatatctcctcttaactttacaatgtaatactcaagccctatttctctttaaccgtctcttgcaagaattagctctatgtaaactatgaactaaaataattaatgatcattgaaattggactcaaccattaaacatgcctccatgtttccttggattatttgggaccagactacataacgtggaaatggggggagtacctagctcgttctgacgacgcttggatctaccgctctatgtgacactgaggtggtctcccttgaagtgcttgtgctggactgctggctgggtacaatgcatccacgcaaaactctcctattttgcatccacgaaaaactctcctataaagttagaaaattttgataacatagattaatacgtgatatgatatgtcaccctcataaatatgagcaagttcacatttattaacttctacgtgttgaaaaaaaaaaacagggcgagtgcacgtataattagagtttattttttttctacaacttgttgcgatcgaaattgaacttgtatggttgtgaatgtttcccaagttacaaatcacatgttaatttatcttattatgttagaaaaatcatagctcttcgtattcccctcgaacgattagaatcggtgtcctgacccatgcatgcatggttcagcgaagctgcgggaggacacagagaggcatttgctggacggcaagctcagggtggcggtcgcatccaaggccagttaacccggtgattattactaatataataacgaacttggcactaatctaatcagaaacggcaactgggttgagctatagctagctagctagcgagcagagttaacccaacttgcacgattagacccccagcatccccgaccgagaccacgtgaagtttcccgttgcaaactaacacatgcggtacgctatgtacacgagtaggggtagtgtggcaatattgttcttatcaagcctgacagtctgacaccgccgagttaaaaaaaacgcgaggaagatgacaacgcttggaacatgggtcttctgtatcctcttgtataatttagccggtctccgatccggtctctccaagcagatcatctcatagccgcctataaaacgtgtacacaaactccgaattaatcgatcaatcaatcagtgagccacaaacgcctataagctgtagctgaaatcttgatctgtgtagctccatggagtcggccatgaggaggaagatggccgtggtggtgatgtcggtgttgatgatggcggcggcggcggcggcgaactacgcggcggagccggaggaggactgcgcgacgcagacgacctacttcaccaactgcctgaggcgcgggatcagggaaggctgctgcggggtggtgaagaaccactggtgcctgtgccaggtgaagcgggaggcggaggtgaaatgcatccccgggcgccgctgcgacgtgcccaaggccctcaagatcgccgacatggacctcccctgcatgagaaacctcaggtgcagcaagcacgcctgatataaccaaatctgctacgctatatccaacttaattagatgcctactgcctccaagttatgttactctgtttgttactgcatcctatgttttttttctagatgattttgttgaagcaatcaatcccaacctgatgtatactgctcattgtcctatatattattattatggtcggctccggatctcatattcacgatatattctaaatttgtattatttaattatagtggtttagaattttaaattttatttaaaaaataatgatttatccaaatgttatcgacgaaatcgtagatctagatcaagaatttatggggctagaaatagccagctacaaataatcttggatcagttgtacaaaagagagcctcaatcgatcagttaaaaggagctaaccacagaccttaaccttcatggtgtattatatttgcttttccaaatccaatttaaatacccaggcaacgattgaagataactcacaacccctctagaactggaaagctagtggatgaagcagccgcagagtgat

SEQ ID NO: 66804 - DNA, 9899 bp, Oryza sativa
ctgtcactataaaaaatcattttttttcaacgcccgctctatctagacctgtttagatgggatatcacatcagatgtttggatactaattataaatattaagtatagactattaataaaacccatactataaccctggactaattcgcgagacaaatctattgagcctaattaatccatgattagcttatgtgatgctacaataaacatgtgctaattatggattaattagtcttaaaaaatttgtcacgcgaattagctctcatctatgtaattagttttataagtagtttatgtttaatactccaaattcatccgatatgacagggactaaagtttagtccctggatccaaacacccccttagtcacaggcgagctaagagcaggtacattagcaggctataagccagctataaacatatttttaaagagataaagaaaaagagagaagagcagcggactatagatttatagctagctgtagcacggactccaagacgtaatgtgtgtatgacaggtgggaccaggtattaatagtatattaagcaactattgtatgaattggctattacattggatatagatgatttgtagatagtagttgactatactattaaactaaataacatcggtaaataaaaggatttgggtgatgtttagttaaggattgtttgtgaaaatctatttttatagatgtacgctttaagcgagaatcctaattcgcgcgcacgcccggcctacacagcccagcacgcgcgcgcccgaatctttttttcgcgctgtttcttctcttttcttttttcactttctctttttttctttaatttttttccttttccttttttcaaatctggacttgaaagtttttaaatctcgagttgaaaattttcaaaattcaagttgaaagttttcaaatctcaagttgaaagtttcaaaaaaaatttaaatctgtacttgaaagttttcgaatctgagttgaaagttttcaaatctgagttgaaagtttttaaatatttcaaatctggacttgaaagttttcgaatctcgagttgaaagtttttaaatctcgagttgaaaattttcaaatctcaagttgaaagttttctattttttcaaatctggacttgaaagttttcgaatctcgagttgaaagttttcgaatctgagttaacagttttcaaatcttgagtcgaaagttttcaaatccgagtcaaaagttttcaaaatttgactttaaaatttaaatcttaaatcaaaagttttcaaatctgacttaaaaaaatttcaatctgttagtaaaaaattcttaagaatcttccataattacccatcattagtgttaagtgttaactaatatagagtagttatagagagggaagggaaggagatgtgctcgctgctggcacacacatgccagctagcaggccccgctttaagatacccatctgcgaaaatagcatatttttaggctggtttaatttcaggctgcctgaccaggcaacattggttgccttctcggatgctatatattcacgcatacaaatttctaaggcagggtgctcatggctccaaccaaacaggctcttcatccaggatattaagaagccaagatatcccatttgccgctggaggcggtgatctcaagtccagtattgggtttttattgcttcataaaaggaaaaagtacaccgaaggtccctcaacttgtcatcgagttacaaaatcatctcttaaccacaaaaccagatatatgacatccctcaacttataataccattcactttaaatttttaggtggctttgaccctggttttggttttatctgatgtggcggcttaatcagcgtgggtcccacaagtcagggcgtccacgacagccccctctctatccctttttctctcccttcgttctctctctcaccactgctggtcagcgggcggggagaacgccgacgggagaggagggcgtcggcggccgcgagcgcgcagcggacgagagctgcagcgagcgggcgggcggcggagcggagcggcggtggcaggcgagcgagcggtcgtccgacggggagctgctccggtcgctgcaccgcctggcacgcgacctgtccgccgtcgacacacccgcgccgttcctgcgcgccttgttcgcgtccatctcgaggcggtcgaagctactggcggccgcgttggatgacctgcggggcgccgccgaggagttgccgcagcccgcaggtttatctttcctttctggtctgtgttttcatgttcccttctatgttcaatttgattcttttttgggactgtctaacaatcattcgacagattttctttagaaaatcagtcgaattttcaagccatcaccatgtgctgctcaaatgaaaacgtatcaatgtacgtcagtcactggacattaatcacgtcagtgatgctgctaaaaagaaaaggaaaaacaagcaacttacatcaacttacgcatgtaatttttggggttacatatgtaattttgaaacttacgctataaatatattaaaattacatatgtaattttaaaacttacagcgtaaatatattaaaattacatatgtaattttgaagatttacgatgtaaatacgtaccgattatttttttatgaaaaatatgacggcatatatatagtccgaaaatatcaaatcacacctcaaacaattaggttaactacagtacaacaaaacaaccatgagtaaaaaaattaccatccatgtaaaacaaaaattacacctgtatctattaaaaattacactgtaaatgtagtgtacttaactatgaaactgcggtgaaagttttaaaaacgttaggtatagcagcaaagtaatcagtcgcttcttgcacagttggtacgatgcacgtcatgttatcccgacatcatgtggttgattccctgctctagcggcattttttttttcactcgaaggcacgcgcacaaatctcaaagtaaatcatacggtgaagaaatcgacagatttttaactgtcgacagatatacagcaattccgttttggttttcatggatcgatggtatatggtattatgtttttttttcctgtgttttgaatcgtcctctcttgctcctgttaaggttggggaaccaatatctccatggtgtcaccatctttgcaagaaggggatagatcgacgcgtcaagaaatcgtttctgttgccatggctcgagtaagcaatacgattgttgcttgcgtacaattttttctttttgcggggtgcgtacaattttttcttgatgcagactagtttcttttcttgtaccctgttttaaaaaaatctcactcctctgtttatatctgttctgttcatgcaccgtgctaaccccgggcttgtcggactggaatcctttgaagaatgaagccccaatgaggcaatgactgtgctagatccaccatgccattcagtgttgcaggtcatgatgctttgagctcgtgattgtgtctgtgtcagcgtaatggatacattcagctatcatatttcctctaaaatattcgtgttttcgttcattggatttactttgttagatttggcggtttggcaatgatgatacaaactttcagcttaccatgccagttctgcttctgagaattcatgacagataaagctgatatagatctgaactgaatgttttcttttgcattatgagtgtgcggcgccgccggggagctgatatagatatcgaggctgtgcggcgccgccgggagttgccgcggttggcgtcgctatgcctgcgggaggtgctcctggtgctgcagcggttcaacgccatcgtcgccgattgctcggtgcgaagccggatgtggctgctgctggagtcggacgagatggaggcggagctgcgggagctcaaccacgacctggccacgctgctcgacctcttgccggtcgtcgagctgggcgccttggcctcgccgacgacatgctcgacgtcctctccctcgtgtcgcgccagtgctggcggtgctcgccggcaccggaggcggtgcaggcgctgaacgcgagcgtgctgtcgctgatacaagaaatcgagcccccggcaccgccgtcggatttccggtgcccaatctctctcgatctaatgcgcgaccccatcgtcgtcgcaagcggccagacgtacgatcgcgactcgagcggccggtggagtggagcggagcggcggcggcatccagcgacgcccagggaaaaatgagagaggaagagagagaagaggggaaagggagaatgtgtgctgacgtggcattctgacatgtgggtctcacatgggtcccacgctgactcagcctccacgtaggacaaaaccggggtcaaatccacccaaggatctattgtgaccggttttaattagttaagggaatatcatatatctggttttacggttggggacgattttgtaacttgatgacaagttgagggaccttcggtgtactttatccttcataaaatctttttgaataagttcacattgactcccttaactagcggtcgaatttaattcatatccttgaaccacaatattactggatatatccaccgtcaactattaaaaccggtacaatttgatttcctcggtggttttggagggtggttttgccgacgtggtgcttacgtggcaatattgaccgagtcttcgttccatgtggtgttgaggtggcacttaggtggcattagaattaaaaaaatatgtgtaggccctatttatcattcacaaaaaaaaaggtgggacccacggacacgtgggctgtcacaccccgaagttttcctcccaagccaaaattgtaatttttataaatgaccctaagaaaataccggtgcaaatcaagagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaatacttttaattcctgggaaaatcctttttcctttttctttttctttttcctctctttttcctcctttttgtcaaatgggccgtcggcccatttctcctttcctccccctcctctctgctgggccggccgcaggccgaggcccagccaggccgcccgccgccctcctctctcggggtcgccgacaggtggggcccacctgtcgggtccttcccccacctcccgccgctcccggccgccgcgcccgcaaccgccgccttcggccatggtttccgatcgccgtggtccatctccctctctctaatccctctcttctccttccttagggcaccccgaagctcgtccgcccgccgacgtcgtcctcccgtggcttgccgtcaccgttcgccatcatcttcctccgcgccgggcaccctcggtgaggcaccccctcccctcttttcccctccctctccctcctagccgccgctttagcgccgccgcccgttagtcgtcgctttagcatcaccgcccttcggcgccgccttgcgccgccgtctccgccggcgttgccgtcgtcggcaacgcgcgtgcgcgtgcgcgcgccgtcgccgtgaccggtcggccggctttgtgccgagccgagcctagcctggccgccgccgcaccgtccgatcggccccgggccgatccgggccgtcgatcccgtatatcggcggtggatcacccgcgtggtcccggtccacggtagaccggccacccttgagtcgctgaccagtgggtcccgcgtgccgccgccccttcctctctctcccgggccgctgaccggtgggccccgcatgtcggcgccgcgccccaccttgatgacgtcagccctggaatatattgcgcaataaatgatttaaggtttttcttttatagtaataaagacagtgaatattctaaaattcataactaattcatccgagctccgtttaagcccattcaagtctcagtaaatcaagaaaaatgtgtagaatccattaaaaatggttttgttccctgttttagtagtcttatagcctgtttgcaatgtttgctttgtatgtcgctagattccgattcctctgacgctccggtgtacttcgagatagtcgccgaggttcctccagcagcagagcaaggcaagtcatgcttgtcacttgaacatgttaatcctatattgcaaatgccctattgttttctttcaaatattgcactgttttataacattactatgggatggttacctattgttacagccatgctttttggataccatgctcctttgttagcttggggttataacatgattagagtttggactaggaattgcttagccatgcttagttcaactagttcacatgggggaaaatcatattaatgtctagactgttggttctaatgataatgttggattagtaccaccgctctggtgttggttaaataaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagcttcctctagtcgacgcatccaggcaagggtgggcgtgatggagcggggtgggccctgcgacggcctctgtcgcttccggattcacttaggcacgagaggggactgcccgttgcccgctggggacgggggtgaaacctgagatgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcatcttagtgtaatcttttaatttggatagcttagtggatggttgggcctgtcgcaacgtgggttaacgttggacagcggatgattaatattaattcattattacaactgtttaaatctttcaatttctgtttataaatgctcgctttatgcaagtgaaccactttagctcttctttgatgattccctgcatcatacctctattccggtatgacttgctgagtacagtgggtagtactcagtcttgctctacttttcccaaccccagagttcgagttcgggtcagatgaaggtttctccgaggagtaggcttcgtccgtgccgtcgaggatgcctgtggagtggtgttcccgctgcagtttagtcaaggcttagctcctgttgtctttcttttcttccgctgcatttatgtaagacttttatgatgtttgtaagacgtggatctggatgtcaacattgtcgtttgtgtaccccggccggtcctggacggggattttaatacacattctgcttgaaattctattcgggaatttctgggcgtgacaagttggtatcagagccgaccttgaccgtaggacaagccaaacggaaaaaaaaacctaagagccctctgaatcctttctcattgcatatgttctttgcaattggatttattccgggaaaattgggatctgttcttgtggttcttgggaaaaatcttggtcgctcgtttaagtgagatttttcaaaacaagtcagtccagggttttagtaaaactattgggatttattcgtcagtcggttgggatttgatgggcgaaatgcattaggtcttagctcaggaacatgggttgcaaggtatttatgctttatttgttatcattagtatgtatctaatttctcattattttatcgttatgtgagtctgtcttatttattcgctctcatgcaaaatgatctatgcataaaatttcgctcttattcgattcccttatttgagtctttattgctttgtttaaatttggatttgagcatgcattgatcctactccttttgtcttctctagatggccggtcacccacccaaccaccgcggagaaggcatgatcgactttgtggcagagttggcacgcatgacactggtggtaggctaccccaacgcgccagagtacacgacgattccaccgctcagtggcgagcttcctcaccgtgttcgcttggaggtccacggctacgtgggtacttgcctagctaacatggtggtcgaggcagctggaggcacagcagatcacgcctgtcaggaggcagcatacctgatgatggccagactacgagagcgccacaactacatcttccacgacacggcataccggtttcaccctcgtcgagccagcaatgatgatgtcagttccttccgtccgacagctggcgagaacgacaccacctttggtcacatgtgtgctgtgatgaggggattggacaggatgcactcggacctgcacaaggcgaccaaggccttgaacgatgggaagctcatgaggatcgtcgctctgaaggacgagataacgcgcctgaagagggagaacgcccagttaaagggtcttcccgcgccaggaggagtctggatccgcactacgccccgcaagactacgacggcacccgtgcgcatccagcttgcgcccaggaacccacctccatcagcagctcccgcagcacctccagttccacccacagttcctgcagctccagctccagctcccgcgtccgctctctccttcgctccagcatcagccgccagaggtccagccagtggcaccggaggttggttgtctgctactcccagtggcagccgcgatctcagcagcagcagctccagtggctcagagtcaggcagcagcgagacttatctgccaggctccaggagtcgctcagagggacctggtgacgagcaggaggacgccttcgactccaccgaccgcagaagccgttccgagcattaggctcgttttttcccattagtttatcgactgtctagcttctgcttgttagtttgtgtgtttaggttgtttgtttggggtcagtcgacggtcgatatcatgtgcctatgatatggctgtcttaataaggatttttgcttgctttttaagtgttttaattcagatcagaacaattgcagttaatttcttatgtaataaagcttagtttctgagcatctgtttttcttcttttccccgtctgcttttccctccagatggtctacaccaggaatggtagccgcgcaacaggcgagggcagcaacggcgaagagcgcactgatggggcgcacccccacagcgattctggcaatggtccgccaccacttcccgagaatccgacccttgcccaagttatggcacatcagactcagatgatggcagccatgatgcagcagatgcagcagcagcaccagcagatgcaccagaggatgatgcagcacgtcgaacagcagcaccagcactttggtccccctccccctcagtccaagttgcctgagttcttacgtgtcaggccacccaccttctccagcaccaccaaccctatggaggcgaatgactggctccatgcaatagagaagaagctgaatctcctgcagtgcaatgatcaggagaaggtcgcttttgccacacaccagcttcaaggtcctgcgtcggcttggtgggacaaccacatggccacccgcccaccgggtactgaagtcacatgggcagagttctgccgtagcttcaggaaggcacaagtgccagatggggtcgtggcacaaaagaagagggaatttcgcgcactccatcagggcaacaggactgtgacagagtacctccacgagttcaatcgcctcacgcgatatgcaccagaggatgtccgtaccgacgccgagaaacaaggagaaggtcatggcgggtctggatgacgagctgaccaaccaactgatatctggggact

SEQ ID NO: 66805 - DNA, 2654 bp, Oryza sativa
tcaccagaggccgcgcttcactcccggacagcagggtggacctaccaccatgatcgtccgccagtaccgcccgttcaatcctagcaactttccccagggctctagtggcagtcagaaccaccatggaggtcaatccaaccgcggtgcagctccacgcccaccaatggcaccggcacagtcaggcccgtccgcgcaagctaagaaggagactggggcaaaaccagggtcctgcttcaactgtggcgagcttggccacttcgctgacaaatgcccgaagcctaggcgtgccgggccaaggtttatccaggctcgtgtcaaccacgcatctgcggaggaggcacaagcagcaccagaggtcgtactgggtacgttccctgttaactcgatccctgcaatagtactttttgattctggtgcgacgcattctttcatttcaaagaaatttgtcgggatgcatgggttaataagagagaaacttagcacaccgatgcgggttcataccccagggaatagctccacttcggttcaattcagcccttctataacaatagaaattcaaagatcaccatttctagccaacctcattcttctcgaatccaaagatctagatgtcattcttgggatggattggctgaccaagttcaagggagtcatcgattgtgcgaatcgcacagtcaccttgaccaacgagaaggggaaaacggtagtgtacaaatcaccagactcaccaaagcaaggagtctccttgaatcagattgaagcggaaatcccagtggacaccgtggagaagaatttgaggaaattggaagacatacccatagtctccgagtacccagaagtgttccccgaagacctcactaccatgccacccaagagagagattgaattccggattgacttggcaccgggaaccgctccaatttacaagagaccgtacagaatggcggccaacgaattagccgaggtcaagaagcaggttgatgagcagctgcagaaagggtacattcgaccaagtacttcaccgtggggtgctccggtcatttttgtggagaaaaaggataagacgaagaggatgtgcgttgattatcgtgcactcaacgaggtcacaatcaagaacaaatatcccttgccgcgaatcgacgatttatttgatcaactgaaaggagctaaagtgttttctaagatagacctgcgatcaggctaccaccagttgagaattcgggaagaggatattccgaagacggccttcaccactcggtacgggctatatgagtgcacggttatgtccttcggacttaccaacgcacccgcattcttcatgaatctgatgaacaaagtgttcatggaatttctggacaagtttgttgtggtgttcatcgacgacattcttatctattcaaagtccgaagaagagcatgaacaacatctccgtctggtactcgagaagttgaaggagcaccagctatacgccaagttcagcaagtgtgacttctggatgacggaagtcaaatttctgggtcatgtcattacagctcagggtgtggcagtcgacccatcgaacgtagagtcagtcaccaagtggaccccaccgaagaccgtgtcacagattcgaagttttctaggactggcaggttattaccgccgattcatcgaaaacttctccagaatcgcccgacccatgactcagttgcttaagaaagatgagaagtttaaatggacagctgagtgcgataagagtttcgaggagctcaagaagaaattagtatccgcactagttttgattctgcctgaccagatgaaagacttccaagtctattgcgatgcatcccgtcacggacttggatgtgtcctaatgcaagagggcagagtggttgcgtatgcctcgcggcagttgcgtccacacgaaggaaattatccaactcatgacttggaattggcagcagtggttcatgctttgaagatctagaggcactatctgattggcaaccgctgcgaagtatatacggaccataagagtctgaaatacatcttcacccaaccggacctaaatctccgacaacgaagatggttggaactaatcaaagactatgacatgagtattcactaccacccgggtaaagccaatgtggtggcagacgcattaagccggaaaagttactgcactgccctatgcatcgagggcatgtgtgaggaattgcggcaggagtttgagcatctcaacgtgggagttgttgaacatgggttcgtagccgctctggaggcacggcctacgctcgtggatcaagtcagagcagctcaagtaaatgattctgaaatagcagagctgaaaaagaacatgagagtcggaaaagcccgggattttcacgaagatgagcatggcacaatctggttgggagaaagattgtgtgtacctgacgacaaggaactgaaggatctgatactcaccgaggctcatcagacccagtactccattcatccaggcagcaccaaaatgtatcaagacctcaaagaaaagttttggtgggtcagcatgaggagagaaatagctgaattcgtcgcactctgcgatgtttgccaacgagtgaaggcagagcaccaaagaccagcaggtttactccaacctcttcaaatcccggaatggaaatgggaggaga

SEQ ID NO: 66806 - DNA, 2028 bp, Oryza sativa
aaaggagtgatatcctcatcagtgtatgcatattaatacatctttcaattctatgaaaataactgtggaaagtgaaaatatcaagttgcttaggttttactaggctagccacgttctagcaggcatactttccttcttgtacattttttcattaatacttcttagaaatctttatttttcaaatcaagctatcaaccttctaatatttgtaatgtattgatttatgccctcaaataatgcttattaattaacttaatttcatctatcatgactcctaatcagtggcggaggaaaaaaaatgaggtgtggcggtgtcgctggtgtggccgcagagaaaggaaaaaaacaatctcaatgcactatattatatgacgcaacattgtcccatcatgacgcaatctcaaacatgacaacaaacactagtcataagttcataaatcatccatttgccaaaagtgtaaataaaagaggcactgaaaaatacctcaagattccagctgtcagctcctcctcctcctcctcctcctcctcctccatctctactgcagcatttccgcttgcatgagtacttgcgcttgcagagccccggttccaaactcttcaaatctgcaaaacaaattacacaaatgcaattttagtatcaaatttgtatacatcaaagttcaaaccaacaaaaataatgttctgaaattgtcaaaatttgaagaatatgtacctctttgtgaaactgtcaaatctgaaattgtcaaactgttgattgcactcctcggttgctcacagctcacttgctcttcttgctgcctgccccgcgcctgcctgcctggccagccgctgcgcctctgctccacgccgctgcctcgcggcgccgcggcgccttgccgatcgctgctacctcgtgccgccgctccacacgaccgagccccaccctgccgccctgcgctgcggccccgagcctcaccccgtcgccgttggccatagtccgcactcctcagcgccgcaccgccgccgctcgcctgttcgatggggattggggagatggattggggaattggggaattggggaaattcgtgatagggtttcatcattcatggtcaaaaggtccatttacacaaaaacaagaccaatgggcctaattggttggcctggttcgctctctcgcgccgcgttcttgctctccctctctcgatcgtgttggtgcggcgtactgggaactgggaaggaggacgagccagggggagggggggaggtcgcgggaggatcaaggtatggcgagtgtcacacctcaccatacaagtcctccgcccctgctcctaatgcttacccgtgaagtttcatctatcatcactcctaatgcttacccttgaaagccccgcttgggattttccttgttgtgtcatttttttctagatttttaaaataaagttaagagcaggcactcacacacgcacaatcatccttacgaatgcacgcacaccccacctttacaagcactttcagaagactggctcggtatatcttgagatcgacgaaatcgtcatgaatggcttgttgtcaatcgtcatggatggggttgaggacgatggcggcggcggctcccgagtccttctgccgcggaaggggtcgaggacgatggcggctcccgagccctcccactgaggacgggagaaggtcgacgacaacggcagatctcgaaccctcctgccatggatggggtcacagacaatgatgatggctcctgagccctcccgctgagaatgggaggaggtcgacgacggcaacggtgactgtggtggctcccaagccctcccaccacggaggtgatcgatgacagtggcagcgatagtgatggaggatgatgagcgtcggagagagagcgagactggggagagagaggggtaggggaaagagaaggaaggggagggaggtgaaaaaaatggaactggcaactaggttccacgtgtagttagggctaatggagatttttgataaatattgtgacggagtgacatgtttcaatttccctaaat

SEQ ID NO: 66807 - DNA, 4658 bp, Oryza sativa
atggtcttgtagcaccatgtggtcatgcatatgtttgcaggagcggaggcatgcatgcaggcctaacatagctagtgctaaagtccttacgcttacctgttttagagtttaaacccctttaaatcatcatatgatatttggattaatgatctaaacatcatctctataacaaagcaaatacaaaaggcaggtttttttttatctcatggccgcacggaatcgtggagatgtccattaaactcataaattattaagtgtattggttatttggctacaaaagtgtgtcactacaaattagtcgccggctctctttttacataattgatagaaattcgatctttatatttataagtggatatatacaggtaaaagtttcacggctgcatatactcatatctcatgactgagatacatacaaatacaaacaaatcaaaaataaaatattagaagtctacctacaagattgttctcatcgctttcaactggaaggatagccctctccatgccgtctcactaccattgcagcaatcaaaagcttccccatttcgtcatgagcaaatacgaaggctagaactagtccgcctaattgttggctctcttatctcttcatctattttcattccacgtaagattatactaatatcaactaacttgtagctagtctatttattgactacttcctcgtttcacaatacaagactttcgactttgaataaattcatacatcaatccaaatatatgccttatatacgtgttaaagtttatatagatattagtgtatctaaccgagggatggagaagctataatatcttataacgtgaaacaagcatagtatcggagtatatcttattggccctgctgctaacaattagccgatcattgtcatcttattgccctgcttatttccaatagtcaatttgatccctaaaatgatgatgggtgggattgcctttctcgaatcctgttccaccacaggatcgaagagatctcagatcgccggtgcttccacggagaagacgaacaagcgccattgtccagatccctatggccgaactacccgtggattgtccagatccccatggccgaagcaccccgtggggcccacctgtcggaacccgccaagcgaaacacaccctcttctcttcgtcaagctggatcgcaacgcaagggcccgcgtcctcttccctttccagccaaaccgacgccgatgctgttccactgcagggcgggccccaccacctctttccgagccatgggtccacccgtcagtcacccaagaaaaaaactaattgctattgtgggtggggtccaccccctccacgtccacgtgggccacgcggcatccgggcccactttcagtgagcgaggggctcccttcttcttaacaccggaggagagatccttcccggccgtctcctccttcccctctccgctcgcctccgcgattcccttcccatttcgccgccgatgaagggcggcgggggcgcggcggcggcgtcggcggcgccgggggactacgtctacttcaagtccgtcgtcccgctccacaagatctcggtaagcaattttgcacggtggaggagctccccccctctctcgcgtgcgcctcgctagtgctgctggcggcgtggatttcggtcctcggcggtggaatttggtgcggttggttgtggggattgtggttgaggagggttcccatgcgggtttttggggttgattttgcggggaggatttagcatgcgggatctacgggatcacaatgtctgggttggatggataacggggtccaagtatgtgtatggtttagttctagttttagggagggaggaaatgggtttaggttgattggcatttccccgttctggatgatggcatttggtgcggtttttgtctagatcatgatcatcaattcgtcatgatcatgagtaattcgggcagcatcttttgctccgttggatgagatgccgacaatgattcgaagctccgatgtttatgtcgtcatttctctccagtgccttgattcatagtatctggttatgatcctctcttttttttagagagataaagagcgttaagctttagtattccttagttactttgccttaaatttcttaaaatctcgtcaactccaccgtctagcaagtgaacaaatcaagttatctagtagcaattaggggttggtttggttagatgtaacctgctgactaaatttggtacctatgggagttatccgtatatattttttatctttgccttcttgagtgtcatatgcagtgtgtcttggtgattctgtgcagaattgacactagtaatgtgatctgaattgcgatgtatgatgggattggcttatggtgtcccagagtccccatgtttttattgatcttcttttttcctgcaatttctttctttttttttattgcttttaccttgctattgaaatatgtgtgcttgactgcttgcttttcgctatgcataatagaatatcttagattaagctattttgctttgtctacttaacttattcatcgattataacagcagatatgcatattgcatcattctctgcttacgagtttcctcaatctgtacaaagtgaactgtaggatgtacaaattttgaatgtgaatatgcgttacatgccaacttcttctcaactttgtattattataatgtgtgatggatgccattctaataaaaaccaagctgctttcttcaattctttgcatgaatttctcaattttattcatatggttgaccagtttctctgctttgttcttcaacatggcagaattataatttgtgatgtatccctttttgaagaaaataaatttgctgccttcatttttttaagaactaattttttaatcattacatacgattggctagattctaatctgtttccttattggaggttttgtagattggaccgaaattatggaggtactatgattttggaccaaagactgttccacctcttgtctgcatcccaggaattgcaggaacggctgatgtgtactacaaacagatcatgtctctctctatgaaggttcctagtatctgctttgagactatttttttcatacctgatctggttttggttttcagtttcatgcatacctacaaacatataccgatatgtttattatttgcatttgtagtcttgtagtgctaagttttttttaaaaaaaaaactacaaaaaagtcatggtcaagtgttctgtacttggtccttggacctgttctcaatcattctaccaaacaataatttcgctctcaacataaacagtttttatcttgaactactaaaatttgaagtatcaatgaagatctgaagtaatttggaaatattagtacatgatgcatagtaagactgttaatatgatcaagaatccttgtattcttggtgcagctttagtacctttggatgtattcatctttaggttatatttagtgtgtcagttttgaatacgaacatctccatctacttgtaattaatttgaatgccactcatatatttctgaaaccttgttgatctctgttctataggcaattagttaatcgcaatttactacacccttcatttctcacttctctttcagggttatcgagtgatgtcaattgatgttcctcaagtttggaatcaccaggaatggattcattcatttgaaaaatttttggactccatgaatatccatcatgtaaggaagtcttcccttccttctgcatttcttttatgcattgcagtcttagaactgtccaaccattcatattttaagccatgtattcttcatttccactcttcttgtgcctcttgcaacctataaggctgtgttcgttttgttgttttgggggggggggacccttctccccagcacgcaaaacggagtggtggattagcgcatgattaattaatttttaactcaaaaacttggaaaatagattaatatgatttttttaaaagcaacgttcctatataaagtttttgtaaaaaatacaccgtttagtagtttaggaagcgtgcgcatggaaaacaagggaaatagaaattgggaaagtgtagtgtagaacgcagcaaagtatgtactccctctattccattatataagacacaaccacttttcttagatgtttcataatataaggcatgcatgcaagcatgaaattaactattacatcttctccattaaattattacttttttaaatactccattctcatgttatctaatcctattggatgcatgcattatatttattaggatgattcaaactagaagatgataataattatttcttggtctttgggttaagggtggttgtgccttatattttggaatggagggagtatacaggattgtcatagcagtgagaatataaatatgctatagtcagctctgaacaatgtgaaatcaatttgatgttacctactacttcgtgaaagactgcttttgcttattctttctgcaattcccagtttgcatgattcacttctttattaaggagtctatagtagagtgtgttagtttgttccttgtatgtcagcagaagtttttgtttcatttcgttgagttttgagttatttagtactaatttatttattttttcattggagaaaacaggttcatatttatggtacatctcttggtggatttcttgca

SEQ ID NO: 66808 - DNA, 1767 bp, Oryza sativa
agcggtacctattgacaggaatccgagatggcccccatgaaccgtttattgcagactcagtggattttgttgtgagtcaggtcaggatcaactgtaaacattttatttgatgtttgaactaatttcatacatgttataaatatgagcattcaaactttatctgaaattgtaatgttaggtattgctagttagatgactactctgtgcttgacaacgcattgttactcagtgttgctcttctattttactgggcttgttattgttgttaacaaattaaaatctaaattttgcatgccaggttgagacgctgtcaagagatgatctctcatcaaggttgatgttaaatgttaatgttgcatcagttggatcattaatgctacctgattcactcatcactataatggatgtaagttacctcgacccaaataatacaagtgattctcatgtgtttctgtttatatagggtttatttattattattttccattctattgattggctgcaccagttaagagataatctaaggctagcatggtattaagaaggaatgattcttaatcagtatgtcatgtgtaggtatgctgggagataagcatgctaaatttttgtaccttagaagttacaatcaagtatgaagttgaaatcatcagaaaagggtgcccaagggttcccattatcagagaccttgagcatcccagtgtcccttgaatgctaactgtgtgtgttgaacatatttgcacagacaaacgactattccgctgttcctcagcagttaaaggaccaagtgaatgaaaggtacccaggtgcaaggcgtgcagtactaaagacgggtggtgatttccccttcctgtcacgtcctgatgaggttaatttgtaccttcaggtattgtaaacgcttcttctgcaatctttcagttttgaaggatttatgaatgacaattttgaaaacaatggcagctacatttgagacgagttggagtagaacctagaccagatctggtccaaggtttcacacgtaatggcagtgctgggagctcaaaggaccaaaaagatggtggaaacaattttgacaatcatcctggagataatggtggccctggttcagggggtcatgatcatgagacacagaattctggatcagaatcacatgattctgatgaatcaataccaacgagcacaatgcttgccaataccattctaggtacggttagctcaaccctgcaagcttcactatgtgtgctcttgatacatcattactatgagtctgctttgtatatttcgtcgagacagccattggatgtatgaagtagggaatcaccccttttgcccccatgtagagctcgctttgtagaatatcatcgtggtacgagtgtcatagcttctttggagtgggttcttacttcgttgctgccaacgggaaaggcacatcaacaaccaggaaaacaacttctgtatgtttgtatattagctcttgtttctttatcaatccttctttttgtgtttctaggcctgtaaattgaatttgatctgcctgagacatgaatatgattgcttaattttcttgtagttgcaccataaaaagttgcgtacagtttcatgatttcatccaacttatttttcaccaattcatgattgttatgcctattattatatttgattgccatcaacatatctatcatgaacagatcgtgccaatcttcttgtggcaatttctgtacatggagggataatcagattcagttgaagtatctacctttgctatttctg

SEQ ID NO: 66809 - DNA, 4828 bp, Oryza sativa
tctctttttcttctcgtttcgttgggactactaggtgaggtagggcggatttcatagcctaccattttgatcctgaaggtgtttttccttcctccgtccattttccattgcactgtttgtaaaccaggtgaaattatttctatcttgatgcatgtccatagctaagatatgtgccgcttggttgcagtgcgccgtaccgaattgatattgaaatcttcaaaagcctcaccctttgttttttatttttattttttggccatcgtatgagtccccatgtatcaatcgttcaggaaaatcaacaatatatttcgtacctgtacactgtcagtttctaggattatttctgtactcctatttcttctgttagctggaaccagcatcttcgctagcgtagcatcgttgtgaagtacttcattccgttgattagtgcttaattaagaacttatagtacactggaggcaagtagaacagccgctccagtggcatatacagagtagttattgtataaccaatattgttctacttattagtctagtttcctctcatctctcacgaagtactgtcatcttaaagatataaattgtacgagcaataaggctaaagtcacatggctacagagaatatccatcttaaatctcatgtgtatcattttatcatacaaaattttccatagcaacaatcagggttacttgtacgaatgtacgattgtagtttcagatggggcttttgttattcatcatttgcctgaatttttctaatctagtaccatttttttttcacaacagctcacatcgcattgtgactcgtacaacttcaaaccatctttgtccccctacctgcggcgtcacacactgcacccaccactggcatcggccacctctcctcgtgtgctacctcccttcctcgccggtgtgcgaaactccaccgtctctgatagcttgtaccactaagatgccatcatcttccgcctcataaccaatgtatatctacactggtccgctgccctccttcattcttatggctttgacgccaccagcaacacaccacggcctatctatgtccatcgttcatggtcagtcttccaccaccccgcccatcactctaaagccaccatcaccgccttctgcctccatcccatcgtggccaaccctgaaaccctaatttgtattggagttcgtgggttgtaggcagaaagtttgtcgctgttatcactatcgttgtctacgtctatggtgagtcgtgttgaccaagagttatgaaaatataatgtggactaatcaatagtattccttccattttgaattacttatcgttataaatttctcctaagtcaaacattttaatctttggcatatagtttatctttataagatttacattattaaaaaaaaaggagatttggagggagagacgtccctctaaatattttaaagaagaaattatgagcatgttagagattgaacacgacacatcaggattgaaaccacataccacataccccttaccactgcactatcaacatctcataagatttacattattagattcactataagaaattttgatataattcacatgtaactaatggtcaaatatcaataagtttgactcgacggaataagagagatcaaatattgataagccattcccaattcgcccaaatcgtggcctttatgaacaatcctagcaatgcaagaaataatgacacattaatttgagtttttttcaattaaaaacgtatgtagttcactgatatggaaatgcattgaacttaaatgacacaattttttgttggagactagaagaacacgcacgccaagttaaagcagagacagcaagctcgtcacacgataatacttaagtcgaaccatgtagcttcgtccccgacgcctcctccggcgtcacctcgccgcggtgcccttccaccgccggcgccggcgccgccgccttgaacctcgcgtagatgtcccccctgtagaaccccctcgtcctccacaccagcaccagcgacacgatcacggcgaagaacgtcgccgccgtcacgatcaggaacgacgccctgaagcaccgcacgccggcgcacgccctgtgtccggcggcgccgccgccgccgttctgcctcgccgcctcggcgtcgtacagcgcgccggcgacgcgcacgttgaatatgtacgcgccgatggggctcgccaccatgcccaggttgtagagcgtggcgtagtacttgagcccgaacacctcggagacgatggagaagagcagcgtgtacagcccgccgaagctgaagccgacgacgacggacgccgcgtacaggccgtgcggcacgccgagcgcgatgaggaggtagccggcgctggagacgacgagcaccagcgtgagcatcagcggccgcggaaacctgtagcgcgacaggaggagctccgagagcgagccgacgccggcgcggccggcgtacatccagatgttgatgagcgaggcgaaggtgttcacgctcctcgccgggtaacccagcgactggctgatctgccccatgttgtcgatcgccgtcagcgagccgccggcgccgcagatgacgcacacgaacagcacaaccatgtccacgctcaacgccgcctgcgggatcgtgtagtcctccccgtgcgccggcgggttgaacgttcgcttcaggcacgagccgacgccgcatgtcgtcgccggtggtggtggtggtgtctcgacgacgggctgaggcggcggcgccgccgcggggagagtttcttggacatcggcctccctccggcttctgagctcctgtctgatgacgaccgcgagggggaggaggaggaggatgaggaggagcacgatggccgtcgcggcgtaggcggcgtgcgagaagctgatggttttctggagcacgatcatgacgaggaggtaggaggcgacggcgaaggagatgtagaggaaggagaagatggggccattgctgcctccgccgccgacgcggccgttcgtcggccggtgcggcatgacgcggacgacgcggaggaacacgagggagatggcggcggggagccaggcgatgagcagtatcagcgacccggcgtcgtggccgccgccgtagatggcgaggtagagctgcgggaggacggcgccgctgagcccggcgaaccccttgaggaggccgacgacgacgccgcggctctccgggaagctcttgacgcaggtgacgagcgcgccggtgttggcgaaggcctgcgagtcggcgccggcggagatgcaggcgcacatgagccagagcggcgggcgcgcgacgcggccggcgacggcgaggtagacgacgaggtagcccgcgaggctcatgcaggcgcccacggcgagcacggccgacggcggcgccacctcggcgacgaggccggagacgatgccggcgttggcgccgagctccttgaagaaggagagcgtgttgagcgtccgttggtcgtagcccagcgacgacttgagcgcgccggagtagatgctgaagatgttggtgccgcccgacgccgacatgatcaccatgcacgcgagcatcatgaaccaccgccccgtcaccacctgcttcgcgaacagcgccgccgccggcatcttccccagccgcggccacggtctcccgccgccgccggcgcccgcgccgaacaccatggcgcgcgacgcgacgcgacgcgcgcttacgtagctggcttgctctagctacgtactcgagcttgtcgcttgcagctgggatagcgtgagtgttgtacatgtatttatagagtgttgaaggaatacggtacgtacgtaacgtatctgaaattccacctgcataaattaggaaagtttattttcaaaataaaaattgcttcaagcttcttaaattagaagagtctaccacttcaaaaggaggggaaaaatacagagaaatgtgtgtattgctcgattataaattaaaattcgtgaaggtttctggttttaatgtaaaagactcaaccgtttgatacagctcctaggagaattaggagaatgaagcggagctgatgagtggtgagaatatccctccatcctcgtattgtaattttttagcaacggagcgatagcttcgttatatgttatctaagattttgaaagtgtttgatagagttatagctctatgggacaaaaacatcaaagtaaaagttgtatcaaacggtgttttgtttattctgaataaatatccgaaattcagagagagaatcttagtacaagcgatggatgcataaagaagtattgcatgagtagaatgagaggttggggagaataaatattgacatattctacctaaaagatagaaaatgaccatgtgtgacaacttagttagttatttgtacatcgtcaaggggttgaactccgtggctcattggtctttgcacgaactcgaccaccctagctcagccaccggtcctcactcctcgctcctcggttagtttgtgaagcaggggcaaaaaatttccagcgacactttcacaaaaatacattttagcattagaaaaaatattttgttgtccgcaccatactacctttaaaaaaaatcatttgatgctcaagatataaaactcttatccctccattcctttgtaactttttttttcacagaaaacttgttagtgcgccattcccaagtcctaacatgcgtttttttccaattttaccattaacggcacaaacaaagttttttttccttttttcccctaagactggagcgtttcccttgattggacaagtatcagtagctttttgctccatgtgcattttccaactagattgggagtactttaaaccaggagcatttagccat

SEQ ID NO: 66810 - DNA, 2116 bp, Oryza sativa
tttcataataaatttatcttgggttaaaaatgttactattttttctacaaacttggtcaaatttaaagcagtttgattttgaccaaagtcgaaacgtcttataacttgaaacggagggactacatttttgttttatgcttggccctttcttcatcgccgatctttttttctctatagcttgcaagtattttcgcattaaacttaaccactgtcaaaaaaaattagaaatgtttattgttggatggagccacggagggagtatatacgaacggaggaagtagagtttttttaaagcatgggttgtacacatttacattaattaaaaaaacatttagtcaactcatgagactgaaatcagagtattaattaagatgtgtccgctgtgtgtaaactactatcttaggtgatgcagtttcattttttagggaaaaaaaaacggtacacttaaatcgtgagatgctgaaaccctctatttcataaatgaactacttgtcactgtccaaagttcaaacttttacaagaattattttttctagaaatacggtataaacgcagatgctcacaatacgcgtattatcgtccctatgaacacgcatatatgcacacgtttttctcctatgtgcatctcttttctcctatatgcatctctgaaaaactaggccgatatatattaatatcgacaaggtcaccacgagcgacgcaacatattttaagatcgataaagtcaccgctaatgacacgatatatcttaaaattgacgaagtaactacgagcgacacgacgtatcttaagtttgacgaagtcaccacgaacggctcgctgtcgaagggtacgtcacctaccataaaaataaatagctataaatgtaaggtagcacacgtgtcaagtttagaatttaaactcaggtggtggtatcataaaaaactagttaaacctaactagttgagctatatctcattttgcttttacgagaaaattatgcataaaatttatttgtttgcagggaatgtgtaagtgtcatgtgtgcctctgttctgatcacgcgtacatctgttgttacgatgttatcacaggattatgctatcgaaatttcgttcaattttattaaggttcactcgtggcaatttttaatttttttatgcaatcaggatgtgctccatcggctcatgtccatcctaatcagggctctctgttacggtggctggggggttgctatcctagtgttgacaaaaatattaaaagaacagaaaaaaaggactattaaaccaatgattaggaccaatatgaacttagttaaattcatggcatgtgggatacacaacatatatgttcccactagaattaatagtgatattccatttgtatgttggatggtagttacttttctaaagtcgaagtcaatttccacaacccaattggtctgagcaggaagtgacttatgtttaaggaagcaatagttttagtacagaactacaggcactaccatggaatattatggaacacttacataaactaggacagttatagtgcattattagtatagagaatttaggacatttcccttcaaataaaagaatttaggacatttccatttataaaacgaatttaggacatgtttagttgttgccgaaaaaagcttatcaggatttggtaatatggaactctgcaacagaaaatttagtgttgcaacgtagtttagtgttggcagtgatatctaacattgcttaattatatctactgttttattgtattcaaattatgatttataaatgatgctttttgtgcaaatattttatagcctttcctttgtgaatatcttgcatcataccttccttttggtatgacttattgagtacagtggttggtactcagttttactttatttttccccaccccagaagcagagaattgttcagatggtgagttctttgaggattaagcttgttccggacgttgaggatgcctgtggattatggaggaagctatgtgtttggtcgtgaagattaagtttatattatttgtttatttccactacgtttgtaagaattatttattattttttgtaagacgtggatctgtttatcaatttgttgtttgtatactctggctgatcatg

SEQ ID NO: 66811 - DNA, 2580 bp, Oryza sativa
gtagattacacatgttccctgagttcgatatccttttgcggtcacccgaaggtgaagtgctacagcggtattccgtgcgcttgcggatttatctgtggtcgtaagaaataccaacacatacaaaacggaaccgtggcggcaaaggggttggtagatacgacgaaccgcgaacggggggagtgaaccgggaatggttcacgaccaaaggagggagaggaaagaattattaattcaactcctgacattttaacttgacagtattacttcctctactctgtatattcctctgaacgtcctgttaatgatttaaagcaaagctaataccaaaaaaattctccctgaccattccaattattaaatgcattattaattagggtttcctcctagttaacagagttatatagttaacagagttatagatgattcaacaatgatttagaaactacgaaaaatggaaaaactccaggtgtgatagccgccaagtcaaccatagctagatgcacttgtgtgattatgatgaatataaagcaacaccggcttcgaccaacaggagtatggctattacctatcagataaggggcccgagcgtgtataaaaattcttgtctccatcttttttacttcaatctcgcatataccttggtaccgacaatctccatatcatgcaaataccatagtcgtgactaaaaagtcaacaattaggaaaaagtatagtccattttattccttgaatttcgctcgaaggttatttttcacccccgaaagttggttgtcacacccaaacttttaaaacaagataaaataacaccgtaaatcatatttcattgtagttttatttggtaaaatgaacttcaagctgttaattttcatggttgtgtaattaattaacatctacattaacaaaaatatgcataataagagtatgggatagaaaactgccgcatttcagataaaaacatcaggaatatgttataggatgtcactagtctttgataactgaggatgaaaaacaacctgcttgtattgaaaaactgaattttgaacaaagttcaaggcccaaaaaagggctttacccttgaaaaaaaaattacaataggaatagttagcatatttttttaacgatcctagaccagtggcttgctcctggtagctccctaccagttgagctatccactgtttctagtcagcatatttcatatgatatagaacatattttttagaaaaaagaaatataatctaggatgttatttattttattttgaaagttaaggatgaaaaataaccggtttgtaatttagggtgaaaaatatggactgtgaacaaaattcaacagtaaaaaatggcccaagaaaacatcaaagttacaatctgaaaaatcagaatattcatatgttataaaaataatttttaacaaattaatattacaatttgagtaggaaatttcggaaaaagcacaaaccaaaaacacacacagagacgaagaaatagccaatagctcactctttctcgaaagtgaaaactgaaaacccaaaagcccaaaaccctagctctggtgcccggctcggctaccccgtcgccaccgccgttcgtttcccaaattcacacaagccatggtgctaggcctctacgccttcgccgacatcgccgccgacggcgccccccacctcaactccgccgccggggaggagctcgtccgcgtcgagcgcgccgctgccgtcgccctcggctcccgcgcgccggagccccccgggaccctgttcatcaccaccaggtagtaaccgcgcttctcttcgttctccacttcccccaagtagttgcctctccattgcctctgacgcggcggagcgtgcgcgtgtgcttgtgtgttgagctaggagggtgatttgggtcagtgaggtggagaagggcaaggcctacgcggtggatttcctcgccgtctcgctccacgccgtctctcgcgatccggaggcgtactcctccccctgcatctacacgcaggtaatttctttcaactgtagtttgagatagcttggggggcgaacatttgtttgattttagagtattcacagggattggctgatcagctgtagggttttattagtgacatatttgagaaatttgtgcagcttgggtaatatataggatacattccctgtaattactactaatttagtgtttgaattagacttataatatggattggccatcatggtcatgttgttattcaattttatttcttaagttcgggtatctgtaattctgcattgttagcttttggttggggcttatggttcatgtgatgttagatatttttttattttgtttttttaatcaccagctattggtttcaacaaaacaaaaaaagaaaggaactaagtagctctaggaaagaaaaagcttgtgcgcttggagtttcaagtgcttcgggtccaactgagctacttctctttggagtttggaatatggcttggtcatgttttacacaatgtattgtctatagcacttatgaataatctttcatgataagttttatatattcattttattgcttatgtcgtgtatagtttctttggattacatt

SEQ ID NO: 66812 - DNA, 1813 bp, Oryza sativa
ttcagagtcaggaaaacgatgacgaagttcttgagcattttcccaagtgaccacatgcggatcatctacagaccaccgaaccagcaactgctccaccatcttggatcctttccgaatgaagcgacgatccagcacttgcgatggaacaactgacgtaccagcagtggactgaattctgggcaattgagaatacaccacctcacttggcaccaatgctttcttaagctgtgagacatggaccaccgggtgtataagactggtagctggtaaagccaatttgtaagccacttcaccaactcgagagagcacctgaaaaggaccataaaaacgaaaagccaacttgcgattagcacgagtgaccactgactgctgcacaaccggctgtaatttgagataaacccagtcgctgacaacaaatgttctttcagagcgatgttgatcagcctgaaatttcatacgagcttgagcacgcaacaaatgatcccgaatcaaactctgaatctgctccctttcatgtaaccagtcagctaactcagtcgactgacaagctgcatttgctgacaaaccaaaataccgtggcttatgtccatataatacttcaaatggagtggtccccaaggctgaatggaaggaagtattataccaatactccgctagagccagccatcgactccactgagaaggacaagcatgcacaaagcagcgaaggaaagtctcaagacattgattcacacgctccgtttgtccatcagtctgaggatgataagaagaactcaaccggagttgtgtaccagccaacttgaatagagtagcccacagggtgcttgtgaaaatcctatcacgatcagagatgagtgactaaggtaatccatgcaatttatgaataaactgcatataagcttcggccacatccatagctgtgaaagggtgagcaagaggaacaaaatggctatacttggaaaacttgtcgactacccccaggatacaattaaaggtagctgactttggtaagccttcaataaaatccaaagaaacaacttgccaagcatggtcaggtacaggcagtggttgcaacattcccggatacttgacatgttctgatttggcttgttgacaaacagagcaagcagtaacaaactgcataactgtagtgcgcaattgaggccaagcaaacagttgtttcaccctttggtaagtgacatgaatgcctgaatgacccccaactggtgcagtatgcaagttagccaaaatcttttgttgaactaaggtattgttacctatccacatccttttgagcaggtgtataacggtagggacgcacattgactggagtagctcctggcatgggtggaattgtatgatcaaaaaccctggacggtggtaatccagaaggttcttcaaacacctgtccaaattctgctagcacttgttgaatttccacaggaatttgctccttgtttgaagattctgacagagtgcacaactgaatcaggtgagagatggcctgtctatccttcaactccaaaaactgttgagaagagagttgagaacactgttcagtttctgacaaaattccctgtaatgtaatggattcctttctccaggaaactgtcaagagcttgttaacccaatcgacctgcataggactatgagccatcaaccagtccatgcctaaaatcatgtcataacttcccagatttaacacctttaagtcagtataaaacacccatccttgggtcatccattcacaccttggtactgaagtaagacaagtaagtatggaaccgtttgctactttcacttgtactggtgg

SEQ ID NO: 66813 - DNA, 2056 bp, Oryza sativa
attaaggaggtgacaatccttcgttaagttctcaaagaaaaaacaatccttcattaagctagcatttgtgggctaatagcaaccataataaaattagtacataatctttcataggctgctagcaaccatcaagaaagggtgcatccaggagcagtgccagagtctgctttcattgctactaataggagagaaggggttcaaccaccactaaccacatcaacaaaagagggcagggccacattgaggaagagaagtgcagcacccaagaagaaaaactctcccaagaaaaagaaacagtagtttatactatgcactcagttatgcatttagttttcgttcaagttattcactgaattttattcaggatctcagtttctgttcaaaatatgcactcagaagtttcattgtgttcagattttgtcacaatgtgtacaattaagcattacattccttgctgcttcagtggatttaatgttcatgcggttaatctgacggcacaatggcttaattccttgctgcttcaatgtctgcactgaagcattggagctaggcttcaaagttgctatatgaattgtcagtctgagataaccgatgttggcctaaagcaaggcactcatatgcctaccgcagcatcaaaataaactaaaacttgattactgttgcagccaccaccgccagacttgacctacccgttgcagcaaccgtcggactcgactcccccaacggcgtagctgtcgggctcgacctccccgctgctactgccaccaaactcgacccccacatcgctgcagccaccacgcgtggattcgacctccccggctccccgccgctatgaacacctctcagattcttttcaccgagaaattatacatgatctaaataccaaataatagaaggggttttctgataaaaaagggccattgcatatgagcagcagagcatgcaagtttgtcctccttacgtgaatacgtgaatgcttagttggcggtctactcatcatccaactcagcaaaattagttttgctattctatttagtcatagttcgcacgcacctatacaagtttgtgcatcaaaataaaagttttacaagtttttacactaaattgcacacacattacaagtttgtgtaccgtgagcgcaatttactctatatttaatatctatgaattagaggtgcaaatagatatcagtttccaaatccgattcgaagaaataatatgggataggatacgggatgagtgatatattattcggcactacctgtacccaactccgaatttaaaggaaaatatgggttaggatatgagaatgccataatccgaccctagccacccgtttctctattttttacttaaaaagtctggtggcggtgaagccagcactgacagacacacataatatggaccatccgattgccagatccaacggttcggatcgataagcagacgcacgtttctctccgcatctgcgcatctaatctcctccgcatcgggcggcacctctcgtcacaacgtaacccaccgccggctctctcccttccgcgaatccctccgctctccaccgtgccccgccgcaatacgcttcgtccccatgtagccaatccctcgcgcaatcactcgtcgtcaggtcgccgtcatctcgctccggaggcgccgctgcgcccccacgccgccgatccctcgccactaggtcaccgttgtgccgcgtcaccagtggcaccctcaggcaccgctgtctgatctccatcgacgaccaccacatctcgcctccgtctgcgctcctccagccggccgatcttgcctccatatgtgccgtcgcaaaggtctcttctgctataaataattttcatatttgctttccagcatgtggaattgacaggagttatatgtatataggatctagctaacgcttgagaagggaggatatcaagatcttgctggcgtaagaaaccgatgttgatgaacaggtcatgcttcactgcccaattctgctctatcattgaggattttgacacttttttacccacctcgacaccatatcctttccaaactacat

SEQ ID NO: 66814 - DNA, 2859 bp, Oryza sativa
gaatgatgaacttcagaacaattcagaaaacgatgaagttcagagctctttctcttactgagttactgtactgtgaacgatgtttcactagcagaaggttattcttgaatgctcttttgtattagctaatagcttcttaggtattattttacctatactattaatagttccgatagagctgtcaatttttatcagggtatactactctctattctctaggacagccatatatctttgagaatattgattttattccccctatttgtattagattatccatatagagactgctgttggccatgaatttatcccatagcatttgtgcgcatggaaatgtgctgaatttttttcacagtgattcacaaatataatctattgagttgatcatattattcaaaagcttcttttgatttctacctatgtcctttctattgatcactatacaggaccaccaccatcgtacctcgccaatcacgacaacagaggctgcagccttcatccttccatccatataaccttaggccattgcccagccatgacaatttgttactcttaactgcatttgagaactaattaatttgtttcttaacgcatgcattgcagcagggcatcgcatgcttattcttcccagttaccaggaaaaactaatccagtggaacaattatgaacaactcacatctgaataactctttgtagcatttacaagtggaagcaaataatttatggcgttgagttgaggtacctctcatgttctctgattaatattagcacgatgccttttcaaatactattcatgaaccaatatttatattctactgacaggtaaaatgaaaattcggaagggtatacttacaggactaccgtgaatttggactcaggtccacaaggggactgtaaagtcgtttgcttaatttatatttcctatttccaaatttcctggtaagtcagatgatatattttgcttagagatatccctgttacggattctttcacatcaacatgcatatccaaaactaactggagtgctccagcaattgatctgataggttttgctgtttactatgttagctctgttccattaattagcactggattgaaattaataccttgaccatactttgctcggagttgggatgaaatcaccactgggttaattttgtgatggcatatccatctagccatatggccaactacatagaggaataactatgtatttatttgcttacagaagtgaaatgctctgctgggtaaaaatgattaatatggtcaagggatttttgtttggcgtatattgttcgatgcaatagatatttggttgtattgctgacaaaaatgtttgatataaaattttattgattcatgtagattaacaattgattccacaagcaaacgaaagagtgtgttttttagacatttattatgggtacacttgctattatttactaaggaggtgtttcttaattttcaatcccattgttacttgaggtgctgttaaggagggaagatgttggaactgccaagaaggctgagctccaattggtctactgctccttcattggcgagatcagcctcaacctgcgtttgtggaagtttgacatgttaaatagcccggttgacttggtgttgtatcacattctgttggcgatagttttttattatttagcccaaaagacaatcgattaattttgtaaaactgaatcattattagcatttttttgtcagtgctatatatggtgatagattaatgtgattagttactttggtcacattgcaatgtaagatgacgtatgatcaatacgtaatgcatatataaaattagatctctgcttttctatcggctcaaaagctagctcctattattttagttattattttgtcctttcgcatatcaacgaattttcaatatataaatatttcatctttttgtgtatcataagctagctcctgtatgtttcagttattacaatgtttttagatattaataattatccagtttatcatcaaagtttaatttgtgtagcacgtatagttaaacgctacctggattttagttaagtgggtatgtcattttttgtttgcacgaacagagtaaggtgtataattatttaccccttgccacgtaaaatattcacttcttttattatctaagttgcgtttatatctgattttcatggaaaaatgctcgaggttactaaaatacaatccaccctaatgtacgaagctagctctagaaaataatttgtgcagcatagttaaaacactatccacctatagaatatggtgcgcaaattactttcttttccattatgctcatcatgcacgtcgaatattaagtttgatcatttcggatcctttcatagagattgtttgctatgttgtcactaatgactccatttgaacaaggataataactatgttatttaatttttataaatgtggcaatttaattaataacataataaatatatccatcaatcttaatttgtatttttagatgtcgtcgtagcgttagcataggctattactacttcacccctactcgcactgcgcggggttttctatctctctcgcgcgcgccaagaggccaagtcgcgcgcgtgggcccgccccgccctccactatctccacacggacgaccccgccgttcgctctctcccttatctctttcgatcgcgagtcggagcgagcgcagcggcgacgacaaggggcggtttcccttcggcggcggcggcggctccggctccggcgagcccgctcttcttacctccgacgagcccctcatcactccggcggccacgaggcgagagctgagtggcgacgccggcgagtccccttcctcctctcctcggccaggttagc

SEQ ID NO: 66815 - DNA, 1305 bp, Oryza sativa
ccctactcctgtttggggatttgaatccgctgggtgtgtattgatctgacgatcaggttgtctcatgccccctagaggcctcctgcccaccttatataggatggggggcaggattacaaaatagaaaccttaaccaacacggtatcggcttcctaaatctactttacaatattatcaaatcaggactttaggccgctccataatataaaaggaaacgtaatacccaagtcatgatctgttacatattccatacatatatgttatcccctattactagtcggataaccatgccgtgtgggtatggggtacccataatctccacaggcctactatttttttaaatttattgatgattggattgtcatgtagacaccacgtcaccaaaaccactctcgaaacagcctaggaagtcgttttgaatggttttaatacttgggacattatacatgattttacggttgagggatatgaattagatccaacctatatttaaggaagtcatcttggacttaacatgcgtacaaaattgcaaaaatgatgatagatatcgttctgagtttaagattttcccctaaaaagggtttgctgcaaataccacttctctctcctaactcacctttgcttttgaaatccccccacccccaaaatgttgttgcttgcccattcttgtaatcgcaaaccccatatacacccatatacgctcatatgaatactattagatgaggagctatggttgtcactcataagtcatgccctatatgatatgattgtggcattcccagtgatggcgcccaacacttcattggacagtggttgtcatgagtcttcactcttggacatcttagtcactaatgaactgttgcgcttgcctcttggggttcggtgagatatgtttagggacatgtacatcaatatatgcactaaattgtataacacatgcggaaagacaaaaaagaaacacacaagcaaaggcaattggggagaggtatcaaactggtgaattaagaggggttatttgcaataaaccatcttatatagggaatcataaaacttaagagaaatttgcatatatgctactcgaaaaaactagcttcgctagaatggcactctcaaaatgggattcaaccaaatgccactatcaatctgggggcattcgctgaaatgccaccttcgggcctttttctatttcaaaaatatttttcatcaattttagtttttctcggacgtttatgcccctaagtcaactgctgaatcgtacgttgaatcgattgacagtttcttctctgtttctctgggctgcaggaa

SEQ ID NO: 66816 - DNA, 1210 bp, Oryza sativa
aacatgtggttggacgtccaggggcaaaaccgtccaaaaaaattatttcggtgaaaaatcttttgcaaatgcaacagacactgaaaatggcattcgagcgaatctcattttaacgatggcattccagcgaagccgctttttaaggatggcagagatgcaattctctaaaacttaaggtgatatttggaatggtttatacaattttctctaaaaacaataaggtaacgagggagagtcggccacgtgaatgctctcatttccaggaggtagcaaaagtgcacatgaaacatgctaatggtattttggaccactattatttctaacattaagctactacatactcctactaaactggtaccaccaaatatatctaaggcggaaggccaaacttcactctaactccaaaacaagacatgccttgccctcatttctcatctgagagcatttcgactcaaaacaatttacaaacgcgtatcgttaatgcaaaacaaaaagttgcttatatagtatgaaaaaactaaaatgtgcggaaagcaaagcgaatcattacatagtaacaactcgtaggtttcgatttcctcttatttttgaattttttggctcctcaaaatagctgtcatgttttttttgcaacaagatttctcaattgggccagcagaatcagcgacacgcggttcgatggtcagctgctctatttctcattggtttgtgcaacgattcagtaaccgggcataagcagttgaggcatacatgtgtgcaatgcaacctcacacatggttttttttataaagaccttaatactctaaaaatctcgaagcaaccctttaaccgtttttaccctgttgtaaattttgtaaagccctatatatttttgagaaatataacacgaagaagacaaggtttcgtttttagaggtagcattgtaataccaagaagcataagggtttttttggcaaaaatatcatcccaatctgatgcagtcccctctcgtatcatctgaacttccgcctcctttgccgccgctttccgcttctgacgccgcactcgctccagccgcggagccgcctcttcttgctgttctccacctgtggtgaaggaggccaggtttgccgcccagccacccgcttcgccgctcgccctcccccacctcctgccaccaccctccccggtagcgcctcctgccgttgtccccacctcgcgcagatcgggg

SEQ ID NO: 66817 - DNA, 3962 bp, Oryza sativa
ccaattcgtccaccgcaaaaccagatacatcgcatcccccaactaaaggtaaagtagcaatggcggtgggcggccagcgaggagggccgcggcggtctgtaacgacagaggaggtgaggggggagtgtcggggaggagggaggtgaggggggagtgtcggggaggagggaggcgagggagctcgagctcaccatcccctccgcggtacggcaacaacggcgaggagggggccaggagtggcgttggcaacggtgcgggagtcgaaaattgaggagaatcgctgttgagatttaggagaactgccacccatgctttgtggcctcgcgtcacacgcagcacctgctcttgcgccgccgatgccctgctgtggcggcgccaactccttgcccctgccgatgctgacgccctcctctcttcctctcttccccatcttgaggacgacaaccgatgggagaagggcagcacacggcgggtgccggcggccagtgagagaagagtcgagcgatgtgcggcggcggtgtcaagcgggcccttgagcatgcggtcgtcgtcctcgcgcacggagaaggacgcgacgtcgcactcctggtaaaggagcttgtacgacgaaacccatcccctgctcatgcatccctcctcgtcccaacctcccttgggtgtgctgctgctaccctcgctcacgaaggacgcagcgacgtgctcatgcaggggtggagctcgtgcggcgggacccagcccctgtcctcgttgccctcctcgtccccgttccccctatcagcgggagagtagttgcacggcgcatggcaggcgtcacggaggactccaacctaagggtccgctcgacgccgccgtcacgcgccgctaagttctgcttccgccggcatggtgatggggacaagaaggatcgcgggagcaggggatggatcccggcgcacgagttccttctttgtcgggagtgcgccgccgcgtcctttgtgtgtgagggtggcggccgcttgctcaaggcccctctcgtcgtcgcgcgccgcttgactcctttctcactggccgccggcgcccgctgcgtgcttccttctcccgttggctgtcgctctcaagatggggaaaagaggagggtgttgacgggggcacggagttggcgccgctgcaggaggagggcgtcggcggcgcgggagtaggcgctgcatgtgacgcgaggccacaaagcgcgggtggtggttgttcttcatcccgacgatggttctccatcccaatgacaattctcctccatcttcaactctcgcaccgctgccaacgctgctcctggccctctcctcgccgttgccgccttaccgcgaaggggatggcgagcttgagctcgctggctccctcgccttcctcctccccgccactcctgctcacctcctctgccatcacggaccaccacggccctcctcgctggctgcccaccaccactgctaccttaactaagttggggaatgcgatgtatctagttttgcggtccagtgatgaatttcaggctcgacgacaaattgagagacctaaattaaatttattccaatatgcctcggctaactgcaaagtcgcaggcccataaaataggctcaacaagacagcatgtaaccttagattcctttgggctccagcggtctagctgagtagctgccctcagtcccccgaaccacgacgccgcccggacgcccgacgcggcgaccccgaacggccgaagtgtcgacctcgccgcactctgtcaccttgcgggctctcggcgaaaaggcgggagacggaggccagagccctaagttgcgaggtggttagcccctgagccctctttcctccacggaccaagccaccacctggcaagtttcttcttaaatctcccaaccaatcttccatttgttttgttttaaactgagtagtcattgaattagttgtagagctagaaatttgaaaaatgaaaaagaagacaataggtttgaagtcgctaaatcaacccaatgtgtcactgaatcatttgctgtttaggacaagggaaatttggttaaacttgtttagttgtatcctaaaaatttctctaatttagagttgatgtatctcccatttcaactccaccactgatatatgtaaagataaaaggttttcaaaaatgtaaaatctggttgaactttatatcttgtttgttgaaacgaagaaacaccttagttatgaacttatcttccggtgaaaaaacatctcaaattcgtgctaattcttccagtggcaattgcagtgtttaaagagtgttatcttcgctgaatcacgtgaagaataagctatgaaaaagaataggagtgcaatatatgaaattttgaagattgcatacctacctttcttagcgtggctttttgtgcaaattaaggacggtcacatcacttctcgctttcgaaaccatggcacaaagttaaattgtacttttcttcaagtgttatgtaattcattgaaactacgtgagacatctccagaatgaactattagtgctactatgtgtactctaaaacatctcagttttgtttcttttcatatgaaacagttcttttaactcattatattcagctgcaaaatcctttgtccgtcacaattgcccatggactctgctgtcgatggcccgagacaacctccggctagggcgggaagccgcctctgcacacgctgcagcgagcggaaggctgccctcaagcgtcccaaaaccctagagcagttgtgcctctatgcccctcacattttccgtgtagtttgtcctgatgtttcgagacaatccaggtgcaataatttagctctagtagcttaagattaacagacattttttaatgtttttgtgaaagtaggaatactgtgaaatgcaaaaccgtttttgtttggcagttgtagatagtgcttacacatattcttctagatatgtagggaatgcttctacattgtctttgaggatgagatccatcagactattgttgagaataatttgtttaaacctggtgatcgtgtggccattggagcttctggtggtaaaggtatttccacacctgtatatgccatcactaactaatgaaatagcatgtgttctttatgcaactattgactattttctttcttcatgtatagctataatctgcatgcttctttctttattctgctcttgatcttccaacagactcaaatattttcatgtcatgactgctattatgcagattcaaccgtgctcgcatatgtgctatcagagttaaatcatcgtcacaaatattgtcttgatttgttcctcttatctgtggatgaaggaattactggttacagagacgactcactagaaactgttaaaaggaatgaaatacaggttcccctcccctctgccatcaacacaataatgcctgtctgctgcagctttttccttttaatattggttctattttttacagatatttaatcaccaacttttaccatttaaatgcatattcgtcagttgctgatacaaccgacttattgcagtatggcctgccattgaaaataatttcttataaggacctctatggctggacaatggatgatattgtgaaagcaattggcctaaaaaataattgtaccttttgtggtgtttttcgacgtcaggtaattcttacttgcctctttggtgcaattttttactagttataggttaagctttactgccaatccttttttctaggcactggaccgaggtgctgctctcttaaaagttgacaagattgtgactggacataatgctgatgacattgcagaaactgtgttattgaatatattacgtggtgatattgcacggttagtgctgatcattcctttgtccttttttttctgtggttgatgttaaggctgattttctttatatataggttaagtagatgtacctttataactactggcgaagatgggccaatcccaagatgcaagccttt

SEQ ID NO: 66818 - DNA, 1729 bp, Oryza sativa
ttgaacttagtaaattatgattggtgcagacctagagctatactggacatcataaaatcaggtgagaattttaggatctccacaacaacaaggatgccagagcaaggaacatgtgaacgttgtggctacatttctagtcaggtatagtgatggtataataatatatatatatgttgactttttaggacctcttccttgctgatttactcaatgagactgatgctaattagattaagtgaataacagaggtgcttttgctaagtcattagataggttgtcattttattttcgttttgagggaaacattgtcagtttattcagttataccagtttatttgtgccattacagtttgtttctttgaagtgtttgaataactcacccatatgatagttcaatccatcttgtgcattccatgaactatcgaaacatgaccatggctgctgaggccctctgcattgtgctcactcatataaaaaagctatctaatgatgtgactggcatgaattcccctgatttccaatgcttttactgaacatcagttgacattctggtcttcgtagaaattatgcaaagcatgcgtcttgctggacggattgaatcgaggcttgccaaaactaggcatagggaggaccaaaggcgtagctggaggtgatagtgactgtgagcagcaggccaaacgtccggagaggagcaggtcgagtctgcaaggaaaacatggaaacgtcgacttttagatattatcagtttttttgctcaaagcctcaaaggcttctgccgagatattttgttaaaatgtcattgttggtttactacacctggatcatttgacatgattcagttgtacaatctgactatgggcctatttttgggagcttctagttattacagtttctctcaaaatcagaagcttccctaaacagtctagcttttggtctaagattctaagaaactatacttgtaaaatctagaaaatgaactaagagccagaagctgagaaacccagcttttctatatttttataagctagctaaaaacaagctgcttctcacaatctgaagctcttcaaaagacccattgtaagatggcttgctaaactgtcagctggctgattccacagcatgtgttctgtacatgattcgcgacgaccagagtcgtccacacaacggtcacactatcctgttataaatcctgtttgaaaccagatactctctctatctcgtagtataagggattttgagcttttccctgtaacgtttgaccactcgtcttattcaatttttttaaattattatttattttatttgtgacttactttattatccctagtacttaaagcacaattttttgttttttatatttgcaaaaaacatttcaataagacgagtggtcaaacgttgcaagtaaaaactcaaaatcttttatattgtgggacggagggagtatgtttttgtttgctttatcccttgattttttttattttttattttatatattaaaatatttataggaatgatttttttgtttgaaaattattcctttatcaataaacagttgactttatgaaaaattctaaaaatagttaacagtgaatatgagaacacaattatttttcaaacattgtttcttaataatagatagaaacccggcctctatattcatatgtgccaccatttactattaagcgatttccacgattgggatgaagcgaccaagacaattaggataaga

SEQ ID NO: 66819 - DNA, 1790 bp, Oryza sativa
tgttataccgtaccagatcaaatatcctcaggtctttcttagggtcaagatgatccgcggtataaaagggacccccagggaggagtgaggggtatccaattcaactaccaacacacccaccatagtttgcaaagccggagtacacgaagccaatttgccgggagatctcgtcgaaaccctcgactacgatctcgtcggtattatttgtctcgactactctctttgtaatctgttatcaccatcataaattccataaaaactggactagggctattacctgatcaggggcctgaaccagtataatccttatcttttgtctgcttgatgtcatacttcgtagaccctcgttccaacgtacccggtactcaactcatccggtccgtgagtatcactcgtcgaaagtttctacaaaaatcgtggtagtagctccgaaaacgtgttcatgataatccatatagaatcatttgaatttaagttagggaaacatttgaatcattgtacaattgtgcataggttgaatcatatacacagttgaagatagaatttataaaaatatttacaaaaatataattatgtacttaatttataaggaagacaacgcagtgggacaacaaagggaatttataaatcaaaacaatagaatgccattatttttctattcgggacgtatgcacatgcacaccaatagaatttgcattattatgataagatagttaagaagtcccatggataaacgatacgaatttgtccgtctcgacgaattgagcttgagcttatccaccgaccccttctacgtcattcaatgcgtattgcatttctgtgctcctttaatagttgataatctacttatgttttattagactcagttattttttcaccatgatatgttggattgacattgtcgatctacaaagtgaatccgcacatccttggattgacctaagaaataaataaagttagtcagtaaggtagtaatattatgcaaatgttagcgaaattgaaaaaaatgtaaggcttcgacgtacgacgaagctgttatttacgttggggcagacaaaatatctccttccacatgtttcttctgcaaaggaggtagctatctggcagcgacctctacaaccgtactttgaatgctcggaccatttaggtaaacctaatggattgttctttcagtctaagctagcaaattgtacccggcattcatactccatccatgactggttgaattgtgtggtcgcttctgtcaggttatggataccacatacctaatagtagttgactaaatctcggcaggacccaccacataccatgtcttatacagaaacaaccttcggatataggatgagttccgtataaggaaggatgaatagagttttacatggaaaagacaaggactactcggattgtatccatattagttttcctagttttacttgtacaaggggacacctatgagtataaatacaaaacaccttatgaggagagaggacacggacaacatagacaccacaaagccacaagccaatacaagcatacatacgccaagacaagctgctagatatcgacatcagagataagcctaggaaaaccccatatggtacctacgggaaccaaagagaggaatctagtgctgtctctgatctcgccgggcaagaactcgaggaggaagactaccctgttgtcgactacgggatggtttcatggccgccatgtcgacaatagatagataggctaccccaaacattgtattggtgtgattatggtgaataagagcaatgaccggcttcggc

SEQ ID NO: 66820 - DNA, 914 bp, Oryza sativa
taaagcgaatagcagccgatataagtaaatcgagatactaagactaaattaactaagatatatgatagattaggtgcttacacttacaagatcaaagtgtcgaagccctagccccgccgatgcaagccgccatgataagaataaactcgtcgaaaaagtagaaaaggttaaaggtggtgatgtgccaaattgtattgatcgtagagatagtttacatggaccccgagtgtacatatttatacccatgggtagacacaatacttgctaaacaagaaagaaactttcctaaagataaaagggaaacataaagtccttatatgacactaaacaccctttcctaaagataaaaaggaaactaacggacttttcctaattaatagatacactgccatgccgcatcctccttgaactcggtctcttctggataagcttttctttaatagattaatttccttaaccaaatatagcaagaatccggctatggcgacttgacgactcccatcagccgattccaggattctgaagccgatactgactctagccgatgatgacttcggggcttaccaaatttcactgttaacacagtggtagtgaaaaaaagaatgatatgacgaaattgtcttcgacaatgttaacacacacaaagcaactttgtcgtagagtttgttatcttacggaccttatcatctgacaatggtcaccacaacgacactctggatgcttctgccatgtgaggagtcccaggggatttacctgccattctaatggttctgcagcaattcatcattcgtgctcatcctttcgcctgaggttgtccgatcttctttcactacgtgaatatcaacgtgttccgtcgttatgtgggttctccgtatctacccactcaatgaagttgcacaccgtacggtatgtct

SEQ ID NO: 66821 - DNA, 1727 bp, Oryza sativa
cagcgtctaacctggataccacgagttaatgttggcactgacagctcgtgcagcgtcggcctattagagacatacgtaagcatgttagtaccaatcggacaaaagaaaaagaaagaattgagcaggagttcgacttaccccgaggaagtagtttcggtcacagtgcgtggggtactcatctgtgacagcggcaacatgcggctatggcacggtaggagtaaaggtctattaatagtgaaatttggtaagccacaaaatcatcatcgaactggagtcagtatcggcttcagaatcctgaatcggctggtgggaattatcaagtcaccaatagattatgctcaaaggaaaaagggtgttcctgttcaaattcggaccgttctttctaaaagagattgcatattttcccagggagaatttaacagattgcagagattgttaatcattaatcatcatggttatgtgcgggatataaaccatttccattatctaaaagaatcattgtggttaggtacagtcagtgagtcgtttcaaacaatattacagtcagtgagccaataggagtgtttgtttgttgaaatttgctccggtccaataaaaagtacctcgaggaactagtacctcacggtactaaatcattttcgatcactggacctaattggacaagatgggtattgctagatccaacgatcggaaacgatttggtatcgtgaggtatcgatactttgaggtactttttttttttggactggagcaaatctcctgtcagtaaaaactctgttcttatttggttttctaacaaagctggatcaatagatataatttccaaaaaaaaaaagaagttgcgtatgtcatgcaaaatattttttttgaaataactaaagctaatttcagatggatcaggtggaacatacttttgcttatgtatatgctcattgtatttttcatttcatctcctaacgttgagtttatgccttgctgtgtcaggtggaggatcttggtaatctgatcaagctatacacagactggcattcttcgcttgattccttattactcctttgatcagtttgtgtgaaaagtcgagaaagtgggtgctagtataaacagatagaagagcaggacgatgcctttcgctcaaatgcaggagaagaaaaccgcgaagaaaagccggatgttacgagaacatacgcattagggcaaccacaatgtgcatgaaaactaaccttaagaaataaagtagtaatttttgttgtacctttgtacattgggagatgagctagggagagaatagtgctatgtgcaaccttaagcttaaggctagccataagaattaaaaaaatatatcatggctttgcaacatgcatgcacactttcaatcttgagtaaatatgtgtctttttactcaatgggtcccaccttaaggtcgagaagctaccatatacattgtagcatgtactatagataaaacaatataagaatgtgggtcccatcttatggctcaattgatctaaaacattgaggatgcccttattgcacgcgacctttatttaggcccttaaagccctgtgtttatttgtgtccaagatttccaccgacttgagctttacttccatataggctgtgtttagttggatccaaagtttggattttggttgaaattagagatgatgtgactgaaaaattatgtgtgtatgacaggttgatgtgatgcaaaagggggctgcaggaat

SEQ ID NO: 66822 - DNA, 8277 bp, Oryza sativa
catccaccccaccccaccccacccaccgttttcccctctcctcccatccccccgcacccatctcgccgtcctcctcctcctcacctcacctcgccccggatcccccatccacctcgcgacctctcctctcccctccccggcgcttcacccacggtagcaatcactcccccccaaaaccctagcccctccgatccgcccgccgctcgctggcccttccgagtcccggatcggcgcggcggccagatctgctttccccgttcgatctgactcggtttctctcttttccatccgcgtgtgtggtgtggtgttgggtttggttggtgggtgtgggtgtgtgtgtctccaggcgatggcgtcgaggctggcgcagctacggtccaaggcggcgcaggcgtcggagctcgtgtcgaagcacgggtgcgcctactacaaggaggtgatggagaagaacaagcagcacgtggtgcagccacccaccgtggagaagtgccaggagctctccaagcagctcttctacacccgcctcgccaggtgatccccggatttcacccccgctgtgcctgttcatgcggctccatttggtcgctgtttcgtagttggcggtgtgttgcgatctgttggcaattgcgcgccgggggggggggggtgttcaggcttgggtgttccgacgaatgtagcttggcacgatcgaaaattcgccaataattggtgggtatccaaattatcgtgcctccgattactctagtttaacctgaatttggtatggcttgctctgctcatggtctgcaatttgggtagtcagggtgagcctacatagtggttagtagatttcgctagacgatgggttttttttttgttgtctggtagtctggttgtgcacttgtgcttttgttgttgtcatgacctattaggggtttgagagctcccttccatacttgcactttataaatcttaatcatttgagttgaccatttgttcacacgctcctccctttatgaattgtgcttgtgtaacttgttgcatgtataaacttcggagagctcgtaaccatgtgttatgaggctgtttgaatgttttggcctgtgggatgcgtgatgttctccttgaaatacgctacctgctagtacattgttttggtcagacttgctatgctcaataatttggtgaaagaggataggcacagtattaattatggaactacttattaagagtgcatttcatctggtcatgcaggcactgagttctgtaagacccataatctgtcagttttgaaagtttgtaacaaaagaaacctatgcaataagtatgatatacctgaggctcttactgtatattccttgttacctttgtatttttgcttggatccatggttcatgaagacatagaacgatgcattactgttaggcgaaagtgtgagaagtcaaatacaccgagtgaaatgtgaaatctattgtggatgatacataatgacaaaatggaatggtatgtattttgtatgatttaagaaatgaacttatatcaatattgctgtggtaattacattagcagtttgttcagtatgtttgaaattatttcttgtttgtttgtttctgcagaaaaggcattgcagtaaaatctattaccaatttactttatgggatttacctaattactatgaactataatacaaaatctacattagtccattgtctgttctgagaatgttatagaggtacagctctgtcataaatctgtaggataagatgaatgcttttctgggcctcagtcttctattctttttcacttggcaaccagctgtgtttagaataaaaaaagtgacaacaattcaagtgtggatgcaatattaggctttatcacggaaaagttatttcttgaatcccaatccagtggccgcactttagcctgctttattattgtgacgaacattgttttttctgattgctgtataatgatgctaatccttgtttgtgtacatggtttgatgagtggtgttgttcagtgtgggagctgatgacagaacaaactggctaggtcagtgatcactgatcagtctggtttacagaactttgttgtatacatgatgtgcaaccaataacatgcgatttagttagtatcttgtctgcaatgtttcaagtcatgattgataattctggctagcaatcacgtctgttaaattaaggctgagcaatttcttcacgtgttataaattgatgttgaaatgttttgaggttggtcaggagcagctattatttttatttttacacgtttttgcattagaattttgtatgttgtttccattttttttcattagggctcttaatcaaggcactatctccaatactgtagcagatggtgtaccttttgaccatcttctgctgtgatgttagaattagggctcaccaggttgaaactatactggtcaattcaggctggtccaaagagcatgcatgagacaatgagatggacgggacacatcttctgtgatttgccggtgcccatgtctacctatcatgagggaaatgaacggattgacgaactttgggtaaactggatttgtttactcttaactttgaatgattaattaagatgtcatgttagcccttagatgcatatgcatagggaccagtcacgtgcttgttgtggattgttggatggagaagttgcaaggtctgcacttgataggcaaagcaattgtgcatgtatttatgaatgtgtatcaacttgggtggagcattgtgcttttaacctttttttctttttctttttttttggggggtggggtggggggggggtgtctgccatattttcttgaacaagtcaagtcatcgattctgcattgtgaatatgccttcgttactatgcttgtttactttggagctctgatctcaatgacttatatggctgttgttttcttcagtttgccaggccgctatgaggcattttggaaggaatttgatggtgtcaagcaggtatggaagaatagaaaggagctcaaggtagaggaccttggaattgtgacattatttggagttgagctttatgcgtggttctgcgtaggcgagattgttggcagaggattcaccataaccggctataaggtctagaagagttctgattaagacctggtttataaaatacactgttagctgatgcttgtcgaaatgacaaagatacctcctgccttttcacaattttgtttatggaaagtctttctagtgctggatgtcagccaagacgagcacatcgttgcaacactgcttcaataatttgctcgatctctcgattgccattttggtgtcctgtaatgtgaaatactgaaattccatcttgccccacccgtcaaattgtcatttatttgttctcttgaatccatctcaaactgcaagactcaagtttgtcgctcgttcaaaatgcctttctgttgatgttggcatatacatcatgttgtgcagctagaaacgatgaaagcgtcagtactgttctattgctcgttagagtttgctttaaacaatgaatatctaattatcttacttatagaaccggggtcttcctgaataccggcacttttatttccaaatcactagtacttcctcggtaacagccaggctaacaacaacctaacgtagatcaaccgggacaagctctacaggagaacgtggcgacaaagctagcagaaaaatggtaaaaaagaaaagaaaagctgttcctaaggtgagttgggtgggcttcagttgtatagcagcactaggaaagtagtgaagctgctgcttgccagtacgaggatccagcccttgctcgccccgcacatcctctccgccgccgccgcccccttcctggtgaagaggaacagcaccctgtcgcacgccagcttgaacagcgccaggcacgcgaagaagaggctgatggacagcacggccagctccttgttctgcatcgtctcctggatgctcctcatctcctcgacattcgacctgcacccaacacaacaattctcatcaagaatccgtagcgccttctgcgaacaaatggagaatcgcagctggagagacagagagcttgcctcatcgcctcgttgtctctgatgagatcgtccagcttgccggacacggctgacctccactccttgagctcgccgagatccttggcctgatcaacaacaacaaatggcaaagcgaatttggtggattaattttatgatgacaagtttcagctgtcgtcaacaagctacaggaatcaatcaatggtgatggttttgtaccacgttgcccttccactcaacgaggtcgcggacgtcggccttcatcctgtcgagcgccatggtcgtctgggagaggccggtgtggaggtcgggcagcttggcgccgtaccggtggttgagcgccttggtgtagtcctccagcgttgagaggcccagctccagggaccgcatcttctgcatcatgatcttgagcacggcgtcgccgtggaaccgccccgccgcggccggcttcccgtcgccggccaccgtcatcctcgagccgttgttcttggcgcccgcgccgtcgccggcgctgtcgttccggccggcggcgcttcctcctcctcctcccacgccgtccagccttgcgttgacctgcgcggtgtcgttgcggagggtgccgccgtcgccgccctcttcggccttggcggcggcggaggcgtcggtgtcggcgccggagccggagatgatctcctgcagcatctgctcgacggcgtcgatgccgtacacctcgaggtagctgaggatgcagtagaagccggagccgtagtgggtggcgaggcggaggcggaggtagcgcgtccaccgggggtccggcagcacgaagcgctgcgcgtgcttggcgttgtcggcggtgaagcggccgagcagctcccactcctccgccggcgccgggtagctcgggctgccgtacagctcgaagtccttgaagttggaggagtagtgctccaggttggcgaggccgatggtgcgcaccagcgtctcctccgacagctcgacgtcgacgaacttgtcgtcggcggagcacgggttgcgcaggtaccggtccttgtcgccgccgaggatgttggcggcgcccttggcctccctgttgtgggcgagcaccttggcacccttggacgccgccgcgtagttgtactccgcgccgctcggctccagccggtgggccgccggcgtcgcgccgtcggggacgcggccgttctcggccttgccctgcaggatccggctccggaactcgtcgagctcatcgagcgccgccgcctccgctgacgatttgccgccggttgtgttgttgaacggctccaggctccggtggtcagtttcctgctgcggctgatccggcgggtgcaacgatggctggcacgtgggcgcggccgcggaggcgttatactcggtcgggaaaatgtaggcctccagcggcattaccttgcagtagttttcgcgcattccgtcctccacgtcgtcgtagaaatctacaatcaatcaaacgccatgggtgacatgacgacattgatcgatcgatccatgagcatgagaggaggtggatcgtggtgggtacgtacctgaagggtcggtctggctgtggaggaactgggagcgaaggaggaagaggaggcaccagacggaaaagacgacagagagggacacctcgcggaggccgccgtccatggacagcgcatcggtcacggccggcgggtcgcagccgccgtttcctccgccgcctccttctctcctcttcttgctcatgcatacacctgcgcgcgccttcctcctgcttgctgtgccaaagcgctaaccacgtacgccgctgcacgctctcagtacaaaccttgcctctgcctgcctacccgaacgacgtacgcgcggcgcggtggatcgatcggtctcgcggacatgcactacgagtggattcgggagatgagcgaggggtgcgcgagggagattgggacggggagcaggagccagcggtggagcggcaacgtcggagcggagctaggggcgcgtgcggaccgagcacgcgctgcgccgaggcgacttggccggtgcccggtgatgcccacggctgtctcggcgcgtgtgaactgttcaaattatcatggtaagtgccacgtcaatatcacgtgggacgaagacttagtcaaagaaaccacgtaggcgtcacgtcagctaaaacagaacacaatactgtcgagagacatcgtttgcacggttttatcggttgaagaatgcgttgtacctcgttttgcactcaagagactcgcgacaaattgaggaacctaaagtatacttattcctttgggcgaggtggtggcccagtgaaacgtgggccgaggcctaggcccttcttctggtgaaaacgatgagaatatgaaccgtgggctggtagcccagtatatgcctgtatgtgacaggattaagtccactgttactccctcaattcgtatccctcaaccataatacaagtatcttaaccctcaaactattgaaactagtttaaaactttaaattgactcactcgacaatttttgagactaatatagctcgttgacctggactaactagcttagtaagcacgcgtgacccacatatcagtgtcacatatttcttctcctctcctcctcttctctttgttccctcttctttccctcataggcatacagcgatgacactgactagctcgactaggggggacggccatcggcagcttcagcgggccaagagcagagcagaggagaaggcatggtagaaggaaggaaagcggcccttggcatggccttctggccacgtcggggtgccgtcgtcgtcgtcgccctgccgccgccctcctcacgagccgttgcgccacctccttctccggcattggtagcgccgccctccacgatgacgatgcagccccgtgctcgcattctccaattgatctggcgatcgagctctcggagggcctccacatctccgcgcagccccgccgctttgcctccgctttgaactccaccaagctcccttgctcgatctgcctccgacttgagggccttgtcatgcaccgcaacagtgagcggaagagcatgaagaaagatatgtgggcgactttggggaggaggtccttgggctacgggctggtggcggcggcggagatccacgcgaaagggcgatcgatctgcctcagtccccatcaggattggaaatttcggaccgaaatttcggtcatttcgaccccctccgatacgatattatttcgaccaaaatttttaaattttttcatgaattttggtaatatttgttcaaattcaactaaaatttgtccaaaatttcggaagtttcggaccgaaattctgaaatttcgatatttcggtggtggccgatcaaatcggttaaaccttttcggtttaacctggtccccatcacggcggagcgaaacctcgcggagcggcttgtcggtggtgaggcgccagaggcagacggcaacgcgctggggcacagggatggaggcgtgcaccgtgcagtgtggtgtactccttggtgacgacggtggccaggtggtcgcaaagcttgtcaaacactgcgcacggcatgcggaaggctcgccggaagtccgtcgggctcctgcagcatcgccagccaagcgcccgagcaacctctattcgtacatgctctttgccacgtcctctgtcttgctgcatcccgttgtcgccctgaactcaactgctatattatgcacgatgccacctactcacacctaggggtgaaatgggcgggtatttcccgcccgcccacccgacccgaggctcacgggaggaatatgggagaaataatgggatatccgatattatccgagttcgaaacctattttgttagaaaatatggtttaggatacgggaaaacatgtatcgcctgtatgtcccatattataaaatatatatgaaaatgtattataaatgcacctataaacatgataaaagtttgattaatcgctattttacgagctcacatgcaatattatataatttttctcttgatgtatctcttttaatttgttaattaccttattatatttaagagtacattacattgacattgacggtacgcgaacttatgcagtgggtgcaatagtacaaaacttgaaaaactctcgtttcggtacacaaatttgtgtagtgcgtgcgaagcaaggccaatacatacatgacttcattgccaatcttattgagttggcttgtgattaggatgccacatcaacgctacacacgttatgtggggcgtga

SEQ ID NO: 66823 - DNA, 2308 bp, Oryza sativa
ttacgcgttggcatgtcattagcggagtactactaatttacacttagctctaattcatggcacgtacttacgtgatgtgaattgtgagatgcgagcgtgacgcggcgcgccatgtgcaatgtgatgcgtctcgctcgctcccctcgtgacgatgctggccgcgggggggctctttctcctgagatcaagctgagaaagaagataggcgcatcgccgtcgcgaaatcaatgtgggtgcagtgcctgtgccgcgggggcgcgggggcagcggatcggaagcggttgcgaaaccgaccgatcgagagcgtcaccgtcccagatcggggcgcgggattcgttgccggaagaggggggagccgcgcacgccacgccttgctccggtaatctggttggcaccacgccgcgcgcgtgccgcggccgcgagcaggagctatagggggctggctagtgaactgatccgtgagaaaaacgtaaacctcctcccgtggttttttccggggagaagagacaacggccgtggtctgggtgtgcatacggcatgtgccgtccgttgcaccgggcacggtcgacgggtcgaggcggcacatggaggcgtgcagtggagaaatttccacactggtctgtggacgacgtgctgtgtgcacaagcacaagctatccctacccgtactattccaagtccataaagtagcatggggttaggtagcaggaggcttggacagcgacaaacacgcccgcaaaaaaggcacagtgtccgaggcagccaaagcggtggacggacggagcccggagagcaaggaaaaaaagcaagccctcccaacgtttctcacagtttgtgtcgagccttcgtacgtctctctgactctctctctctcgtctccgtgtccgtggtacgagatgggagagagcgtgagaccccacacgtgtgggccctcgccacttgaaaacttacctttagagcatgtacaccggttataaccatatatcgacaagaaaatataagagaaaaaaagtcgggctacagatttgtagccggctacaacacagactccaaaatgttacgtgtgtataagtggtgggaccgggtattaataatgtagtatattttatagttaactattgtataaaataagctattagattggctatagatattttagagctagtagttggctgtactatttaccctgctcttactccttgggaccgttagaaaacttccaagtgacggctgtgtgttcagttcgctcagttgcgctgtgtcaagtggcatgccaatgtcacagcctcgcatgtccaatgcagtttaattaaacggcagattactatacttataacaactttcatactagtaaagcccatcagcaaagttttacagaggtaaaatagcaagaaaaaaagtcctttagaaaaggccaagttaattatactgtcgtaaaagaccaggaaaagaaaagggacaacatatatacaactatagcaaacgagccagtcagagacagtcatagaatcatactgacatggtcaaggagatttttataacccatcactttaactgttttacagccttcaaccgccttatcctcaaagcacacagcgctttacagcatccaaagctctctccctccctcactcactcgccaccttaatcaaaccaaacccttaattaagtacttaattatgactaaacaaggctcactcccccgttaattagattaagcagcaggcttaaggcgcaattagctagcatcccttgggcacgaagccgaggcgctggccgtcgccgtcgaacaccacgcggaagccctgctgctggatgttcccgatgatggagacgccgccgtcggtgccggcgaacgcgaagcagaaggtgcccctcgagtccaccgggatcaggtagttctccggcggcagcgcggcctcggcgccgccggcgaagtgcatcgacacggtgggcaccttcaccaccttgagcccgctcaggtcgtagcacgtgtcgaacagggagaacccgcccggggagaggcggaggcccgcggccgccgcgcggaacgcgtcgcgcagggcggcgtacgccggccgggccaggcgggtgacggacgtgccggagtccacgatgacgccgccgcggcctgtggacgggtccaggcggaggtcggacacggccacgcccgggacgcgcgcgccgccgacgctgatgcccatgagctgcacgtagtagaacgtctccatcctggggttcttcaccatcggggtgaaggacgcggcggccgaaggccccacggagccggagccgaacgtgacggtgga

SEQ ID NO: 66824 - DNA, 5978 bp, Oryza sativa
  unsure (1)..(5978): unsure at all n locations
gcagccggcccacgagccggtgaacccggtggtgcggtgcggacacgttcccgtgctcgcgtcgtcgtcgcagcggcgcgcctcagctcagcaccgccagcgtgtgatacccctgtgccacagtgccagcttgcgctcctgccgcggcctgcggcgacagtgtgacgaatcgcgtgtgccggtctgggggcatcgattggctgtgcgaataaaaaccggagcagggaggcagcttccgatcgaccacctttccgctttcgcttcttttgaaactgtccaattttctgaaaaatcttggaactagttgaaactccaaatacatcctacagctgatgctacacgttctctacaatccaaatacaccctacaccgtggatgatgtttcctgtggcacgtgataccatatgttacacgttctatggatgtttcgctgaaattgtgtaaaccaggcctgcggggaacaaggcctcggtggagaattccgttggaccaaggagttctatatgggccatattatgagattttgatggcccgcgacaatcattttgggcggaataagttcactttaggtccctcaatttgtcgccgagtctgaaatttattcgtaaactgaaataccaaatataacgggtcactcaatttacaaaaggaatcacccgatgtcctaagcagtactatgttcggcttttaggtaacatggcaaagctgagtcggtgcgggacctatgtgggacccacatgtcagtgactagcattgtctttcatcctctcttctctctctcccctctcccctctcttcagctctctccctaatcctctccaaggcctccaccatggcgtgtatcacgaacccatccagctccagatctaccaccagaggccgtgggcgtatgtcagcaatgtgggcgacctccactttccgtagcgacaccaacgatagggcaccctccacttcccgagctactccaacgtgctcatcatattgagcatgttgtccaccacctagaagagaagcccaatgcagcgcgcataccgtcggacgctgtccaactcggcctctgtgcccaaccgacaatggtgccggaaacggctgtgtcctcaaggggtcatgtcgtctttgcacatgtggatgtactccagcatggcgaggctaacgaggaggccctcgctctccttattgactacctgtccagcggcaactcccctggtgctgaaggtgctcccgagttggcgacctcccgtagtgtgagcttcgcaaggacaccgtggtcgccgcagtcgtgtgacatgtgctcgaacgcgaggacatggagcacttcctggcgagggctcgggcctacgccgctgacaagcttcggagcaccggagatggagctcggtggcccaaattggagggagggtcgatgagctccccgatggcggcacggagcggtgggttgccgccgcgttgagctcctcggcagtggttgatgcggcctcctccggtcagatctggccgctccctttctgttcccctcctcaccgcctctcttccgatccactctctcctgtggcgcgtgcagtacacaaaagtgtgggcccaatgcaatttctaacgaggtatctgtggcaacatttatctccgcattcttcatggagcaccgaaatactccgacatggaggaaaatctccgacctagcctcctcaagttgaatgccacgtattgcactgtgaaagccccgagagcaggacaagcttcgtactcctaaaacttttccttcctatacaaggccttccatgttccttagagcaagttcaatactatagtctactactagctccaattcatatatagctaatctaatagccaattcatacaatagtttcttactatactattaatatatggtcccacctatcatgcacacactgcgttttggagcccgtgctgcagctggctacagatatgtagcctgctgctcttctctcttactccccccgtcccaaaaaaaaatccaattctagagatgaatctggtgtgtctagattcatctctagaattggacttttttttaggacaaagggagtatcttttatcttattaaaatatatttataactagctaatagcatgctattgtacctgctcttagagcaagtttaacaacgcagccggccagccggctgcatgcgtcgctcttcgcccaccgctgcgccggctgcgggcggtaagctggcgttttgatgcagcctggcccacgaacagagaggcaaacaccgatggcagccggcggtgtgtaaaatacccgcttttttctctctcttcctctctctctcctccgcgtaggatttagcctgcttatagcctatcataatacttgctcttagcaaaccagatcgtgtcacctgctggggttacctgtacagctatggcgtcgtgagtcgtgactcgtgagagcagcggaattcaaaacgcataanaaaaaaaaaaaagaaaagaaaaagaccctcgcttccgtttcctcctctcccaaactcgcctcgcctcgccttcccgcccgccgccgccgtcgccatggatgccgccggcgaggaagggggcatgacctacggggaagtggtggactacttcaactcttgcaggacccgccggcgcagagcgcatcgactgcatcatcccctacctcatctccctcctccccgcgcccttcgtccccgcgccgcccgacgccgcctccgccgacgactccgaggacgaccacttctccttcacctcgtccgacgactactccgccgccgaagacgcccgctccttcccgtcgccgccgccgggggatggcgaggaggaccacatcagccgcctcgcggacgacctcctctcggagatcatctcccgcctctccaccaaggaagccgcgcgcaccatggcgctgtccacgcgctggcgccgcgtgtggacgaagacctccctcctcgtcgacgacgcgcacctcagggacgccgacaacgaggtctccctcgtccgcgccatctcccgctgcgtggacgcgcacccgggccccgtccgctccgcgcgcatcacccacgtcgccttctaccaccacgagtacgcgctccggcgcctcgtggcgagcctggccgacaaaaacgtcgaggacctcatcctcttcaaccgcccgtggccgctcaacatgccgctccccgacgacatcttccgctgcgcctacctccggcggctgtacctcggcgcatggatgttccccgaagtcgccgctgccgccttagtaaacctccgcgagctcggcctcttccactgcatcatccccgaccgagacttcgacgccctgctctcgctctgcagtaagctggaggtgctctccctcgccatgtcgtacaactgcccgtcgcggctccgcatcaagtccccaagcctccgggccgcggtggagtggatgtccagcctcgacgagattgtcgtcgacggcgcgccatgcctggagcggctgctcctccaccacgccatccccgtcgccgagcgtacgcccatcaagatcgtaagcgcgccaaggctggaggtgctcggcatcctggacctccagctccacgagctccagattggcggcaccaccatcagggtataactccaaactgttgtgctctgcactttgcaattcagttcgtgattctgcaaccaaacaatttcctctctgttgtttgatttgttgtattgggaatgaaatggcagcctgggatgtggatgtttgtgaagtctagcgccaagctcccgagcttgaagatacttgctgtcaaggtgtgtttggcgatcgaacgggagatcaagctgctgatgacgctgctcaaatgcttccctcacctcgagactcttcacatcaaggtagttgttttagtacacgcggttagcacctgcaagcttacttccactgcattcttctactagtcaaataccaattctagattagatcgagaatataattagatagtagtaccatgttattctgttaatttgcatcgtgtagttgatttgcaatgttcattacttctggttgatatgatagctttcctgattgataagctaagcaaagttctgattgttgctttgctaaattgcagtccattcctccatgcgcatcacctgaaatcgcgaattgcgcggatgtttgggaatccctgggttcctgcgaatgcctcaagtcgcatctcaagacagtcagcatccaagggttccacaccgagcgctatgaggtgttgtgcctcaagtacctcatcttggagggggaggtgctcgagaccgtggccttcttctgcgaggataaagtgtgcttcgccgccaaggacgacgaggcggtggagatcgagctgatgtttcccaagaacctcgtccaagatcgctggagcttccagagcgccattgatctgtctctcgacgatcccttcttctacgccgtggagagctgatgggtctgtgcgtttatggtgtttttgtcatccgacatagatgggttcacaaatctatggatgtagcactgacatactaaattcttcagaaattaacggtgaactctggatgctaatttagtactagttgttaggttctgggttgcggaagtactaaaactttggtgcgtattgttttgggccaaaatccacaatcctgtctcaatttgaagttgttcaaaatctccctgctgaccgccagatggaacctctcctgtaagcatgttgtttgataagtctagctttcggtttcggatgtgttgcattttacatattgatgttggaatggtgccagtctgctagatactccatagaattgttctgaagagcaagcacatataatacctctgttgcaaaatctgttaagttggtagtttccctgataaagagttcctggaagagtcaacgtaaatggaattgttttgtactgggcctgataatctgtttttgcaaaggtctatcgggtgtgcgtgcataagttccagtctttctggtagcatgccggttagttgattgtttgaaagatccaaaacagtagctccagaaacaatcagggactgagggtgtgtttagttcacgctaaaattggaagtttggttgaaatcggaacgatgtgacggaaaagttggaagtttgtgtgtgtaggaaagttttgatgtgatggaaaagttgggaagtttgaagaaaaattttggaactaaacttggcctgaatcagtaatactttcatttgaaatggcaagaatctgtatgccaacttgtgatcgaagccaaagttgggattcttgtccctaggctggatgatcggaggtcagccattgccagtctgaatggaggaacccagtctgaactgaatgtcttgtgagattattatcttgaaaatctaggtcaagtttgtcagaagttccaaccagtctgggaggcttccgtagaagttgttgctaatggcagacgatacgaatccagacagacatgatacgtctattattaccttcatgttgcacaggttctttaaaattgatggtttttcacctgtaaggttgtttccagacagatggattccttcgagggctgtcatgtttatactagattgctatattttgaaacaaagggatcggagtagtagcacctgttcactgccatgattacctctcttaatttagctttagctttctctagatgacacaagcatcatggcaaagatgttctttttaacggaaacaatcgaccttacatcaagatgtatccagctaatcacgtcatggatgtggtacgattgttacatgatactgttatcttttgtatgaaatacttgagatcaaattgatgaaatacaacatctaagccatgtgaagttgctacgaaattactgtgagccttcaactgtgattaccctcacttccattgatggccttgaaaaactgttcacttgtcacgcaaagccgcacccaacaccttccatggctgtactatatgggctgcaggaa

SEQ ID NO: 66825 - DNA, 7907 bp, Oryza sativa
tagagatcgtgcgggcgccctgatcaagcgacccttctctatataaaccgacccgccgtctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacatgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagcgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgcgaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagtatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttaacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatgaattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccagacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcagaattttgatatgaaagatttgggagtagctgatgttatcttaaacattaagctaattagaggtgagaatgggattacactcttgcaatcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacagtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcatgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcatgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaatcgctggtatataaacagtacattggaaaaggcaaatctcagtgggattttgagatttggtgggggattgttggaattaatgaatgggccttagcccactcgaagattaattctttggaaaatcacaaaagcccacctcatgggatgtcatgcatgtggagtttagtaccaccttgcttattctatgagagggggacctccttaaaagggatgatgccctcctagtcgcttgaagcatgtgtggtggagagaagaggggaaacacacgcgcgcgctcgcctagcctcgcctcgcctggcagggcaggcagcgcgcgtgcacgacgtacgcgtcgaatggtccgaaaaattggctcctcacccttgcgcagatgcagcctccttttgcagttttgttttgttgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtctagggtttgcctcctactctgtactgcgccgtcgctcgtagagtactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacatgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacagtgagcatctgctggtcagtgatgctacattttgaggcatcaactcatctcctatatggctgtttccctagtcaacaatgcacgcaaggaacaaacattacatgctagaagtgttgcaaacttgcaatctagcaagtagcaacaccaggtttcaggttaggcaaccatgtctgcttcgctgacttctgagtgaatcacaaaacttgggaataccatggtgaggtccctaaagaatatcaccaaccaataataattagttaatgcgcaatacatatgacaaaaacatgactatagtcaattgtgattgtgaagcccattatcatcctttttttcccccaatcgctatcattgacaagcgtctgattctacgttttggcactgacgagtgcaagttctaagaaatattgttgagtataattgctagtgtgactccaagtaaaaacattctacatagcagagcaactctattcatggtggtagtaaatttgtgcatagcacttacttgaggtatgggagggtcatattcctcagcacatatggattatttttgacaaactcattccactcctcctggtctattctctcatcgccttttgtgtcagcctggtcaaatgtctgtttttgttttttttttgtttttaaaaagacttagaacaatacagaaggacatatttacttggtgttctagggagttaggacccataccctatcaacaatcatctcgacagcatcacttgtaatattcaaatctgattcatccagaagagccaacaccatctcctttaactacaaaaaaaaataaagaatagcaaagagaaaataaaatcagcagagttagcatgatttcattgctatagacgaggggagaaatgattaaataccaaaatagaaccaaagtttacacaacaactcttagaaatacaaacaagcataacttctctcatgcaattacaaacatgttatgtagctgcccaatctgttaatttgtttcactaagatgataattttctaggtaatatctatacctgacaatatagatatctgactgtgattcagtaaaaaaaagtgctactgagcattaaaaagtatatcaaacggtgctcaaatcaattttctggaactaaaagaagagaaaagtaacacttacctcatgcctttcaataaaccctgtctgtcttaggtcatataacttaaatgcaactgcaataagaagttataacattaattagtgaaagcaaatgttcaaatctaaacatctatattcttatgcccgacatgtttttggtaagaataaacaattgactgaagagtccttacatccagctttctgttcctcaggtgcatctggatgaaacacactaagagatcgaacaaattcatcaaattcgatgacaccatttcctttttgatcaaacaaatcaaagacctgcgattattttcaaacacataaatatttactgataatactgaatgccaatacattcaaaattacccttttttaaaccggaagcctgtcatgtaaaatctattctatttgttagtttttaaatgttgctctaatgcgcaagagagaaattacactgcttcaggccacttatatggattcacctttaggaaggataacatatgagtgttgatggtggatgactaaaaacaatgagcacaagaatgtaaagtgggaatcttttctacgatttatataatgatatgcagttctcttgcatactattgtgaagtagaaagaatgtggactgcaaacatcatttggacatattaattcaaaaagaatatggagaataaatattattatttttaatataaactgttagcactgaagaacagaggaatcatcaagaaaacctatacaatgacaatttggaacatattaacactcttaagtcttaccctatcaacgaagagatttgtcttcttgttcctaaagagagcaagatggaattcttcctggataagaaa

SEQ ID NO: 66826 - DNA, 4171 bp, Oryza sativa
  unsure (1)..(4171): unsure at all n locations
cacccagcagcttgaatccaaaaatgaagccgagcgcaaatcttaagcacaagacagctagtacaattcaaggagatggagcagcgaccctgtaagctgtacatgcaaataaaacagcaataagaacagaacaagaagggaatataggggtgcattacgaatatacagcaacaaagatgttcctaactgtggccggtgttctttgccggcccggcgaaaaaaagatgttcctaactgcttatatccttcaggaaattacaggtggcaatcttttactgttaaacctacagtctcttaagatagttcagcagtgcatatatgatacatagtacaacatactgttactgttaaatactatatagtatcttaagtctaaaacaaagttcaacagtgtgatttatattgtcaaacactacagtgttttaagtcagttcagccgtatatgattctccatatactggattaacatttcaagccgtggccaaacatgtaaatggattgtaatttgcaagattgttcatggtacttggaagggaacaaacaaataaaactacaaaaaagaaaaaaaaaagcaatctcaattcagttgaacagtgtatgatatatataatagagtaaatattttagagatgttaagttcatgaccagacatgtagattgcttgtaaaaactgttcacggtaatcgggaaggaacaaaaaataaaaattaccaaaaagaaaaaaaaatcccattctgaaccaactgtttaagaaaggaacatttttttgtttttgggccccagttgtgcatcgattgtccgaattatataacgccgtcagaatattcctcagattggtcaacccctcaactcaaatgggcggctcggcgcctcccaccagcctataagatcaatgcggaagagcacgatttccgcaggataaatcaagaaacggtagcactacccgaatgaccaaatccaccgagaagacgagaaacggagctctccactccactccatcaggggagaaatggatgatttttttttaaaaaaaaaggaaaaagaaacggaggagttcgaggaagacgaaatcaccatacctgccgccggaggagatggattcttgggcgcgattgcagctcagcgccggcagttcctcttcttccggatttctccgtcgtcgtctccggccgccgcttgttatatccttcgcttctagcagcagcgcctgcttctgtatctgtacttcgataatcctcttgtcgattgacttgcagaaaatgacacgacatcgctgtagcgaataggggagatggcgtcaggggaagggaaagagacggcttttactttccgcctcacttccgttttctgacccgcgtgctcgtagacgtgaccatcttggcttcatttttaatcgcctgctcgcgcagataaaagaggcttaaaaaagaaaagagacagactcaatttcacttctattttattgtcaaagttttattttagattcctctttactcaatctttttattttgaactaggcaactttacctcagcgcatacacgtggcacacaagtgcatgtgtcgctagcggaacgaacagcggtgttgtcagaaacaggaaaacgagggaaaaagtgattatcacgtaattagatgcagattagtaacatcattagtctgattttttttcctttcttcgggtaattagccatatcacgttgagttgctttttttacttttcaaatataatttaaggttttcaattaaaactagctgtgtggcccgcgcaattgcgtggctagcacccatataaaattatatttttttaacatgattttacttaaaatttcttaaatagttatctcgttgtcttaagattttaaaagaacaaaccttatcattctcgtgtttataattttataattttgtaatttttagaagtcccgtcaaacgcttccattatactcctctatgaccgtccactgcatcttctctttattatcattactccctccgtcccattttaattgcaaccataagttttcgcgcccaactttgatcgtccgtcttatttgaattttttataattagtatttttgttgttatgagatgataaaacatgaatagtactttactcgtgactaatgtttttattttttttttaaaaaatgtcaaataagatagacggtcaaaattaggtgcggaaaactatggctgcatttaaaatgggatggagggagtattattttaaaaatcgaacataattatcgtttaggtttatttttttacttctagaattccaccaaaacgtcagcaactttgtcactatactcctctgtggctcgcccgctgccgcccttctttattgtcattgagattttaaaatcaaacatgattatcattggggtttatttttttactttttagaagcccaaacctttaaaaattagaccttatactttttagagtttattgtctcgttgggtttcattttttcttataatttatagaaatcccgtcaaacggtgccactatactcctctacgacccgtccgccgcatactctttattctcattgggattgtaaaatcgagcatagctatcattggaattcatttttttactttctagaagacccaccagccatcagcggctctgccattgtactcctatatgacccgtccgctgcctctcattttttttttgtaattgagattttaaaaaataaaatatgattttcattggggtttattttttaactttctagaagtctcgccaaccgccttgaccgattacttcacgacatgcccgtcgtccttccttttaatcatcattaggattttatttggtgatttattaatagtttttagatgtcccatcaaccgccaccactctgttcctattagagtggttcctatataggcctgttacttaattaatctcgttatgtgttttagatggtattttctttcaatggtctttacttttttatcaccaatttcagaatttattttatttttcttattgtgttcttttgttatttttattttttattttcataagctgtttcaaaattgtattcctactttaactctctttttcatttgcctgattttagattttattttattttttattccaaatttaattcatctactattgggttctgatatgtactcttatttcaatactgattatatttaattttaaattgtattctacttaactcttcttgtcttttctttttttcctaattttgattttttttatttttttattcctaacttttactaatctcgtattggattttttattggactctttgttttttcctatcaacctcttttttttggaggaatttttggaaaagcatcggtttttatggaatcagatttttttttgaacgtttcacgaaaactttttcttcaattaacaatttttctcactattttttttctttttttaaggaaaacgggaacctttgttcgcgcttgtttgtttttcgggcacggaggtttttcgggaggaccggtttatacgtactattttttttaagaatcggacataaatctttttttctcactactttttttcctttttaaggaaaacgggaacacactttttttaatcggatagaaaaaaaaatttcgcgcttgtttttttggggggcacggaggatgggatttttttgtttagaatcggacattttgttcgcactattttttttccttttttttacggaaggcggaaacccgtttttcgcacttttttttatcggaggctgctagttagcaattcctaaaatttttagcgcttgtttttttttccatacagaaatcttttttttcctttttttatggaaatctttttttaacgttgcttaacctgctgctgcagctttcgtccccctaatatttgttgatctgtttccgtccatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66827 - DNA, 1667 bp, Oryza sativa
catatgtatgtgcaactcagtgataattttgaattttctgatgttcaaaatttgctttacacattttaacatcttgaaaaatgctttttaaatacttaatgtactctgtcctttccaggtttatttgctaccaaaagtttgccctggcaatggattattcttttattcttgtacttacctgagctatattaatcggagttttttttttatttgtaggttcaagaaaagaaggtcaaaaaggtatctgagatgaatttgagcccttcaaatgcatctgcaaatggtagacctgctggcagtaatgctagtggttcgagcgcatatctcccaaatggtggcatttcaaaacctgttggactcaattcgcttcgcctgcctgtggtggtagtaccgaacttaaaattttcattaccacaagaaaatctattcgaaattggtctcagacagtattattgagctaattcctgccatttctgttgtgcctagcatgcatcttcaactattcagttgtttttattgcctcatatgtatttcctgtgtttattgtaactttatttctttgatttgttatatttacttaactttgtatgacaggttacaagccaagaaacaagtctttctgcaagttgccgaagagtctttacgcatgcacatgactaccatataaactctatttcaaataacaggtcttctacattattaatttttttatttagttgtataatagatattatttgaacttgttgctattgaatatgaccacgaccattagctccaaatgagtgttgctagaaaagggccttcttaagggcaaaagcttatttggtttcaccttgcacatgataactgcatctagcatatttgtaaccaaccaagccacctagcttcacagtttctgcatatatgataaatttgcatcccacaatatgccaaatttatttgctctttgacataccagaataaagttctcaatatccttttagggactctttgtttgataatctcaatgtaaaacataccttaatgtgccttaactagtacggaaatcagggtagcgaaagcctaacagattcatatctactacctctgtagtaatattgtatagttttgggaagttcatctgaaccctgtagcccaagatcactatagtcaattcattctccacaggagatttttgatgcttgtgccgtatttgtgtgcgcgctgaaaatttgtcatctgtagtaatatcgtctgtgattgagctgtatgccatcagctatagataatttaatacaccacctcctactttccatgtgtgtttgctatatattttgctgatgtgcatctcatatacattcgattagatgtaatgtaccctttcgagttttatgtagtgacatattgttgcctgctcttttttttttcgacagtgatggtgagactttcatatcagcagatgatttgcggataaatctttggaatttggaaattagcaaccaaagttttaacattattgatgttaaacctacaaacatggaggacctgactggtataactttcaaatcttcaaactcttagctatgctgactagtgagtattaacatatacagccttttctcacacaatgggaaaaaaatgcagtcctatatagctacagtaagcaaaattatgtgactgatgttcaa

SEQ ID NO: 66828 - DNA, 1923 bp, Oryza sativa
agacatattctcagtcgtgattacatgacactgaaggtctgtaccagtttacctgttgacatccctttactttttattgatcttagtcatcaagaagcattgattatgttggatattacttggctacatcatgcttcagttatccctagacaggataaccagattagcagggctacctttagatgatcatctacatatctgcactgcattgcatatactgcctcagatgtttcatacttcatttttcactattatggtctctatattcattgtaactgctatggtttacattctgggaagctggtgatttatactattttctgtagccatagaggtgttatttttctgcagctgttacttcgatgtttttgtgttcatataaattttttccttttgttccagctttgggatattaacatgaactctggtccagttgcaacattccaggttcatgagtatttaaggcccaaggtaattctgtacatgttaagatgaataatccatacttctttgaggatcatgaacaataaactatttcactggagtaactctgattcatgtattgcttcctgaaactgcagctatgtgatttatatgaaaatgattccatttttgataagtttgagtgctgtcaaagcggagatggattgcgagtagcaactggttcttacaggtgttgcttttgctcatctcagttatggtactgctcggtctccttcatgtgaactaattgttagttgatgtatgctctttcagcaacatttttcgtgtgtttggttgtggcactggtagcaatgaggcaacgacacttgaagcaactcgaaaccctactaggtaatccttctcctatatgaataatggaagctaactttatactgtacacatctgctgtttatttctgcctgtaaaactaactataatagtgttcatctgatgcgcctctaccagtcccatttgctccaatgaagtggagtatttcaaattcagctattggcactaaccatcttttccactcttatttgtctaatgtgtaaccaggaggcaacttcagaatcccacaaggcctgctagatctctaagcactctgacaagagttgttagacgaggttaccttcatgatgtgtagcatgtttaactttgtagaagctcgtcatttcaactactaattttgaatccttatgcaggtgctgaaagcaccggaatagaggccaatggaaattcctacgatctgagcacaaagttgctccatctcgcatggcacccatccgaaaatttaattgcttgtgccgctgcgaacagcttgtacatgtactatgcataaacaaggaggggataagaagagcgacagtatttttggtagctgctcccggtgagaagtgttttaacccctggtgcagcagagcagggagttgctggtagtggtgttttttttgggccggtcacatgctgttcttttgagtgccatatagagctgtccagagtccaagaggaagtgactcgatcattcccgggaagcagcttgattctgattattttttttcgaggggaaaggcctgtctttcccttataggttcatttagatttaaaagataagatttctagttcgacatttggaaggaacaagaactgttgggaatctgtggttagatgataaggggatgatcttccgttgtattcatgttgaaattatggtcttgtaacttcaggacagaggcactgaagcttttgataattttgtttttacaaaagtgatatttctttcctatgtgccgtagcttttctttcctaccgaatgcctgggtagcagtccgtcgttatgcgacgtaatgcaaaatggatgagcatcaaaaccagatgcagacatgtgccatcttttctgctctcccgacttgtctaagccctttatttgcttatgatttgtat

SEQ ID NO: 66829 - DNA, 3066 bp, Oryza sativa
gccctcctcgcccccgtcgtctccgagctctaccactccgccaagccccggagggaggccgaggccctggtcgaggccgtcctcagctacatcagcatctgcagcagccgcgccgcccccgccgccggcgatggcgccggcgccggcgccgacgccgggagcctgctaccggccttcggcgagctggtgaaggtgtggagcgtgcgccactcgagggacaggtgcccgttccaggtgctcttccctcttgtcggggaggacgccaggcgggagctcatgagggaaggtgcagcgtcgccttcctcgccggggcggtggttgccgaggcgttcctgctcaggctctgcctcaaggtgcagggcgcggcaggcgcgtcacgcgccgagctgcagaaggagctcaggatctgggcagtgagctccatctcggtcttccagaaccagcaattcttcggtaagacttgatatgatgctacctgtgtttgtatcatggtttctcttaggattcaggtgcagtgacccgattgtgatgaccgttgtgctgatggatttcgcaggggttctgctgaacatgctcgtgaatcctccgctacctgtttattcactactggtacgtgtttcatgcttaatgattgatttgagggatatagttagtgtatgactaggctagcaacataggggtagtatgcactagcctcttaatgcatttcggcatcatgaacattgtatttccacagtattgtcattccaatatgtatcacaagaagcctaggatttgaaattaacttaataagctcatgccttgaattaacaagcgggtgtaagctcaggtttatcattatctgttgtgtgtttagttaattagcacaaattacctttgtgaaataagaactctgcaacttgttcctttgtacttcaattgtgcttggactcaggagtctgtgttaacttgcggaaattaaagaggagaacagtattaggaatattatgtttcccaatgctggtgttactgtaccattattgctgtcgatgtatcctcaaggaggctgaattgggatggagttctatctcatctttgggatgagcaaacaggttgaagtctgaactgtggatattcttacacccttttattcaattgataatatgatattcactaggaatgactatgctgtgttgtgagaagctagcaaacttgatgttgcctgaacaaatattattcgttatactgtttacttgtaaggaaatgctgatcatggccatattatttactccctaattaattaagttcaccaatataatcatcatatattgttgcgaaactaatttattttgtatatcgcacttgttcttatgtgttccttgagtagatgactacttgatcagtttccttcatttactctggtaatatttcatttagaagagtgagctgttagttattagccatcaaatgtgggttgtgacgatgccattgctgggattttgtgccatcttattgatgctgcatattggtttcttatgcataattcagagtgctgatgatgaaatcttggtgagagatgtcctttatgatgctctgattttggtggattattctttcattaacaaaggagcaggagttgatcaagctgatagctcccttttgcccctttatgtgtcaagattgcttatcactcatgatgccatcaatgacgccaggtgataaagtgtttgtgtaaccggaacttagctgatgttagaaatttctcctcattccatttccttctgacaggagcaaaggtgatcaaggaagggcgatgtctttcatgaatgccttcttcacttcaaacatccccacttattttgccaagtgcgctactagtcaagttggcttcaaccaactcagcaaaccagctgctatcacacctcaagctcttctcagtatgtattgatatagcatgattcacttgattttcagtagagtgggttgatgtttttatagagtaactaatgaaatccctatatgtttgctttttgacagagtggcttgtagatctggaagataagggcttcaaagtatttggagagaatgtttccaggattagggagaggctgatgtatgacgaggtcaagaatggttaccagagcaggatgactcactcagatgctgaccttttcttcattgacaagcagagcggtggggaggttatggacacaagagctggtgaggatgaagaagctgttgagatggaaacagcagacaatgcttttatggctgctgctcagtctatgaaggcgatggctaatggcatgaggaaaaggaaggattgcggggctgaagacgcaaatgtggtcaagtttgtgaagtacaaggttgaagacagctcagtgaaggattacttcttgtcggcaaataatggtatgagcagtggtagtgaggtagagaatccacagtctgatgatgagatggaagaaactgattgatggatagagaggaaaccatccgctaatgcttacttgggagagtcttttggcgagtctggagttgggacgattgctgttgcttcaggttccccttctgtaggatgtcatgcagcttctgtctggatgatgaatgaagcgggattctaggataataatctgcaacgcagagcccgaccccagccaggcttaccgatatagtagtaactgcttagctaacttagactcgatgcatgatgctacaaactatatatcatgttctcttctatatgcaatagagactttaaaatgtagatctactttaaagacttctgtaagagaagagtaccttttatgttatcccacggaacatcttttaagttagtgaaatcttagcatttgtgtagctgttacgattagtgtttctacattgcaacattggcatgttctgtgtagagttgctattttctgtgacgatcatggtgaagacgtgaaatatcggtggattgttcggtaggacgctcgggtgaaaattgaggtgttgcatcacaagttacgtttagatgttgtagagtagttgcttgtgccgtttagatgggaatcatgtgatccctttaaagcataaaatgtg

SEQ ID NO: 66830 - DNA, 2184 bp, Oryza sativa
cctccgactccgagccgaggagctccggtcctacgccgcggcactccagggctgcgccgccagccgcgcgctccgccgcgggaaggccctccacgcgcgcctgctccggtccgggccgcgcccggacgcgttcctgcacgactcgctgctcaacatgtactgcaagtgcggccgcctcgcggacgcacgcagcgtgttcgacgggatgccgcaccgggacgtcgtcgcctggacggccatggtctccgctatcaccgcggcgggagatgccggtgctgccctccggctgttcgccgagatgagcgaggaaggggtcgtccccaacgggttcgcgctcgccgcggcgctgaaggcctgcacggtgggctcggacctggggtttacgcctcaggtgcacgctcaggcggtgaagctggaaggtttgcttgatccatacgtctcttcttccttggtcgaggcttacgtgagctgtggcgaggtggatgttgctgagagagccttgttggactcgccggtgagaagcgatgtgtcatggaatgctctgctcaatgagtatgctcgggatggtgactacgccaaggtcatgcttgtttttgataagctggtggaatctggtgatgagataagcaagtatactttacctactgttctcaagtgctgcatggagctcggtcttgcgaaatctggtcaggctgtgcatggtttggtgatcaagagagggctggaaacagatagagtgttgaacaattgccttattgagatgtattcaaagtgtctgtcggctgaagatgcctatgaggtctttgccaggatagatgaaccagatgtggtgcattgcagtttgatgatctcttgtttcgatcggcatgacatggctccagaagcattcgatattttcatgcagatgtcagacatgggagtcaaacctaatcaatatacatttgtcggcttagccatcgttgcatcaagaactggtgatgtgaacctatgtcgcagcattcatgcacacattgtgaagagtggattttctaggacaaaaggagtgtgtgatgccattgtaggtatgtatgtgaaaactggtgctgttcaagatgcgattctcgcctttgatcttatgcaggggcctgacatagcttcttggaacacacttctctctggattttatagtggaaacaactgcgagcatggtttgaggattttcaaggagttgatttgtgaaggtgttttagcaaataaatatacttatgtaggaattttgaggtgttgcactagcttgatggacttgaggtttggttgtcaagttcatgcatgtgttcttaaaagtgggtttcaaggagattatgatgtttcaaaaatgcttcttgacatgtatgtgcaagctgggtgctttacaaatgcacgcttggtatttgaccgactgaaagaaagagatgtgttctcatggacagttgttatgtcaacatatgctaaaactgatgaaggtgagaaggcaatagaatgcttccgctcaatgttgcgagaaaacaaaaggcctaatgatgccacattagctacctcgctaagtgtttgttctgatttggcgtgcttgggcagtggcctccagctgcattcatataccatcaaatcaggatggaacagttcagttgtttccagtgctttagttgacatgtatgtgaagtgcgggaacttagcagatgctgagatgctatttgacgagtcagacacacatgacttagttgaatggaatacaatcatctgtggttatgctcaacatggtcatgggtataaggcattggaagccttccaagagatgatagatgaggggaatgtacctgatgagataacatttgtgggtgtcctctcagcttgtagccatgcaggattacttgatgagggaaggaggtacttcaaattgctgagtagtgtgtatggaattactcctacactggaacactatgcttgcatggttgatattctggccaaggctggaaaactagctgaggctgaatctcttattaatgagatgccattgaccccagatgcatccttatggaagaccattcttggagcatgtaggatgcatggaaacattgagattgctgagcgagcagcagaaaaattgtttgagtcacaaccagatgatatatcttcttgcatattgttgtctaacatttatgcggattt

SEQ ID NO: 66831 - DNA, 3979 bp, Oryza sativa
tcctgcaccccgatcgtggagtaaagaaggaaccagggtgcagctggattgaaatcaatgggaagttacatgttttcctgtcacaagatgggtgcgctaaatactaaaatttgagtggtgtatttcacccatcttggtcctgcaatctgaaatgtcaatgcagtcacaggccaaaaaccggttccaggtattatctagttctgatgaatcttttttaagagaattatcattgtacatgatgcgtgttcagtatccaatctacataactctgctaattggtgaactgttttatctgatttaaacaggctaatcttagggtaaactatactgctggaaacgtagatttgtctgaagacttatatagttgcccacttaactggcagtaactcagtaagtctcaatccatatagttcaatctcatgctatccttcactttcagcaaatctatctgttaaatcattgcatcctttttattacagcacatatcaggataaatgcagactgaggagagttccttagtcgaggcatatggaaatggtaaggcaatattgcctgccattgtgagtaaagaattggttacagattaatgtggcacacgaagagcctgtcctacttcagtggatactggattgctcatatcacatttatattcaaattgggatggttgtgcaggtgggtgatcaacttgttgaccaacttaagtaaggtctgttcgagttcctcgccattattccatggatgaacctcggccttgagaagctgtttgttgctgctgatgagattccagagggggtatttctcctttggcatgacatagtccccttcccctagcttaagggaggggcaataatctcctctgccatcaccaatgtagatgaaatgccttttaccattggccgtcgcctgaatcctctcaattatcttgccctgcacatgataaagctacactttagcgggggaccatgcatgctttccattattcatatccctcttcatctgaataaatgcactaagattttagcgcaaagaaactttaatacttataattgttgaacaatgcaatattcttatttgttatgtgtaagattcagattgcataatccatcacactctttgctttatccatgatctatctatactgtttcttttggacagatgatgctgtttcttttgtctccatcagccacgtgcatcggggcggacgcgctaaaggctgacatgaaaaatgtgaactgacctgtcaatctgctggtgtcctactgtccataccttgcacatgttctcggggcagaggctgcatccatggggcgagctgtcgtcggggtcgtggaacggcgagatcctcagcctgccgttgccgtcgacgcgcgccgggttcgtgctgatctccgagaagcatccgaggacgccgtggtgctccagcacggtctcgatgaagaaggcgttggcgtcgctcgccaccctcaaatcacacctgcaacaaacaacacaacaggtggaacacaaccaccaccaccaccaaagattatccatggcgccatcagagctttagaggtggatggattgatcattgatggtgcggtaccctaatgccgaggccgtggtgatggcggagaggacgtgggcgtcgaggggggcgctcttgaggcagtcgcggatgtcgtcggccgacctcccctgggcgtgcagctccaccatcatcctgtcctggaagaagccacccatcctcgcaggttcaatctatgcatgttcttgtgttctgtgtgtgtgtgcgcgcgcagggtgatcgtaccatgagggggttccagcgcatggtggggcggaggcggcgaaaggcgtcggaggcgccgagcttggtgatgacccagtcgtcgctgtcccactcgatgatggtcctgtcgaagtcgaacaccaccaccaccccgcctccggcggcggcggcggcggccgtgtcgccgtcaacgccagcggccatctgagctgctccgacggtgaccgggggaaggccggaagggtcaagatggagtcgcggtcgccagacgaacgcacggcggcgcctgactgacgccaacgtttgcaagcaaatttcctttgtgacttctttggtggcgtggcgtccgtgtcggctttatataggcaaggccgcaaggcaccccgcaccccggtggtggttgttgggccggtggcgacttgttagggttctactctacgcgtccaccacaccaccgcaatccgcaatatgacctgtcctgtgccgtgttctccgtttgcccgcgctgccgtctccaggctgacttgcctgcctccctcctccttacacatgtttgctctctgattctgtatcccatggtaccattaattagtagatcgatcgtggtcatcgatttttagtacatctgtttagcgatcatctcttttatatttaatctatataaaagcctacctggaaccgacaggtattgtccgtctatagtaactacacgtcaaccactgctactactgaggattggaactgggaagtgggaatagcctccatggacctattaaattgagcatcaatattctttggaagctctgagtttctcgttgttgctagtgctgtagacattatttttatggtttgaccgataagatgcaaaggtctacctctccgttccaaaaaaaaatcaaactctaggtttaaatcaaaagccagtaaaaataacattcatagacatagtatagacataacaagcaaagaggcaaaaaaaaaaaaaaaaactaaacttaaacttcatgtcacgattacatgatagtagatgtcatgcataaatttgtggtaaacacaatatctaacggaactgttttttttcccttcgaggagacatcccctcgttttgtgcatgtcgttcaaaaaattataaaagttttctaaaaaaaaattatcaggatagatcaatatatgatatatcttctcgcaaacatgcgggttaaaattcgatttatacaattcaaaacaaaaataacaaattttaccgtgatttacacgttctattcatagtcaaatttgttatttttgtttctacttgtataagttgaatttgcatgtttgtgaagtggcatatcacatattgatctaccctactatttttaaaaaaaattttggatgactttttaagtgacatgcagaaatgatgagatatcctcttaagggatgaattgagttttccatatctaacacatacaagcttcttactagcaggggctaagcatctcgaactcgcatagacctcagcagtttatgttactaagagcaagtttaatagtatagccaactactggctccaaatcgtctatagtcaatttagtagtcaattcatacaatagttacctataaatatatactatacactattaatatctggtcccacctatcatacacacattatgtcttgaagcccgtactgcagctgaccacaaatctgtagcccgctgctcatctctcttctttcatctcctccatatgtgtttatagctggcttatagcctgctattgtacttgctctaatgcttcggcacgcttatctccagtccctgcatcacgcggttgatcatgtcgaggccagcctcgagttgcatgaccacgcgcttctccgcgagcagttccggcgtgaaaagccctttccacacttcataccaagccatcgcctcatctagccgaggcctctcgcccattaggtaccgatagttggcgtacatccatttcttgaagaacccttgtatcaaaagtggcaccatgtactttactggcacgatggatgcccacctcataacaagagggaagaagttgttgttttgtagccaagtcattcttaccgagatctcgagatcatggagagccttcctcatgtgaggcagcacatgccgcttgatgtgttcgtcccagctcattggatcgaacacctttttccatggcaacgcaagcctgtagtcgtagtca

SEQ ID NO: 66832 - DNA, 1457 bp, Oryza sativa
ttgttcactattgaccatatactctggttatggttttgcagagggcaggcagaaaaagagttcaaggttgaagttgagtctattggtcatgttaggcacaagaatctggtgcgacttctaggttactgcattgagggaagctacaggtaaatctgtgttttgttagttagcctttatattttcagttgatcgttcatggatctgcaggaaattgtatatttttcttgcagtgactgctacaatatgtcctcttgctgttacacagccttcaatgtcacaagtcaattacaacttaagaaagaaacaaaatgttcaagtctggcagctcgacatggtcatatttaatctattcagcaaaatatattaactgataatgataccaagtactggtataatggttagaataatctgtctttttagatggtttatgtacttaattatgcaaagcactatagaactcgaaaaatatgcaaagggcccacttcaaagcctagaagtgtctttaactgttatcctactctagtatctgcatatcgtgtttccatagatatgctttggttctaaattttctgattctgaaccatttgctgcaatcctgaaatcttaagttagcatccaggtaataagaaacctccacaacgtcagcttggtctgctgttaactttggtacgcaatatttatccatggacctgatatattgctagagttctagaaatggagaacatttaagaggatctacccgccttagtaaaaatgggtgttcggaatgtacactcaccccaccagctaactgaactagaagtttctgatattgatagattgtctgctttcttaatcaaacacaatcatatactgtataaatgtattactacagaggcatattcatagaactatagaagtccattaacctatatcaaactaagcttttccgtgaatctgttaggtttacagcaaaacatcattaggcttctcacgttgcaggatgcttgtctatgaatacatcaacaatgggaacttagaccagtggttacatggcgcaaggagtcaacatggtgttcttacatgggaagcccgcatgaaaattatccttgacattgcaaaagcgtaagaaatgaactatcagtgattctgatttctccctttgtatatgagaccaagcataaaatttgtaaacggaatgctgtgcagactggcatatttgcatgaggggatagagccaaaagttatccaccgtgatatcaaatcaagtaatatccttattgataaagatttcacaggaaaactttctgattttggattatctaagctcttacgtgctgggaaaagccacattactacccgagttatgggaacctttgggtaagctactaagctctcgttttaagttgtaattttcctgattgagttgcaggggctgtataaaatactgatcaacatgaaattcatgtttaactatc

SEQ ID NO: 66833 - DNA, 1609 bp, Oryza sativa
ggtggcggtgccccctctctagccgatcttatctcccccttctttgtctagcaccagctgctaccgccacagcaggcgccgtctgtcgcagccgctcgacagcgccgttcgacagtgtcgatcgcctcctctcccgccgctgccgtcgcgccgtccgagagctcatcatcgcgccggtcgcctcctctccttttctcccgccgccgccgtcgcgccggccggctctctcgccgcccccgctccaccgctagccacctctctcccctctgccgctgcgtgcacttgagagaatcgggagaaaagagaagagaaaaagaaaagaatggataaatgtgggacccacaccattttctctcacttacatgtgggccccacatatttattttaacttttttgctaactaggatgccacttcagcgaaatcgggcagctatactacctcgggacctttttttggacggttttacatagtttaggggtacacatttctgattttgtgattaaggtacttatagaaatctcggtgttaagttgagggacctccggtgaacttattcctttcttggcaaaagcctgaaatagcagcggaaaaggtacactgaaggtccctcaacttgtcatcgagttacaaaatcgtcccccaaccacaaaaccggatacaacgcattccctaacttataaaaccagtgcaaactagatccctcggcggttttgactccggttttaaccgacatgacagttgactcagcatgggacccacgtgagccccacgtgtcagcgtggccacctcagcctcctctcttcaccctgttctctccctcctctgtccctctctctcacttcgccgaacaacagaccgatgctggcggcggtccagagcagcagccgtgcctccgcacccaccaccgcggtggcgcccgcttctaccttggcgcccaccgccgcggcggtcgagcggtccacgtggtggcgcgacgttgagcggcccgggacagcggcgtggcgctgtggcggtcgagcggcctgggctgccaccatcgtcgtccgtatgcaaccaatcgcaaatttggggatgaatctattgatgggagagggagacgacgaggcacgttgctgcatcaagacagagacaaggagcaccggtcaccaaggacatcgggctagcagtaggcggcggtgcatcgtgtgtgtcttttcatcactgaagtcttgtggagatgaagagttgaatacacagcagatcagcgtgcgctgtggggcagcaaggacggcgtgcagctgccaccgacttttgcccccacaacgcttgtcgcgctgcctcggccggcctctgccgccgctgaccgtgcgctgtagcctataggtggcctccatgccgtccgggtcgaggtgcaccgccgctcgccgctcgccggacccgtgttgtcttcgtcgctgtcgctgtccgcttccacccaccaaacgcgtccctctcctccgacggtgggcacgtcgtgcgcgcatgcgggatgggaggaacggcgtgacaagacggatggcaaagagtatatgggcacggcggacgcgggcggctgccgatgagggaggagatgccaccggcggcggcggc

SEQ ID NO: 66834 - DNA, 1729 bp, Oryza sativa
tcctgcagccccaactggcagcttttcttggacatagatgccctcacagaccaacacaaggtcttttcagcacaccttgtcctcattcgtgtgcacccgggaagaattttccggtcagtcacccatcctgaaattgctccaggcaaagttgcaacttgttggtatgagtattctattaatcctattaagccctgtgccaggatgtcacaacctatcatgacggctcgtagcagtgatgcgcacagagtgggacaaggcactagaggagaccacgcgattgaagcactccgttgctgacctagagctgaagctcgtgtttctcgagccctgcgtgcccccactcccacaaccgctgccttccttgccgagtccttcctccgggtgatcccatggtgtcccccgccctgtcgtatccctctccgtcatcttcgtcagcgtgctcccctctaccgctgttgtgtaagctcgagggaggggagacagcgagcgagacgggagtcagcgagtgcggccgtcgcaacattggggagatggtgagcgagctggtttcgaggcgagagagaagttgacgttgccgctgctgcttggaaatcttgaggctcctcgttgttgcctaccgccacccctggccttggcctcctcgtcgtcttcctcgtctgccaaaccaacgccggctggtccttcctgttgtcttcctctcccgcctccccgccgtggctagggcgagaccgacaacacctgtgtcggacctgagttccccaccgctgttctctcccgcctccccgcctagctgattctggccatgcatggccattgcctctcccaccgacgatgtagccgctgtctccggctcttcttccgcccgacgtcaccttggttttgtcggtttgcgccatcgtcctgaccagcgggagagagtggggtgaaagggaaggaaaaaggagaagtggtcactgacccatgggttccacatattatttttttattgtaatgccatgtcagatgacgaagactaagtcaatgcgatatgtagatgccattcaacgaaaatcaccttcaaaaccaccgggggagttattttgcatcggttttaataattgagatattatttttcagtaaaaaaaaggatatctgatattgcgttgagagataccaatcagactcgacctatattggagggagtcaacgtggacttattgcttacaagggtaggcttgcagcccatctttgagtccaaaatggactggactcaccccgtcctggcctgtgaacacgttcggccttgtcccgttgattttgttaatatttgggacactgagatcccattaatatgatcttagtcacgagctgtgaaatggttaaccgtgccttccagcgtgcgcgcgggttctctcgctctttttttttttcatttagaactcatgacttttattaatattaaccatttagaaacataggacatgagttattacactctcgtaaacgtaaggagagaggctttccaacaaactgacattagggcaactaggagtctaggatgatgacataaacgagaattactttaacagtaagcttaattaccttgtcgatatcttcttgcttctcctgccaatttatcctgtaatcatttgtcttccttggtatctactacttcctccgtttcacaatgtaagtcattctagcatttctcacattcatattgatgttaatgaatgtaaatggggtgcag

SEQ ID NO: 66835 - DNA, 1153 bp, Oryza sativa
  unsure (1)..(1153): unsure at all n locations
attcancggcgtcatctattaaaaaacggagggagtatgtagaatgatgattcaaatgtaaaagtaggatgttgtgcttttatgagagaacagaagaaagaagatcatttagaccatgcatctaagggctaaaaaattaaaatgatacggcttaatgagagaagaaaagaagagagataatttaaaccgtagattaatcatctaaggactaaaaacaattgatgcaatatgacttaataagagaaaagaaaaataacatgaactaagtgaggatgaactgtaggtatataggatattctaaaaaataaagagataaattgaacatattatgtgaattatgtgggatgatttgacatgcttacattttaaatctctaaaatttaataaattattaagttatagataatatagcatgcttgcatgatgtttaaatataacaattcttagtggggatgatgtggatcattgcatgttaatttttaggaattagtgtgctataattaactttatataagagaggatttctcgattttaagtgtattatataaaatcttgtatgaccagataactcactgcacgataagtcaagtgactccaatgccttgagatcactgagttctcgtgtattcttctacacagattgttttgagataagttcaaattctttagcgtaactagctagagcattgatctcattagggatctttcagtaaataatctgttgcaagataaaatcgaggtttactgtgtacacttgtggagaaatcatttttactcccggttggtaaccccctatagtcccgattttccaaccgggagtacgaatctaagactaaagatcggttcaaatatctttgatcttcagtcccggttggtgttaccaactaggaaaaaagagaggaatctttagtcccagttgataacaccaaccgggactaaagagagagtagcactttttttttcttttgccagatttaatctctatattttctcccgaatctagtgccatgtatatccctaaatcaatccccaaatccccaattcaaagtaacatcccaaatcttaagttacttataaatataaatcaaatacatcacaaatcctaaaaaatacacacaaatcaaatacatcacagattatacatctcatatcc

SEQ ID NO: 66836 - DNA, 1152 bp, Oryza sativa
caggcgaaagcaagaagatttgaaactgttgtgcatgatatttaaccaagacattagaagattggccactcaggtatgtgtccagaccaaaataattgacagggacctgaaatatagtgaattccatgcattgacttgaattatgcattctatttaatttgactaggttatcagagtgaaatggtcactgcatgctagggaggagataatttttgagctgctgaagtatctaggaggcagcaccacaaaatcattacttgaagcgataaagaaagacgcaagacaaatgattgaagagcaggaggcagttcgtggccggctcttcaccatccaagatgtgatgcagagcaccctccgtgcttggtcacaggtatgagctataaaatgaccttctgaatccttgtgcattctaaatgaacatcaaatccttatatcctactactgaacagacaatatgacactatgaatctagttatttagttagtgatagctgaagtgtcatgtgtgaaaactaaaaactctgttggtgtgctactcaggagaagagccttcgcattacgcataacctgacaattttcggtgggtgtggcttggttctgtccatcatcgccggattgttcggaatcaatgttgatgggataccaggagctgagaacactccctacgctttcgcgctattctccgcgctgcttttcttggtaggactcctgctgatcatcgtggggatagtctatttcggactgcagaagccgatcagcgatgagcaggtccaggtgaggaagttagagctccaggaactggtctcgatgttccagcacgaagccgagacacacgccagggtgaaagaaggggtcttgaggactgacttgcctcccagagctgccgatctcatatgtgatgataatggtgattcacgtctccttgtttgtgactgttgaagttgaaatagccaataggtctagctgctttgggtcttcagttttttttccctgtttttagcttcatttccgttttgcatggtcgagcacgatctgggctctctcgccttcccggatcttgcgcagttaagccggactctcgtcgcgcgcttatgtaggagtccactacattttcagttgtaattcccttattagtagtccaatgaaataatca

SEQ ID NO: 66837 - DNA, 1467 bp, Oryza sativa
cgattctgttccgaacaacaacctaacatctcttgaaactctggacctttcacttaataatttcaacaagaggattgcacccaattggttttgggatttaactagtcttaaacttctagatatctcagatagcggtttctatggaccatttccaaacgagataggcaatatgacctctattgtggatattgatttatcaggcaataatcttgtgggaatgataccatttaacctgaagaacctatgtaacttggagaaatttaatgttgctggaaccaacatcaatgggaatataacggaaatattcaatagattgcctagatgctcatggaataagttacaagtgttgtttctaccggactgcaacttgactggaagcctaccaacaacactagaacccttgagcaatttgagcatgcttgagcttggtaataacaatatcacaggtcccatcccactttggataggagagctcagtaatctaacaatgttgggcctcagctccaacaatctagatggggtcatacatgaaggccatttatcaggcctagaaagtctagatttgttgatcttgtctgataataaccacatagccatcaaggtgaattctacctgggttcctcctttcaagcaaataacagatattgaacttcggtcctgtcagttagggcctaaattcccaacatggctcaggtatctaacagatgtatacaatcttgatatctcaaacacaagcatatcagacaaggttcctgactggttttggaaagcagcgtcatcagtaacacatttaaatatgagaaacaatcagattgcaggtgcccttccatctacattggaatacatgagaacgatcgtaatggatctcagttctaataagtttagtggtccaatacccaagcttcctgtcagtctaaccagcttagacttctcaaagaacaatttatccgggcctctaccatcagacataggagcgtcagctctagtatcacttgttctgtatggcaactccctttctggttcaattccatcttatttgtgcaagatgcagtctctggaactgttggatatatcaagaaacaagataactgggccaatttctgattgtgcaatcgattcaagctcagcaaactacacatgtacgaatattatcaatataagcttaagaaaaaataacctctcaggacaatttccttcgttctttaagaactgcaaaaaccttgtttttctggatcttgctgaaaatcaattctctgggacactgcctgcatggattggggaaaaattaccttctttggtattcttacggctgcgttctaatagctttagtggtcatattccaattgaacttaccagtctggcgggtcttcaatatttagaccttgcacataacaacttttcaggatgcataccgaattctttggcgaaatttcataggatgacactcgaacaagataaagaagacag

SEQ ID NO: 66838 - DNA, 9329 bp, Oryza sativa
gtgagtttgagtgtggtgtgtatgcatgagtgactttgtgtgttcaacttgtacttgaaaaaaaaaatgtaaacttactgtgatatgtttgcgatgttcatttgcgatagttttgattttgatattctgatatttttggtattgtttttatttccaacgttattttgattacatatttgaggggaaaaatatgggaacggaaaaggttaggacaaattttcgaccgtttttatcactagtagcgggtattctctgccaagtgtttctctggctttgatgaaatacaattttggcatgttttgctatgggcacttattttacaaaacttttgagacccaaaccaaatgcaagcagtttttatacctcgatactgtttctcaagacttgagatgtttactaattcaaatcagactggtttatactgaagatgattatcatcactcctgtacactaactcagagaagcggaagcatgtccaagaaaacactgaaaaatgagatggcaaataaaaacaagacttcccttttaaaaaaaggactagccggtggtggtggtcgtggggtggggggatactggtcggtgttggggcagccaattatgataaggtctatgtacaggtggttataagctggactcgcttggtgcaaaaaacacaaggcaatgcagcatgaagagcctgtgtttgctgccagtgaattattgaactagtatctaaatacctcataactcaatgaataagttctactgttctacaaggtagaagatgcactccataatctttttcttccaaggaaaaaaatatatatactctaatggcaactgcactatgccttttttttcttagtaataagattcatttttttctccaatagcattgcaatacagtactacttaccgtttaataatttggatatcaaaattctatttgtaagaagggtagagacctcggcatatggatacgggtcattctatgacagatttgcaggtccagtactggagtttccaaggggaaagtttcataccttgacttgtgcagtaatcatttctcagtacctttgatccatttcgttcatcaattgatagagatataggaagaagtgtcagccaaacattgctgttctagctacagcaaccttggatttggaatttgtagagcggatcagcctctgtaagggaagcccatgacacagactggcgacctggccacaccgacctctgaatcggtggcggctcccgtctcccctaaatcgtgaggttctccagtataaacgagctgcttggggcccgcccagccgcgctgcctcttggatcgatttcccatcgatcgttgctgtgtcgagctccggtcaggcatacgatcgaacacctcgaggggatcatcgtccacctccgcccggcaagccgccacggaaggggcggcccagctgaggaagcaaccgtggtgcttcctgaccccgacctcaccggcaggacgcggcacgcgctagccctgcactgcagcgagcgcgcgaggaaggccggcggcggcgagtcggtccgcagttgccgccggtgcaccgcggccaatcgcatgcgcaggagggccgtgcgcctgtggatgggccataaaacggctagtacaggagcaagtctatttagcctctctctcagctgtttccattgatcgaaaaagtatactttggacaatttcgtttcccccccccccccccactttatctctaatattaattttgtcttctattttttaggattttcgtttttgctcatactttttttttaactgaaagagacgtttacctcttatttggatgatggaagttagttggatggggtttatggcagaaaaaaaatagaaaaataaagagaataaagatttttcgaattagtgatttaactttttacccctggaattctcctctcctcaaacccgagacctagccggcggcgcaggcggcggcggaaagcgggcgtcggccgctcctctcggcgcgagcaggaggcggcggcgaccggccggcggccaagcggcgaggctgctaaacatggcgccaaacacagcgaggctgctgccgttgcacgggccgtcgtgggcgaacacgaagttcatcgccatcatcagcgacagcgcgtccttgccggcggcgacgacgtacatcccctgcgcgcgtccgaccagcctcgaggaggtcaggttgggaccgtcggtgagcgggttgtcgatcaccaccaccgtcccgaaccacgtcgccgaggcgttcgtcgtcggcgcctccgccacctgcgccaccgtggagttgggagcaccgccgcaaacacgaaggaggaggaggcagccattacttagctctgtgttggtcgcatggttctaattaagatagcttaattagctagctgtctgatctattggtttgcctatgatagatgtggtagagggtataaatgtcctatttaacaccgttaactccatccaaaacaggggcaaaagtatttttcggtttaaaaaagtgagggaaaaaacgaaaaccctaaaaagtaggggcaaaatcaatattaaagatcaaagtgggagcaaaaacgaaattgtccctatattttaacatcaaaaatcggtgcattgatttgcaccagttctttttaaaaaatggggaaaacgttatatccggttttatatttaagggacaagaatttcaaaaaaagacaaaaatagacttatttaggtagaagttctatctgtcggtaataccgtgtaccgacaggctttccactgacacatcctctctatcgccagaggccttttccgacggactattgatgttaaaggtggtcttcgccgacagattagttgttgccaattttgggacatggtgtagtggtagtatatatgatccatccaaattcctactttgatccagattccagcacaaaacctaaggtgcgaatgagtggggcagtgtttgctaatgagccagatttcatagccgctcctaaagctttgggcttccaaatgggcgaagtcctccatctgctcacttgtcgccacaacacataggcgttccgctccgcaactctcgtgctgacctatctaccacacaaggtcaaggagctgtcggatgaaattcctcgcagctcatcagctctcacagcattgagacgtttcaacttgttctcgatgaccaggcatttcggtgtatgttggcaaccaaaatatttcctccatttcaaaatgtatgacgtcgttcaatttttcgtataacgtttaaccattcgtcatattcaaaaaaatttatacaagtattatttattttcttgtaacttgttttaccattaaataaaatataattttaacttatacttttacatatttatttttttaataagacgaatggtcaaatatttttaactaaaaatcaacagtgtcatacattttgaaaagaatgtactctctctgtttcaggtcataagacgttttgactttggatcaagtttgtagaaaataataataacattttcaagccaagacaaatttattatgaaaatatattcgattattgatttcataaaactaatttagtattataaatattactatatttgtctataaacttagttaaacttgaaacagtttgactttgaccaaagtcaaaacgtcttataatctaaaacggaggaagtaatatttttgtttctcctttagtcaaagaattgttcagaaaccttaaaggaaattcgcttcccccaccgggtcacacatcccctcatactcgggccttgtttagttccaaattttttcttcaaacttccaactttttcatcacatcaaaactttcctatacacataaactttaaacttttccatcacatcgttccaatttcaaccaaactttcaattttgccgtgaactaaacacaccctcattggaactgattattggataaaaatccaagcaatgacactgatcgatcttcctgttcacatatggaattaacgtgatagggagcctcctgcctgatcccccacgctaaagatacaatggcagcatccatatatccaaaggagtaaaaaggacatctacccaaaaagacaaccgaactgctaccaaatgaagtctttggtcttccgataagcatagaatcatagatgcttcataaccatcccgttcgtgctcttagcctcttacaactcttgtgaaattaggttcaacagccaattagttactccaccaactgaggtcaatatgtctaaactggcgctcctcctccgaggagctgcaatgatcttgtggctactcatctcgcagacaccatctacctgttgtgttcatgcgagatgcgtcaccggcgagcgtgatgcgctgctctccttcaaggcaagccttctggacccttctggcaggctgtcgtcatggcagggtgacgactgctgccagtggaagggagtccggtgcagcaacagaactggcaatatcgttgcgcttaacctccgcaacactaataatttctggtacgatttctatgatgctgatgggttgaacctattgagaggcggtgacttgagcctattgggaggtgaattgagctcctctttgattgctttacatcatctgaggcatctcgatctgagttgcaatttcttcaacggaacgagcatacctgttttcatgggctctttcaagaacttgagatatctcaacctctcctgggcaggtttcggtgggaaaataccttcgcaaattggtaatatttccagcttacaataccttgatgttagctcgaattatttcttccatgaacagaacacgtttttcatgtcttcaactgatctttcttggttgccacgtctcacctttttgaggcatgttgacatgactgacgttgacctcagttccgtgagggattgggttcacatggtgaacatgcttcctgctcttcaagttcttcgtttgtccgagtgtggccttaaccatactgtatctaaactatcccattcaaacctcacaaatcttgaggtccttgatctatcattcaatcaatttagctacacgccactccgacacaactggttttgggatctcactagcctcgaggagctttatctctcagaatatgcatggtttgcacctgcagaacctatccctgatagattgggtaacatgtctgccctacgtgtcttagatctaagttacagttctattgttggtttgtttccgaagaccttagagaatatgtgtaatttgcaagtattgctaatggatggcaacaatattgatgcggacttaagggaattcatggaacggttgccaatgtgctcgttgaattctttggaagagttgaatttagaatacacaaatatgagtggaacattcccaacgttcattcacaaaatgagcaatctcagcgttcttctattgtttggaaacaagttggttggcgagctacctgctggtgtcggagcgctgggtaatttgaaaatattggctcttagcaacaataacttcagaggtctagtgccgcttgaaacagtaagtagtttggatactttgtatcttaacaacaacaagttcaacggttttgtgcctcttgaagttggagcagtaagtaacttgaaaaagttgtttcttgcgtacaatactttcagcggccctgcaccatcatggattggaacactaggtaatttgacaatattggatcttagctacaataacctcagtggtccagtaccgcttgagattggagctgtaaatttgaaaattttgtatcttaacaacaataagttcagcggttttgtgcctcttggaattggagcagtaagtcatttgaaagtgttgtatcttagctacaataatttcagcggccctgcaccatcgtgggttggagcattaggtaatttacaaattttggatctttcccacaatagcttcagtggacctgtaccaccagggattggatcactcagtaatttgacaacattggatcttagctataacaggttccaaggcgtaatctctaaggatcatgttgaacatttatctcgtctgaagtatctggatttgtcagacaacttcttgaaaatagatatacatacaaattcttctccgccattcaaactaagaaacgcagctttccgatcatgtcagctggggccgcgctttccattgtggcttagatggcagactgacattgatgttcttgttcttgaaaatacaaaattggatgatgttattccggattggttctgggtgacattttcccgagcttcattcttgcaagcatcaggaaataagttgcatggctcattaccgccaagtctagaacacatctcagttggtcgcatatatctcggttccaacttgttgacaggtcaagttcctcaactccctataagtatgactcgcttgaatttgtcttcaaactttttgtcagggccattgccatctctcaaagctccactgctggaggagctgttgcttgccaataataatattacaggcagcatcccaccatccatgtgccaattgactggtttgaaacgtttggacctgtcaggaaacaaaataacaggagatcttgaacaaatgcaatgctggaaacagtcagatatgaccaatacaaactctgcagataaatttggttctagtatgctcagtcttgccttgaaccacaatgaactttcaggtatatttcctcaatttcttcaaaatgcctcacaattattgttcctggatctttcacacaacaggttttttggaagtttgccaaagtggttaccagaaagaatgccaaacttgcaaatcttgaggttgcggtcaaatattttccatggccatattcccaagaacattatttaccttggtaaacttcattttctggacatagcacacaacaacatatcaggatccataccagactccttagcaaacttcaaagcaatgactgttatagctcagaatagtgaggactatatttttgaagagagcataccagtaatcacgaaagatcaacagcgtgactacacctttgaaatctacaatcaggtggttaatcttgatttttcatgtaacaagttaacagggcatattccagaagaaatacatttacttattggacttaccaatttaaatttatcaagtaatcagttcagtggaacaatccatgatcaaattggtgatttgaagcagttggaatcccttgacttgtcctacaatgaattatctggtgaaatccccccaagtttgtcagctctaacttctctaagccacttgaacctatcatacaacaatttatcaggcacaataccatcaggatcacagctacaagcactcgatgaccagatttatatatatgttggaaatcctggtctttgtgggcctcctctcttgaagaactgttcaactaatggtacacaacaaagtttctatgaagatagaagccatatgagatctctctacctcgggatgagcataggatttgtgattggtctatggactgtgttttgcaccatgatgatgaagagaacctggatgatggcttactttcggatcattgacaatttatatgataaggcctatgtacaagtggctataagctggagtcgcttgatgcggaaaaaccaagatgcagcgtgaagagcgttgtttccactgcaaatgaattattcaagctactagtttctgaaaaacctagtaactcaaagaataattttaggtgttttactattccaagtggatatttactgttcctactataatatctggtttccgatgaaacctactagcatatttgtctgtaatgtgcttgacattctgttgtcattgtattatatgttgttgttatatgatttattttttaagctggatggattgaagctagtaaagataatatataatataactgccctctgccttttcaaggtacttaccttcctgtctgaacatttgcatgtcataatgctagttgtagggtgtgtccgtacttaccttcttattcataataagaatatgtatatgcctcattttaacagatttgcatgtccacagctgaagttcccaagggatgtttcataccttgaatccttgatttgtcagtaaccctttgtcaaaaatgttctagctaagcttgagctccaacgtgacggactggagattatcttgtctaacataataactgaccatgatgatccagtgtctttggtctctgggtggccacaacggatggatatacgggaagttccatccatgttgatgcaggatggctggatatatggggaaattcctacagaacataggtttagctaccagcaccttggaatctgtggacggatcaacctggaggggaagctcatcgtgacatatcggcgacctggtcacatactcacatcaatccatcatatccctgaataggagtaaacggaaaaatccgcaacctgcccacacggccacaccaacctctgaatcggaggagactccccgaaactgtgagactgagacattgctccagtctccactgaccagcttgggggctcgcactgttgatctggtcgagttcccggcttcccgtcgattcatttgatgcaccgcgccccggtcaggcaaacggtcgagcacctcgaggggatcgacgcccaccgccacccggcactcccccgccgaaagaacgccggccctgcagatgaagcaacagtgcgcggtgcgccttcctgaatccctgacctcgtcggcaggctgtggcacgcgctggcccggcgagtcccgccggcgccgccaccaatcgcctgctctgctgaccgcggtgctaaggccgaactcgcagattcgcgggtgctgggattggatgcggcagcgcagttgatggcgccccgtcggcggcgaggtggatgggccatcgagaggcccatttacgtccagctgacattccggcccacacgctcgcgagtagcccgttcagaagtccggctgctatttggaaaaagtacaccgaagatcccttaacttgtcatcgagttacaaatcgtccccgaaccgcaaaaccggatacaacgcatcccataacttacaaaaccagtgcaaactagatccctcagcggttttaactccagttttgaccgacgtgcagctgactcagcgtgggacccacataggtcccacgtgtcagcctctacttcccctcccatctccacctctcttcctctctctcctcccacgaaagcagctgggtacggttcggctggcgcggcggatggctggtgcggaaaaactgggcggcgccagcgggggaggagctgggcggcggcggtgacaggtgacgcggggacgcgggagaatgggcgacacggtg

SEQ ID NO: 66839 - DNA, 1778 bp, Oryza sativa
ccgatcatgtcgatgtcgccgtggtcacggcgtgcgcgcaccgtggcgacctcttcgctgatacggtgctccaccccctctcccgccgccttcacctgcgccctctccggccggcaccagctgctgtcgcgtcactgctgccgctgctcgcctgccacggcccccgcgccccaagcccctctactcctcctgagcccagagccgccgctccgcagccgcactcgcccgccgcgtcccccgcatcccaagcccctccattcctcccgagcccggagccgccactcgcttgccaccgctcttacctgccaccgccgatgctccgcagccgctgccactccccctctcggccaagaaaaaagcgattgaggagaagattgctgactaggattgttgaccccacatttttttctcacttacatgtgggctccacatatttatttttttctgactaggatgctatgtcagcaaaaccggacaaaaatactgccatgggaccttctttgaacggtttgagtgagtttaggggtacacatttctgattttataattaagggaccttaaaaaatctcgcggttaagttgaggaacctcaggtgaacttattccgccaggaaataaaccaggtttcacccaactactattcctgcttagccgtttcaaaaggaggcctttccatagctgctgcgaacaatatgggaaatggaagtgagttgattcatatctagcgcaagttgctaacactaaccatgaaaaagcagtcagctactctacaatctgtgctgaagcctgacggtgcctttgttcatgagcaaagcacggatcctatcagagatcccgaaagagacgccatagaacggatccgtattgctgctgtacagatgaaaatactacttcctccgtttcacaatgtaagattttctagcattgtcatttagatgttaataaatctagacatatgtatgtgtttaaattcattaacatctatatgtatgtggacaatgctagaaagttttatattatgaaacggagggagtacatttctttccggaggaaaaaaaacaacacgttgccttaccctaaagtatgaagtatgaacacaaatatttcaggccttctggtgataaaaagtgatcgtacgtaacgcttatacaaaagctgtatcgtatctcgccgatgtcccggacggctcacgccgccctgaaccgtcgccgtcgccgcatcgccccatcgggctcctccgatccttgagcaagagcgcatacaaaaacttcaggtggttcaggcgttcagcatcgacaccgacggcgacaaaatggttgctactaataattgatttagggagaaaaaaacaaaataaagaagatgctaaaaacaaacctgccgtgatgatagcgcaacatcatcggcctccagcatgcggacgacgctgcccatcgtgggccgcttgtccgctttggggtcgacgcacttgagggcagccacgagcgcgcgcctcagctgccgtttggttggcttggcctccatcgcagggtctactacctcctcggctcttctgctgctagccatcagcttgatccactccagcaggtgcacctgcaaacagcacgtcttgtgttattgaagggggaaaaaaatgaagcttgaagtatccacgtgtgcatagagaacaacacacagctctgagattcagtcgatgtagaaataaactgttttactgcttttaaatgtgagaactccatattaagaaaataatggcgaccgggcagcaagggtgacaga

SEQ ID NO: 66840 - DNA, 943 bp, Oryza sativa
tcctgcaccccaacggcgtcatacattaaaatatggagggagtagatctgtgtaatataatccaagtttttctcagaacaacattatccaggttcagcgtactctaatcgttgccataatgaactgagagcgcatcgccaagtaagaacagttgtgaagaggaaaaaaatgtcattgggcccatgaccagtttaggatgtttaaagggggaattactagatatattaatactacgactattaaaaccggtacataataactcccttaactgttttcaaggcgattttcactcatgcttgttgaactggagagaacagggtgacaagggggaggagctcggcaacgactacgttatggagacgatgaggagttgaagtggagagaacagggtgacaagggggaggagctcggcaacgactatggcaagggagaccggtgcgagggaataacgccgacgatgcctatgagggagtgacatgaggagtcgaagtggagagaacaggggtgcccgaaccgaggtggagaagggggtggcggcgtagcggactccacgacttacttcctgctctagctactgcttcaagtagtgtcttcgcacgcaacataagtcttttctgcacattttatcctcactcgtgtgcactggaaagaatttcccggtcggtcacccatcccgcaattgcttcaggccaagcatgcttaaccttagagttctttggagatcggcttctgaaaaagaagttgcaattaagctgtcacatcctcacccccttaagagatcgacgtcgtcagtcaaccccaagctaggaatgtctcctcttggccacgtccatatgtccagtgccagcgcatgtaccatgcagtgtgatcactccgagtccacaccagccatgcgcactatgcctgtgcaactgcaacacacgcgcccgtgaaaccgcgagag

SEQ ID NO: 66841 - DNA, 2356 bp, Oryza sativa
ttgtgaaacgaagggaatagtatttaacacagcagtagctataggccctatttaaagagttcaaggttgtgaaaaacaactactcccttcatcccatagggcagtaaacatttcgtacgacaaatctggatatgcgacatgttcaaattcattatattataaacaacaaatttggataagagacattgtcggtgatatgggaccgggagtatcatgaccagaggcttgaggcagacataatcgcccacgtggcctggcaccttcggggacgtcgggcccgagggtgaggtgtccgccctcctcttgatctcccccgaggggggggtcgggttgcgcttgccccggccccgagggccgaggcaccccgaccccttaaggaagtctgcgccacatatatgggataagtgagcacagctgtgctcacctaacagcatttattgtagtctggtcaagcgtgtcacgctgcatgcaacgcagtacagcgcgttcctttacccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggttagatttataccaggcttcatcctaaccattacaggcaaggtgttacacgaagaagggcaaaacatgcacgttgttaaactgacgcgtgggggacaagaatgaccggtctgacactggtcgcatcagcaacgggcagccacgatcccgcgtcatctccgtctccgccgggagtggaggtaggtgtgggctgtcccatcagaagggctcccggatggaaaccgtaccgatctccgcccattaaagagaaaaagaacagtccagtttggaaagagaagggtgcatgtggtatccccttgaagtataaaaggaggaccttgcccatagagaagggggttgattctttccagattcagagcctagaacgagggagaggtgggctcacactttgtaacttgtccatacacaaatccacaaaaacacaggagtagggtattacgcttccgagcggcccgaacctgtatagatcgtccgtgtctcgcgtttcttgctggctgacgatccttccacatacagagagagagagagagcttgggatctcaccctaagcccccggccgaaccggcaaaggggggcctgcgcggtctcccggtgaggagcctcgagctccgtcatctggcgcgccaggtagggggctcagcgtgtttttttctgagctctcatactcttccgtgtgcgccaagcttcccttgttcaacctaatggctgagcaagcaaaggcgcacgacctctctccgagtgtgagcggcgacgacggggagccaaacccacgccgtcgagctcgtactccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggctccgtgtcgtcaaggcggagggcgcggcgagcggcggcggctgcacgtcattcggctgctactccctcgtcgacaccttcgactcgggaggatcagcatggggagccggatgcccgcctcaacatcgagcgccggcgtaataaccggcgtactccccgcgcaacggagggcgcctcttcgtccagagtgtcacctcgacatggacgtgagaatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacatggccctaaaaggacaggcgcggggttggctaatgaacctgccacccgcgtcggtccactcctgggaagatttgtgccaacagttcaccatgaacttccaaggcacatatccgcgcccaggcgaagaagcgacttgcatgcagtacagcgaggcga

SEQ ID NO: 66842 - DNA, 2491 bp, Oryza sativa
cctgcgccccgaacctggggccaccattgccaccgtcgatggaggagcgtgtgctcacgtctctcgccggagcttcaaggctatgaagcgagagcttctggccatggcccctactcatgaggcgatgcgtcgggcgcggtggtcggaggttgctctcactttcgaccagaccgaccacccaccgtgcattgcccggggagggcaggttgcgatggtggtttcccccaccatctgcaacgtgaagttgggacgtgtcctcgtagatggaggagcggccctcaacatcctttcccccgcggctttcgatgccatcaaggccccggggatggtgctccgaccgtcccagccgattatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggcccgggtggccccatctctgtccatggcgatcttaaagtcgcgctcgcttgcatggagcagcgcgcggaccgcctcgctgctgcgtccaagcccgagggtggtgacgagaggcttggcccttctgcccccaccgccccgaggcagcggatcgtcacatgcgacgaggtcccggtcaaggaggttgccttgggcgacggcccatccaagaccacgcggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccgtaggaacctattgtcatacatcaatgccttttgggttaaagaatgcaggtcctacttttcaacgtactactcgaatttctttgggtagccaaataggacgtaatgttgaggcttatgtcgatgacttggttgtaaaaacgcgcaaccaagagaccttactctcagatctagcggaaacttttgaaaatctccgctccgcccgcataaaactgaaccccgataagtgcgtgtttggtgtgcctgcgggcaagcttctcgggttcttggtctctgcccgaggcattgaggccaaccccgagaagatacgagctatagagcggatgcgcccccccagcaaacttagggatgtgcagtgcgtcactggttgcatggccgccctaagtcgttttatatcgaggttgggagagaaggcgctacccttatttaagctcctcaagcgctcggggccgtttacttggacggaggaagctgaaaatgccctcgcccagctgaaggcgtatctcagctctcctccagttctagtcgccccggagccaaatgagcccctgctactttacttagcggcgaccccccaagtagttagtgcagcgttggttgtggagcgcgatgaggacaatcctcattctgcgtacccccactctgtgccgacttggcccgggagcaggcagggaggagaggcccccgagtcgaacggtggcctaaggcccccgacgaccggagtcggccctctgcccgcttgtcagacggtgctgagtgcccccgaccctcaggaaggccccgaggccactgcgggaaggccgcacctaccaccctttgaccccgaggctaaccctgtgctgattcgacccgggagagagcagggagaagaggcccccgagccgaacggaggcctgaagcccctgacgatcggagctggccctttgcccgcgtgtctgacgacgccaggagcccccgacccccaggacggccccgaggccactgtgggaaggccgcacctgtcatcttcggaccccgaggtcatcagcgcaggagacgagtgtgccccgagaggccacttggacgaagaacgccccggggatacggcccctagcagagaggatcggccccaccgaagggtgcagcggcctgtctactttgttagtgaggccctccgggacgccaagacccgataccctcaggcccagaagatgctttacgctattctgatggcctcgaggaaa

SEQ ID NO: 66843 - DNA, 1210 bp, Oryza sativa
cctctccgaacggagacgttctcagatatttggtccgtctcgactttcgagcgactaacaatatggcagagtacgagggactccttgccggactcagagtggcagtcggactggggatccgccgcctcttggtattaggcgactcccagctagtcgttaaccaggtttgtaaggagtaccggtgctctgacccacagatggacgcctacgtacgccaagtgcggcgtatggagcgccatttcgatggaatagagcttcggcatgtgcccagacgggataacatgatagccgacgaactctcacggctcgcgtcctcgcgagcccagaccccaccgggtgcctttgaagaaaggcttacccagccgtcggcgcgacccgatcccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgtaccctggttggcaaggcctttcgtcaaggattttattggccgacagctctcaatgacgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgaatatctgtatgttacgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagac

SEQ ID NO: 66844 - DNA, 2977 bp, Oryza sativa
ccgcgcgctaccagcagagcttgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggcgtcccccggccgggctccgtacggctggccacgggcgacggcactgagctgccaaacccgtggaacatcgaacaccttcgtcgcttctacccctgaggggggggtcgagtgtcaggtttcgggctcgggctaaccccgcacccccctcgggtgtgccgggttagccgggggctaccacacatgcacagttttacttttcttatttcagcatttcaataaaggaagtttcaatttcctaaaggttgtgtctgtgccgtttttccttctgaagaatcttaacttgaaataaggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactagccccgacccgagccattcgaggactgggacttgggcacgagcccttatttcaagctaaggcgcaaaaggaccatggcacagatcatcctcatcgtgtatatatagcaaaataaagttaacatagaaattttttatcattttttgattgcagattaagttaatttgtacacaaaagaggcgtgaaggccttagaagaaaggaaaagaaaaagttggagattggcgggggctcgggggctcattccaacgcgcccgggtcgccggccttgtcgccaccgtcgtcctcaccgctggcgtcgccctcctcgtcggagctgggggcgaaagcaagccgaggggccgacccctcgaagccgttgacgatgtggtcggcagcatccccgacccgcgcgcgcgcgtcgtcctcggtcccgggagggaactcctccagcgccatccatggagagaagttggggtcccgggcctggtaactcgccagcacgagttcgaccgctccccgcgcgaggtcccttgaggatgacttaatggtcttctcaagctcctcggggagttgttcgagaacccaggccatcctgtggaggtgcggagcgaggccttccagattggtggggggcaccgtcgtctggcctttccagaggcccgcttgccgaccggcgcgcttcaggcgggagaccgcatcccaaagcatgtcgggcccaatctcgcccgccaagcgaagggcctcggcctccccggtgaaggagtccagcgctcgctgcatatcggcgacggtgtgttcggcagctgcgaggcgggcggctaagtcgctttcgcccgcggccgccccaccgatatgcgccctcgcgtccagctccttttcccgcgccttgaggtcagcagcccgctgctccagtgcggctctctcggtgcggacgcattcaagattgaggcgcgcctgctcctcctgcgccgcctcgcgaagggacaggctgtccgccagccgtctggtcgtggcctcggcctccttgagagctcgccgcgcgttcagcgagtgcatcctcgcggaggcggagcgcggactcctcctcggcgcaggcggcctcatgcgccgccagcgtcgcctctcggagaccagcggcggcctcacggtccgtcaagcccctctccacggcgccggcgtgttcttccagcgccatggcacgggcctcaagggcctcctcgcgccgccgagacgccgcttcagtctccgttacccgccgctctcggacagcggcggagtcaaggaccccttgggcggcgtcgagcttttccttcagctccgcctcccagcttgcgtgctgaaggcggagggtgtcttgcgcctcgatcatcgcggtggtagcaatgagggcggccgctcgctcctcctccacctcacgagcgatctccgtcagcgccgccttccgggcttcaagctccgagacgtgacggcggtgagctttgcggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgagggccgcccgagggagtgggcccaagtgacgcgccagcagcagctgtcgcctcagcctggcgaacccgggcggcctcctcccgggcagcttcttcggcttggcgagcccgggcggcctcctcccgagcagcttcctccgcttggcgaacccgggcggcctcccgagcggcctcttcagcttcccgaaggcgatctgcggcttcacgccggtcagattctcgcctccgctcctctgcggccgctggatcttcggcctcggaccggccggacttggggtggcgggaggaatgcgacgggacattgctgaagcagaagaaaaaaccagaagacgaacaaaatgagtaagaaaaaacttacttttgggagaaagatggttgcaaggagagtgagacgaacctgcgagggggtcggttgaatgaccactttggaggggaaatcagatttccccggcatggttccgtctcccccgtcttgcggagccgtttctttttgcgctccccctcgggctgcga

SEQ ID NO: 66845 - DNA, 1358 bp, Oryza sativa
ccccgcggctggaagtagcagccgccaaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaagaggaaaatggcgggaccagcccagccattgcgaaggggaggaagaaaatggaccgccccgggtagtctggtgccgggcgcccttcgcccagcatcactatctcccgaccggtggcggactccggcatgaagcggcgcggcagtccggcgtgcctctcgttcacgatgcgggaaggcggtaatacactgccgtcgagcagagcagagccccgtgccatggcggtggaggaagagatgattgagaacgagcgcgtgtggcgaaagtagggcgcagcagagaaagagttagagctcaggcggcgaaggcaagaggaacaatggcgaaaggaaggaagcaaatcctttcctcgatgcttttatacccttgccatcgctgggcctggctcctcgtttctcgcgcccactacctcgctccctcgtatctcgctatctcgctccctcgtttcccgtgcccacgctttcactaatcccattcgcccgcttacggcgcatgaagtggatatgcggttgtggcaatcgaaatggattgtatcgtgcgcgcgttaattacgctcgccgaccgaagcggcgttaccgtatctccgggcgagataaatctgctcacccagattcgcgcgctgctcaagaggtgtggcagtcttgaatagaccgcccattatggacaaccaaagttaccaataccaatgcgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacataatcgcccacgtggcctggcaccttcggggacgtcgggcccgagggtgaggtgtccgccctcctcttgatctcccccgaggggggggtcgggttgcgcttgccccggccccgagggccgaggcaccccgaccccttaaggaagtctgcgccacatatatgggataagtgagcacagctgtgctcacctaacagcatttattgtagtctggtcaagcgtgtcacgctgcatgcaacgcagtacagcgcgttcctttacccggtctgtgaccagtcacaga

SEQ ID NO: 66846 - DNA, 1961 bp, Oryza sativa
cgccgaccacctcgccgaccccgtcaacaacaacgcctgggcctacgccaccaacttcgtccccggcaagtgagcgccgccgccgccgtgctgccatggcgacgcatcgccttcagctaagctagctaggttgacgacgatgcgcgtctctgcaggagagtgtgcgtgtgtgtacgcggtgcagtagatgtacgtacgtgtaccgtatagatgtacgtattcgtgtggaccgcgtggatggatgtacgagtattggagagagggtgagatctgtaccggtagtgtgtatttctgtgcaggttctgaacctgatcaatgaaatatggtgttgtgaattaattataaaattagcttgtttaatcctgcgtgctacttaatgatataataattcttctgataattagtaagagtaatgaagagattgcaagaaaattactcccagaacagtatacgaactgaatcaagtataaaatgatcaaaattaacctgaacatgctttaactgttagtattttgaacgaaaattaattgatagtatgcacacgctacaattttatattcccaaaatgtaagttataagttgacaggttggggtagttaggtgaagtctgaaccttaccactcaaatttaaaagcactggatgcatcatatatgatgatttttacttgaagcaacactgcccatgctaagatttgcttcctaccgaggttacaataatttaggtggatagtgattacactgcattgacaaggaaatttgggtataatttcatctagaactttctattacaactgctaagctagcagtgacagatacgtatagttgaaaaacactttgtgaactttctcagaatatggccaattctgagaaacttagcactgtctggtttcacccaacttgtagtggttggaaagttacagttacatcgacctcaatacccatgtgaattgggaggaaaattacaagttacatcaacctctctgggctcttgtcatgtgaatgtcacatgatcatgagagggatcgttcaaggaagtagtgaagtactacaacaaagttctagctattatcttatatacaaagtctgatgaaaacaccacagcgacgtactccctccatactcgtaaaggaagtcgttatacggtctccaaaacacaactttgacttcttgtttatataaaaatatttattaaaaaatgatatatgtatacttttatgaaagtatttttcaagacaaatctatatatataatttttacaatttcaaactcaacaacttgaaagatattcaagatttatatttttaaggtttgacttaaatattgttgtaaacgacttctttgtgagtatggagggattatgtgataatttggaaagatcaccttgttacgttacctgcctctgaaaagggctctgaaatgtaccattccgtccagtttcttcttcagaactgggcatgctgcgacgaacctgctgcattcgctcctatcttgggctgcatgaatcaaagaaatcagcagtgttaccttgcatggtgagagaacagtttgatggatggatgtgctctgctgacctcattgttttgctcctacagggtgtgcaaagggaaaccaagtggtaaccttgaagggttggctcatcttttagcttcagatgagaagaaacctcccagtttgcacactgaacaaatcaaatgagaaaaacatgaaggacataagttgcagattttttgtggtatgattttaaaagttctaggtttgggccatacttctatttattgttatttttttacaacaagatcaggagatgcgtgcttccatacaatgagtaatccttttgttttcaaagaaaaatcttggctatccttattttatttttattttttaatgtgaacagtaggaaatatacatataggttaaaattaagcttgttacaaataagttaaaaatgtacaaggttcttg

SEQ ID NO: 66847 - DNA, 2173 bp, Oryza sativa
atgggttaaagaaggaagattgctgagcgaaacggcttaatatatatatatatgagctaccacctgaacttcagtaactccaatgacgttaacgtttggtgcagatcccttcacgtgaagtgcagttatcagaaaattttgagcttgccaagcacggagcacaattggaatgtcttcttcgtcacgagctggatcaccaaccgactgccccaacagttcaaatagcaagcctcctgcaactcttacagggacctgaaataagttaaaaaaaagatacgaggtttggagggagagacgtccctccaaatatttttcaagaagaaattgtaagtgtgctggggattgaacacgagaccttagggttgaaaccacatgccccttgccactacactatcaagtgaagaaaatccagacaatattccaagtaacagtaagcttagataaatactgcatctaggtagacacactaattcaggacattccgcaattgtgcatgtagtacatgggagcagggttcactctattggttctggggtttccatcgggggtcaccgaaatcctgaaatttcggaaattttggtccgaaatttccgaaattttgaacaaaatttaattgaatttgaacaaatattatccaaattcatgaaaaaattgaaaaattcaaaaacttcggccgaattaatatcgtatcgggggtcaccgaaatgagtagcccatatgaaatcatcaaagagtttcagtctttcagacattcaagctaagaagtggcagtagagtcacactgaaacattgacactcgtagtctcctacatatctaaatgaacatatatttttagataatggaatatattttatgcctttgcttaacttgctacagccaattattacacaaattggcttacaagcgtttacgcacgaaagagtgtttaattctagatagaacatcaatagactcaaaatctattatataattaaagtaatagaaaaagaagcctccacgttcgctctcatggcctagaaattctgacattaatcggagaaaaagaaaaaaaacagagtccatatagaaatacaatttagaaatagctgaaattcggaattaaaaaataaggaatattagaaaaggtgactagagtccatatagaaatacactttagaaatagttgaaattcagaattaaaaaataaggaatattagaagaggatactagagtccatatagaaatacaattagaaaataactgaaattcggaattaaaaaaataaggaatattagaaaagagactagagtccatatagaaatacaattacgaaataactgaaattcggaattaaaaataagaaatattagaagtagagcatagagtccatatagaaatacaattaagaaaaaaaaagaaatttggaattaaaaaataaggaatattagaagtagagtatagagtccatattggaatttaaaaccaactaaaatccggaataaaaaggagcctccacgttcgctcttatggcctagaaattctcacattaatcggagaaaaagaaaaagcagagtccatatagaaatacaatttagaaatagttgaaattcagaattagaaaataaggaatattagaagagaagactagagtagttattacacatgagtagtttcgtaaagttattgcaaaatttaatattatgttgtcattgtaatatattttaataatataataagaaaacatatatgatattatatgagagaaaatataatgatgctagccgcgcaatctgcacgggccaccatgctagttgaacatatgtagtcataatgatttgcatacaaatagtaccaagacatggtgctttctatcaaaaagccggcctcttttggctttccctctaaaaaatggtaccttaaacatataaaacagtagaaaatggatgaattacccaatctcttgggtagtgcagtgctggatttctttctagctttcggtagaaaatttggagtagaaaaccgcggagaagtatggtaaggtaaagctcacctcgtagagcagatgcttcatcttctcactgatgagcacgctctcgtccctgagcgccacgcagatcgccgggtggagccaccgcgcggcggccagccacgcgtccaccgccgggtgccccgccggcacgtggcaccaccagg

SEQ ID NO: 66848 - DNA, 2818 bp, Oryza sativa
tggactgcagcaaggagcagcacttgctccggcacaagttggccggggtaacgaagccatgggcgccgccgccgccgcgcacgaactcgaaggcgcagacgaggccgtcggtccacaggccgtcggacgacgaccacggcgaggacgcagaggcatccttggcgccgaagccgtgactgagctggtggtggtggtggtgctgcttcctagcgtcgccgccgccgccgccatggcggacgccgtgccagagaggctcgccgttcaccatctctctctagtgaagccgcagcctctggggcggacgacggcggcgacgagatgtttttatttatggggtcgtcgcgtgacggcagcgtctgggggtgggccccccacgttggcgcttttgcgcgtcgtgggccatacgtgtcagtgagagcgagtgagtacgggggttggggcccacgagacacgtggcgttgccacgctgctgctgttgcagcttgttcggtggcgctagaatgcgtggttggtctcgtgccccgtgcccgcgcggtggatttcgaccgttctttttcaaataaatctgtccaatttctccactaccggatttgttccaagattggtgcaggcataatgcgtaaaatatcaggtcttcacgcgtggggtatgaatggatcccgcctcttttagggcagcagcagggcgtcgcacaaaagcaaaaaaacaagtttatccacgtaggagaaaaactcgaaaaaaggagtcaagctcctcactcctcagtgcacgtgcacgcgtaggcgtgacttcaggagcgtaattttttaaggccggtcccgccacgacttttctccattttcaattcccaggcccgtctctctcttcatcttccttactcggctccttcccatctctctctctccctcttcaagcggctgagatttgcaagcgacgccagcgacgagcggtggcctctcccctccggtgccggtggcggcctctcccctctcctctccggtaccagcacggcctcccaacagctcagcgggacggatctagcggcgctggcgacgagcggctgcctctcccctctggcgccgacaacggcctctcccctcatgtgccagcgcggcctccagggagctcagcggggcggatctggcggtgccgacgacgagcgaccgcctctcctctctcccctctaggctccggtgccgcctctcccctctggcggcggcgcgggcatcgacgcttctcccctccctctcccttcttcacctcttctcttgtgggcccaaaagttgtgaaatgacgaagagccgaggctccgaactatgcctaggtggagaggaatctttgagctagctagatgagggagaatgacacctaggtacactgtgaatgactttacaagtgcgcctcatttatcactaagttagaattgtttttatgtttgaaacccaattatatacaatttattaagcgtagttacaatataactggggtgtaaccagaacctacttagttatttagaaatctgttgacaatgataaaggtagactcgggagggcgcggatagccgcgcattagatttgcattgttcgggggttaagacccagcttgtgatttgtgaatcagcgacaacgagcatgacgaaatattgactgctacagagatgcaacaattgagtatgctttcttttttttaaagaaaaaaagcaagtgagcgtgagtaaaaacaacaaaagaaaacgctccatccgtcccaattaaaacccaataataaaacaaatgaagtactatatcactaacttttgtaagataaaattataaataagtaaatgaatagcaaggtgagcataactcagctgattaagttactcgtggcgaaactagcccatccgtattcatatcttgaacttaacacacgtgctcgtatttacgttgcaggaaggctccatggtaactccatcgattttaagatatatggtcccaatcttccggaggtatttatagggttagggtacgtatttgtgccttcataagatgagtgtgctaggtttacatgggtaggccgtatgccgagtgtagcttcatacgggtaagtgagcgcgtattgtgagcacctatgtttgtactttgttttaaaaagtaattaaataaataaacttccgaaggtgtttatactttataagggtagggtgtactgtgtgtgcgccttcataaggataagtgtatgcgtattgtgagcatctatgtttgtattttgttttaaaatataattaaataaataatctgacaggcgaaaaagttgtaaatgattgaactcatacaagtagaatgtaagtggctaacccgtgaacctgtatacccatttataagtcaaaataagcagctttgtattttttttttgcaaataaatggatttcacagttagccatttacaccttaccgatcaaacgtttctgagagacctgatcgacaggtgaggatcttctatcataatatcattactattagtcactggtatccttttattgtctcacacgtactatggtgaggatgtgaacctcctgatcaactaggtgttgtcccgtggcaaacagacagtagttagcctagcaaaaaagtagacagttagtcacgcataaacgggctttttacagaaatatcacatgcaaattgaaagaggccattcaccaacttgtactgttacttgttcgtcgatcatcatacgtaaattcctttgtttacggtcggtccttttcctcacctgaaaacactatttttggccgctacgaaaaccgatgatgatatgcctcatcagccatcaggta

SEQ ID NO: 66849 - DNA, 1856 bp, Oryza sativa
cggcgtcatctattaaaaaacggaggtagtactttttaaatttaaatcacatcaacttatttaaacttatgtttatgtttatgtaagcttatgttgttaaagctattttacacatttatttttacttattgttatcataataaactctcgcaacaacgcgcatggtttaacctagtaaaataaatggtggggtacacttatataagaccgcgactatcctcaagggtaatgaatgtaaaaaatagcgtgtcgtaataaaatcaattttttattttggattttttaatggaaaaataaaattctgattttctaggtctaatgaataaatgatagagcctggttccaattctggcaaaacaaaaggcaacaagcttaacttcttaattggaagaactctatgatctaattagacgttaaaatagattagtatccgatgtagggaaaaggctgcattttctatgagtagacctttgatttttttttagaaatcctaattattcttaaagtgtggggaacacttttaagaatatttataaaatcgggaaatatttttaaaagtgtggggtacaattttatgtatatttctaaaatcaggataaataaacagtcatcatgaaattatcgttgcctgaagaggcatcacttttttaatttaatagagggaaacacctatttcgagacatgtcatatctataggagagctactttttttttttaaaaaaaaaactcatgcattttattaattatagataactaggtacatatcacatgagttatccctagcgggaaatcaattgcaagtaaaagcagttttgcataaaatgtcccttgaagatggccaaattaacataagctcctgaaaattcgcaggaaggactcctaagaaactagaaaaagcaataagtccttctcttctctgtcaggtagcaagctagatccatggctgcaacgctgatgaagaaaccaagagtgactgcagatgaagatactaagtatagttggccacatcgcctgagtcccgacgacctggcccaaggcatgagaatttggcccgacctaggcaccgcccgacccgctagggtcaagcccatgccgacccggtatggcacaatgaaaaaaaaacagttgagggatccaacatagacatactttcagcccatttgaggcaaggcccaaagataagagggatacaaaatagacttaattcaaccatataagacaacccaaagagatgagggagggaaaatatacttattttatagagaagcataatgggttgtcgtgccttcgagccaacccggcatgacccaagtcttattgggccatgcctgggccatgggtgcagcccgtggacaggcaagggccggctcggcgtgtaggtcgggccatgccggctcgactaacctcggcccaagcccggccgttcctaggccgtgccgggtcgggcgaaccatttggccatctatagatacaaggaagcatatccaaaagggacctccgcttggaggttgaggcttacatgacaaaaccatgaaaacttggcttctctctgatgatgcaccatcggtgacgaagaaggcttgcatatttgtggttgcctcgccggagatgaaccaaatggcgatgtaaacttgtcttacttccaattgaagtcgtccctggcaaacccagaaaccactccatggatggatttggttgggaaccatagatgatcaccgggacaagagaaacatgacgctgacaaactcttgcactacacaaaagtaccaaaagaaaagagaaaacaaagaggaaaacactactacgggaagaacccgactacctggactcccctgccccatcactggcgactggag

SEQ ID NO: 66850 - DNA, 1227 bp, Oryza sativa
aacgggtgtaaccggacgaccaagcgggagcaattttccttataaccttgtgcatcataaacaacgaaaaacagagtccctgagtccccatcccctacctaacaagatttcctcgagggtaacaatcgaaaagtacaaaccggtatgcaccgtagattagaatattatagattagtataattagtcccaaccgacgcacctaaaatctgtgcagccaaagataatccaagagacagatgaccgaaagcccaccgaaaccggtaaatcctagcgctaaacccacaacccaacacgcacaagaagcagcgggaaagtgcgaaggacgagcagctctcacccaccaggagagagtcctccgctgctctcctctcctctcctccggctaagtggttggctggtctcagcgacagcgatccctttcggggtactagtagctagtagccgcgacgacggatggtggaacccgtgggtgcaggtggtggcggtagtggctggggcgcggaggggttggcgctgctggcctctgctcctccagctcgcgataagggtcttcgtcgtcgtcgtcgtcctcgcatgaccgctcatggccgcgacattgacgatggccaggtgagtatgattgttgagttagatgtatcttgcgtgatggtgctcattatagctgtttgttcgtgtgcctgtgcatggcacggaagctgtttgtgttaatgcgtcagagggagcaaccgagcaactgtaattgtgatcaagaggtgtttgcctgagaagatgatgctttttaggatttcttagttttgttggttgaatgataacttagctcactgagtgacaggtttttttggatagcttttaccatactctttagataatgcacctgagtgacaattgaaagcgaactatgagtcggcatcagtcctggtctcaaaatgatcctcttttggcaaattgaccgtgatgggttctttgtttccgtttgctttaccatttttgttccttttccttttcttagtttttttaccctgatttggttacttcacttcaattatggtagtagggcatgcagcttcgataatactataatgttaaattgtttggtcagggaaatgaagatgtcaaccggcgaaaacttacaggcggggttattgtctaggacgcctccatttggtctgaggctatgggttgtgcttggcattagcatttgggctgcaattctgtttgtcctaggtt

SEQ ID NO: 66851 - DNA, 723 bp, Oryza sativa
tatattatgaaatgtcacgtactgtttgttctagttagtgaattgtcatatggtaagaatatataaaaattaggttttctggactctatcttccaatgtatttttggatcctataacaaaatattttcataaatatattttttaagaatctaaacttttttgaaataaaagagcaacaaagaaaataaaaacgctctctcgtaagtaactcgtgaagatccatcgagagccactcgtttgaatcgtcgacacaaaagaacacttcattgattgcttttcgtcaattagccgcacagcacagtactctccaatctgctaaaccaaaaccaatctcatccatccatacccttcttgacaccaagtggcaactcctgattggacgcgccctatcctacatggcacccccaagattctctcgataggctacaggggccacaccgaccctccacgtcatcgtccacgtcaccctcatcccggcccatccagccaatcccagcccagcaaaaaatcttcccaagtggccaccagataagcctctccacgtattaatacgccaagtgttcgtcgccatgacacagcacgcacacacaccccaccagcagcagcagcagtagctgagcttgaagcagcagagcgaggtagacatggccgccgccaccatggccctctcgtccccggcgctggccggcaaggccgccgcgaaggtgttcggcgaggggcgca

SEQ ID NO: 66852 - DNA, 1565 bp, Oryza sativa
  unsure (1)..(1565): unsure at all n locations
atctcacccagggcccccggccgaaccggcaaaggggggcctgcgcggtctcccggtgaggagcctcacgctccgtcatcatgtgtcttcttggcaccaaaatgtcccatcaaaccgcctccatggcttcctgcaacaacaacaagcgaacggagctagctggaatgcatagcttgttagctttgaaaacaaacccatcattgatgacgaatttgttccatgttcttccatccttacaatgcagcaacacatcattanaatcagcatcatgcgcatattggtctttgattgtttccagcgcaaaaatcttgtagtcaagttgtgtcaacaaagtgtatctcctagacaaagcatcagcaatgatgttctccttccctttcttgtgtttgataacataaggaaaagattcaataaattcaacccatttagcatgtctacggttcagcttcccttgactatgaatatgcttcaaagactcatgatcagaatgtatgacaaattccttgggccacaaataatgctgccatgtttctaaagttcgcacaagagcatacaattccttatcataagtagaataattcagaacaggcccactcaacttttcactaaaatatgcaacaggttttccttcttgtagcaaaacaccacccaatccaatcccactagcatcacattcaagttcaaaagtcttattaaaatcgggaagttggaggagaggtgcatgggtcaacttatctttcaacatgtggaaggcgttctcttgtgatgtgccccaagtgaaaggcactcccttctttgtaagcgcattcaatggtgcagcaatggtgctgaaatcctgcacaaagcggcgatagaaccccgcgagtcctagaaagctccgcacttgtgagaccgttttaggagtcggccaactctgaattgcctcaaccttggcttgatcaacctcaatcccctgcggagttacaacatagccaagaaaagaaactcgatctgtgcaaaaggtgcacttctcaaggttaccaaataaacgtgcatcacgaagagcattaaaaacagcacgtaaatgattaaaatgttcacccatagacttgctgtaaatcaagatatcatcaaagtagaccaccacaaattttccaatgaaaggacgcaaaacctcattcatcaacctcatgaatgtgctgggtgcattagttaaaccaaaaggcatcactaaccactcatacaacccaaacttcgttttaaatgctgtttttcattcatcacccaacttcatacgaatctggtggtaaccactacgcaaatcaactttggagaacacaatagagccactcaattcatcaagcatatcatctaacctaggaataggatgacgatatcgaatggtaatgctattaatagctctacaatcaacacacatacgccatgaaccatctttctttggtaccaaaattaccggaaccgcacatggactaagagactcgcgaacataccctttatcaagcaactcatgaacttgacgctgaatctccttggtttcctcagggttggttcggtatggcgcacgg

SEQ ID NO: 66853 - DNA, 1129 bp, Oryza sativa
acgacgacggcacccgtgcgcatccagcttgcgcccaggaacccacctccatcagcagctcccgcagcacctccagttctgcccgcagttcctgcagctccagctccagctcccgttcacatgtcagctcccgcgtccgctctctccttcgctccagcatcagccgccaggggtccagccagtggcaacggaggttggttgtctgctactcctagtggcagccacgatctcagcagcagcagctccagtggctcagagtcgggcagcagcgagacttatctgccaggctccaggagtcgctcagagggacctggtgacgagcaggaggacgccttcgactgcaccgaccgcagaagccgttccgagcattaggctcgttttccattagtttatcgactgtctagcttttgtttgttagtttgtgtgtctaggttgcttgcttgtgggtcagttgacggtcgatatcatgtgcctatgatatggctgtcttaataaggatttttgcttgctttttaagtgttttaattcagatcagaacaatggcagtttaaattcctatgtaataaagcttagttcctgagcatctgtttttcttcttttcccccgtctgcttttccctccagatggtctacaccaggaatggtagccgcgcaacaggcgagggcagcaacggcgaagagcgcactgatggggtgcatcccaacggcgattccggcaatggtccaccaccacttcccgagaatccgacgctagcccaggtgatggcacatcagactcagatgatggcagccatgatgcagcagatgcagcagcagcaccatcagatgcaccagaggatgctgcagcacgccgaacagcagcaccagcagtttggtcctcctccccctcagtccaaattgccagagtttctacgtgtcaggccacccactttctccagcaccaccaaccctatggaggcgaatgactggcttcatgccatagagaagaagctgaatctcctgcagtgcaatgatcaggagaaggttgctttcaccacacaccagcttcaaggtcctgcgtcagcttggtgggacaatcacatggccacccgcccaccaggtactgaagtcacttgggcagagttctgccg

SEQ ID NO: 66854 - DNA, 1197 bp, Oryza sativa
ggagaaggaactagccgcgttgaagggagaagcaccgccgcagaaggccaggattcgtctcaccgcaaggaagagagctttgtttgtccctcgttatcaattggcgccaaagattcgtgtggtggagaaagaagttgccccagctcaagcagatcctccagtcatcatcataagtagtgatgaagaagaagaacccaagcgcaacaattccaagtttgagtgggtagctatcaaagatgaggaagatgagccgaacgagccttcgatcgacctcctatgctcggaagaactagagtgacttgttgggtcgttgtcttagatcgttgtgttagtttgcttgtttaagtttgcttgtgtgtgtgtgggtcctgcatgtgatttacatcagtggtgggatgtaagtgcatgcgtttgtttgcttctgagtgttaggaagttggtgagtttagtggtgtgagagtcttcagtttgtaataatgaaactcagttaagatcaataaaagttaaagtaattctctgtcctaagtagtttccccggtttcttttcttatcctgtccatgccagatggtgaacactcgcagcaacgggaatggtcccaacctcaacaaccccaataacaataacaatggagagaatccaacccttgctcaagttcttgctcaacagactcagctaatgcacatgatgatgcaacaacttcagaaccagcagaaccaaggaaataaccatgcacctccccagaacaagttagcagaatttcttcgggtgaggccgcctattttctctagtaccaccaatcctgttgaagccggtgattggctgcatgccatagagaagaagttggatttgcttcagtgcactgatcaggagaaggtctcatttgcatcacaccagttgcatggccctgcctctgaatggtgggatcacttccgcctgaataggactactgctgaacctatcacttggcttgaattcaccgctgcttttcggaagacgcatataccatcgggagtggtgtctctcaagaagaaggagttcaggtcgcttacgcagggatctcgctctgtcacggagtatttacatgagttcaatcgtcttgcccgttatgctccggaagatgtgcgcaatgatgaagagcgtcaggagaagttcttggaaggacttaatgatgagctttcttacccactcatgactgg

SEQ ID NO: 66855 - DNA, 3585 bp, Oryza sativa
ctttttttcttgattagtacagcaaaactaacattaatttgtgggttagaggataggaaattaaaaaggccatgtctgtttgcttcatttgctctgactaaactatgtgcaagcctgtcctgataaatttatggatactagtaaaataaagatctgcgaccttcgaggaagacaaggacatcctgtcaaggaactttagataattaacaagaagggagtacaataagttaaagagggaaagagacctaggatttatccagtgagtgcttgtatgtgccagattaagttaacctaaccatgaaagttcagtaatgaaagatggttgagagagtgacctggatgttgatgcagtctcttcagatacgtttccaccagctttagtgaaaatagcctgtatgacataagaagaatacattcccaaagctactacatataaagatgctagagataaagtagtcatgatgtaaatataaagtaaaaaaatcaaaagaaagcaggcagcatagattacccgggtatgatttttccctggaaaagccaaatatgcttccaggaccacatcaaaggaaggtgtaccatccttgtctgcatcacaaacggccagttaaccagctcgtggttactgaactcggttgtagccttcttcacaacgattttgtttgcattgtcagataggtgaacaactgaacaggcactgtgatttcagttttgtgttatccatatggtaacagaaaataaagccaaatatagcaacttgagaaaaaaaaatgaaatcaagaaattgattgtattgattgtctccccccaaccaaacttacaatgaattgtgctacctatctttatctacaaaagaatcatttccttcttagatatgtaacaaaaaatgatgattctaatgaactaagaaaagatcaaaagaccttaaaattcaaaaaatataccaaagagcaaatcgctcttctatctaatttctttttggttcttctttccctgtctgtgtctccatgtcatgtattgtggtgccgtgctgtgcaagaccaaatacagtgtttaccaatctaccatggaagatttccagtgtgtgggtctgtgaaaactttctgaacaaaatctttcaaaccgttatcatatacttcacagaaacgtctcggccaatcctctggttcaaccggtttggtcccaagcccaggagccctgtcccttgatccaacattctcctcgtcctgccaatcagcaacatatgtcgcgacacgtccggagaacttatccttgaacacctcccagacttggtatttgtagtggttgatcagcatcataccctgaccaatgttcacatatttcatcccttccttcagatggaagtggtgcaccacattgatgagggatgggttcaatgcgtctggcctgacaattgacttatggcgctcaggtgcagccagccggcaggtgtagcctgttgtaacacctttctttgggatcttagtccggcctgatggaccaaaactatggcatgcagtcctgagctcaccgatccgtggcttgacagagtaatttcggaggacatcttgtagtgtttggttgccagggaagtgcaggaactcatctatgtcaatgaaccccacccactcacagctctctcgagccctgagtgcacaatgtgcaaatccagcctcctgagatttcatccatggccataaatagcgtgtcacattgtacctggatgaatccatggtgttgaggacctcctcaatgccatcgtcgctgttgttgtcatagatgaaccaccgctgcacaccaatacgtgagtgatagatgatccattcccgcaggaaccgtgcttggttgcgaagcatggtgcagacacacattgagtgtgcctttcgtctccaatgcttgttgtaccgaggaagcggcccgggttgcgcgattgaggggagtgtagagcttccccggcccttagtcctgatggagaccaacataggcttgtcatcattgtatacgctgttttcgcctccggtagtcatccggaggtaccggcgaatgcgaactggtgtcacacaccggaatatctcctgagcagcagaaacctctggggaggtgacaacaagctttggcttcgaaaagtctcggccaaagacacactcgtactgtgatggcacacttagacgacccggacgtaggttcatcccctttgcaaacacagcggtggagtgtccttgctgtcaataagtgcagtgtacaccagccgatcccattgcaacggcgccaccggaaccgactgcgccagtgagagggacacagcgaccctggatggtccggcgggacaatggacgaggctgggtccatccggcaaggtagcgacggacaagggctggcgacgcagctgcgacgagttgacaggggagtacaggcactccaattgccccgaagcccgcagcaatgagccatctctgagcatcaggagaacatggtccggcaaggcaaccgcgtgctggatatgaacagaaggcaacacggcgtcgacgctgaccatgccggcttgctgcgcgccgcgctccgacgacacggcgttcagggtggccgacggccacgcggtcttgagcacgggccggaaggatgctgcatcagggggacaacacgaacatgggattagttagcacagcacattccgtccataaattaaagagccaaacggattcggcatgggtgaattcagattgcatcaacagaaacgttcttcatgtgaccaagataagccttttctattcccagaattcacagtatcaattcagtcaaacggcagtagcagcaacactagttgcaatttagtaaactcgcaagccagcgtaacattccggaaatcgcgaaccacgcaagaatggaatgagaaaaaaaaacactacaaattttgttggaacagtgagacccctcagatctgccacgcgatttgcaaccccacaagaaagagagaactttttcttcaccactccccaacagcaaacactaaacgcataccagaaacaaatctaaataaacaaaaatgcaaaagaaactttccctcaaatcattcgcgtgagtccaattgaatcgatccaaaccgcgcctccaaccacaagattgtcatgggagcatgattccactggcctagctaaacccaaccaagatccaattcaactccccccccacgccacggcggcagccaaccaactccgccgccgtccccagaagcgaccaaggcggaggcgagggggaaaaacgagtctcacctccaatgacgtgcgcggcgccgaagagcaccgcgccggcgaagaggaacgcgaagaacgccgcgaacagccgccgctgcgtccccgccggcgcccgctgccccctcgccccgaaactcccacctccccctcctccgccactgcccttactcccaagcctactcagcttcctctccttcgccgccaacgccatgccgcggacgcacgcaccactgtctccagcagctcccctctcgctcagatcgatccacgagcgccggctaaccccacgcgccgcaccattcactgctcctcctcgccggcggcgaccactggagct

SEQ ID NO: 66856 - DNA, 3465 bp, Oryza sativa
tctgtttgtatcttattaaaaaatagaattattacttattttatttgtgacttgctttattatcaaaagtaatttaaacgtgacttataattttttatatttgcattaatttttttaataaaatgagtggtgaaacattacatgaaaaaagtcaaagcgaccattaatttagaacggaggtagtactaggctatgtccaacggggcgcgcgtgtgtgtgacaatgacatgtggggacagggagctggggccgttgcgtcagttggttggggtgaggtgggatgttggtggaaagtgtttttttttggggcttggaacagcaattattggggtgcacatggggcaaggtatccaattctgcctattgaagattagggaattttatttagggaataatgtagggggtatttctcttaagtaacaggtgttctttccatttccatctttctttcttttcttttcatagaaaatgacagattaatgactaatgaggagaacaatgggaaatgaatacacattgtttcactggaaaaggagggtttcaaagcctttgtgttatattacttgtttaaatattttaaacacatcactaatcctacaaacttggacatagatagatcataaattactggtgatgatttttttttctggaaattattttactttcttattgcatcaactttacctatcattttcattgtcttttttcttaaaaggaaaaacgataatcaatcaaatatttggttggctaatagcgtttgaacgatgaaatcttccacgcgttgaagttggtggtcaccaaaatgtttgcttaggttaggaccatcaaggccctacttggacaaaatgttttggcacatccatattagcatgtgataccctgttcacttttgtctttagaagtcaaaaggaaatagtgggctgtgaacttcgttgaatctgaatcacttggaagaattatacttaccatatctcaaaatagcttttctttgtcttggaaaatatcctcttagacaaatattttgcatatcgatggaatgaaaattgacttgttgcaattcctcagtgatcaacggtgcaattagacccagtaattgcagtcaccttagttgaagctgggatataggtttcagggttgtcatggatcatctaacagtagcttatgtaaccaactttcagcacaaattttaccatactactgtatttcacacttgacagagtagttaacttgatggtttgcagtaatatttgtccttagggttgatcaagaaatccaaagttaaaagaacccttacctcaaagcaaagtcaaatgtggtcctttaaagggtcctcacattaaaccctgcattaacccttgttggaggttggttaagggtaagtattaagtaattacaacttgcattgtattgtattatctttgtatgagtgatgatgcctcaaaaccctgcagaattccaatgtggagcccttgccaaaaggttaataaaaaaaaggcaattgtcctggtaatactttattaactgtactgttgctcctgcaactagtttaccttttgtactcttacaacacacatggggtgtgggacttaccgacttagtaatctactacttctcagctaatctgaactctgaagaagcatataaattttacagatccggataatctgatgctatgccagtactaggtgtttgtcagtgtgttggtgtccgtattaattaaatggcattgaaatctcaaggaagaacctactggttttaatatagatgcagatactagcagcttaggacatgtgagaagtcgaaatgcagcataccttattcatgaaccattaaaagtgtgatttataggaagcagaagtatatcaaatgcaaatgcataccatggtatgtttctggtctggtcagagtttgttagaaagtggaaccactttcagcacttctttttctgaacatgcacagctcatgctagagaacattgcatggagtagaggaagaacttcagattgaaatggtctataaaatggcagctccataaggctgaaacattgcaacagacagcatatggttttagctctgaaggtaagagttgtaggaaactgaactctttcttgtcagtgacagtttcaggagctcagttttctccaacatcttatcttcggcgccttaatctttgtagtgactataaatatgtggagtggtagcttggttaggtatcacaaccataatctttggcagctgaatttgaggtttggatgggaccaaatcttactgcagacttgcagagcaagacaagatttggtttcctccaatatctcatgttcagttgtcagacagtgaatagtggtgcaattagttagctttaacttatgggtggaacaaccttggaagctgaatgtgagagttggatggggccaaatcctgagcttcagatcttgccatggcacaagatttggtttcctccagtatctcaccttcaattgtccaagatggccagatgcaacataaaatgtgttttgtttatagcattttctgtttagaaatgggtacagagtgggattggaattagagtggaacagatgcagtgtagggaaatatggctgtcctgttatttccaatgctgagcattctgcagtaatcaagttgctaaacagataaattagcagtagaagcaattacatttcataccagtttttttttttttaaaaaaaaaaacctttcatactcttcaatcttgtatttctatgtaaataacttttattcctcttaatacaaagatacgctcctagcgtattctcgaaaaaaaatactccttttccactgaacaagtagcatatgctaattcttgatcatctgcccacacaagtatcacattttgctgaaatgtgcaggcagcagcatacagcagttgccatttgcttaaatctaatttttggtagcttagctccatgaaagatgcacataaaacttccttcttttagttaaagactagctcgcagccatcaatttgagacaatttctcaccgcatacaagcataactcttttccaaattttctgaagctaatcagagataaagcatggtgctttttctttttacagtttcagactttcagcaatctcaccgtggagtcgtggactatacacagtcaatctccaaggatgcctcaggctctcttcgcgtgaagaaaataaatggaactaaaggaagggatgcacgaaccttggctgcaggagagttagctggaatggtcgattgaggtcgccggcgacgtggaagatggaatgcacgcgcgccgcctcaccggcaaggctaggagggtccgccagagcggcagagccacgaggtcgatgttaaatatgtgatccgaattaattttaggcttacaatatattcggattagttttctaataggactccatgtctttcctattaggtgtctctcctatatatatactcttgtaaactg

SEQ ID NO: 66857 - DNA, 3076 bp, Oryza sativa
tcagaaattcaatggcattctatattaaaaaacgaggagtattacatcaaaattttcgtttcttcttattctattggttatcgatgtggtgaagggaacctggaattgagatgtggattcagatttcagaagccctttcctttccccagtattcagtgctggtcatgctagctgttgctctgatgttccgaatttctgatgagatgtcatactttacagtaccgactatttctgagtagatgaaaaacagttcagaacaataaaaggtacttactacttgttttaatagagaatcaaatactagcaagtagcaacgtaagacatgtgacagtcaaaatgcagtataccctattcatgactcattaaacttctgatttgtaggtccctttcaaataaaaaaaaatgatttgtgacaagcacaagtggtcaaatgcaaatgcataccacagtgtttttctggtctggtcagagtttgttagaaattggaattactttaagagcctttctttctgaacatgcacaactcatgctagagaacattggacgagtagatagagcagaaacttcagaagttcattttgaactggcctataaaatggcagccccatgaggatgaaatactgcagctgatagcatatgtttttgcactgaaggtaagagttgcaggaaactgaactctttctttgtcactttgttagtaacagtttcaggagttcagtttcctccaacatcttatcttcggcgccttaatctgcaggactgtaaatgtgtggagtggtagcttagctaggcatcacaaaccataatctttgacagttgaatttgaggtttggatgggaccaaatcttactgcagacttgcagattaacgcaagatttggtttcctccaatatctcatgttcagttgtcagacagtgaataatggtgcaattagtgagctgaacgaacaaccttggaagctgaatgtgagagctggatgggaccaaatcttgagcttcagatcctgctattgcaaaagatttggtttcctccagtatatcatcttcacctttcccagatgcaatatgaaatgtgttctgagggttacaccatcacagatacttacagaattttctgtcgagcttcttaaattaattagttaaatcttgaagctagttggcaactagtacaatgccgggttagaattagagtggaatcaattcaatactccgcattcagataaattatcagcagtctgcaggtgcattcaacatttctactctttccattttaaaagaaatagtcgttttcctccgattcttgatcatctgccacacacaaatgtcacattttgctgaaacataggtttctttctgttgagacctgctgactgccgttgccatttgctaatttagttttttttgcagcttaattccatgaaaattgcagataaaaaacttttcttttccattaaaaactgagatcatactcatcgattcaagacaattgctcactgcacaggagcattgctcatttaatttttttttcatacatcctctgaagcaaacacatatactgaactaatcagtgaaaaagaaccagtaaaaaaaactgggtgttttgtgcctgaagcacgaactaaatcaatcaaagtgtggtgtggcaagtttagccaccaaccaaacaacccctaaacaaggcagacaaaaatgcaataattccaaattgaccaccagtcagcaactctgcatcgattgatgcaagcaggaagcattcctcgttacaaatttctgtatacatctagaaaaagcaaacacatgtacacccggggtacatattatcatgataagactcgaagttattcatacataaaaacattgtatttctgcaaaaccatgatcaacaagcaaactctgttcctacttgctactctctcatgtgctgctaaccgtcctcaacatcagggcactgagctccagtctgcaccttgacccctagcaggctagcacatacatctcagaaaagcaaggacataatctgcctcctttcctttgtcccacagcgaagaacaggtgctacgatctcggaacagacacagctctgagccctgttgaagattcgaagtccatcatctaccttgtatatacaagtcagcctgcgaaaatgttcaggagcaagtaacatgaggcatgcaggaatccatgagcattcacatcagtgatctaactagatctggcaaacgagctgctcatacgacgtcagcattcagcaagcaacgctgaggagcgctgctaatgaactgtagcctctggaggaactgctggctcactgctgatagtttttgacgaggcaatctcttctaggcgcttccatgtggcctcacgttttgatctcaacgcggtttcttttgcttcatcttcctcaaacttcttgaggcactcctcaaacagtaccgggtcatgatccatgaatatcttgcgaacattaagactcaagctttgaactgcctggttccagtgttcttttgtatttcgttctattgcaggaaggattatgggcagtatcaccttgctgttctgcttgatcaagacctcaatatggtcgttgttccacagaaacagagctcgctctgccacctgcaaaacaagaaaaaataagaatcaatacgccattaccttctatgacaaacaggtagcatggggtcactagaaaattaaaaagcttaagtttcgtttatcacaaaaacttaaacacaacacaatttgatcatcaagcaaatgatcaagtagctgatggtcattctcaaacgccaactagtaaaatacatataatatcacacatccatggatcaggatctcagtgaaatttcaccaatatcttgtcatcttggatgggtccgaaacaattgcataccaggggaattttttttaatttaaattgtatatacaaacaagcctagcggtagctcttactactatacagggtaagtttctgtggttcgagtcctgtcgatgccagcttcatctctttttcacataaaaatttaaatttggtttcagtttttttggcaacattatggcaagaaaaatgatctctc

SEQ ID NO: 66858 - DNA, 4530 bp, Oryza sativa
ccgcaagcttgcagtccttctcaacaaactgagtaacacaatatgacagttgttgatgatacatgctaacacattttggtttgtggagtggaatcaatgctcgcacaagaaacaatttgtgctcttccttgagtggcaaagcaaaaccattgattatactccccaaaatctctaatagctcagcaatcccgttatgcttttctgtctcaaatatgaacctgtagaagatattattaatcgccttcctaatgaatggacggtgcaccatgaacttcccatatatcctatgaagtattgtcttcaaatactccctttccctaggatcctccgagtcaaagagatcaagcagcttgataatgaaaccatgatcgacgtatctcttggccagcttagcatcggtctcaggagactggacaaaccttaagaatagttcatacacaatctgcaagtgtggccaagccgggtccatgacaggttcttcctcctccatatcaaatgactcaagcggcttgttctctcttggcgcggggttcggtaccctgaacaagttggtggacaccattttgatgacctcctgcacagcgggctccgggaatttccccgtagctgaggtgacataatccacgagctccagcaatgtttgcctcttgatctccttctccttgacatccttggtcgggtccgtgaagtcgaaaaccacacagcacatgaccaccttccggagaaacaagctgggcttctctggcgccggcgcatcccgtaagctcggaagcgcctcaaacacgggcggcgccaagaaaccattgctgacaccagcaccaccatgatgggcgttcttgacggtgtaattctggccgggatttgtgaccgcggctgtataattgttaggattggcgatcctactagacatggtcaaatccgtggtggttcttgcatcaggcagcgacgagccgactccggccaaatccttctccccggacttgcccggcttctccttcttgggaagccggcccaggatttgcttaatcataacggatcgtccaaacaagcaactcgatcaaaattcacgaatccatcattcctcaatctgatcatcaaattaattaaaacgccgtaagaagcagggaaacgaattcacctcatatatagcacaaaacaaaaaaaaaaccgcaccttgctaggatcaaatcgacgcctccggagccaaatccgcgatcgagacgacccctaaaaccgcgccttttccacgagaaacacaatcagtgacaccaataaaaagaagaaccgtgcggagagtcaaaaagggaaaggggggtaaagaaaaaggcagaaaaatcccgcctttttttcccgaatttccacgcgaattggccccagggggaagggaaaggccgcgaattggatcgattcgtggagaaaactatggggatttcgccgtggaggaggcgtcgccggtcgggttcttcctgcgatgcgagcacagtggggagagaggcagtgggtggggcgaagccaaaatgggagagaaaactaaaaagcagaggaggagatgatggatagagagagagagagagagagagagagagaggaaaatataatctttttgttttttgtttttggacctaatccaaaatggatagcttcgttttggtcctaaatattctggtgcacattttgtgttgcacccagtgaagtgcaatttcagtcttgtgtggactgtaactttcagtggcagcacaaaaacatttttattttttcatggggatgcttttctttttcttttttccgtttttacatgtgttttagtacttatgtatgataatccctccattctaaaatatatagtaatttatgatcggattggacatatcctagtataacgggacatacccttgtccagattcgttgattaggatgcgactaattcgatactagtttttatattttgaaacggaagagtagatttatgaagattgattgttctaccattcatagcgacattctcctagattcaatgaaactagattgccatgtcatcaggggcatgtgatggttgtctcaaaaatcaatttcatgttagttaagatggtctaataactgtttctgtactatttagcagatatctgaacttttttcctattgataaagattacctaagaacataactacccccaagaaaagaaaaacataggattcggtaacataccctttttttttctcactctaacactttacttacccctatatcaaagatacatacatcatgatttatgaagctgtcgttttgttgatggcacaataatgcaaaaggaaatattcttatttcactttagaatataaaccgtatgcttttagaactgaaactcttcttggtgaactgtctttcctctgagtacgctttacgtgtacccttaaaaaagaagggttaaataaaggtccgtgacaaatgagaactcatgagaagaaatttctgatttgaactaattgaatatataagcatgccatataaaacaaaataaactaatgatgcaaccatggccaaaacgatagacttgtaacaggtccaacatgccactaggaggagaagaccagaggcagtcaaatcaaacgcatatacttttattgggtcaccatttaggacggtcaaatctcacctttttatgtcgaaaatcacatggtcaaatatcaaaccagatgccctgttcttcagcacgagcaagaatgtaagacccatcatacactgaatttttcaaccacaagaacattatttcttatttcaactgaatttccatgcgtgcttaacataatggatgattcaggatgattactggattgatggtgattcctgattactgaataaagacagctagtgaggggaagagaggggggggggggtctaatctgcctctggtgtcactattaggaccatgagtaacaaatggctgaaagaaaggcatgagagaaatgtcacattcagagcagtgtgattaaagcaaaggccagtgttttgctgtgctgtgccttaagcgttgcttatctgtccacctgcttgtgcaagcaacttttacctaatcccctccactttactgtgtgctcttgcagattggtttaaccctagctaattagctaggcaccaaaatagaaccaattagggaacagcagagaaaaagtgagcaggtgtacatgtacattcagacataaagagatgagaagctagattgcattaacacagatagaaaatggtggtagaaaattaccattttgtacagtctctcgtaatcgaagtaaagcaaagcctgatgctgcttgaaaagatttacatcaccagctcctcgagtgaaagaaataagggaagaacacaagatgcagtaaaattcaggatgagctgcaaaagaacaaatcaactgaatttgcgtgcggaacctgaactgcagcttcgtttcattctccgatcgatcgctgtcgaatgtaggtggatcgcaagtagcacaaggcagcacaacaggcagttcatctctatgttacccagatacagggttacggatacgcgatacgttgatacaaggatacaacacttttcagaaaatatggatatggggatatgtatatgtatgtacatacacacataacacgtatatctatatatctttatttttactattataaaaattaaaaatgtttttggggaaactcttttaatcactcgagtggatgtccacccgtttaatgcatatcatctaaatagttataaaaaaattgtcaagatagatcaatatataatatatcactccacaaacatacatgttaaaattcatcttctacaagttgtaacaaaaataacaaataaaactcaaattagtatacgtatatttgcagttagatttgttatttttgttacaacttgtagaagttgaatttacatatgcatgtttgtggagtaatatattacatattgatctaccttgtcaattttttttgaaattttttcataactatttagttgacatgcaataaacgggtggatgtccacttgggtgattagaatccatctccaatgtttttccggtactttggtacgtcatctgtgtatgagtcagtttttaagttcgtttgattttgaaaatacagatatgtatttgagtcgtgttttaaattcgttcgctttcgaaaatacgaaaggattcgtacaagatatctttttataaaaactcgcatgctaaattgagatgattggactcctattgcagcacatgattttctagaaatatatatatccaagcgaattcacacagtgaatttcaccttaactaaaccgtataaaaataataagattaaaataaccttcacccgttgcagcgcatgtgaattgagggtggatagggagagagtagctacttccggtagtaacttatactcaatttcaacaatggtgtccgggcaccatggagcaccaaacaaaattgtgagtatatacctagttataataattcgattcatacctatacctatcaacaaaacaactcaaattta

SEQ ID NO: 66859 - DNA, 1250 bp, Oryza sativa
caacttattccggaagtcgcttggcggaattgtatatggcaaggattgtgtgtttgcatggcgtccctaagaagatagtgtctgatcgaggcagtcagtttacttcaaatttttggaagaaacttcaggaagagatgggttctaagttgaactttagtactgcttatcatccgcaagcagatggacaaactgaaagggtgaatcagattttggaagacatgttgagagcttgtgctttagatttcggtggaagttgggataagaatctaccttatgcagaattttcatacaacaacagttatcaagctagtctacagatggctccttatgaagcactgtatggtcgaaagtgccgcactccgcttttgtgggatcaaacgggagaacgtcaggttttcgggacggatatcctaagggaagcagaagaaaaagtaaagatcattcaagaaagattgcgtgtggctcagtctcgtcataagagttatgccgacaatcgccgcagagatttgagttttgaagaaggagattatgtgtatcttcgtgtcacgcctctacgaggagttcatcgttttcataccaaaggaaaattggcaccgcgttttgtgggaccttataagattgtcagtagaagaggagaggttgcttatcagctagagttacctcaatctttggcaggagtccatgatgtgttccatgtgtcgcaattgaagaagtgtttaagggtacctaccgaagaagctaatattgagcagatagaagtccaagaggatttgacttatgtggagaaaccaatccgtatcttggaaatagatgagagaagaaccaggaatcgagttatccgtttttgtaaagtccaatggagtaatcactcggaagaagaatcaacttgggaacgagaagatgaattgaagtcagctcatccacatctattcgccagttcttctgaatctcgaggacgagattctgtttaaggggggtaggtttgtcacaccctaaaaattcaaaatctataaattgttgtttaattggaatttttagaaatgattttaaaagcctagaagagaagatctaattttaattaataaattctaatataaaatggggccagataaaattttattaaatactttgcttaattctataattcctagatttttctgggatttatttgagctaaggaagtatttttaataaatggaattgcatttcatgaataatttaaattgaaaaaggtttttaaaagtctcttt

SEQ ID NO: 66860 - DNA, 3917 bp, Oryza sativa
gaaacctctatgacaattcccaaattcaatctttcaaattccttgcataattccaatggcaactgtcgtccttccgtagcattgcaatagcctttcctgctaagagcgtctgctacaacattagcctttcccgggtgataatgaattcccatgtcataatccttaattaattccaaccatctccgttgtctcatgttcagatccggctgagtaaagatatactttaaactcttgtgatcggtatacacctctgtacgagtaccgaaaagataatgacgccaaattttcaacgcatgaactactgcagctaattcaagatcatgagtagggtagttctttgtcacaccctaaaaattcaaaaaaatataaattgttgtttaaatggaatttctagaatttattttaaaagtcttgaaaagaaaatctaattttaattaataaattccaatataaaaagggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaacccttctctctctcttcccccggcccaagtcggcccagtccgcagccgcccgcgcgcgcgcgcgccctcgcagccgctgacaggtgggtcccacctgtcaggcccgtcgtcctcctcgggccgaaaccctagcgcgccgccgccgagccgccgccgctgtttcctttcaatccggccgctcctttccttctccggccgaattggttgaggggaaatactctccgggatctcctctacctttttcctctttggaatcttcggccaaatcgctttggaaagcttggaatcgagttcgattcggatcgggttctctctctccaagccgcgagtttccttcgccgttgccgtcgccgtgggcctccgccgtcgcctccgagcccctttaaaaggatccccgtgcccttctctacccgccgccaccctcgccttcgcctctcgtcgccggaatcgtcctagcgccgtgcgccctagtttagtcgtcgccgccgccgctccagccaagctccgccgtcgctccagccgtcgccgtcgctcgggaagaccgccgtcgtgttcgccgtcgcgtcgccgtcctcgtccgccccttcgccgccgtcggagaccaccggagcatcttcgccgtcgtcaacccgaagagccccgccgtttcctcctcgtcgccggcgccgtccgttgcctctccgccgttgttttggtcatcggtgagttcgccgtgccgcccgcttcgtcccggtgtccttcgcttgcgtcctcgtgccgccgttcgccggcgagcatgcgccgcccgagccgtccccgtccgccgtcgctccgccgccgccgtcggtgacgtcatcgctggcgtcatcaagcccctctcccgtgagccgccgtggacccgatcaatctcagccgtccatcttggatcggttagatctcggccgtccgttcgcgtgaaccgccgcccgtgcgcccggtccacccaaaccctagcgccgctgacgcaataaatccccttttccttttcaaaaataattcattattgcgtcataattcaattttaagccgatttaggtgttttaatccgatttaatctttaaaaattcataactaattcatcttagctccgatttagttggttcaagtctctaaatttttctaaaattgagatctacacattaaaaatatccacatgtactgttcaagcttgtttatgtgctgttttggtgattttgttcttttctgcttagattccgtcgtttccggagagtccgttttcgccggaagagagtttgaagagttccaaggccagcaaggcaagtcacacagatcccaaacaaccctttgagcatgttgatcctatttaaagctattgttttcattcaactactgcatttattttcgaatgtcattgggtggaattaacctattctttgttatagccccttttgttcttgtttattctattccttgataccttgggttataataatttgactggttgaactttatttatattggttcaactagattttagatacaattgcttagccctgcttagaaacattagctcacttttgggataacttgattcactattatttcatgatggtttaatgatagttcacgatggtcaatcgtgattagttaattaattaatgtgccaactaaaacctggtaatggtgggttgtgagcacatggttttgaaggtcgtgctcatgacaattaaggaccggttcacgagtttcggttgtgaaacattaaccgtgccaaccacaagccagcatgggcaacggctttatcttttgtgtagcatggttcattgcggagcaccagactgagaagtggcggagataagcccacgggggtcgctggggagtccatgccttgtttataagggggtgattatgatccaggaaggtgcgctgcagtggattgtgttgtatgaggggtattgtcacaactcctttccgaggtatcgtggtgatattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacttttcaccatagtaaatgatgctataattggtaataatttgattagctcctggtttggaatggtatattcctggtttggagatagagctgtgcagccgggatggttgttcagaatggttgggcctatgcaacagggtatgttgtatagcgttggattaatattgcttaattaatacttaactgttttaaattctcaaatgtttgctaaatgctgcttttgcaaatgaaaccctattatgccgtcctttgttatcctgtgcacttgcatatttgttgcgtggcttgctgagtatgtcatatactcaccttgcaatcattcatcagaggaagagttctgcagtgaagctgatggtgtggaggattaggtgtagccctggtcaagctgcctgtggagtggagccgtctgcgccgtttattttattttccgctgcttagatccttattgattgagaggaactatctacctctgtaataacattttatacgcttatagagtagtaattgtactctattatcaatttgttattgtgtgcctcggctgattcctggacgagggttcacacacatgtaagcgtttggaattttggatagaaattccgggcgtgacaagttggtatcagagctcccttgaccctaggttatgccaaatggttacccatagaagccctctaaaaatattggaaaagtagaactgttcttctccctttctcttttaattaaaccaaactaatggcacatgcactttataatctcttttaatggttctcatttaaaatttattccagtgttattagtactgtacatctattactgtactgatggctcatttaccagcagaagtttttattgttttatttaatcttacagcaataaaatgaatttagcaagttgattttataacttttctttttatttcttttgaaacctgttattcaaaagtacaaaattcgtttccaactgtttcaacttatcttgcaaagtttggtttacttaatttatttacccttttactttgaatttccaaactttattaaaattaatccaaaaaattgtgctattaattggatagatgtcttaactccctcctttcacttgcctttagatgccgcgctacaagcctgagtacctgtttggtgttgaagggtttgtccaggagttgcgtacaatgtcctttgt

SEQ ID NO: 66861 - DNA, 7856 bp, Oryza sativa
ctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccactcccgtggacccggtccgcgcgccctctccctcggctgacgcaataaatgagtttttaattgaaaattaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgcttgttgtatggagtttattagagtaaaagccgtttcttttccgttggtcgtgtagacgctgcagcttcggaagatccgcccttcgtggaagttgaagccggcgtttgggaaagtgagcaaggcaagtcacatcacccttgagcatattgaatcccagtttataaaattatttcgatttaaattattgcattatcgctttgtttaaattcccgcgttatcactgttttatttagccatgcctatttacctttgttatgacattattattgctattgttattattaccttgttcaccctagaataaacaaaaccccaactagtgggtactctattcctggttccactagtatgaatttaggtagatgcttcgctgattaattaggcaacattaggtggttttataactttagactttgggaattctcatatcatttggacactatggaattgttggattatggtggaattggacatacacctctcttcctctttcaaaacccctaaaacctgttttcggtggggtttgggtgcatgccagttatgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaaccatcgtaggccttgggttaaggcaggttcgtgagggttcacggccttgtttaataatactgtgtagctctaggatcgtctttacaaaatggctttgggcaactgagtgacttttaaatgctgtttactgcaaaacttaatccctatattattactcccttgtacctccattgcattaattatgcatccgccggtgtggcttgctgagtactgtggttgtactcattcttgctcaatctttcccctcttcagtaagagaagctttgaagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcaggtttgtgtggtgtaccccggcttttcctgggacggggatcaatacactagcgttcgggaaaaggcaattttcccggtcgcgacactaggatcgacggcaactcctcctgctgagatgacgtgaccaaggaactttacttcagacaaccaaaattcacacttgctaaacttggcatacagttgatgttctcgcagcttctccaatgcaaggcaaagatgttcttcatgctcttctttggttcgagagtagataagaatatcatcgataaagactaccacgaacttgtctaggtattccataaacgccttattcatcaagttcatgaagaaagcaggggcattggtaagtccaaaagacataacagtacattcgaacaatccatatctagtggtaaaagctgtcttaggtatatcttcctctttgattctcaactggtgataccctgatcgaagatctatcttggagaaaacggtggcacctttaagctgatcaaacaaatcatcaattctgggtaacggatacttattcttgatagtcacatcgtttagtgcacgatagtccacacacatcctctgggtatgatctttcttttccacaaaaataactcgagctccccatggtgatgaactcggtctgatgtatcctttctgaagcaaatcatctacttgccttttgacttctgccaactcattggctgccattctacaaggtctcttatggatcggagttgttcctggtaccaaatctattctgaactctatatcccttttaggcggcataccaggtaaatcatctggaaacacatcaggatactcccggactataggaatctctttcaaagttatttggtttagtcttgaccttaaagactcagaagacaatgcatgaacagtcacaactcgaccatcattgctggtgagggttacttttctgttagcacagtctatcacacctttatgtctggctaaccagtccatccctaggataacatcaaggtctttggattctaacaagataagattggccagaaatggtactccctgaatttctattcggacagaggggctacgttgcaaagaaagtgcttgattacttggggtactaaccatcaaaggacgtctaagatcttctacttccatcccatgatttcccgcaaaactcatagataagaatgaatgtgtagcaccagaatcgaaaagcactgttgcaggaactgagttaacaaagaacgtacccaaaatcacatttggagcatcttgagcttctgcagcagcaacatgattgacacgggcctttgatgctggtgcggtagagttgctctgggcagggacaaccttcacacgtcggggcttcagacacttgtcagcataatgtcctgggtctccacagttgaagcacactacgggcttactgccttgctccctcttgacaggctgttgctgtgtcgaagcggcaacagggcgtggagcttgattgtggatgttgttgccagcattgttgttgaagaactgacgctgcggacgaacaacagatgaagaacctccctgtggcatggactggggtcctaaagtaagacgcggcttctgattattctcctgttgtgtcttgaattgagcaatccggcgtttcttctgctccatacggttgtatttgtcctcctggcgaatagccttatccaccaacttctggaaatcaggataatccccagtcatgagtgggtaagaaagctcatcattgagtccttccaagaacttctcctgacgctcttcatcagtgcgcacatcttccggagcataacgagccagacgattgaactcgtgcaaatactccgtaacagagcgagatccctgagtgagcgacctgaattccttcttcttgagagacaccactcccgatggtatatgcgtcttccggaaagcagcggtgaattcaagccaagtgataggttcagcagtagtcctattaaggcggaagtgatcccaccattcagaggcagggccatgcaactgatgtgatgcaaatgagaccttttcctgatcggtgcactgaagcaaatccaacttcttctctatggcatgcagccaatcaccagcttcaacaggattagtggtactagagaaaataggcggcctcacacgaagaaattctgctaacttattctgaggaggtgcatggttgttcccttggttgagctggttctgctggttctggagttgctgcatcatcatgttcataagctgtgcctgttgagccaggacttgggcaagtgtgggattctctccattgttgttgttattgttgttgttggggccattcctgttgctgcgagtgagcaccatctggcatgggcaggagcacaagaagagaaaccggggaaaactacttaggacaggggattaatttttcttttattgatcttaagtgagtttcattattacaaaactgaagactctcacaccactaaactcaccaacttcctaacactcagaagcaaacaaacgcatgcacttacatcccaccactgatgtaaattacatgcgagacacacacaaccaaacttaaaacaagcaaactaacacaacgatctaagacaacgactagacatggcactctagttcttccgggcatcggagttgattgaaggctcgttcggctcatcttcatcatcttgagtagctccccactcaatcttggaacgagtgtgcttggattcttcttcatcatcacttatgttgatgaccggaggatccgctagggctggggtaacttctttctccaccacacggacctttggcgccaattggtagcgagggacaaatagagctctcttccttgcggtaagacgaaccctggccttctgcagcggtgcttctcccttcaatgcggctagttccttctccaaacgatccaccttgtcttctagcttgcaaatcttaccacgattccggtcttcacgatcttgagctgctaacacagtctccgcacgactttcatccatagcccatagcatctcaaccaaatgccttgtggtagcatcattctcaattccttcggtcttaaggtagctgccacggtcacttccctggggttggcgaggatgatagcgatactcagtgtcggccaaccgatcactgtagcgatcgcggagctctcctatggcgatccttgccacctcctgacatgcatggatgtagtttctccctccagcttcgaacattactgaggggatatcctcactattactgttcaaggtgactttgactcggcacttctcttcatgtcgatcatgaggaatctgggcataaaaaggggcagtcccaaatccaatgacaaaggacatcgtacgcaactcctggacaaaaccctcaacaccaaacaagtactcaggcttgtagcgcggcatctaaagacaagtgaaaggagggagttaagacatttatccaattaatagcacaagtttttggattaatttgaataaagttagaaaatcaaagtaaaaggtaagtaaataaagtaaaccaagcttgcaagacaagttgaaacagttggaaacaaggtcacaaattttgtgcttttgaataacaggttccaaaagaaataaaagaaagttataaaatcaacatgctaaatttatttaattgcagcaagattaaataaaacaatgttgtagaacttttgctggtaaatgagccattagtacagtaatagatgtacagtactaataacactggaatagattttgaatgagaaccattaaaaaaaagattatgaagtgcatgtgccattagtttggtttaattaaaagagaaagggaggagaacagttctacttttccaatatttttagagggcttctatgggtaaccatttggcataacctagggtcaagggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtaaatagttcctctcaatcaataaagatctaagcagcggaaaataaaataaacggcgcagacggctccactccacaggcaacttgaccagggctacacctaatcctccacaccatcagcatcattgtagaactcttcctctgatgaatgattgcaagatgagtatatgacatactcagcaagccacgcagcaaatatgcaagtgcacaggataacaaaggatggcataatagggtttcatttgcaaaagcagcatttagcaaacatttgagaatttaataaaacagttaagtaataattaaacaatattaatccaacactatacaacataccctgttgtataggcccaaccattctgaacaaccatacccggctgtacagatctatctccaaatcaggaatataccattccaaaccaggagctaaacaaattattaccagttatagtatcttccattatgatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaattccaccacggtacctcggaaaggagctgtgacaataccccttgcctaacacaatccaccacagcgcacctttcccggatcatagtcacccccttataaacaaggcatggattccccagcgacccccgtgggcttatctccgctacttctcagtctggtgctccgcaatgaaccatgctatacaaaagataaagccgttgcccacgctggcttgtggttggcatggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaaataatagtgaatcataagttatcccaatagtgtgctaatgtttctaagcagggctaagcaatcatatctaatatctagctgaaccaatatatatagcccaactagtcaaattttaataacccaaggtatcaaggaataaagtaatcaagaacaaaagggctatagcaaacaataggttaattccacccaatgacattcgaaaatagatgcaatagttgaatagaaacaacagctttaaataggatcaacatgcttaaagggttatttgggatctgtgtgacttgccttgctggcctaggaactcttcaaattcttctcctgcgaaaacggactctccggaaacgtcggaatctaaacagaaagaagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagatttaatcggattaaaacacttatatggattttaattgaattatgacgcaataatgaattattttggaaaagaaaaaggggatttattgcgtcagcggctagggttacggtggaccgggcgcacggcgatggttcacaggaacggacggccgagattgatcgggtctacggccggaccacgagagacgacgacgatgacgtcagcggcgatgtcacctccggcgacggctcggcggctcgggctcgcatgctcgccggcgaacgacggcgcgaggacgcgaacggagggca

SEQ ID NO: 66862 - DNA, 1278 bp, Oryza sativa
tttagaaggagatggcggcgcggctcggctagggtttcgggcggcggcggcgcgacgaagacgacgactccgacaagcgggacccacctgtcagcgacagcgagggcgcgcgcggctgtggcggacttgggccggcttgggccgaggagagagagaagggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaataaaattttatctgccccattttatattagaatttattaattaaaattagatcttctcttctaggcttttaaaatcatttctaaaaattccaattaaacaacaatttatagattttgattttttagggtgtgacacacaacataccggaaagaggccgtgacaggacccttcgcataaccccctctaaccaaacacaccacacctcaggtttcacccccactcctcgcaaggcagcgggcagtcccctctcgtgcctaggtgaatccggaagccgcataggccgtcgcagggcccatccaaactccgtcacgcccacccttgcctggatgcgtcagctagaggaaagctacactacaagtccagccgttgcccacgctagcttgtggtaagtacgataagttcttccagggcatcccgcgaaccggtccttaactgccatgggtgcgaccagcaaaaccatgcacccacagcccaccatgtgatttattttaattaaccaacaccaaagcggtggcactaatccaacaataccattagaaccagcagtctaaacattaatagaattttccccattgtgcactagttgaactaagcatggctaagcaatccctagtccaatctttagtcatgttataaccccaagctgacaaagggacatggtacaacaatagcatggctatgacaataggtaaacatcccatagtaacattataaaacaatgcaatatttgaagaaaaacaatagagcatttgcaatataggatcaacatgttcaagtgacaagcatgacttgccttgctctgctgctggaggaacctcggtgactattttgaagtacaccggagcgtcgtatgaaccggaatctagcgacatacaaggcaaacattgcaaacaggctataagactactgaaacgaggaacaaaaccatttttaatggattctacacatttttcttgat

SEQ ID NO: 66863 - DNA, 1959 bp, Oryza sativa
caagatgatgatcaaatctcaattatttgcagtacttgtccacacaatttcgcaatgtagacttttcgagccccaaatcctaccaactttggggtcactgaatttggcccattagctatgtgttataatccaagaaaataataagagctgtacttcatgtaatagtataaaccaacatcacttcactgcaatttgtaagtcaccagcagcactagcaggatcagaagttaagcagagaaaaaggcaaaggcacatgaagcaaattggcaattaacacacaacagaggaatcggttcagactaggtattttgccacataacaactataccttacacctagaaatgcaagttcactaaatattggtcacagatcaactagggttgtgttgggtaagttcactctactgctgaagaagaaagaggaactgaagttgaagcatcgaaatccttcgtcagacagaaaacatcagtgccatttttaagttcatctgtaagaagcgagctccaaaagaacatcaatgtcatttatcggttcatctgtaagaagggagctctcctccaggaagctcccaattgtcatgcttatcatcctccatgatcccctcctttggttcctgctcgtcaccaaatgggtacggacccttgaaatgcctgcagtagaaatgataggaccaattatagaaaaggcatgtgacattgtgacaaacaaaatgaactcaagaggaaagtacaaagcataatcatggatgactcctcatgctacacattctaaatgtcaaaagtatgctactgtaatgtacaatcgatggtcaatttgtcagctcctagttacctctacatgggaatacacgtttgccatgatgaattcatggctgagaattggatcaatatgtccaaggctaggatagaagcaatgcgatcatcgcataaaaagaaactactggtggatatcctaacaaaaacacaggaccatctttcttgctagaaaaggggatcatctcataagctcaattgctttcattcaggactgaaatgctaatgacaatgaatttgcaagatggtcgtacagtccaatgaccacattcagaggagcatgccaatcagtagcatcagagtgctgaaatgctaataatattcacatatgctcgatgtattatagcaatataagacaaaaattcaccgctaaagaggcagcattgcattcttgtaacaagtgaaatcagtcactgaaatatcaaatgggcctaaaatggagctcaaacaggctatgattaattgattatagttttccgatgcaggtgcccaatattagaacagatcaaggagatttcatgacgctggcagaaatcgcacgattaattagggcctaaaatagtgagcacatgaaatgaatcaccaacattcaacaacagtagaaggcagcagctaatctgcagccgacgaaatggggagagaaaataataggatcaactttgatcggcgtaaggcgggatcacggaagcaatcgaccgatggaacgacgagggcctcacctccggcgaaacctccgggcggcggagcgggccttgcgcttgcgcttgtcccgggcgtcctcgtgcctccgccgccacctgatctcctccatgactcccgcacgggccacctcccgcctgaaccgctgaagcagctcctccccgtccacctcctcgtcgcccgcgttcaccttcgcgttgtggtacttggggttggccgacggcggggcgggggcaggggcggaggaggccgagaggagggaggtcgtgggaggcgatcgccgcgggaaggagacgaaggtggccctggtgttcgcccagaggagactaggtgtaggcggcgagatgatccccgcggtggcggctgcggcggcggcggcgcacatggtggtggtcgccgaattttttttatttatacttttttttattaaaatatttacaaaaataat

SEQ ID NO: 66864 - DNA, 3130 bp, Oryza sativa
cgccggcgacggggacgcagaggttggtgggctttttgggtttgagcctttcaggtggagatggagaggccgtggataacagggatttggactggaagttacgttgcttgatgggccttataaattgggcctaaataaaacatgggtctatttgtgcagcgcgtttcaatttgggaaaaagtacaccgaaggtctctcaacttatcatcgagttacaaaatcgtccttaatcgcaaaactagatacaacgcatccctcaacttacagaaccagtgtaaactcagcgtagacctacgcgggtcccacatgtcagcctcttttttccctcccctctccacctttcttcctctctcctctctcatcccctctcttctgtgtatctaccagaacccgctcgcgtgccgcccaaggaggtggtggctggcggcgtcagcgccgtcaaggagtacatggccaggcagtggcgcgacgcccgcgccgaggaggcgcgccggggcagcgtcgtcgccaagagccccaaggtgtcgatgcccaagaggtggcttgtgcgcagcatgtcattgatgggtagatgggtgtccgacgtcacgaggtacaacaccgggtaggcggcgagagaggagctgtgcgcgagcctctgccggtgaaggagtggcacgcaagtggtggggagcagctgcgcgcgggggtgggtcgcacttcttctgcccatggcgaggggatagcgtggagagccgccgcccatggcaaggacgccatcaaggttgaagggcggcgcaaagatggaggagacggggaagagcaagatgtggcgcgcgtcctcctccttctcctcgaacccgtcgacatcatcgtcgtcgtccaccactgccccgctccgcgccgccagcttcgcgtgccaccgccttgcaggcctacctgctccacccaccaccgcctcgctccacgtcgtcggcttcgagcgctgccgctctgcccaccgtcgcccctcttcacctacctggtacgcccaccgtcggcttcgcgcgccgtcgtcctactccgcttggctgctccgctcaccgctactccgctccgccctacctgccgtcaccccattccacctgccttccccagcccaccaccgcctcgccggcttcgtgcgccactgctacgcctcgccatcgccccacttcgcccgccgccgccgccccgctccatcccgccggcttcgtgacgcggatagatacagagaagagaggggaggagagcgaagaggagcgaggaagaaacatggagaggggaggggaagaagaggctgacgtgtggggtcacgtgggtaccagctgagctgccacattaggcaaaaccagagtcaaaaccgccaagggacttagtttgtcctggttttgtaagttgggttatccgctgtatttggttttgcggttcaagaacgaatttgtaacttgatgacaagttgagagaccttcggtgtacgttttcctttaactttgttgctttactcttgcagaaccttttcttttattttctttttttccttttttgaaagaaagaacactacacagcctgtttaaatttgctgaagacgcttttgtttcgttgatgctaacttttgtggatttcacgccggaattgtaaaaagaagactactggtagcaaatactccctccgtttgatattataagttgtttggattttttttctagtcaaacttcaatagatttgactaaatttatagaaaaatttagcaatttctacaacactaaatttcattaaatgtaatattaaatatattttataatatgtttggacgaaaagtatttatgtattttttctataaaattatagagtttgacaagaaaaaaaaatccaacaacttataatatataacatataacggaggtaatagaagtgatggagcaaaacatatgaagagactttcgggaaggtataatgctgcagtctgcttgaagatctggattgagctccaagcaaatagcaatcccctcttttatccttcgcaaaaggaaaaaaataacctcctccttttctcttttcgagaatacacacgaggaccaataaagtatggatcgatcgatcacaaaaatttaaggaggtggaaagccctgaaacaaacactcgagtaagaaaatgctgaatatgtagtgcatgttggggaaactgttcggatggtgtccctcatttatttaaaaaatcatcgaaatagttatcagaaatattaaaaaaataacagcattcatatgttgaagtttaggccgggaattgttaaagaagactactatcaaagaggggcacggtgatggctacaagatgaagctaaggtagaacaaaacatatggaaagacttttagggcccatttgaaatggaggattagcaaaggaattttggaggattcattttcctaaggattttttcctatagagctctttgattcataggaagaggatagaaaaactttcataggattgcattcctatgatcaattccataggaaaataagcaagaggttagacctcttgcgaaactttcctttgttgagggtatcctgtgctataatcaaagggctcttctctcaatttcctatgttttcaattcctgtaggattggaaaaacatacaacttcaattcctacgttttttctattcctgttttttttctatcctgcgtttcaaaggggcccttagggaaggaattaatgctggataaagatctgggattgtgctcgaagcaattaacaatcacttctttttcaagaaaaacacatgaggaccactataatacgatacgggtcgatgacaaattgaggctggtaaataacccccattttaaatggaggtttaccgagacgccagtagtacggtctgagaaaacaagctatttatattatagacaggtgggagaacaaaatttccgaagatttcaggaattgtcatacttttttttgcacagaattatttgaaattttagcaaattttattttgactaaatttgaataaactttgaccaaattcaaaaaagttggaaaaaaacagaaaacttttggctgagatatttgcttgcctagggccggggggggggggggggttattttcgaaacaaaattgtaat

SEQ ID NO: 66865 - DNA, 1956 bp, Oryza sativa
ggaactaagagtgttttcccgagtttaggaacccttgtaactctcagtataagtcccatacaggagtagggtattgtggagattatgggtaccccatacccacacggcatggttatccgactagttataggggataacttatatctatgtaatatgtaacagatcatgacttgggtgttacgtttccttgtatattacggaatggcctaaagtcctgatttaggaaacagataccgtattggttaaggtttctatcttgtaatcctgccccccatcctatataaggtgggcaggaggccctctagggggcatatatgacacaacctgatcgtcagatctatactacacccggcggattcaaatccccaaaacggagtagggtattacctctcattgagagggcctgaacctgtctaaatcctttgtctctgcatccatccacttttaggtctcgtgcgctacccccttttattattgccgaaatcatgtttcgacagttggcgcgccaggtaggggttgcgtcgagtttcctatcaacgagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcatattgatttttaatctcagattaatttcttactattttttgttgttgttcgcatataactacgcggcactattgaggcgattgatgctggtcatggactcgaggcgtctcagctttccggtcgatcggccgcgagtccactccgccggcttgtcctcgccaccgccattgctgagagcaacaacgacttcaccgccggcctgcctccgtcgccgccgactggtgtcatcgcctatacggttggtcggtcacaccaccgttcatgggcgtccatgtcttcaccgaccagctggccttcgccgccgccgactggtgtttccgcctgcacggctggcctattatgccgccgctgttgggcgtttacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgactggtgtcctcgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgactggtgtcctcgcctacacggctggcctattatgccgccgctgttgggcatctacgacttcaccactggcctgcctccgtcgccgccgattggtgcctccgcctacacggctggcctattatgccgccgctgttgggcgtctacgacttcaccgccggcttgcctccgtcgccggcgagtggtgcctccgcctacacggctggcctattatgccgtcgttgttggacgtctacatcctcaccgccggactgcctacgtcgccgccgactggtggtctacgctacacggatggcctattatgccgacgttgttgggcgtctacgacttcacc

SEQ ID NO: 66866 - DNA, 1887 bp, Oryza sativa
ggcatgcctccgtcgccgccgattggtgtcctcgcctacacggctggcttattatgccgccgctgttgggcgtctaagacttcaccgccggcctgcctccgtcgccgccgagtagtgcctccgcctacacggcttgcctattatgccgccgctgttgggcgtctacgacttcaccgccagcctgcctccgtcgccgccgagtggtgcctccgcctacacggctggcctattatgccaccgctgttgggcatctacgacttcaccactggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccgccgttgttggacgtctacatcctcaccgttggctcaccttcgctgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatatcacccatatgcatgtttgggaaatgcctaggccgactcccgatgcttggggactatgactagtcgggcagagtgtttaaacgtacagagtcatctgctcggggaaatcaaaattgacaagaggagaaatacatatttataaatattttaaaatacttgattttttctcgagtattatatttatatcagatactactcatcctatatgattgttctgcaggatccagatccagatatgcataaaagggattcatggctttaagcttatctcttacgctccaggaatggatcagtcagaacatcaccgaccggcttgcctccgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgaccgccgccgactggtgttcccgcctgcacggctggcctattatgctgccgttgttgggcgtctacatcttcaccgaccggccgcctcgtccgccgccgactgatgtttccgcctgcacggctggcctttatgccgccgctgttgggcgtctacgtcttcaccgaccggcttgccttcgccgccgccgactggtgtttccgcctgcacggctggcctattgtgccgccgctgttgggcgtctacgtcttcaccgaccggccgcctcgtccgccgccgactggtgtttccgcctgcacggctggcctttatgccgccgctgttgggcgtctacgt

SEQ ID NO: 66867 - DNA, 965 bp, Oryza sativa
cggcatacgatgccatgttattttactacaacaagaggctctccaatattcaggatttctacttggacatcttcaacacatatcttcaatcaagcaatgactactcgacgacaagaagctataattctcgactctatgttcagttgttccccaactaaccaaagagtcgggggctacacaaatataaggctcaaaatttgacaaattttatgtcaggctgaagaaatcaattcatcaaccaacgagtcaactccaggagtcattatcttcatctttgattcggagcagacattctacttcaacaactttaaatatttcggtttagacgagttgggcaacaacatcaactctcctccaagtgaagcatctacaacagttataacactaatttgatggattattgtcactgacatcatcaccagcacctctgcttcatcggccctgacatctccgctgttgctaatggatgattatgttttcgccgacttattatttcaccttgacggttgacctactatgcaaatgctgatgagcgtctttgtcattatcattggttgctacactgctattggctggatcaccgacatcgtcttcttcatcatgtcggttgcgtttgtcgtcgtcaactattttcttcatcttcatgattggtggattttgtcatcacctttgatctacctcgtctgtcaccgactgattattttgctgccatggctacacaattttatcgctgggctccttcatcttcattgttagttgatctgtctgccgccgactggtttcttcgcctccatggctatgcgacttcattacttttgattggtatcactatcttcactaccaccagtattgttgccacctctggtgggcgatattatctctatattggtcgtcttgtctatatgccaactgcgtcagctaccatcaatggacgattgtgactacgacagaaggacaagctatat

SEQ ID NO: 66868 - DNA, 3297 bp, Oryza sativa
atccattgccatggaaacaagcttcttgacaaagtaacggtggaaatcatcataacccaactctttcagatcagaagcagccaatttaacatcaccagtgctgaaatattcctcaataattggggcaacagatttcttgtagtcctctactggggttgaaacaggggcttcaactagttcatatggttcctgattaccagaaaaagaacatgaatgtccatacgtctggctggactctaaccacatatatttagacaatactggatacaagctagatgtttaccagtttctccaaaatagcaggtgtcaaacaattcatcggtacataaatgtgcaagtggctagagttcatcgatacataaaagtgcaagtggctagagtacatggtcaagaccattaaatattacctcatcactgtcatagtttgggtcattgcggtcaaggcatgcatctgtgtctgtatctataagttttccccaggtacctttgccaccagcaccatctgaaatagaagctcagcaagtcagatatgagagagagagagagagagagagagagagactaatctttggctcagcagaagtagagatatagatgtaatgagaacaatattggagagtgcaataactttcctggtgaaattgtgtgtagaatcccaaatacactaactcattggaaatttagaactagcgacagaatggacactatagagttattgtagtgtcctaaaaatcataaaacgcaaactactgataagggggatgaactgaacatacgaaatatttctatgtactcctgcgttcatcgaacacccaccatcaaaaggtgggttagttaatcataaatactataatgacaacctttgaccgtcctaatcaatggacagttcagatgccttccctaattaatcagcataaaactcatttataatcattgccttgagccatcacactggagaaattaacatgtaacattatgcagtctccttttgccaaaaactacaatatacagaagtatacaagatttgatgttactaagcgattcagtttatgcatatgtatagatggggactaaatgccgtcaactagaattgtcaactgaaattataagaataattcttaataaacatagtccagacagagaaggcaatccccaccctatatgatatgagagtcccacagatagctcaaaatggcacacaattttgtaaacaacaccaggcaaccattacttgataaactagaaactcctccataataattaaaactgcattaagctagcaaaaagatacaagcagaatgaggggggaaaatcaagtgtgttgacgtgataagagatgtatagtggcagatggacgtcctgtcgcacatacatgacaaatcagagatatgaactgactgaaagttgttatcaagatcaaatgtgtacaatcgatgcctttatgatatggcacctccaatcctactagcgatgcggaaagaacatactagcgacaaaaagaatctcacgagtaacagaataactaatccaaccaactaatcagaaattactagatgcccaaatcatataattgtcgtgacccaactaaatcctcctcctataggtagctgagagaaacaccaatcaacacgcacacggaatcccatatttgcatgcaggagtaaccatcaacacaccaaatatctgattactaaccaaaaactcaaaatgcaatacttccctacttaaaccatgacattccacaaattccctaagcaaacattcaagcacattcatgtttcccctaatcgatttaatcaattctatatatgaatatatataatagacaaataccacaatatatacctactaaatataactaaacccaataccatgaaacactaactcacactacaactgcactgacatatttctcaaataaacattggcaactatatcaacctaatgggtaaagtcacattccaatcatcctaaacaagacgccacaacactcaatatatggataaataataatcagcaggtagcaatgataattattaacaatagcagcagtggtcacatcctatatcctaatcaagcatgccaaatctctagaaccaccacaacaacagtaaggaaggcaataaaccgagcataaatagatcaagccggagccacctcacctttcttcaccttaatggtcttcccggaatgcgaccgccgcacgtgcctcaccccacccccacccccaccgccgccgccgcccctggccgcagccgccgcggcggcggcgcgctgctgctcgtactgctgcaggagcgcggaggtggagcccccggtcggcgagcgcggggaggcgagcgacagcgtctcggcgttctgcaccgcgatccgcagcttctcccgctggtcctgcgtcaggaacccctcgttcctcggcgacgccatccccacctcaactcctaatcccaccaccaccacctgcacccaaaaaattacaccacgcatcagcaccggccgccgccgaaatggggactcgaatccgccgccgcctccgcggcggaggttgccgtacctagggtttcggccgcggatcgagcctgagccgccgccgccgccaacccgtgcgcgagatttgtgcaggcgaggcgagtggtaaatttttttttctacgctccttttttttccctttttttttctctccgagcgagtgagtgagatgagagagaaaggatagggagggtggcattttatacggaggcggattgggattcggggggacacgtcgcccgcccgcgcccgacacgccgtggggctcacgtctcgtgggccccgcatgtcatgggggtgcgcgtgtcctgtgggcttatcctttttctcggcccgctggttttttggtttgggccggctggccgccgctcatccctatcctctttccacgtggcactgccagcctcacctcgtgtctcaccacacgtttcactgacatgtggggaacatgatacggcggacccacatgtcagtgagtgatgggggtgtttttgaggaggtggatcgggccgtgggagttagggttttggccgtgggggaggaaaggggattaggatcttctgcggcggtggttaatggtgggtgcgtgtgtgtttttctgtgggcggtggttatgaatgattgggtggagtggataaggggatgagattcatgagaatgacgcgtcgggaatagtcaagcaagattcagtgtgcacctgacctgatctgacgatgagatcaaccacctgatacacacgtgattgttgatccatgatctcattagtgg

SEQ ID NO: 66869 - DNA, 9634 bp, Oryza sativa
cagttgtttgtttcttcagctgggaatttttatttacagtgatgattgactctatctgaggtgttgtaggcttgcccattaggacacccacaatggttatctataggctttttacaagagatctatgtcagtatattttcctacttggaagagattaaatgaagagaggagcaaagctatcttactaacctagagatagtttatagagaaaaacgagacaatgtattagagagctatagatacccatgtagacatactattgaggtggtttactattaatttagtctattgctgacatgtacatgttttatagatagcaccttattttaccattgcgggtgctcttagtatgctctactagtggtgtctcttgagcttatccacaaatgaagtgctagttaagcaaaggtttgattgatagcgccagcttttaatggaggaggtaacggcggcagggcagatgccgactggttcttgttctgcaactgcaagcccaatcaactacaccatacttgggctgtctcacctgtcgtatctgggccgtgttataggccggcctgattaatggcccagtagtcagctcagaactttgttcaacttagatcactgtaaatttgtacaggcaactctgtgcacctaaaaactgacgagatcagatcaacttcagtgaaaaaaaagggtactaattctaattaatctttgttatctgatactctaatcaaattaaccacaagtataacccagatcaaagtgacagaaccaaaatcgcattgtcctggaatcatcaggtagtactccactttttaattcactgttaaacagcagacaaaatcactttgaattcatttcaaaattcagaaccaaaacaaaacactcgctaaacaagaccaagcaaaaatcaaaatcaaatacgcgacattgcgagagcatagaagcaatcgcagcttattgttacactacattataaaacaaaaatatcaattcgtcataaagcctcagtacttgtagtccttgacgtggaggttctcggagacgccctcgccggcggcggcgtcgccggcgtacgcgccgagcgtcgcctgggagttggccctgcagcgggcgagcagcgccgcctgcgccttgccgacgttctccgccttgccggcccacgccttgagcgtgctctgctgcagcgcgcggccgaaggagaaggtcagcgaccatggcttcttgcccctgctcgccacctggttcatggcgttcaggttcctcgtcgcctcctcctcgctctgcccgccggacaggaacacgatggccggcaccgccggcggcacggtgcggaggagcgcgcggacggtgtgctcggcgaccacctccggcggcgccctggcggcgtcggagcccggcgtcaccatgttgggcttgaggagggtgccctcgaggaggacgtggtggtcgctcagcgccttgtagcacgcggcgaggacgcgctccgtcacctcggcgcaagcctcgatgccgtgctcgccgtcgacgaggatctccggctcgacgatggggaccagcccgttctcctggcagatgatggcgtaccgcgcgaggccctgcgcgttggcgtcgacggcgagctgcgacggcctggacgacgccctgccgatgctgagcacggcgcgccacttggcgaaccgcgcgccggcggcgtagtaccgcctgcagcgctcgccgaggccgtcgtgcccctgtgtcgtcgtctcgcggtcggtgccggcgagctcgacggtgcccttgtcgaccttgatcccggccagaacgccggcggcggcgagcacgtcgacgaacggcgtcccgtcgcgggtgctctggtagagcgtctcctcgaacaggatgacgccgctgaggcagtccagcgcgccgggcgccgtgaacaggagctcccggagcgcgcggcggttctcctcgacattctccacgccgatgctcgccagccgcttcccgatcgtgcccgtcgactcgtcggcggcgaggatgcccttccccggcgtcccaatgtacgccgcgttcctgatcaactcatctgaaaaaaaacaaaaaaaaaacccataaatcattgatcaagaagcagaaacgcatggcttactcatcgaatcaagaaatgcatgtgttgcacaagtgttttttttggataatggaatataaatccatctccgccttcgctgaaacgagctacaaccaattattacaccaaatcgctcaaaacgagtgcaactcaaagagaacttaaaaaaaaacttttccaaacataaagcgaacacaaaatcataaacgaagcttactgtacccttgtacttgccgcagtaggccgacatgattgacagatgagagaaacgaaagcttcttggaggagaggtgatcagaaggaagaggaagaagaagaagatgcagagatggcgggaatgggatggagaaaattcttgtggcgttgtggcctatttaaacagctcggagctctgaagctggaggtgtcggaatgttgggtggtcagaggaagcagacatggttttggctttctctgcacattgtttttcgtttttttctcttgagaattattggcgccatggggccatggagaaaactgtgttgcttttgtccttgcagtattttattagcgttggaaattagtctttctccaactaatcggaaggagaaactaatgaatatgcgtggaattctagattgattggttgttatttttcctccctttgagctcatcgatcatgacttctcccagttgaattctccgtccaaagaaataggctctcttgtttctaagcttccaagttccaacttgttctcttctcctgacaggaaagttgaccctcgtgagatcttcttcttcagaaacatgttgcgtaaataccttatggaaatattttgatttgctgaaaccaagcaattcagggtatcccaaatttctgtgctttttatgtgatgcagaccaaacaacttttctaatttctatgccggaattgctagaattatagcgtcacatttttcgcttaatttcagtcattttatccctatgtgattgtctctctcctatttgttcctatatgtaaggatgctttttatatcttctatctatttaagataataaattacttttaatcctaactggataaaacccatgttttgtatgataatatatagtagaaataacatgtaaaatagctagacaatataattttgtaatactttatataattttcatctttgaccgactattgaaaaaaaatgttcgaacaattaagatgatgtggtttataattcaaattatacatagattaatcattccaaagcaaaattaaggtgagaagaaaaggaaggaagatatatagattaatcatccgaagacaaaactaaaatgatatgacttcataaaataagaaaaaagagagataatttgtagcgtagatcaaccatccaagagctaaaaataataaatgtgatgtaacttaatgatagaaaagagaaataacattaacaacacttagtgggaatgaactttataaatatataggattctcttgtacattgtttattagaaaaattacagtgtaatgtatataggattctcttggcaagtcgagaaaatccaagcccaaatttgacttagaaatagaaaagaaaaagatcaaggagggcctccaaaagaatctcttgaatatcaaagcaaatggggatagcatgtgagtgccttccttttttttagctagctatagttgttttgaggtctcacatgtaaatatgagaaaacataaaggaggatacaatttgtatgattacatgcatggatcatgctctgatctgatacatagctgcaaagagaccatttgtgtgcaggcacaagtgactgatcccatgcatctgcagcacaacaccagcagattcgtggcatttgaattgaccaaataatgttaaagtcatacacacggaattcagatagtgttcattacaaagtcggaattaaggtacaagcaggaatttagttagaaaaataaaagggtacacaaggatggattatgcctactgctccgatcaggagcagtgagcatttgggcgtacatataaatgcaaaaggtaaatatttagtagggatttaaaccgacttaatccccctttttacctgtgctgtagcagcgtttttgattgttctgtttgggataactccctgtttttggagctttctgagactgcggattgcttgtgtaatgatttctctcttcttcttaagatgaaacaggcagaaactcctgcattttgccttgaaaaggaaaaaaaggaattaggtaatggaatggaagtatggcatgatggtacttataaaagcgcagatttatcagaaattcagaattcaagtaaaagctcggtgtgtaccgatcgatgaagccagctagcttgctaactataactgcatctgttgctcgatagagacgagtgttttgaagatgccgacgagaacgccgatgacggagaacacggtgacgatgatcctgtagttgttgtagaggaacttgtgtatgggaatccacatccacctttttcgctggtaggcctcaagatgtgccagcaagcatacgtgttgcggggggaggctaatgagcccggcaaggttcttcagaaaactgagcgtgcacttgtcactgaatttgccatgcaatatacccttcagccgcagctcgtgtacttcttccttcggttcattagcatcgcgaggagggatatgtacgagctgaccgtttgcacgtcattcttaccagtaaatgccaagtaagactcgagcgccaccatgttgaggagccagcatgcattgaggtcgtccatgaccagcggtggcatggagagcttgccgaataggaggcctttgcttattttcatgtccgcgaaccatgacgcctcggtggcgacaacatcgatgccgatttctgcaagctcgatggcgctgtagattgtcgcagtgcagtagtaccccttcagggcgcttgaggacccagctgctttcaccaagcttgctcaatcctgattggtagtatcggaggaggccaaggagatgtggtttgcagctaatttcattcaagtcgaaaggattaatgttatcatccaacctgacattgaaacttgcccctgcattagagatgaagttatccacgggcacgggtacgggcatgaaggtcatcagggcctcgagcacaacccacgggatctggttctccagcataaacatgtccctcaagatgctaggttgcttggagccgaaccaagtttgtaacaatgggtcaacggctacatcgcacatatgagccataaattgcagcaagaaacaaccatcgcgtatcatcatagctgcaaactcggcttttcgaacgcctactaccgcatcgccctcgtagcagcttcgggcaccgcttgcgatggggaggatcttccagtatacttcatctgccgagtgccctgtgttcttgcagaaatcgcagacggcactccacttgatcttctccgcctcctgaaggtggcgtgcaccatggtggtaggggccaattgccacaacactcgggacgaagtagcggtagtaatccatttttagattttgaagaatcgcaggatacctgcagatatggaagatgaattacacctttggcttctacatgcagggcttgtgcacatcaaccatagttcttgtgattaatctttgtttatcctatattaattggatgtcctcctagaaacctatagcccatacaagaacacaaaatgtcaagcagtggagataggtaaggataacaacccagttcagctcgggttgttaactttaacgagttaaaatcctagctaagtgtaagctgtgagtgtctgcgtttgtattgtgcttctaaaaaaaatcctagctagcgcagctcgctcgttaagctcgttatgctcattaattaacgagctatatatatatctctcatttgtattacatgtacaattttaaatttaccattttatcatatattaacgtaataataaacaataattagcaaagaaatcactaaatacaaatatatagtttgactataactaaaagactaattaagtagtagttaacaagagtaattaagtatataaagatacgatgatattttatactagtgagctaaatgagcagctcacgagctggcttgttaagcttacactgaagtctctgttaatctaattttagcatcttaatttagttctatcggctatctctcgttttagggtttctgtcagtatcagctaaatcgtcttgctagattagattaccttagacaactaccaccctgaaaatcagtcaacagcttgattgtctagatattatgtttcttttcacatttaatgctgcatcaatacattcgatctactaagtcgtgcttagaaccatagtccctagcctgcttttgattgccaataaaggttttatcggggtttcagccgatgagttatctggatgttgcaacggcttataaggattacatacaagttagattggccgatcacaacaaagattttactgtttatctaatcttgtgaatttcatggcatcggatcttcagccgatgtatgctttaacctttggatcagtgcttatttgatcaactcattgttagccgattggtttctactggattatattgttatttcattatattaccatcaactgattgtcagattctacatcaaccatatagccgatagctcaaaatattatcgctatcggctggtatcggcatcggttagaattactctatcggcttattaatttgctatttgtatctcttgtcagttgtaggatcaaactgtctggcacgcacgtatctcatcaacctttggacctacacttgagctaagcagatctcccaggccgttgttttcgtcgacttagtccgtgccaacacagttccggtactatcggccgagcgcggatttctcgtcaacaggtacattcttttatatggccctttcgtataaatctgttgattcttataatgcacattttaatttttaaaagtatctgaggtcttgtttgaatcttctgaagatgaagattaaaagcgggcacgcaaaacaagaaagctattagcgtgtgattaattaagttttaattattacaaacttgaaaaatggatatatttgatattttgaagcaactttcatatagaaagttttcgtacaaaacgcgtcgttttgtagtttgaaaagcgtgctaacagaaaccgaggtaaaatctttatcttcatgagaaaagaatagtacctaagattctttaaagcgttgatttcttgtaatatatattcttgacagccataaaaccaatattttttataaaatacttaaaacatgaatttatcggtatagttttgtaccctaattaaatttcattaattaaatgaaatttaattttactaactatatatttatcaaaaatctacaaagtttgaatttttaaaattaaaatataaaatcaatgtgggtggtggtcttggtggagtaataagtatattagttatatatcaatgtagttatcaagaaggaaagtactatttttgtcataaagcatgtatgcatatgcatgtacctcaagacaacaagcacatagtaaattttgtaagagaaagaacataggagtatattatatatttaacatacaatcacttaaattatagagtaagtacaacgatggttggagtggtcgtagaactagcaaggaagttaaatcaagggttaaattaatttttaagccgtagtgttatagtaatttgtttatggccccgaaaaaaaaatctagggatgtaatttatgttacctaaaagctttagttcgtattgtgaagaactaaagtgaacacaccaaaccaggaagactaaggttgtgttcggcatcccttcttcccaacatctctcatttgttttctacacgcacgtttttaaaactgctaaactgtgtttttttttaaaagtttatatatgaaagttgcttaaaaaatcaaattaatctatttttttaaaaaatagctaatacttaattaatcacgcgccaatggatcgctccgttttctgtgcgctctagtcatgttgggaaccaggtatgccgaacacagcctaggacatgtattatgtataaaaaaccgatggtcacacacacacactctctctctagtagcatgcatgtgtttttgcaatgtatgctgttgactactaccactactactgctactaaactagtactaatgttgaaatgtactagtagtacatatagcatgaatgtactccgtgtgttgtttatacaagaaagggaaaaaaaagttaattaaacattaatagctagctcgacatttatggtggatgcatgaagaaatcattagcaatagtatttgcatggtagtagtacctatgaatcatgattttattgatgcagaggtgaacctctgcgccgagagcagtttcagttgattcaacatgcctgccggagcaagcggcaacagaaagggtaaccggagtcacggtcaccgctacctcggcagcgcttggcttagcagccattggtcgaacttgcccggagctagcagcttaacagagttccgatcagttgctaattcgctacggggtagatgcatggcacgcttcttgctcggttctatatatagtactttcggcaggcggcagctcagctcaaaagtcaaaacaaacgagtagttgatggtaacaacaacaaaaaaaatatatattgctgatgaaaaaaaaggggataattcactttatattctagcataaattaaagtaattgaaagattctgtgcccaaaaaaaggaaaaaaataatagaaaagatcaatgatagcttgagttttagttgacatatatagctccagctcaggattgaagtttggaaccctttgacttcacacggtgtactgaaacggtgattttgggtgatttgtagccttattatactcacgtggagcttattatagtccaagttatataagatcataagattttgttacgtgacatataaccccgtgcactatggttttaaagttttacaaaaccactccaataatcaatttggcatgctcctatattaaaatttttgtaaaaactttacttacatgaatgtaagatttatctgatggataaaatacccataaatttgagatgtgattgtagaactcaaaagtatggtagatcaaagttaaaatgattaatagtgtgttttgttaaacttatgtgtcacatgctaaaactcatgctgttttattcaactcaaatcataatatttagggttaagtgaaatttactataacaagaattgaaaaagagaaccccaccatagattttaaagcctcacaaattaaaagaaaattttttccaccgtaaattcttaggtcatacttcatccatttcataatataaaggcacaactattttttagatgtttcataatataaggcatgtatgcatgcatgcacttaactagtatcttatctccactaaataattatgttttaaatccttcaccttcaccttcaagatctccaattctattgagtgcatgaattataatgcatattggtt

SEQ ID NO: 66870 - DNA, 1025 bp, Oryza sativa
cctatagctctagtacgatcgatcagccttgcccaattgcgcctcattaaaatgacttaacggcaatcaatttgcacattactagtagtacactaccagggaaggtttagaaagcaaatgataataatagtactacaacatgtgcagctgaagttgagcatgaagtggatccctatgttaccctgatatggggatacggatacacgatacgggaatacgaggacacgtcattttcttaaaaacaccgatacggggatacgtctatatatatttaaaaaaataaaaaatacaaaggaaaaacataacacataaataactataagcctgcaaatagagttatacaaattacatgacatcattagagataattagaataaaacttgttccggatataagttcaactcaatagaagttcaagagctgcttgcattcatagccagcgatgtggttgaaagagctacatcctagacaggtcccatgcaccagatcttttaatagtactatcccaggagatcaagctcatcatgtagcttgcccctcgtaaataatatgctcccatgcctggtcacaagtgatcctgatgaatctgtagccgcgctagcagtacatactagtgctagataagtggttaagattccaattctaaaattcaccggatctaaatgacaaggaaaaacacataacaaaacaaccaggaaaagaggaaagaaccaaatagccggtgatgatggactgtacgcgttgggcttggtagccggcggagaagctacgcctggtgacggagatgccgcgactaccgacggcggaggccctgcgcccaggggaccaggggtggcgacgcgatgcacggctggcggtggaggccctactcctcaggtggcgagcggcggcggaacccggtggccaacccgtggaggccctgtgcagtgtgcccctggtagcgatgcaagcggcgctgcaggaggattggatctgcgcttctatgctgcgagcgtgggttcgttagttcagaagtatggggaacg

SEQ ID NO: 66871 - DNA, 4094 bp, Oryza sativa
gaagtacctaggacttcctctgacagctaggcggctacaaagaagagacctccaaccgctttatgataaatcgatgaactgcatagcagggtggcgggggaaacataatggactggcgggactatctaccttggtaaagtcgatcctcacatcacaacctgacttcctcctgacgggcctgaaagcttccaaagaataagtcgagatccttgacaagcagagaaggaagttcctctgggccggcagagaagctttgacaggagggaaatataaaatcaactagacatgctggagggctgggcatcctaaaccttgaaaaagtttgcaagagcattacatctcagatggttctggcatgagtggaggtcaccagaaaaagcatgggtgggatcaggaacaccataagacgacaccgataaattcctcttcgcagcggcgatgaccttaacaattggagaggagccaaaataaggttttctgggattggcttggtaccaggggcgacgcctaaaggatataacaccgctggtctacgcgactactaagaaaaagagcgcaagtctacaacaagcgtcgcaatccgaccaatggttggttgacctcaacctactgacaagctcaggttggacgacggagctaattagccaactcgtcaatgtctggggtgttgtccacaacctataattgacggaacacgaagaggacaagatcacatggaaactaactagccacggcgaatacacgacggcttcggcctacaatgcataactacttggcaaaggagccaagagacggcccaccacctcctggtgggatgtatatacgtgaggagaatttgggcggcaatagcagactgggcgacatgcaaactactaaagccaacgcaaatggcaataaacatcaacgctcctcgagtggtgggaggctactacaacaccagtgaagcaccaaaaaaggccctacggacgctaatgctgctagtcgcctgggtgatttggaacgaaaggaaccgcaaggtcttctagcaaaaagagctcccgacgaccggtataataatcaaaatgaaggaagaggccagaatgggccttggagggagtgaaacacctcgcagctggcttactccctccggtttgagattaattgatgttatgggttactccctcaggtttgagtttaatttacgttttagctttctccactactctctcccttctatttctccagaatacctctcatgcatgcatgcaaacagaaaaaagtaactgctgattggagtattaatgaggggtataacaggaaatatggatctaattaatactgtcattggtatttgccatgatgtccaaaacatcagttaatctcaaaccggagggagtacgttgtaacaatctcgggccaaagaccttgagcctgtacttttttctttcttgtgccttgtgcctgtacagttttactcctttattcaatgaaattggcggctcgccaattcattaagaaaaaaaaagaaatcataagatggaaaacttaacttttccagattcttataaattggccatatctctaatcttctccaaatacaaccatagtctcgcttgttcataaatttgtttgctgttcagtgtagtggactttggagttcggagtaccgtagacactcccacaccagatacttcctttggttttagatatatattacgccgcagacttctaggcataatttgaacaacgcatcgtcttgctcaatagtacatgaatctgcttttgaatatcacatgaataaactaagctgcaagtgttgcaaatataaagttcaaaaaccaattctaaattaccattcttctagaacttgtaggtattaaaatgatacgatatgcaagtgtgctaaatatgaagttcacaaaatgcactcggaatgacagcatatcaatttgctccccggcccctagcgcgatatattctgttttgaacagcgcctaaccaaattccaaatattaattcccaattgaccagcgtataaactgaagtaaatgcctcgcatgctactccatgcggagtctgttggagtaccatgcgttgagaacttgagatgcatacgaattaaatccgttgaggtgcatgctgattggatggagggggtattaggccatccccaatccatgacactaacatagtttctataaactccacatcatcaaaaaactagtactagacactactctttcaatgcaaacatcactattccatacttaaattaaatgctacttatctcacatgatgtcttggatattgtgtagaaaccatgtctcatgcaagacatggtttccttctctttccttatttattcacttgccatattatttttcattctaggtggcagcttatttaatactatagacaccatcctaatcattaggttgggaatgaccttaacaacaaatgttgtgcaccaatcaattcattgagagattaaatcagttcaggtgcatgtgcacgccgagtcgatttggtttccttggtcttagcgtagagacgttagagcaactttaataatatactccatcagtttcatgttgcaagactttttttttctagtaaaactcttttaagtttgacaaggtttcttgaaaaatataatatttctaatacaaaataaacatattatcgaactatattcaatgatatatttaatgagactaatttagtgtcgtagatattactaaattgttctataaaagtcaaacttaaaaaagttttacttagaaaaaaaaataaaaacgacttatcatatgaaacaaagaaagtagctaactattgattattagtttatattaaagctaacatgtataataggttaaataaaatattagttttattttctcctctatctctttctctcatcatgaattgaatgtaaatattttggagcaagtttcactactggaaaaactatctttgatcagtcgaccaaattccacaatagtcccagttgcaataaaaactgggagtaaagataatctttagtcttggttcaaaaggttagagctactttttgatctttagtctctattggtgttaccaaccgagattaaagattattttcagtcccggttcaaaaaagataggcggtgtcagacccctttattatttttagtcctggttagtaacaccaaccgggaaaaaagatcggcatgggcggagaggacgaggcgtgcgcgtgagatcgaggaggaggtgcatggtaattaataagttctatctcctcctccctttatctcttcctcctctccaccccatctcctcatcttccttcttctctcctcattcaccccatctcttcctcttcctcatctcctcctcccctctcctccccattctcaggcggcctcgcggaggggacgatttggcggcgactgggcggcggcctcgcacggcggcggaggcggcctggcggcggcggcggcggtggcctcgtgtggagggccacgcccggctgtggccggtgcgacgacaggcggtggaggccggcgctgcggcgtgcattttttcttttctttcttttttccttaatgaatgattcgatctgtgttgaatgtgtgattcgatctgtgttgttgttgtgtgatatgtgttgaatatgtgattcgatctgtgttgttgtgaatgagctatgttgctgtgagtgatttgggatgactatattgctgtgaatgatttgagataatgggcgtgagatacacaaaatagaaaaaaaagaaaaaaactttagtcccggttatttgaaccgggactaaagatagcgatatttagtctcatattcttactcccgattggaaaatagagactatatggggttaccaaccggaactaaaaatcgatctttattcccggttatttgaaccggactaaagggggttaccaaccgggagtaaaaagcatttccccactattttttaatactatagttagctcttacatgagagctaatacttctcatttttctttatctctttctttcacataagtttagtatactccatcgatccgtttcatgttttaagtcttttttttctaatcaaacttttttaagtttgaca

SEQ ID NO: 66872 - DNA, 1959 bp, Oryza sativa
atctagaaattataaaaacgaaacccaacgtgacaataaactctaaaaactataaaatccaatttttaaggttctaataagaatgaatagaaatagtaataaatcgagtaagcaaataaagaaggagatgacataagggatagtaactggtgtgacttttaaaaactatataattagaaacacgaggatgataaggtttggtctttcaaagtcttaagacaatgagatagctatttaataaattttaagtaaaatcatactaaaagaatatatgattttgtttgggtgctagctgcgcaattgcgcggaccaaccagctagttttgtacataatataaatatttttgaagtactaatcacatctatcacctcattcaatgagtaacggtataattatttttttctcaaccttaatttcaatttaaaactacaccatactttcacctcattcaatgagtaacggtataattatttttttctcaaccttaatttcaatttaaaactacaccatacttgctttgtttgttaacgtaaggagcagatgatgtggaagagataagcgagtgcacacttgaatgcaattgaccttcggttctatggatctctgtccatctccacgacacgtacacaattacacaaacggtcaccgcgactgcacgaagacattgccagaaatcatagagaatgaaatttagaacgtacgagggctttcggcttctgccatcatcagaaaagtttcttcgctgattgatcgccagaaatcgcatgcagtatagtgtgaagttaaagcagcatatatacaccaccaaacaaacaaagcaacgaatgattctagaacaaacggctgtgcagaggggcggaggcggtttcccgctgcgatgcttggcgaaaaaagtgtcacacgcgaggtgcctgaaagaaccaaatacccccctagctataagatggcttgaagtgcttccttacaaaaagattagttttgtcgatcaagctgaagcaaagcaacatgcttgagccatcagtcttagtatcagctgctgacagatagctcgagagtgtaccttatacgtacatctcactcgatcccagagagttccatgcatgcttgatagctataaatacctgccgcgacagcctagaaactgaaactacatatctactccattaattagcttattaccgtcaatcttgaataatttgagagcaacatttagctgccccaatggccggcgaagtggtggcaatacatgtcgacgtcggccatggcgtcccagatgaagcacaagcaagtaccaagatacagaaactggatggcagccacatcacccccattgcgcagggcaagatccacaggttccctcgaggcctgattgggatcggcggctcaaacgagcagcggtacatcgtgccgaccttcgtggccattggcccctaccaccatggcaagcctcacctgcacaagatggaggaggtcaagctcgcggcgatgaaccgcttcatcgcaaccgcgaacggcgcctctgccggtgatgtctccggcaagctcctctccgtcgtcggcgacgtgcgcggctgctacgccgacgacgagaagttgaagtgcttcagcgacgatgacttcgcggccatgatgctcgtcgacggctgcttcctcctgcagttcatgatggagaaaaggaagccgctgttcgagggccgcgcgctgtcgtcggagtacagcatcctcaaggacatgatgctgctcgagaaccaggtcccatggctggtgctcgacaccctcatggagttcctgcccatggagatggaggtggagcaaaatgtccgctgttttgtggccgacgtgggagacatgttcctccgcaataataaggaacacgaagtctcgttgacaacctcctgtttcagcgtattgttcgaggtcagtccacataaaagcagctttctcaaggactacaagcc

SEQ ID NO: 66873 - DNA, 2130 bp, Oryza sativa
ccgtccacaagttcctgtacaagcacataagggccatcagcatcatcttgtccatcgccagcgtgctcgttggcatcttcaaagcactcagggagctatagtaattaagctttcttagttaagcgttgttactttctccaacaaacaaaaaatatatatttgatttaatcgtttggacacttatacaaagccgtttttgagtaaattgtccacgaatattcttttagtactactatttatgttaataaatctttaattggttttgcttaaagaacatccgacatttttttggggtgactttcgattttcatacgcggtgctccttacctgctgagctattagcaatttcggtaagttacaagcaaattagtatatattagttgctaatcaatggagtgcgggtccacgcttccctcaccggaagggtctttggcaagaagatcctctatttcccatactcttcattctagtcatggatgtgctcaatgcgatgctccgcaaaacctccgactcaggcgggttccttttgctcaacgatcgtgccttgcgacaccgcgcgcctccctctatgcggatgatttggttctcttcctctccccggttcgacaggatcttaagttcatctagggcatcctctttgtctttggtgcagcgtccaggctatgcaccaactttgtcaaatgctcgattactctgatccgttgttcggttgaggacttggagttggttcagtcatgctttccctacgcgatttctgactttccttgtacctacctcagcattctgctgttcgtttgcatgttgccgaagacggccctgcaaccacttgtggataaaggggctatttggttgatgccctgagaagaacttgccctagtgaagacaagcctgaggctagcttgaaccttgtttggttgctatcctgagatcaactaccccttgcctagcctgattccttctgacttgcggttagcctgagccaggcgacccattttggtcgcctgaactccaggccgcaacagccaccgataattagcgctgctaatccgtcctgctgccctgcgcagccgagtagccgacaccccagatgccgcaccaaccccttgcccaatcctccgttcaactgttgctgctcgaagcttcgatgtcaactagatgcaagcgatacttgtgatcatcgtgcaattggatggactgctagtgtatatagatgagagattactgttgtaaaatgaatatgtattatatttttacgctttgttcacataataaacgtcattcaatggttgtgttttgagctcaggcacgcttgacctcaggcctgcaaccaaacagagtaatcttaggcttgcctgatcaagccgaacgcatcaagatttcagggatatttcaggcagcacttttcttcaggcatgtagctgagggcaccaaccaaacaagcccaaagtatcccattgtcttccaccctagaagggacgactcaccactctggctggccactctatgttggtttagtatgttctctcctctattccagtccatgtgtctatgacgatcggtcttccagtctaggtcattaaggccattgacaagaagcgtcgcaccttcttatggaagggttcagactcggctcataggagtagtgccaggtgtcctggacgaatgtctgtcatcccaaagctttcggagggttggaaattcctgaccttaggatggcacggtttgccctgcgtgtttgttggctttggcttcaacgctcatgacatccttactgcgatgtcctgaaggccctagtcgagcagaccgtctctaacatgttcgaggcatccacctacttcgatagggcgatagtgagtcgatgctcttctggtctgaccaatggatcggcgtctgctcggtggcctccttggctccagatctcctcttcgctgtgcctgatcagcgcctccgaggttcgagcccggttgcttctggcttggcaaacaattcctgggtttctgatatccgcggtgccctcactatcctggtcatctcccagtttcttcttgttgggatgtggtggtcacattcagctctcgccgggagtcgggaatcgtctaatttggcgtaagatgagtgaccagcgctact

SEQ ID NO: 66874 - DNA, 2613 bp, Oryza sativa
atcttggcaactttggaaggaacagaactccaggattttcgactctatgctctcttttctgtctcaatggttctagagtccatcctcactaagggccatctatggtcgttagctagcgttgcttgttttggggttttcttggagggtagtatggctctgccccattcccgctgattggagttgtgtttagccgtcatagtagtctcttccttttttcctttgttttttttcttgttttgtcttttctcccttcccttggcataagctggtcagactgattgtgttgtgtaaacaaacactcttttcttctaatatattgatgtgcactacttttatgcatgcgcaaaaaaacatattagttgcattataactatagtacaattatggcccgcgcaataccatggctagcaccattacaaaaattatctaatttgtttacacctgattatcatcttattgtcttaggatttcaaattttattttttattctgaattttaattaatcttatattgcgttttatatggatttttctttcgacgttccttatttttattctgaaattcagttactttaaaattgtatttctgcttgaacttttttctctgtctccaattaatggtatttatagcctcaacaggaaatgtgatgtctccttttaagattgtttaataatatgatagatcattttagatttatagatacaccaatttttaatagtgatcaaattggtatcttgctaacttaatttcatggatgacaagtggttagtatttactatggagggaaatatgtattatttttagcctataatctcgcgaggtgtgcacgcatacagggcatccgatctacacatccatgtatggggcatcctgatctgcacaggagcagtgttgttatcatctaggaggctcgaacctgtatagggatatgtagcattgttcctaagcagctccaagcacgccaaagcatcttaattagagccccagacgtatatgagggctcgaccgggaatagtgtcggagccctccacttcttgtacgctagctgctatataccattataccaccgtcgtcatcacataaggatgctggcgacgggcaccggccggccacaacgtctgcagagtagtggccgccatcatcaattaatactacacttctccgcctcatctccgtataggttttcctgcactaataattctcgctctgcttgacatgagacttcttgtaacgtgtaagagacctcaggcatgcgtaggcaaaagtgcagggcatatgtgatagaaaatcagacagaatgaaggaacgtataatagctttagcctttagccatcatcacaaaagtttcttaggctctatttgttcataggactaatctctattttaagtcccttttagaccttaagaattcaaacatggatgactaaaaaggaatacaagtacatattagaactagaatccattagtccctcttgaaagtacttatagggtctctcttttctctccctaaaatggcagcctctctcttctctctcctttgatccacgtgcctttagtctatcttagtccctagatccaaataataggggactaaagtttttaatctagggactaaatgatccaaacatggccttagttgatcgatctccagatatcgcattcagtagtttgaaattaaagcacaatatatgcaccaaacagaaaaaaaaaaaagcaacgaattgaatgactacagaactaaagtttgcaatgctgcatgttgcttcgccaaaaaaaaagtgtcacatggtgcctaaaaagaaccagataccccctagaagatgacttgaagtgcttgcttacataaagattagtagtatcgtggatcaagctcaggcaaagcaacatgcttgagccattaatctaagtatctgactgacagctcgactgtaccttatacgtacatttcactgcacttgcatgcgtgctccctataaatacctgccgcgcgcgacagcccggccggaaactgaaactttgttatcctcaaacttgatttcttagtgagcaatatatagttagctagccaccgccatggctgacggtgaagcagtggcaatatatatcgacgtcccaggtgaagcacacaagccactttgaaggatatgaaagagaggatgaccaagaatacacggttgctggagggcagccagccacggcgccgccattgcgcagggaaagatccaccggttccctcgaggcctgcgagggatcggcggctccgacgagcggtacatcgcgccgaccgtcgtggccattggcccctaccgccacggcgagccgcctcacctgcaggacatggagaaggccaagctcgcggcggcgaaccacttcttcgcggcctctgtggaagatgtctacggcaagctcctctccgtcgtgggcaaggcgcgtgactgctacgacgacgacgacaaggtcaggcacttcagcgacggcgagttcgccgtcacgacggctgcttcctcctgcactacttgagccggggcagcgcggtcgcgtccgaccacaccatcctcaaggacgtgatgctgctcgagaaccagatcccatggctggtgctcgacaccctca

SEQ ID NO: 66875 - DNA, 1207 bp, Oryza sativa
gatgaatgcgggaaggaaatcggacgaatcggagggagagagagaggggaaaacgggggaaacgggagaggaaatcacgggggtgatttccccctctttattgcgcgcggggacggcgggaaacggcgagattcgcggcggcggcggcgctagggcacgggcgggcggcgggcgcggcgggaggtaggcgatgacaggtgggccccacccgtcagcgagggcggcgggcgggcccgcctgtcagcggcgcgcgcgcgggggaggccgatgggccgcgggggaggagagagagagagggagggagaagtgggccgagccggcccaagagggaaggggggggaaaaagaacttttaggatttttcttttttttataaaccttttccactttgtttatttcttttcaattattatttgtgctctgaaaattccactaaaatttgagggctccttttagaccaaggagaatttaacaaaaattctccgggccacatttgaatttttcttgtacgtattttagggtttgccaatttcttttcgaattttaattaattctattattccttttagaagatgatttttatttcgggatgaatttatcaggacgtgacacctagtaatgtggaatccgtaaccaattggaaacaaccaaagacagtttcagagatccgcagtttcctaggcctcgcaggatattatcggaggtttatagagaatttttccaagattgctaagcccatgacacggctgcttcaaaaagatgtaaagtacaagtggtcagaagaatgtgagcagagttttcaagagttgaagaatcgcttgatatcagctcctattttgattttgcctgatccaaagaagggtttccaagtgtattgcgatgcatccaaacttgggttaggttgtgttctgatgcaagatgggaaggtggtaaattaagtaaaccaaactttgcaagataagttgaaacagttggaaacgaattttgtacttttgaataacaggtttcaaaagaaataaaaagaaaagttataaaatcaacttgctaaattcattttattgctgtaagattaaataaaacaataaaaacttctgctggtaaatgagccatcagtacagtaatagatgtacagtactaataacactggaataaattttaaatgagaaccattaaaagagattataaagtgcatgtgccattagtttggt

SEQ ID NO: 66876 - DNA, 1366 bp, Oryza sativa
agatagcgcgcctgaagagggagaatgctcagttaaagggtcttcccgtgccaggaggagtccggatccgcacttgtcgaaacatgatttcggcaataataaaagggggtagcgtacgagacctaaagtggatggatgcagagacaaaggatttagacaggttcaggccctctcaatgagaggtaataccctactcctgtttggggatttgaatccgccgggtgtagtatagatctgacgatcaggttatgtcatctatctctgccccctagagggcctcatgcccaccttatataggatggggggcagaattacaagatagaaaccttaaccaatacggtatcggtttcctaaatcaggactctaggccgttccgtaatatacaaggaaacgtaacacccaagtcatgatctgttacatattacatagatataagttatcccctataactagtcggataaccatgccgtgtggtatggggtacccatagtctccacagtagcccctgagaccttcacagtcggaaggataaccttctctcgaactagattactccaaagccgagtgcttcaatcatcttcgccatggtctcccgagtacttttaccaaatctgaagactgtggatggctaaaaaatatagtcaggtgcatcgactagatgcacctaataggtgtagcccccgactatgtggttaattgaacaaaccaagcatatagtcaaggaataaataatccaaccaaccgagtggttttaataattatagtcaaccaagcgacctgatattaatatgtagcatatgcggtgtgaatccctgaataacatgatccgagtgatataccgactgctttgtaaaatatgatgagtgtaacctaaagttggttacatcattgaaaattcacatagcaaaacagctataaagaagcttatatattgtgaataaagaaatttccaaagtattgggcatacgccatgcgcacactgctttaacagatgtgcttaagtccctaaaagacacatggtttcaccacacccggaaatatatggcatatgtggtataaaatccgagtaaataaactcataaaggatttaccaaccgcctgaaaaatgaccacaatataatcagcctaagccataatattggtcaataaaaatgcacacttacgtggcgaaaagcaatgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgca

SEQ ID NO: 66877 - DNA, 982 bp, Oryza sativa
ccagatgatttacctggtatgccgcctaaaagggatatagagttcagaatagatttggtaccaggaacaactccgatccacaagagaccatatagaatggcagcaaaggagttggcagaagtcaagaggcaggtcgacgatttgcttcagaaaggatacatcagaccgagttcgtcaccatggggagctccagttatttttgtggaaaagaaagaccatacccaaaggatgtgtgtggattatcgtgctctaaacgatgtgactatcaagaataagtatccgctgcccagaattgatgatttgtttgatcagcttaaaggagccactgttttctccaagatagatcttcgatcaggatatcaccagttgagaatcaaagaggaagatatacctaagacagcttttaccactaggtatggattgttcgaatgtactgttatgtcttttggacttaccaatgcccctgctttcttcatgaacttgatgaataaagtgtttatggaataccttgataagtttgtggtggtctttatagatgacattcttatctactctcgaaccaaagaagagcatgaagaacatcttcgccttgcattagagaagctacgagaacatcagctgtatgctaagtttagcaagtgtgaattttggttgtctgaagtgaagttccttggtcacgtcatctcagcaagaggagttgccgtcgatcctagcaatgtggaatccgtaaccaactggaaacaaccaaagacagtttcagagattcacagtttcttaggtctcgcaggatattatcggaggtttatagaaaatttttccaagattgctaagcccatgacacgactgcttcagaaagatgtgaagtacaagtggtcagaagagtgtgagcaaagtttccaagggttgaagaatcgcttagtatcagctcctattttgattttgcctgatccaaagaagggtttccaagtgtattgcgatgcat

SEQ ID NO: 66878 - DNA, 879 bp, Oryza sativa
tgcaggatccagatccagatatgcataaaagggattcatggctttaagcttatctcttacgctccaggaatggatcagtcagaacatcaccaccggctcgcctcgaccgccgccaccgaccttccgctgccgactggtgtttccgcctgcacggctggcctattatgccgccgttgttgggcgtctacgtcgtcaccgaccggcttgccttcgccgctgccgactggtgtttccgcctgcacggctggcctttatgccgccgttgttgggcgtctacgtcgtcaccgaccggcttgccttcgccgctgccgactggtgtttccgcctgcacggctggcctttatgccgccgttgttgggcgtctacgtcttcaccgaccggcttgccttcgccgctgtcgactggtgtttccgcctgcacggctggcctttatgccgccgttgttgggcgtctacgtcgtcaccgaccggccgcctcgtccgccgccgactggtgcttccgcctacacggctggcctattatgctgccgttgttgggcgtctacgtcttcaccgaccggcttgccttcgtccgccgccgactggtgcttccgcctgcacggctggcctttatgccgccgttgttgggcgtctacgtcgtcaccgaccggcttgccttcgccgctgccgactggtgtttccgcctgcacggctggcctttatgccgccgttgttgggcgtctacgtcttcaccgaccggcttgccttcgccgctgccgactggtgtttccgcctgcacggctggcctttatgccgccggtattgggcgtctacgttttcaccgaccggtttttttcgccgctgcctactggggtttccgccctgcacggcttgcctttat

SEQ ID NO: 66879 - DNA, 748 bp, Oryza sativa
tatgtcatatactcaccttgcaatcattcatcagaggaagagttctgcagtgaagctgatggtgtggaggattaggtgtagccctggtcaagctgcctgtggagtggagccgtctgcgccgtttattttattttccgctgcttagatccttattgattgagaggaactatctacctctgtaataacattttttacgcttatagagtagtaattgtactctattatcaatttgttattgtgtgcctcggctgattcctggacgagggttcacacacatgtaagcgtttggaattttggatagaaattccgggcgtgacagccagccatggctagcggcgacggcgcgcgtgcgaacgcgttgccggcgacggcaaccggcggcagaggcgacggcgcaaaagcgacgcgaaagcggcggcagcggacggcggcaacgaccaaaggcgacggcaagcgcgggcggcggcgacgcacggggaatcggggaagtaaaggaaaggggagggagtcctcaccgaaggggacggcggcgaccggcgacgaggagcgacggagggaagtcgacacgcggctgacggcgaccgggacgacctaaagagcgaaaagaaagagattagagagaaagagaggggccataggaggcgggaatgccggccgaatgcggcggacatggcaaccctcaccgtcgcacgacgggaacggctcttcggcgacggacctcgactaaggaggggtggaccgggtggat

SEQ ID NO: 66880 - DNA, 4970 bp, Oryza sativa
aatcccggccatctcgggcgcgggcgcgggcgggagagagaggggagtgggcgcggggaacgcggcgcacgcgtgggcgtggtcgacgtggcccggaggaggcggaggcgtgggcgcggcggcggttgcgggcgcggcgccggctggaggagggagacgggcctgacaggtgggccccacctgtcggcgaccccgagagaggagggaggcgggacggcctggatgggcctcggcctgcggccggcccaacagggaggagggggaggaaaggagagaatgggccagcggcccattcgaaaaaaaaggaggaaaaagggaggaaaaaagaaaaagaaaaaggaaaaaggattttcccctggaattaaaatattgcttgctcaattttaaatggttaaaattatttctagagttctgaaaattccactaaaaatcctgttagtgaatttcgacatgtagaactcaagaaaaattccacatgccaaatccgattattatttgcattactttcttagggttttctcttgatttgcacctgcatttttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctagcagcggaaattaaataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaagtgcacaggataacaaaggatagcataatagggtttcatttgcaaaagcagcatttagcaaacatttgagtatttgataaaacagttaagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaaacaaggcatggactccccagcgacccccgtgggcttatctccgccacttctcagtctggtgccccgcaatgaaccatgctatacaaaagataaagccgttgcccatgctggcttgtggtcggcacgataaatgtttcacaaccgaaactcgtgaaccggtccttaattgccatgagcacgaccatcaaaaccatgtgctcacaacccaccattaccaggttttagttggcacattaattaattaactaatcacgattgaccatcgagaactatcaataagccatcatgaaataatagtgagtcattagttatcccataagtgtactaatgtttctaagcagggctaagcaattgtatctaatatctagttgaaccaatataaataaagctcaactagtcaaattataataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagatatgaatttttaaagattaaaccggattaaaacacttaaatcggtttaaaattgaattatgacgcaataatgaattatttttgaaaaggaaaaggggatttattgcgtcagcgggctagggtttgggtggaccggcgcacgggcggcggttcacacgaacggacggccgagatttaaccgatccaagatggacggccgagatcgatcgggtccacggcggctcacgggagaggactcggatgacgtcagcggtgacgtcaccgacggcggcggcggctcggcagctgggacggctcgggcggcgcacgctcaccggcgaacggcggcgcttcggcacaaacggaggacaccaacgggtagcggacggcacggcgaactcaccgacgaccaaggcgacggcggacgaccaacggacggcgacggcgacgaggaggaagcggcgggaaccttcgggtcgacgacggcgaagctgctccggtgatctccggcgacggcgaaggggcggacgaggacggcgacgacttggcgagcacgacggcggccttcccgagcgacggcgacggctggaacgacggcggcgcacggctggagcggcggcggcgaaggcaaagctagggcacacggcgctagggctactccggcgacgagaggcgaaggcgagggtggcggcggaaagagaagagcacggggatccttttaaaggggctcggaggcgacggcggaggcccacggcgacggcaacggcgaaggaaactcgcggctcggagagagggaacccgatccgaatcgaacttgattccaacgctttccaaagcgatttagccgatgattccaaagagaaaaagatagaggagatcccggagattgtttcccctcaaccaattcggccggagaaggaaagaggcggccggatttggaaggaaacagcggcggcggctcggcggcggcgcgctagggtttcggcccgaggaagacgacgggcctgacaggtgggacccacctgtcagcggctgcgagggcgcgcgcgcgggcggctgcggactgggccggctgggccgaggagagagagaaggcggttttgggccgactttcggcccaaagccaaaagaagactttttaaaactttttcaatttaaattatttcttaaatgcaattccatttattaaaaatactttcttagctcaaataaatcccagaaaaatctaggaattatagaattaagcaaagtatttaatgaaattttatctggccactttttatattggaatttattaattaaacatagattttcttttcaatacttttaaaattatttctaaaaattccatttaaacaacaatttatatattttgaattttcagggtgtgacaaacctaccccccttaaacagaatctcgtcctcgagattcagaagaactggcgaacaggtgcggatgagctgacttcaattcatcttctcgttcccaagttgattcttcttccgagtgattactccactggactttgcaaaaacggataactcgattcctggtccttctctcacttgtttccaagatacggatcggtttctccacataggtcaaatcctcttggacttctatctgttcaagattagcttcttcggtaggtacccttaaacacttcttcaattgcgacacatggaacacattatggactcctgccaaagattgaggtaactctaactgataagcaacctctcctcttctactgacaatcttataaggtccccaaaacgcggtgccaattttcccttggtatgacaacgatgaactcctcgaaaaggcgtgacacgaagatacacataatctccctcttcaaaactcaaatctctgcggcgattggggcataactcttatgtcgagagtgagccacacgcaatctttcttgaatgatctttaccttttcttctgcttcccttaggatatccgttccgaaaacctgacgttctcccgtctgatcccacaaaagcggagtgcggcacttccgaccatacagtgcttcgtaaggagccatctgtagactagcttgataactgttgttatacgaaaattctgcatagggtagattcttatcccaacttccaccgaagtctaaagcacaagctctcaacatgtcttccaaaatctgattcaccctttcggtttgtccgtctgtctgcggatgataagcagtactaaagttcagcttagaacccatctcttcctgaagcttcttccaaaaatttgaagtaaactgactgcctcgatcagacactattttcttagggatgccatgcaaacacacaatccttgccatatacaattccgccaaccgacttccggaataggttgtttttactgggatgaaatgagccactttggtaagtctgtcgactatcacccaaatagagtcatggcctgatgacgttctgggtaaaccagtgataaaatccataccgatttcttcccatttccattcaggaatcttcaaaggctgcaacaaaccggcggttttctgatgttctgccttgacttgctgacaaacatcacatactgccacgtattctgcgatttcacgcttcatacttgcccatcaaaacctttccttgagatcctggtacattttggtactaccagggtgaatggagtataatgtatcatgagcttctttcaaaattgcatcttttaaatctttgttgtcgggaacgcagattctctcgcccaaccatacagttccttgctcatcttccaagaaaccgatagcttttcctcttctcatattcttcttgatt

SEQ ID NO: 66881 - DNA, 6918 bp, Oryza sativa
caacaatttatatattttgaattttcagggtgtgacaattttcttgggggtcgtttaaaaattaaatttttggcttgggagaaaaacttcggggtgtgacagcctccctctagaaccgtgcagcccaactcaaccgacgagcgagccaacttacacataccactccacttttcgttctcgcttcgtataaaagggttaacccggaagtgatatggttgaagggaaaatgccttataaattggttccactcgtgctaaacttgcaaggtgatgctaaacatgcgcacacagctctcatgggctatacatgcctcatcctaattgagccaggatgtcacaatttttcgggcctggctaatgggcgatcgatcgcttatccccatccacccctatacactcctctcccccttcctcctccccttcttctcttccttctacaccataaatttaaaaaaaataaaaaaacagagttgggaaaatttatgtacaaacataatatatatatatatatatataatatttgaattcaaattcaaatttgaatcgggtatgtaaacttttgacttataaactttgggtttataaactttagatgtatagaaatactatatataaaaaataattgaattgaaattcaaatttgaatcggatatatttcaaattcaaatttgaatcgagtatataaacttttgacttataaactttgggtctataaactttaggtgtcatcggagcgggccaatttccttttgcccctcctatcacgccgcttagagcgggggacagactcgggggtagccgcagccaccgcgccggtgccgggggaattccaggcccatgcctcctccttccgagccaccttgtccgccagctggaagagctcggcggtggtcttggtctccttggagacaatcttctctagcatgcggttatgccgcacgccattctgaaacgcataaacgaccgcgtgggccggaatgcatggagtagtgttgccgacctggcagaagcgctatatgtacgagtggagggactcgtcgtccttccgctgcacagcgtgcaggtccgcctcttccccatgcgggcagctcggcgcttgtcccggcgtcgctcgatattgattcgagcgtcctgctccccgtagaggccatcatgacacctctgacttcccgaggcccccgacgatgttggagccgtggaccgccttgaggccgtggctgatcgacgggccctcctccttgccgacgaggagagggtaatggaagtacgcgacgtaccggtgatggcgggtcggccgcccgcggccagctgccgctgggcagtggtgaccaagttggccacatcatccaaccagcgctggacaggggtctccggctccaggttcacggggtgatgccgcagaagggcacccgccgcttgaagcgcgcctcggggtgagccgccgtcaccataagtgaggtggcgccgtgccccgacgcgttgtggcctccctccgcccgggggcggggagagggccgaaccatctgaccgagtggggtcctccctccgcgagggatcgtggcggggaggagttggagagttgtggcggcggtgacgagggccgcggctctcgctagcatcctcactcccagacggagtgggggtgtacaccaccgcctcctcctccaggacctcgactatgattgtcgagggccgagggaaacttggggcggaaggaaacgacttctctttaaagcgcgcgacctccccctacctggcgcgccagctgtcgaggagtgatcctctctagcgggagatcgtgagaccccccttttgtgagttcggctgggggaagaagctcgcctctggaaatcgtgtatccgtatccaaggcccctagctagcttgcacacagccaagttatacaggttcgggccgctatgaagcgtaatacctgtcgaaacatgatttcggcaataataaaagggggtagcgcacgagacctaaaagtggatggatgcagagacaaaggatttagacaggttcaggccctctcaatgagaggtaataccctactcctgtttggggatttgaatccgccgggtgtagtatagatctgacgatcaggttgtctcatatatgccccctagagggcctcctgcccaccttatataggatggggggcaggattacaagatagaaaccttaaccaatacggtatctgtttcctaaatcaggactttaggccattccgtaatatacaaggaaacgtaacacccaagtcatgatctgttacatattacatagatataagttatcccctataactagtcggataaccatgccgtgtgggtatggggtacccataatctccacagtagcccctgagaccttcacagtcggaaagataaccttctctcgaactagattactccaaagccgagtgcttcaatcatcttcgccatggtctcccgagtacttttaccaaatctgaagactgtggagggctgaaaaatatagtcaagtgcatcgactagatgcacctaataggtgtaacccccgactatgtggttaatcgaacaaaccaaacatatagtcaaagaataaataatccaaccaaccgagtggttttgataattatagtcaaccaagcgacttaatattaatatgtagcatatgcggtgtgaatccctgaataatatgatccaagtgatataccgactgttttgtaaaatatgatgaatgtaacctaaagttggctacattattgaaaattcacatagcaaaacagctataaagaagcttgtatgttgtgaataaataaattcccaaagtattgggcatacgccatgcgcacactgctttaacagacgtgctttagtccctaaaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaaggcacacttacgtggcgaaaagcaatgatattgtatccaatcaattgcttaaaaacccaaacagcaccttgacttatataaaaaagtcagcgggacagctatataaagctttactgtttgacaccttttaagatgcattgtaccaactcctaaaaagttaagtaattgcggtataaaaggattttaaggtattgggcacttgatcacgcgcactttggcctaagcaaaaagtgcctaagtccctaaaagaacgtgacaggccacacctgaaaatatgggctgcagacatatcaggcctaggccaaaaaatatgccttcgacaccctttaaaggatgacgcatgtaacatgctcccgagtaataaatcttctgggtaatatagaccaagtgtagctcatatgaatagcttctgatctgaatgattatcccttatgggatactccaaaataaatataataattgaatcccgactggcgcaagtattcagttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgcataaccatggaggcgaagaaaccagtcggcaacagtcaggtcagctagcagtgaagatgtaggcgcccaacaacaacgaaagaacagtcggtggtgacaaaagcaaaccgacgatgacgacgtagacgcgcatcaacggtgatggcgaaatccaccaatcatgaagatgaagaaaataatcggcggcgacaaacgcatccgacggtaatgatgattagcagcaacagagatagccgactatgatgacgaagtttcccatcaacggcagcagagtaggctatgttgaagaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagtcacttgttgtagtaaaataacatggcattgcatgccgagatgtcgaggttcacaaagacgtcgtggttggtgaagtagtaaaacttgcgaagtagcagcaatagagtttgccagtgccgaagataataaagatgaagtcgctccaccatgatgacaaagttgcatcgccgtgatgaagtgaacacgagtcggcggcaacagaagcaaactggtagcgaagacgcgcagttgtgaagataaaagcactagtcggcggcggcataaccagtcggcaacggaagacgatgatgtccatcagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagtcgtgaagaaggtagcatcagttggcgttataacaggccagccgtgcaggcggtgacaccagtcagcggcggatgcggcggccggtcggtgaagacgtagacgcccaacaacggcagcataataagtctgccgtgcaggcggaagcaccaatcggcagcggcgaaggcaagccggtcggtgaagacgtagacgcccaacaacggcggcataaaggccagccgtgcaggcggaaacaccagtcggcggcggtgaaggcaagccggtcggtgaagacgtagacgcccaacagcggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcagcggcgaaggcaagccggtcggtgacgacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttccccgagctgatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagacgcccaacagcggcggcataataggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaagcggaggcaccaatcggcggtgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaat

SEQ ID NO: 66882 - DNA, 5245 bp, Oryza sativa
cgcctaacacgggggacagccctgtcattccctcattaatgggtgaagacttgtggtggccgccctccgaatgaccctccgatgggacgggtcatacctacctccactccgccggtagcagatgcgacgtgggagcacggttgtcagtccagtcagacatgaccggcgtcaggccggtcacagaccggtcattcttaaccatcacgcgccagacggacacgccgcacgtctaccccactgcattaaatgcgacagggggcagttggggggctgcgcgcattaaagggggttcagcctgggccccctcctcgcttgctccccccgccaaatggcggctaggcgagggcctctgggcaaagcggcgcaagggcctgaggggcatgacgtggcaccccgaggcccctcgccatcccggccgctcctgcgattcgcagaatgcggggataggactaggctgtagggacacgtggcaggatgggaaggtagattcccctcacctcacatacccccaggcccatatctccgacaaaaattgttaaatatgttatccgaatttcagcatacaatatatttgggttagttacgtaataagactttgtattacaggattagtttcctaataggactttgagcgtttgcatattaggactcctagattttcctttatgtatctcttttatgctgcatggaaacggtgcggcaacccaatgaatctgttactttcgtatctaactcctttatactgatatttgccggtcgacgcacatggtttttttcccatcaggattttcacataaaatttgtatttctattatccatctattttcataataagaaagacttaactgtctaattggttattataaatgcactcatacgtataggttgtgcatgcatgcaaaaatcatagcagggctcctattttcatagagcaaataatggtcagctccttttcgtcaaccttgagcttcctttctagagtagaatatcctacggaattaagtaatatgtaagattaaaattcctttaacccgtcgtaacgcacggatactttttctactaatttgaagatgaaacaaagggggcctatgtaccactatgaggattcgatatgatacaactttttagtagtgtcatttgttcgtattgctatcaggcttactgatacaaatttttattagcatcatttattcatatctctatcgaaaagttgtgctgactatgaaacaaagggggcctatgtaccactatgaggattcgatatgatacaactttttagtagtgtcatttgttcgtattgctatcaggcttactgatacaaatttttattagcatcatttattcatatctctatcgaaaagttgtgctgactatgaaacaaagggggcctatgtaccactatgaggattcgatatgatacaactttttcgtagtgtcatttgttcgtattgctatcaggcttactgatacaaatttttattagcatcatttattcatatctctatcgaaaagttgtgctgaccacgtctcatgtctctcattaattatgaactaccaacaatttcgttttcaagtgagatgactgctcggttacatgcgctgaatgcactgaacaagtagacttgttaggtagctttcagttcagcgtctcggattagctaagctagaattttaacatgtgagggggccgacttgttgagtaataataatacttaattgttgtagtaactaggaaggtagcccgcgcagttgcgcgggcatattatttaaactatcataatttttgttgttattagaaagaatttagggtttcctttgtaacacaggatttttagaaaagaatagaaaatggtatataaatgattttgagaaaagaaaagaaaatggtatataaatatgatagaaatgaatgtttaaaatatagtatggaatagaatggatgtttggatagagtgtaaaaaatttaaaatgtattaacccagttagatcaaattatcatctggacaaataataatcaaacaacctttgcattagtagcttgacgattgtctcgatggtaattttttaaaattctgttatatgcaagatatatatcttgcatgtacgtacagatatcgtggagagacgagtgattatgtacgggagggaggtggaatggatttgtatttttaaggattggtctatcggatgtaaataattgttttaccgattaaagttacaatggtcatattttttttcttatattttatatatgttttttattttgaaaagatataatgtaatggtccaaaataacaggtctaagattttaaatcatgtgatagcgtaggattttttagaagcatgtgtaaaatagaggatagagaaaagtggttatctgaattattaacacatagattattaacaaaacaaattacataatccgcatataagctgtgagacaaatttattaagcgtaaataatcggtcattagcaaatgtttactgtagcacggcattgtcagatcatggcgcaattagttttaaaagtttcgtctcgcaagtacaggaaaaacagatgattgttaaattttgttatctatgtagatgaaataattatgcatttgtgaaaaaaaaactgcacttaaccaaacaaattttgcatcactttgctttgactaaaatactaattagtagtaggcaactaatactctgtaactctgtctaagctaattttttttgctcttcttttctattccgctatacgagtatacgtatggatagcaaggagagagtgacagaagaggggaaaatggaaaggatgaggtctgaggggaagggcggacgaggagggcggatggcggatggcggatggcggatggcgcgggccggaggtgcgagcggagagctttgggcaggggggacggcggcgcaggcggcagggatggcgtgggttggcggcgtaggcggcggggacggcgtcagacggcggggatggcgtgggttgctggcgtagatggcggggacggcggcaggcggcggggatggcgtgggttgcgggcagagagcggtagcggagagctgcaggcgctgtggacggggggacggcgacgcgggtggcggggacggaggtctcgatctgacgtgcgctcccgcaaggttgtggagtgcgaggccgagctggttgcgccgccgagctactgcatcgccaaccgcttcactcgcgattgggctgtacaacgggcgctgtcctcaggtattgcatcgtgcatccctgcatcgtcaatgtgtactgcactaatgtcctgttgctctgttcccatgtctttgctctgtatcgatttgtctctgctttacgttcaagttatccctcttgtactgcatatttgagattttttggcccatcatgaagggtgtctgtatggctctgtataattgagctttcgtagttaactaattgtagtaaaaaaagcttgtaacttcaaagtaaaaaatgctttcaatttgataattttatatataattaccataccagaccttcacaaaacttcatatggtaggaggcggggatggcgtggtccgcgggcggagagcagcgggtggcggggacggcgtgggtctcctgtagtttcccgtctccctccctccagtggctgttgcaggcttgcagcgccatgtccatatccacctcccatgttccgtcctcacctcaacatcctccttgaattatctcctagctcagtgggtgggttggcggctgcggtgtgtcgacctctctatcttccttcgtctgtattggttatgtcctctctattttccttgattagtggatttggcatcagctgctggggtgttcgccaggggacaattggcagcgatggagttgttgttcacagctctatggaaagacggtatgtgcataatacgaaagattgcggaattatgatgtgattaaatggctcattggctgtgtacatgtattttggatgtttaagcctgtttaatccattgtctaaaaaaataaatggttcatggatgtttactttctggggaaaaatgttataatagaaggaaaatgtaattatcctataactttatatctctccatttctttttgtttgacgccggttagttcaaaattgcactaatcaacgtcattcatttgaaaacagaggtagtaattattgaatatagtacaaagatgaaatatattgtttgtgaaaggaagatataatgtttgaaatatcatcctatttcagctggtaaaaatactcactgtaaatggtaattttgaattgcagcctttcgctagagtatgttgtagcacaatcaatgttgtactggagagaagcaggaatagagcagctgcaatgaatatttacaatgataaggtacccatgagtagtttgcaacatagtttgtatgatcaatatagatgaatgagaatgatataataccttctagaaaatctctttgtacactatgttcctgaccatatgttcacctggctttcattgtcatctagcattatccgtagcccatctcgtcttgtaactctggagaacgttacgtagagctgcccatgcgtgaatacttgcttaggcagatatagtcctaccatgtttagagactgtccttggcttttattgatggtcatagcgaagcacacactgagtggatattgtcttctttttagcaagaagggccatcctgactctgttggcgtcattattattctagggatatataccttttctcctacatgtgttcctgttatgatctgtgcttcaatgaatcttttcccgagctgagtaatggtcattcgtgtaccattacataaccctgtactttggttaatgtttcgcagtagcatcactggaaggcctagtttcagtttcagcacatggtttggcattccagggaagtttagactatttagaaattctgttggatataggacatcggtttcactgtcattagttgttgctttgcatacagtgtcgcagctcagatatgttatctcctctccttctatcatgttcattataaattcattaatttccctcgctgtctcatttcttgggcatagaattgctcgctgttctaagaaatctcgtttcttataattctgtaccaagtttggatatatgctcttcacaatttcttcctttggatcacctcctttcttcagtatcaggtcatcaggtatttctatccattcctctccatccgctgatgttgttttgccatcaccaatgttcaaaat

SEQ ID NO: 66883 - DNA, 2187 bp, Oryza sativa
ctgtaattcggaattaaaaataaggaatattgagagaaaagtccatataagaacccaatacgagattaattaatattcggaataaaataaaaaataaaattcaaaattagcaaaaagaaaaaagaaaagttcaagtaggaataaaatttaaaattaactaaaattcggaattaaaaataaacaatattgaaagaagaattcatataaaaacccattacgagatttattaaaattcagaataaaaaataaaataatatccaaaattattagataggaatacaattttgaaattcaaaaataaaaaaatatttaaagaacattataaggtattaattaaaatttgggggaaaaaaatctgaaattagaaaagaaaaaagatttcagttaggaatacaatttataaataactaaaattggtgataaaaactattgaaagaaacacatgacgagataaattaagtaataggcctataaaggagtagagtggtggcggttgatacgacatataaaaattgttaataaaacaccaaatataatcctaatgacgattaaaaggagggacgacacacaggccatgaagcaaacggacaaggtggttgccgggacttctagaaagtaaaaaaaaaacctcattgataatcatattcgatttttaaaatctcaatgataataaaaaggaaaagcagcgggcgggcgtataggagtaagttgtagagccgccgacggttggcgggacttctagaaaataaaaaatgaattccaacgatagttatgtttgatttttagaatcccgataacaacaaagagtaggcgacagatgagccgtagaggagtatagtggcatcgtttgacaggacttctaaaaattataaaaaatgaaacccaacaagacaataaactctaaaaactacaaggtccaatttttaaaggttcgaaacttctaaaaagtaaaaaaaacaacgataatcatgtttgattttaaaatattaatgacgataaagaagggaggtagcgggtgagccataaaggagtacatagcaaagctgctgatggtttggcgggacttgatgcaaacccgctagggtttgtggcccgatctttcgatgagaggtaagggataactcgattagatgaagtcgacgttcacggcccgactacaactatccaaagacgctgcgccttagcaaccgatacaccgtctccaatggtcgccacgaacttgtggtgcacgtcaacccggccacgagggcactcgtcctgcaagcaatcgaagaacaagcaagaacaagtaggataagcactgaaattgctagataaagatgaaagtttcactatcaaacacaatatggtggggttccgattacaggcagacgggcggtttagccaacacgcgcgctgcgagccggtagcaagaagctatctctatcatcaaaacccgcctgttcttggcggcgactagaggtataaaaagaggggaagaacgaccatagggtcgtgctccaaccctaggacgcacccctaatgggcccaacatggatacacagcccattgggccaaaagaggtgacgcagcaccatggacagaaaatagtcgggagtaaaatgataattgcggccgctccagaacagatatggacatgtggctggatccattcgaaagtagacttgataagctttccatgaagtacttgcacgcccaaatcggagttcgcatgaagtcgtggcgggcgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcaggacttctagaaagtaaaaaatgaacccgaacaataattgtgttcgatttttaaaatcccaataacaataaagagaaaaaacagtggacggtccatagaggagtataatgacagcgtttgacgagacttctagaaattataaaaacgaaacccaacgagataataaactgtaaaaactataagatccaatttttgaagataccaaggagaatga

SEQ ID NO: 66884 - DNA, 7568 bp, Oryza sativa
cgacgaggaggtggacggggaggagctgttgcagaggttcaggcgggaggtggcgcgccgccggcgtcatggaggagatcaggtggcggcggaggcacgaggacgcccgggacaagcgcaagcgcaaggcccgctccgccggccggaggtttcgccggaggtgaggccctcgtcgatccatcggtcgattgcttccatgatcctgcctagattgtgccgatcaaagatgatccttccttttcctttttctcttccccctttcgttaatctgcagccttctactatcttggtgatccatttcatttgcttaccgttttaggtgctaattaatcatgcaatttccgtcagcttcgtgaagccaccttcgatctgttctaatattgggcatgctgcatcggaaaactacaagcatacgttgtttgtgctccattttaggccgctttgatatttcagcgaccaattcacttattacatgaaagcttcgtaccaatactgcctcttcagcggcgaatttttatctcacattagatcgctataatacattgggcttatgtgaatatcattagcatttcagctctctgatggtactgactgccatgttcttctgaatgtggtcattggactgtactggtcatcttgtaaattcattgtcattagcattttagttctgattggaagcaaattgaaattatgagataatcctcttttcttatcaagagagatgagctcttatgtttttgttccgataccactagtagttcttttctttttgatgattgcattgcttctgtcctagctttcaatacattgatcctattctgagcaccatgaattcatcatggccacgttcattatcatgtcaagataaggagctgccatattcatcatcgattgtacattagttatgctagtgatggattgattcaatgaaaaattgtgaatgatgtaaagttgtggatttgggaacatttgattttttgtggattggatctgattggagggatcgatcagggccgatgggaagctgtcgctggttgaggagcagcgtcagctgtgaattttttttagcactaaaaaagtgcagtcggacggtgtaaacttagtcccgtgtgaaaatcaattttagtgcaacaattgaggtatactacctctatatgacgtattacgtcatctagaaaaagaacagaggggagtatataaaagagtaacactggcccttggatcaatgtgcaatggagggtgtaaactatatacttttggtttgccataaaaaaatcctgatgataatcatagccaatttattcggttgtgtgttttctcttcggtctccacacaccacacacatgcatgcactgggacaatcgacaacattttatatggattaagagctcacgtacgtgaaatcagcaacattaaggtgctggtgcatctagcgtgcttgcgcacagtgagtggtcatggtgaccttattggaaatcaaacaactcatcattcgaagatatatatactggatcaaagtaaacagacagacaaataatagaacaaattaaataaaacaataagcatacatatacggtggttgatgtggccatggcatgttgttcggttagctggctagggtgccctagctaggggcgcttgagagagaggattgccttgaagatccccacaatcacgcggcgaggtgaaggtgagaagcggcagcggcgcgaggaagaagaccggagggtgaggggtggccactctggccatctccttcttggattcggtgggggagaagggagttggaggcgcaggaggccggcggaggcggtcggcgagtaagacggtagccagcggaggtggttgtggccagcaaaggtatttgggcagcgaattgaggtgcaggtggccagtggaggcgagcaaggcgatggctggcgaaggtgctatcgaggtggagttggctgttgaggtggctggagaagctgttggccggcggggttttagtggtgatgggtgatggccggtggtattgccacttggagaggtcgtcgttgggttggtcggttggttgctgacgtggttcgttcgtttggaaagctgcaggacacggtgaacaacagtgttgtcagtggcttgatcaccaacaagtgtacctccaagtttatctggggctcctcccgtttcctagagctcctcccctcctattgaccgttctgctttcagattccggtcgtggggagttccatggcgaggggcggggagctagctttggttggtagatttgcttggagttcgagagcctcaacactaccagcgctttgtttttcttgcgtcggcgaggtgcctggttcggtggagttggtgcatgagacctctgcgacgcaacctgttgatggtgtttggggtggagtcggagctgcatgcttggccgggtgtgacaagctggtcaacaataacccccttgctccttccttttggtagtttcgttggggttactatgcagttggcttcctagtgtctttgggtaggtgtgttgggggaaatcggagctgcttgtcggtgacaagctcggcaacgataaccctctcccgctttctatggtagcgctgtggtagccagggttgtcgtagttggcagggagagcgagctggggcgaatgtcctgctcgatcttgggctagagccaacgatggcgatgcctgtgggcgccattttccttcttgaaggcatcgtttctgtgctctactcatttcttcgggtgaaaaccttgctccgattttcggacggacgttgtttgtgtttcgacgctatcttcctccttggaggcttcgtcttgaagaccctgccctacgcttgtctgtggtctgttcataggaagtcggagctgctcttgggagcttggcaacgatagcctatgttttatcctctagttgtgccgtcgcaagttcttttttttttgttctccgtgtgggttttgcccggctttccccttcaaaccatgcttatgtgaggtttttgtgcccggtttccctcaaaaattgggccaagtctcttcttcttaaatgaaagcaggctcttcctgtcctcttctgaggtttttcctcaaaaaaaaaggacaaattcatatagatagaaattggaattcggatacaagcaagaaataattgttgcaacgtacagctagcaagctctgatctgctactcttgggacgtttatcactactgctggtgttgcttgatagacatgagtgttttgaagatgccgacgagaacgccgattatggagaacaccgtgacgatggtcttcaagttgttgtagatgaacttgtgtatagggatccacatccacctcttacgcctgtatgcttcaagattgtccaataaatagctgtgctgaaaaggaatgggaattagatcgacaaggttcttgaagaatacgagtgtgcgctggttgctgaaatcaccatgtaggatacgcttcactcgcagctcgtgcacgtcttcctcccggctcatcagcatcgcgaggagggatacgtaagagcagacagtgtcttcaccatccatgccagtagaggccgagcaaatctcgagtgccatcatattgatgagccagcatgcattttggtcgtccatgacgagaggtgccatgaagagcttgccgaacaaggcacctttgctgatgctcatgtcattaaaccatgttttcttgttggctaccaggttgatgcctatttctgcaagctcgatggcgctgctattctgtgatattgaagtaattccttcagggggttcgagggccatgcttccattaggcatgctcagccctgattggtagtaccgaaggaggccaaggagatgtgatggtgtgtagctttcatccaagacgaatgatctcttttctaaatctgtgtaggcatcaaaactggcgcttttttgagagatgaactctcccacgggaacagacctaaaggtcatgagggcatccagcaccacccatgggagctggttctctagcagaaagatgtccctctccatgctagcatcgttggagttgaaccaactttccaatgatggagcaatgtcgtcagttgagcaaatgatatactggagcaagaagcaaccatcatggaacataatagccgcaaagtcaccttcgcctatgcttgccaccgtgtcatcatccacgtagcagcttcgggcttcggctgcaaccaagaggattctctggtagacctcctcaaccgagtggcctgactccccgcagaagtagtaggcggccgcacgcttgacctcctctgcctccttgaggtggggtgcgccatggtggtaaggaccgatggctacagctcttgggacgaagtagcggtcatctgtgctaattaagcttcgaaaaattgaagggtacctgtggatcttggttttgatcttggagaagttattctccatcttttcggctgctcttttcagctcctcttcgaccggaattgctacggcttctgcagcggccgtggccatcgccgttggctgctcggcagtttccagtggttggacctgatcgctgctaggaatagctgagagttcttccatttgtggatttgctgtcatgctatgtattcctgctacagcctacactcaactcaaaacatgcgagcaattggtggtgaaacaatgaagtttaaggagatgaaagatcccatctcaaccaacaaatatagaataggttggtagatgatgcatgtggccaaatatagaagtacgtttgccaatcaatttgcttttgattatattagagagtacattagctagaagtagtgttccaaatctggtgtcacaagaacatgtaatgatacaagttgttaggaatccaattcgccaaattcaaacaatgaagttcacagtacaagttggtggtggaattgagatgaaggagctaaaaaatgggcaattttaccatcattgagaagatgcctagaggtaccatattttttattttttatatttgcaaaatttttttgaataagacgagtggctaaacgttgcaaataaaaactcaaaatcccttatatcgtggggcggagggagtactagtaattgtgttacgtgttgttcgtgtgctgtgtttcggtacctgcataaatcaccgatcaacggtgtattgttaagtgatcaacaagttcatgatgaaaaaaaccgacagtaatagtggcatcggtatcaaagtgaaagaaacattgataacactaagtcacaatatttgttaacaatatttaagccaaaactttacattctctataaattgctcacgggtatcttcaccaccaaactgtcataattataatgtattagcataccaatgaattttgatcgtccaggttaccgaccagtcgtttttttagcttacctatgttagttgtcatcttgttacatcatatacgtctctctattcaaaagagataatagaatgtactccaattttactttcatcctaaacatttattgcaattatatatcccactttataactggctttatatataggcacaaactctagcaatttatatgttcagtgcaacaaattaattaggaaatataaggggtgcagtggcaacaatccggaagttcctacgtataatagcgacctacggtgatagcagcttcttgcggtttcgttgcttgttttccacttgcatcagttgtcacatgtctcttttggaattaaaccccaagagatttttggatgagctgtggtcatataagagaatctcgatttgcatgatgaacgttccacaccacttgttggcggtgagccggtgagaaacgggtcttggtgatgcttcggtagaagcatgcatgcgtgcgagataatcggttggattgcggtggtggcgactggcgagcacaaatagatttgctaaaacctttctgaaatgtattttcagataggtaatccctccgtattttaatgtatgacaccgttaactttttaatcaatgtttgaccatttattttatttaaaatttttgtgtaaatataaaaatatttatatcatgcttaaagaatatttgatgttaaatcaagtcacggtaaaataaatgataataacataaattttttaaataagacgaataatcaaacgttggttaaaaagtcaacagcgtcatacattaaaatacggagggaataatttttttcccgtattatccttattggcttgacacagggcaatatcgtctaaatatatattgtgctgaagagtagacgagtggtcatttggagtaaattgcatacggcggatctacgactatgatgtatgcgagtttggactaaaaaacaaaatattcgatgcaacttatctaagaaggattgttttcatgccaggcttgactagatcatgaaacatccgaagcaccggaatgcccccatccactagctttatcggattattagccctttgaaatggatgactagacagattgtggaagattgattatagggtgaaatatattatatattatatagctaacaatagcttaaatcaagttgtttaagtaacactgatgtaaaaaagtttttggcaaaattattcttttggaagtgtggcacagataatcatcacatattacacgctttccagactgttaaaggtaaattttgtaataaataaaaaaaactttctatatagtttttttttctaaaaacaatcaaataaagctaattttaaatttacaaccttatatatttaattaatcatatgttaatgatttgtctcgtttcacatgtgcatgtgcttggcagtggcagagccgggaggagcagaggaaggcctggcctcccccaacaaattgcaaatttccaagtacatctagttaatcacaagatcaagtaagcattaatgctagctgccctgagtctttgggcctttgtctcaaaggccattggttgtgaaatttatgctagctgcctagtacatatggatgggtgtggaacactggaacaatcaagtttgatggctccaatcatgaatttgattacttaagtcctaactgtcttgttatacatagttcattgtgaaaaatcttcacattgctaaatgattggcttaaacatgattagtttgtattgttaaattgtcaaaatatagggtatatattaatataaaattactactgttaaattgttaaattatcatatctatcttctatctatcttctatctattatatactaaaagtccattaaactccctacaaacgctcttaagctgccacgtgtctccctcaaaacactctcaacttgccacgtggcgtaacgagaggaattcagcacctcgtagggcccgcacattatttccataaatatatgtacgtgtacacaaggcaagatttgaaatctatctaaaagcaaaacatgtacttgtcgtgaacggacatagattagttccatatttgtgtgtgagaggcaatattccaaatctctcaaagcaaaacattccaaatctcaaaaagcaaaatttagatcactaggaaagattattaattgcaacaaggattagttccatatacatgagacaatattcgtaagg

SEQ ID NO: 66885 - DNA, 2405 bp, Oryza sativa
  unsure (1)..(2405): unsure at all n locations
gaggaacagaatggacaaattgatatgattcctgatacaatacgtcagatatgtggaagaatattgatattcagattgaagttgactaaaaggaatttagaagagtgtaaggaagactacaaagtgaactacacttttacacctaatgaaaagcttgagatgaattatgtaaatgacaaggcagaagaggtatgactatttgcattattcttttttatacatgttatagatcttatattacaatataaatattaatttgcagtcaatgttgaagtacaacgatgattatggcttcactgatttgaaaaaaatatttttgtaatgcatatgatatatatataattatttattggatgttctgtagtttgggcagcacaattttcaggtaaaagaagagccaaaaaatgaaagtagtgatgattatgaaatgaacaatcatcgcaaaacaaagaaagagagatcaaacatgagatctacaaaaagatcaaacaaggtatgtataattgctttcttacataacaattcgtaaagttgtttatagtactacactaataatgatgttttataggaaccatacattaccgattctgatgggaaaacaaatgaaaaggcaatcacaatcgatgatgattccgaagaatcacttgatgattattttgatgaagaatacaatgaaaaggttacacaggagagtacaaagacgaatccttctaaaagaagagttacaagacgttttaaaacatctaacaaggtacttcatttattttactttccaaattcactcaatttaattttcacataaattatttaccatttcaatatggcactatgatatacgctaagaaaggaaaatgtctgaaatgaaaactcaaagaaataaggtacaattcttacttttctttcatatacaaaacgatctgtcaaactattactgacatgttatatacaattgatgggtattaataggaaccatatattactgattgtgagaagatagcaaatgacaaaccaatttcgcttgatgatgattttgatgaagaatataataaaaatatggtcatggcggacaccagtacttctaaaagaaaagtcagacactacataggacaaactaacattgtacttcattgagttttacnttctatttaatgttacctttcatgtttgtccattaatgtcaatatgctattgtgcaggtaaggggaaaaggttgtggaaagaagagtacaaatatgggaacttgcacaaaaagtgcaattgaaaatacaattcaagatgatgaagtatttgatatatttgttaaataaatcatgtattttaacataaaacttttttaattaactaactaagaacacaaaatttaggtgcatgacggaaaaattgcttcaggaactgctaaaagaccatcaaggaaatttataatttcagatagtgaggtactgcatgagacaatttatcaagttattaattaatatatattttttttgtaacaactaatttttttttccataggatgagcacagcagtaatacaaaggtgactggggacagcaccagctgtaatagtagtaaggaagatataaacaaaggtcgatgcaattataatattgagaacattaaagttcacatgaatgagcagtccagtcgatgcagatcaacaaggattagaagaccacccacccgatactcatattagctacaacatattacttctgggaaaatgttggttgctttagatttggtttgattagtaaattataataatatggtctttcgtctgcaggtaatttatagtcaagaaggcccaaaagaaccaattaaaaggagggttcagccaatactttttattgaagaatagtattatatatgttcctattaatttttatgttcattagatattgtcagatgtaacgtacaacttgcacttgccaaaggaatccttggattactttgtttatttctaagatagagagttaataacattcaatataaatgcatgcatgtaccttcagtacatgtatatgagtcgatccctgcttgcttcctctaccgttgatatcctaaaagcatataaaacaagatcagttgatttaataattcttaattaatacaaatccccaagcaagaaacttaatgattaaaaaaacttgattatgtaaaatggaaatcaatcaagaacgatgagctctcggggctaccttcgctctcagccatgcttgatgttgctgcacctgctatccgcactgccccaacacctgccatccccactgccccatttcctacaaataccacctcccataccagagccaactaaccgatggctaacactgctcctgatctagacatcctgcggtggatctaccaaggcactgacttggatgccctatggtggatctagccaaccag

SEQ ID NO: 66886 - DNA, 1145 bp, Oryza sativa
gtatgtatttaatcacaattaatttccgaataggtacaatacatcagaatcagtcaaaaaaaagttgttatatccctgttttgacatccaattttcacagctcaaacttcactgctgaagtaaactcaacggaactcgcacgcttatcaagactgaacaggaaaaggaaacttgaccttagaagaagcggatctacattgaataacagttcgacctgttcaaatccagcaaatcacattgaaaggtaaacatacagaaaatcaacaccattgttagaaaggaaatttttccttattcaacaataaacactgactgtgatatgaataaaatcaggtctagaaaagaaaaatatcagatcccatcaaccaacatggaaacgaataggtatgttaaccacattataaaaatgatatcgtcattcagtttatttttaaatcacttttttcttttatgaaaaaaatatttgtcttccagtctcaagatgaatgatcgagtaagtaaggaaggaaacattacaaggaataaggttgctgtaccaccaaggaagaagaaaaaatcaagcgtgaaagaatggaattttggcaagcctacatgcacatgtcaacactgtggtgcacttttctggtatgaagaaagaactcgtggcaaaggaaaagggccaccttcttttagcttatgctgcaaacagggcaaggttgacttacctacactaaagaaaccacctacttacctttcaaatctgatgtgcaaagaaaaaggaaagagatcgaggaactacatggacaatatcagagtatataactccatgtttgcatttacctccatgggaggaaaagttgacagagagataaacaatgggtctggaccatatgttttccgcatgaatggccagaactaccaccgaataggtactctactgcctgaagaaggcgataaacctcgctgggcgcaactttacatctatgacactgagaacgaagtcaaaaacagaattgacgcatcaacatcatcccataatagagaatcaatagattcacacattgtcttaggcctaaagaacatgctggacagagaaaacgtactagcacagacattcagaatggcaagagatagattcaaagaaggtgactatcataatgtaagcc

SEQ ID NO: 66887 - DNA, 2226 bp, Oryza sativa
ccgtcaccaccgtcgcagtcacccaccaaatcactttctatttgtgtttgatctgttgccgatagcttttgtgagttgccttgtatcctgccgccactagaaaggaaatagaaccctgattcgagtgaccttccttaaaacagtcatatctttttcatacggactcgaaattaggcttataatatatccacggacatctacaaaaaaagttacatccgggttcagcaaatttaaaatcgccaaattcctcttgcaaaattctgtttttgtggcgagaagcttcgggacctattcgcatagaactttgaaaaaattctacaagcttcatactttgtccgtttgagataagattttctgtggttggttctagtgtgctcctggttgtgaaaaaaatatcaaaaaaataataaaaaaataaaaaaaaagttgtgcctctctcctcagcactagagagagcaagcaaaaaaaaaaaaaaaaagaggatccagcgagcacaccacaccattccccctttgtcaccaccttccaccaccggttcttgttttcgttgctgtttgggtttgtgttttgtggcgtcctttgtggttaggctcgcgtctctacttcgactagcctaggaccagcactgtacactatacccttgagcgattattcaatttgctttggctaacgtggtttctagttttctcttgagcattgctttcagcccaccaacagctccaccacaaacccgactacagcttgcaggtcttgttgctacagcaccgatacacctcgttccacggttgctaacttgtggtgttgctgtccccctcctgtgggcaaggtaagaactggtaagagcttgtgagacaagctgcgagtgaagtgagagtgagcgtcttgcaaaagctacatcccaatagttgtgtagggcttacattacatcctccattgttttgttgtccttcatttctaaaccatggcaggtccaaaggataaagatgaggagggtgcatctcattccccacgcaccaaaggcatcatccaatactttacaaggcaagtgaagcagcacacggaaggacttgatatagatttgcaggtgacaaatgagaagattggacaattggagtccacgcagatctccaccaacactaagcttacagggctggagacagcggtcacccgcattgacactagccttgctgctcttgtgcggcattttgatgctctcaatgctggaggcaatggtggcggtaatgacgatgacattgacggagagtacgtcgaggataatttggaggatgaatatattgctgacactgaacaagatgatcgagatgctcgagatcgtcgacggctacacaacaatcgacgaggtatgggtggtcgccgccgacgcgaggtacgcaacaatgatgatgctttttctaaaattaaatttaagattcctccttttgatggaaaatatgatcctgatgcgtacctctcttgggagattgctgttgaccaaaaatttgcatgccatgagtttcttgagagcactagagttagagatgctacgagtgagttcaccgattgtgcttcggtttggtggatagaacatggcaagaaaaatcctaataacatgccacaaacttgggatgctttgaaacgggtcatgcgggctagatttgttccttcttactatgcacgtgacttgctgaataggttgcaacaattgagacagggtgcgaaaagtgtagaggaatattatcaggagttacaaatgggcttgcttcgttgtaatttagaggaaactgaggacgctgccatggctagatttttgggtgggttaaaccgcgagatttatgacatcatagactataaagattacactaatatgacccgattgtttcatcttgcttgtaaggctgaaagggaagtgcagggacgacgtgctagtgccaaggctaatttttctgcaggtaaaacttcatcatggcagacacgcaccactcctccggccagccgtactgcttctccatcttccacacccacaaccagtcgagcagcacctcctccatctagtgacaagtcagcgacaaaggctgctcagccagcaccgagtgcttcttcaatggcatccacaggccgaatgagagatgttcagtgccaccgttgcaagggctttgggcatgtgcagcgtgactgccctagcaagcgagttttggtagtcaaaaacgatggtgagtactcctctgc

SEQ ID NO: 66888 - DNA, 962 bp, Oryza sativa
ccctaagcatagtagacaaggttctattcaccacttcagtttgtccatcagtttgggaatgacaagtagtagaaaacaaaagtttagtccccaatttagcccacaaagttctccaaaaatggctaagaaagtttgtgtcacgatcagaaacaattgtgtttggcacaccatgcaagcgaacaatttctcgaaagaacaaatcagcgatatgagaagcatcatcagttttatgacatggtatgaaatgtgccattttagaaaatctatccacaaccacaaaaatgctatcacgccccctcttggtcctaggcaatcctaacacaaaatccattgaaatatcttcccaaggaacagtaggaacaggaagaggcatatacaaaccatgtggatgtaagcgtgacttagccttttgacatgtagcgcaacgagcaacgaacctgccaacatctcttcgcatctgtggccaaaagaaatgactagcaaggatgtcatgtgtcggtgacatgggaccgggagtatcatgactagaggcttgggcaggagcaatcacccatgaggcctgaccccctcgggggggtcgggcccgagggtgatgtggccgcccccctcttagtctccccgaggggtcggaccgctcccgtttcggccccgagggttgaggcgccccaaccccttgggggttttgtgccgcgtgtatgggttaggtgagcgcagcggggctcacctaaccgcatttattgcggtttggacgagcgcgtcatgccgcatgtaacgcagtgcagcacgctcgtttatccggtctgtgaccagtcacagaccgaacaaatcgtgggttaggtggcgacaggcggtctgacgcacgcctcgccccatcccgtcaggatgagagcctctaagcactcgtccctagccggtgccggcgtgttagctcctggagatggcacgttggtcccggtcagatg

SEQ ID NO: 66889 - DNA, 1693 bp, Oryza sativa
agagtctaagtaggaatacaatttaaaaatagctgaaattcgaaattaaaaataagaaatattaaaagaagagtccatataagaacccaatacgagattaattaaactcaaaataaaaataaaaataaatccgaaattagaaaaaagaaaataaaagaagagttcaagtaggaatacaatttaaaattagctgaaattcggaattaaaaataagcaatattgaaagaagaatccatataagaacccaatacaagattaattaaaattttgaaaaaaaataaaataatatccaaaattagaaaaactaaaagagagttcaagtagaaatacaattttgaaacaactgaaattgaaaataaaaaaaataaaaacattaaaagaacacaatacgttattaactaatttttttaaaaataaattatgaaatttgaaaaggaaaaataagatttcaattaggaatacaatttataaataattaaaatttgtgctaaaaataaagactattgaaagaaaataccatctaaaacacatgatgagataaaattaagtaacaagcctataaagaagtagagtggtagcggttgatacgatatataaaaattgttaataaaacaccaaatagaatcttaatgacgattaaaaggagggacaacaggcatgccgtgaagcaaacgagcaaggtgattgccgggacttctagaaagtaaaaaaataaaccccatttataatcatatttgatttttaaaatgtcaataataataaaaaggagaagccgccgatggttggcgggacctctagaaaataaaaaaaataaattccatcgatagttatattcgatttttagaatcacaatgacaataaagagtgggcggcatatgggccgtagaggagtaaaccggcatcgtttgacgggacttataaaagttacaaaaaatgaaacccaaaaagaaaataaactctaaaaactacaaggtccaattaaggtccagaacttctaaaaagtaaaaaaaaacctaatgataatcatattcaattttaaaatctcaatgacaataaagaatggagacaacgggcgagccataaaggagtacaatggcaaagccgctaacggtttggtgggacttttagaaagtaaaaaatgaacctgaatgataattatgttcgatttttaaaatcccaacgataataaaagagaaaagacagtggacgggccgtagagaagtataatggcagcctttgacaggacttctagaaattataaaaatgaaactcagcgagacaataacctctaaaaactaagattcaatttttaaaggtttcaaagagaatgaataaaaatagtggtacatcgagcaagcaaataaagaagtatatgatagaagtaaggggtagcagctgttgtgacttttaaaaattatataattagaaatacgtggatgataatgtttggtttttcaaagtcttaagacaatgagatagatatttaataaattttaagtaaaatcataccgaaaaatattattttgttgctagccgcgcaattgcgtgggccacccagctagttatattattaaaacagctttgaaaggaggcaccacgttcgctgtggggctagaaattcccacattaatcggagaaaaagaaaaaaaagaaaaggagagtccaagtagaaatacgatttaaaaatagctga

SEQ ID NO: 66890 - DNA, 1659 bp, Oryza sativa
cgagggttcacacacatgtaagcgtttggaattttggatagaaattccgggcgtgacaagttggtatcagagccactttgaccctaggttatgccaaatggttacccatagaagccctctgaaaaatattggaaaagtagaactgttctcctctctttctcttttaattaaaccaaactaatggcacatgtacttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataattttcctttcatttcttttgaaaccagttattcaaaattacaaaatttgtgacctcgtttccaaatgttttaatttatttcgcaaagcttggtttaccttatttatttccttttttttactttgattttctaactttattcaaaattaatccaaaaaacttgtgctattaattggataaaggtcttaactccctcctttcacttgtctttagatgccgtgttacaagcctgagtacctgtttggtgttgagggttttgtccaggagttgcgtacgatgtcctttgtcattggatttgggaatgcccctttttatgcccagattcgtcatgatcgtcatgaagaaaagtgccgagtcaaagtcactttgaacagtaatagtgaagatatcccctcagtgatgtttgaagctggaggaagaaactacatccatgcatgtcaggaagtggcaaggatcgccataggagagctccgtgatagctacagtgatcaattggccgacactgagtatcgctaccatcctcgccaacctcagggaagtgaccgtggcagttaccttgagactgaaggaattgagaatgatgttaccacgaagcatttggttgagatgttgtgggctatggatgaaagtcgtgcggagactgtgttagcagcttaagatcgtgaagatcggaatcgtggtaagatttgcaagctagaagacaaggtggatcatttggagaaggaattagccgcattgaagggagaagcaccgccgcagaaggccaggattcgtcttaccgcaaggaagagagctttatttgtccctcgctatcaactggcgccaaaggttcgtgtggtggagaaagaagttgccccagctcaagcggatcctccggtcatcatcataagtgatgaagaagaagaatctaagcgcaacaattccaagtttgagtgggtagctatcaaagatgaggaagatgagccgaacgagccttcaatcgacctccgatgcttggaagaactagagtgacttgttaagccgttgtcttagatcgatgtgttagtttgcttgttttaagtttgcttgtgtgtgtggctcgcatgtgatttacatcagtggtgggatgtaagtgcgtgcgtttgtttgcttttgagtgttaggaagttggtgagtttagtggtgtgagagtcttcagtttgtaataatgaaactcagttaagatcaataaaagttaaagtaattctctgtcctaagtagtttcccccgttttctcttcttatcctgtccatgccagatggtgaacactcgcagcagcgggaatgg

SEQ ID NO: 66891 - DNA, 1407 bp, Oryza sativa
ttcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgttaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaatttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtat

SEQ ID NO: 66892 - DNA, 3241 bp, Oryza sativa
  unsure (1)..(3241): unsure at all n locations
actaaagatgatctttagtcccggttggtaacacaaaccgggactaaagatcaaatgtgcccgttacccttttgaaccgggactaaagatcatctttagccccggtttttattgcatccgggactattgtggaaatcggccgaccgacgaaagatggtttctccaccagtgtacataggtaggatgagactagagtgatcagtgagggagaccactgacattctgcttgtgcttaatcctcttaactctgaagatcatccttcctgggcccccactcctcttcagaaaagcctgaagctagcttagttaagtgctaactatagcactgatccatgattaaaatactaattacctccacctgttaccagcatccacccaaggactaaggacaaaccacgagccaagctccgactattaagtcattaactaaccaaaagctcctcaatccatgccccctcctagatggcactttatccccttcattaacacctctcccatcccttctaccaacctaccaacctaacccccccaaaaaagagagagcatctcacatgctctccattctctcccccctggccccctgatctccctcctctctatctacaagacaaaccttttctttattttttttctttaaaaactgtgcctccttttctcactggctgctcatgtgattgcaaacattcatcaagaaacctaacttcccataaccaccagcagcaccacaaccacagcatgcaccctccttcactttcatcagtatgtaccactcactccttacctccctcatctttggccaatcaagagcatctccatataaaaggagacataaaaacaagttgcaaaagggctactagcatgcatgagggaaataaagtgtttggaaagctatgtgttgagtgatgcattcttatgaggtctccaaaagggcatgtttagatctaatggtagatcatcaacaacccatgtcttgccctaaaaaaaactatctatatgggttaaaagaaactagaggaagacaagaaagaaataacaactaaaactaactcatgaaccatgtcaccctgatgaatgatgatcgatgaagcatgatgatcactctggccgaggctgcaaatgaggggaaataaaaaaaaaagagaaagagatcacatttcctgatgaatattacaaagagctaagcatgtgtggctgggttttaattgcgaattaagtagtgtatatatatctcctccctcaacttaattaattatgtcattgttgtgctactactgttgtggtggcttcctcctagcggcgtgatgaatctaaacatgtgtgtgctggcctgcatggagggggcgccgccgcgtccgcagctgcacacctcgccgccgtggagcccgaggcggttcaagcacaggcacaccgccgccgtcgtcgccgtcgtcgtcatcgctgcattgccggcgccgttcgccgtcgctgacgcttcgtcgtcctcctcctgcttcatcggctcgctggtctgatcctgcggctggtaaggagctaggctgatggaaaggttgaggtcgatgccgaggtgacgcggcggcggcggcggcgtggcggagctgggctcgtcgtcgctgctgtggctgcaggcctccggcgagttggagaggacggcgaaatggtcagggtggtggtggtggtggccggctggcgcggcggcgaaccgccgtggcgcctggagctgctgctgctggtggtggtcggcggcggcattgagcgggcggtgcgtctgcgggtcgacgccgcgggcgaggagcttgcgcttgatgtgcgtgttccagtagttcttgatctcgttgtccgtcctccccggcagcctcccggcgatcagtgaccacctgcatatacaccatatagatatatgttattatacacacatcgatcgatcagtgatcagtaatatgcttgtcgattcatccatcgccatgttgtcatgatcggatcatgattctatctcttatatagctaatacaatatttatcttctttgcaggatggccggcatggaggcttacttgttgcctagaagctcatggagcttgatgatgaactcgtcctcctcctcggtgaaattacctcgcttgaggtccggtctcaggtagttgatccatcgcagccggcagcttttcccgcaccgcagcaaccctacacacaggtaacactcagtcagtcaccgtcgacctctgaccatgatcgccgccgccatgcacgccatggccggagtagcatgattttgtacgacgttgtatatacctgcggccttggggagcgacctccagcatccctcgccgttggccttgatgtaggcgatgagccgctggtcctcctccttcgtccaggctcccttgttcgtgtgcgccttctcgcagcatggggacctccccatgctagctaggctacctagctcgctacacccagatcagtccctctctctctatatatatacacacacagatcgagggaaagctctcttgttgatgaagagaagaagcacaggagcgagggagggaggaggaagatggagatgagcgggggctggttgcaggtgatgctttgtgggagctttttcgtgagcaaggagagagaggagggtggtggttggttggttttatacgagggagagggagaggaggggagggccccattgacccggatccctctgggccatttgaccgagttggtgcgatgagacgagaggaggagcggaggttggttgagtggctgccatttgcaaaggccctcccccccacggggctggatttggtaggtaggtatacttcactcccagtgctcctcgtcctattccctttccttttttctgtgtctggttttgtttattgtttcatcttttatttttttttcagttcgatttgtttttggaaatgggattgttggttgtacccggtgagtgtaccagatgcgtgagttgggcgcgcataggtaggggtttttcttcgcctccgatttggtgggtgtccttgatggtacatctttctgaaatacgtatgtggtaacagcaaaaaaaaagttttttattacagcatctacggtgttgtataattgtgtattgatatatgaataaggtatttgttagttttgctagtaggacgatgatgatgcannnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66893 - DNA, 11664 bp, Oryza sativa
cctgcaccccggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtctatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcaattgatgcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaatacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtccaagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaactttgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgtgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatcaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctgttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcaaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaatcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagagcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatatgtatgcatatatatgtattgaaacatatatatgcatggtttatatatatatatatatatataaaccatgcagcaacagaggcatgcaaaaaaaaaaaggtcagctctatctttagtcccgggtgaaataaccgggagtaaagatagcgatctttagtcccggattggtactcccggtttggaaaccgggactaaaggggggttacgaaccgggactacaaagggtttctccaccagtggtatcttccatattgctagatttgacgcttgcatattcctccatgggcgcataattccttgagcaacttttgttttagctatattcaggagcaatctgaaactatacatgggagcatgcatacgttttaacctagaatataacaaagcccagtccttaatattgtccaacagtcagctgtataaaccagaggcaatagctaggtaggatgtgctttctacactttgacaacaatcaggtaccacagggagaagctcaaagttgacaaagatggtcatgatatagggtgtgtttagtttctgaaaaaaattgaaagtttgaagaaagttggaagtttatgtgtgtaggaaagtttttgatgtaaaatgatgtgatggaaagttgggaatagagggaaactaaacacggccatagaagagaactagaaaccatttcaacacatatagttgatatatgtgtccgccaaagtaaatacgcactgattgatacatagaagatgtaaccaccggaggaatgttcatttagaactatgttcagaaatttcatactttttttccggtttcgcgagaaaaatgctatgaaacaagctaaaacaactgttctacaggtgctacttcttaaccaccgtatagcagctttctcaaaatattttttaacacaagattgtcggttaattttcatttatgaaaagggtttgctgcataagcgtagtgtaaaagagtgcctcgttttgttggagagcaaggcataatattggtagtccttttataaaaggagttgaaatgtgatagtgcatcgttctaatcaatcatgataaaatcgtaatagtaaagattttattcttaagccccatattttggggcaaaaggtagattaacgttattcctaaattgcatatgctatctaaaagtaacaatgcatggaattgccaagatccaatatttttcctttatatattccgtaatgcttcacttaaaacaaaagcaaagcacctaataaaatgctgttagttattcatttgtttccatatgtcatgatgtcctagccatatttaataggattcatcctttttccctagttttggtttgcattcaaaatgtgtgatgaaaatatgagcagctacaaactttatataccataatatagaatctacctgttgtaaagactagtcagatatcagaaggctgtacttcagctcttcgattgtgttcactattagtaacaactcgcactaacccagatcattagctagatctaataaaagtcggatatacactagtatataatactaagctgaggttgttagatagcctacctcatttgtttccaggtgtagtgtaagcctctctatgcagacgtaagatgatagaggaactgagctgaaaaagaaaagtcaatataaaaacaataagtcgtcatctcgaactaaatagaaattatgtagaagtcagtatcaacggcaaacacatctcatcagatctttgcaaagcatgcatgtgacacctgcacttataggaaaggaccaacacctcaccctacgctgtagttccttaggtaaaaaatgtttatactcgagatctcaacaatttttgccctggaaatttaatcacgtgaggtagaaaatattcccaagatcctatcaatcggatctaagatgtctatagaaaactaatataaaatagggatgcttaatcgactagttcttgctgcaacacagatttgctttttttttctcgtaaacaaaaagaaaatataaagacatgctcatttcaaagaactgccaaagctaaacgtttgcttaaccaaagaacgtcagtggaaagagtaggtttgtcttgtttagtctaagcgtgtgcgcttatggcccacaagagctggcccaacagcaacctgcggcaataataattaagaaatctaattgtcaaaaaagggatcacctatacatttatcgacaaattttctactaaaaatttgacagatgtaattatagtacaattgtagtgtaattacactgtaacttatatataattacactgtaacttctatgtaactacagtttaacttgtatgtaagttcacgtaattttgaatcattagatctattacaagatttgttctggtgagaaagaaaaaaatcacagcacacgtatatgtgaaaggatttgttcccacgacctctattttactgaaataacatgttaccaagagattcttgaaagttacatacaagttacattatagttacagtgtaattacatgcaagttacagtgtaattacactacgattgtactgtaattacatctgacaaatttttggaagaaaatttgtcgacaaatatatagcaaatttggtcaaaaaaattatttttgaactaattgtcaaaatcttggagacagatttgttgagataagtccgtgaggacttgcaacttgcaaaatagacagggattccaaattttcgacactgcgaggcagtgagcgcttgtgaactcaaccaatataatacccagggactgatagctactttttctcttggtggaaggaaaaaccatctaaaaagcatgaacttctcccaaccaatatgtttctattttgtccacaagaatggttatttcagagggcagggtcttttgcaaaacttccttaaaaactggaaatggggtaaacgcaaatggaacaaaacaaaatcagtgactactatagagagttattctcatttgaccacctgaacgtatggtgggacgaatccttttcttaccccctcagcaatcaccaagaagtaccaacagatgacaaaacaattcccccttttctacccttccaccagtggctcaaaacaatcgtgaggctcacacccatgttcctagctgatgatgattcattaggttcctcctggatagagccgaatttaacagcaagcatcctacggttccaatcatacggaggtatccacggcaatcgaatcattcagattggacagctatatatatcaaaggggtcaacgatcatggggctcactctcaagatcttggatgatgtcccagggagcttgtacttaaatttaagtatgtattagtggtatggaccactcaaattgagcgtaatccgcactggcaagaaatccaaatcttttgccagtgtagaagacaagaaccaacttaggagaagatgatgaagatggctgtagctagctgtggacggacagggagaggataagcagagggcttgggaatggatggctggatgcaaacactgggcggtggtagttggtggttggtagcccacatgacatcagcccaaaaagacagcagcccgtgtcttcttcttcttttcacaaattcctggcctgtgcttttggcaattgctctagtcccccaccgcatctcatctctcgcacctccctttcagacgtcattctcggctggctcgggtgagttttttatggcttttgggtgaagtgttggtttttttgtggtggggtcaccttctagaagcacaagtgatccaatgtcttccccacaaatggtcagtggatgcagcgtccgtttgcaactatccttgtcaatgatctactagcggctcaggcactgtttagatcctccaaaatagtaaaagttttatcattttaaagcactttttaccattttggatctaaacactagcaaaagttagcaatttgccatttgccatttgctagtccatagtagcaaattgtgccaaaaaaatgctttggatcactctctctctccaccaaaaagtgctagaatggcaaaagttcaggatgcatctaaacaccaactagtacttttacaataccaaaaacttttgccattccaaatgcatttaaacatgccctcagctgcaatggatgtgaaaaaggtggcatgcagtgtgccggaatcacgtaattattttttccaagaaagaagaggcagctgctcctatacccttaagaaaagctgaaactgataacagccagacctttcctagtcatagccggcgcaagaattcaacggcttatcgattaactttaaatccagcatagcggctccattatacaacctttttttttccaatgagaggtttgggttggatcgcttccggcctacccaacgtctaacaaacggtcaagatcgaagcaggcaaactttgatgcactttgtctaaaatcctatcacccataaattatcgggtgctagctagtgagtggtgactggtggtgagtgtgcgctgatatttttgttaagagaacaaaagtgatcttatccttctgcctaacaattgtaacatcacagtcgcatgcccatgatgatcatccccttaagatcttgtccccttgcccatgtatctaagtgggtgtattgtgtacagacctggttatgtaggagtgttggagtcttcagaaaatgtacgaagcatggtgcatgcctgggggtatggaaaggaagtatcaccacatgcgtgcaagcatatataacctacaaaaaaacatatgcaatacatgtgtaagaatactctgcaagttactgtgccattgtccagtctgcctcagctctttttcaaggtgacttacaggatgattatttgagaaaaaagtatctaccttgcaggagcatctgaaggtgctcgtccaagtaccataaactttccaaagtcatggtctttgacaaatctattgattaccattcctttaattttgatgtaccttgaaaaaggaaaccacagggactacaagacgcgcaaacaccaggtcatagtaacctgcatatcaaggcacgtccaaaaaaatgctaagattgagacatcaatacatcataaaaatcttttgttctatttccccccaagtcaaataaaggaagaactatgtgaacttaattagtttgttgagtaatgaaaacagcaattgcttgcatggttactagaaaccccatcctaatctatcagcatggatccaatatcattactgtcaaaacttttttgttctgggagtactaaatcatcgatccattgcatccttagtgttaaaccttttcgtgaatttagtgttaaaccttttgagttgggagttcataagatcaggatatataacacacgtcaaaattttaaattgtgcaaatggtatatggtatgtaactatgtatatgtaatgtatg

SEQ ID NO: 66894 - DNA, 38702 bp, Oryza sativa
  unsure (1)..(38702): unsure at all n locations
agtgcccaggtaacttttttctcttgaaagtcacataaacttttcaataaatctactttacaaagcaaaagagaagaaaagggttaaagatgttttgacattcatactacataggatgagttaggtctagtgaaggttctacccatgagaaggaccgtgcaaaacccaaaaactaaagtaggtgggatattgtggaagcatgcggatatgatgcaaagctcagtatagctttacctaacaccacagcttgagcaactgaaagatggcatatatgatcttaagtaacatcaatgatgtagagtgcaataaccccttctagaacgaggtaggtcaggtccaaaaatacttaagacctttgatattgcatcacaaccggcacctaacaagagaaaggattaaaaagatattataacctctagtgcacccaccaagccactctggtatgataaaagcttgaagatatggtaggctcgatatggattggaagcttctatgaatctttgtcattgcatcacgggtgctacctaacatgcagagaacaagagatagtttttttcatatttgcagaatgacatcatgactgtaacattttgttagtaattaattgtaccactgtccttgtctaactcctattttcagcagactgtcaaaaaaataacaataagaaaatcttagttgttacattactgttgttccactttcaagcaatagcaactaattaatatagtgattcatgtccctctcatgataggcaagagcaatgtaaatattaacaatatgtacgaaatgatatgacctgcacaaaggtgactaagcttgtatggcattattaaaaggaaatgtctatccaaaggttcaggttaggccttttagacaagttatttaaaggagtttccatggtagagcaaaattgtctatgaaataaatgtttgttgcagcagaagcctatttagatgtggttgactttaaatgcataaagcaaaagtgatcagctgctgaaaaatgtaccttgctaggacaatatttctcaaatatttgatgaagataaatactgtacagcagaagcaggaaactcagattctgggagaggttgtgttttctaaagaggtgtgtccaaaagatgctaactgctcaggtcatcctacaaacagacatgagatgataaacctcagagacagaatacccatgacacaagctaaaaatattttgctgcacatggttgaacagttggagcaattgaccagatgttcaaaataagaacttctggatgggctggccaattcatgaaaagaacatagacatggggtccaattcttgttcaagcatttagaagaaagcaagaattaacaaggccagtcatgggccttgggcctgaattccagaccatcatttaagtcacactacaaaaattatgccctccaagaaaatcatgccctagttttcaaggaagacagacaagatggaggaaaagatattgtgatttacagatttccatatttacaccgcttcttgaatctttgtcgttgcatcaccagcttgaggattattacttcacaaatatgattagttccttacttcctttggatgttgttgataatgaccgtgctttgatgctcaaatcatgggttggaaacttatgctttttcctttgaagtatttgggagcccaccttcattttaaatagacttagaaaaaaaagataaccagcctaatgttgataaagttgtgaagagtggctggctggagggtcagaattctatcctatggtgggcaattggttctgattaaatttcttgtttatctacttttctgttcttaaattcattgtttggtctgtgaaggctataatagatttctgatcagaatgggtctgggtaaatgaaaacactcagatgatggttcttgttgattctgctctgaaaatgaatctgtaccaaaaaaaaaattactgcaatgttgctaaaatcctttggacagagatgtcgaacatgttatctcgccaggccggcagaagccggccgaagtttattaagggaagtcagacatgctatctgttttggtaatagtttaaactttgaatgtgttgctataagtggaaacaagatttaacatccttgtggaatatgagaaatgacctactttttttttctgtgttacattgaagaagtatgaagattgtgcagcacaggatgatgctgacattgaggaactggagtctggggaatgttgtgcctagacagctattatggctgatggaccagaatatgtaaagagtgaagaaggggctggtacagaagagattgaagattgagctgtggagcaaggggcagagcttgaagtggaggaactctaccctatgtatgagaagtaatcagaaagcatgtcaggttgtttagatttgtgtgccaaaagcatgcgttgctgtctacaaatctttgtactctgggttagtgtgccgtgaagtcatccatgtgtggaattttgggcctgtactgcttcttcagcttggaactctgtaaatatgttggtctcgttctaatgaagtccagaactgatgcttagccctttggttctaagaattattaggattatccttgtttccttagtgacttacctccctgtattcccttattaacagcatcatgccattgggccaggtatgttttagtatgctcctgagctccataaaaaaaccttaaagttctagtcaaggtcaagtacaatggaaacaagaacagtatcatatccactgggcaatcatctgatctgtgcatgaccatagataaaccactccattatttaagatcgaagtttcaatgcaagcagaaaatttaatggagtgtgccaagaaatagaagattagcatgtaagcttattttcttcttgtgttttatatagacataggcatatccgcatatatcaggattgtcaacatacctgaaccagagtgccttaccactatcgtatcacacagatgcatttgctccagccaacagtaatctcttttatatatgtacttctaatctatctgtggtacgcattgatgcttcatttgagcagtgctgatgtatatccctgcagaactgaaaagcccactgaaaaaaaggaaattttctgcataattagtatttgtattggacaaactaaaatgcataaccattcccttaatcctgaactcaagatacagtgcaactttctagtgacagagcatcagaccataaaatgtgggaagattgtaataatattggtcgttagttatgaactgctaaagtgctaagacaaaccactacctgggtataaatataaatagctattttgttcaagacaaaccactacctgcgtataaatataaatagctattttattcttttcttttacaataaatagccattgtgttgattgttgaccactataaaagacatggcggaaaacttgtattgtcaactaagtatttacaggataaagcaaggatcaacattcacatttcaattggtgaacatcgaccaaatgctcaaccgtgcgaaaccgtatcagcttactatggttgagaccaatatgcaagtcatgttgtctgctacgcaacaatttaggtctgtacctgaggtcatgctatgctctaggcagaaatttacagattcctataataagaacctgaaagccaatttttcagtcacactgaccacccaattgcaaccattgatttcaaattggcaaattggttgcaattgggtggtcagtgtgtgtttgataaattattttactaaaattcatcgaataaatatttcaagtaatatcggtcacatgaagcagaactgtatgatacgtgggcccaaaattatcaaataataaacatgtctaaatatatccaatattggacttgttctgttgcgtattccgaataaaaaaatagtggtgcaaacagatttcaaatttgatgcacagtctaaagttttgaggtattcaaaataaaaagagattgactagtactacgtgtaaattacatttgatctgttggtggcaactacattaaaggtgggacccactgtcattagtagagataatttcctgattatctccagacttcagtaccacgtcgatgggttagctcatctctgcgctctggcttggcttatcacggagattaacgcgtggcgctgaaagtgcattaatccccctagtgggttttggtgattaatgacaaatgtggttaagggactaatgagttcattaagtgactttcaggtgcattagtccaaagtgtggaagatggatgcttggagaccccaaaaagtacaaaatcaaagcggaccggaactcgagaagtgcataggatagtttatcttttgaaatcgagtttttaggaaaaaccgtactattaaaaggggttccaggtgatgctctgagatatatcaagtgctcttagtgtgaaccaagtgtcaagtttccctaggagtcatttttgcaaatactccatttgtccaaaaatgcaagtccggaacttactgtcttccaggtccggaagttccggtcttgtgaaaaagattttcctaagtgtagtccggaagttccggtcttccaggtccggaacttcctgtctagtttccagttcaaatttgtgagtaacggctagatgacgtcacctagccgttatacatatacagctcgtttccagctcgttccttggccattccactttcatttttcaaacctagagctattgctagcctctcccaagtgtttctggccttctccactcaatctagagcctaattcttgtgagaaagagagattgagagggagagaagaagatttggagatgtgtgaagactagatcttgggtgagcacttggaatatctcgtgggctgtcatctcggtgcttattactcttggagatgatctcctagacggttaggtgtcgcccgcgagaatccgttgcatattgtggatgtcccgggtaagtttgtgaaggatttcctctcctccgaaagggaacgaggtaagttagtgaagttcttgtgctgagattctagaggctttccaagtagagcaacccacacttgtggtggatttctagaagtaggttgagttggatcttggtggtcactcaattctagaaatttgcctaggggtgtttggggttgaaggctgtggattttctctggggtttttgcacaagtgaggcaaggggttaatcgagacccagctctttggagctcctcaacggagagtaggatcgcaagatccgaacttcgggaaaaaatcgctcttgtctctttctgtgatgtttcctgtggatgattctgtgatatatcctctgcttagaatacctgtgcaccatcttgtgaagattagcttagtctcttgtttcgaaatttgaatttcatctctgttctgttacccggaagttcctgtcttagaacaccggaagttccgggcctgggaggccggaagttccggagttccttaccaggaagctccgggtctgtttgaattttaccgcttcgatttgtttttaagttttcagggacagcctattcaccccccccccctctatgcttcatcaacgcgttcaggcgctagaaattcggaggcaatttccattgcctctgcctatataagacgtgaaccactaggtgtcgcgggagaggggaggagaccggagaaaattagaaggagaagaagagaagcagggagaggcgcacaaaaacaactcacattgatctatttgctggtggtgttccgaggagattagaaacttctcggtgactcgcctgcagttcgtgagcaagcgcgccacagtgagattaaatatctctcatcgtcgagccgatgtcgcaagtggagatgatggtggtagatggtaagtatgataaataatcctctccaaccctgttggtaaaccagtcgttctaatggattatcggagtacctccttctcatcaattggagcgctttgaaaatcaaatcgcctccattttcttaaagcataaacttggatttgcctaatctgcggattggattatcctcgtattttttataatcaacactcttatttttatggtgcgcatgccgggagcgagccctaaattataaacaaaggaggagtggagataaaaaaaaaaagatatatgctatgttcatgaccgacgaggccaagcaatgcattggctaaagctgaaaaatgctatggctgttatatatgtctatttataggcgaaaccatggccgagtgctgacaaggccaggtcactatactattaacacgtctagtctaaaatgaacgggagccggatacaccgttgctgggcactgacgaggcaaaagcaaccacaaaaaatccatgtttgatgaaggccgagatacatgactgggcaccgatgaggcaaaagtcacccgcttcaccaaatttcctctacacgccgacgtgatggtagtgtactgtgaccgggttttggtgaaacaaagccacccgttacacattcactatattcaccgtaaaatctgcaccaacctcaaccttcagcgagcaaataatnnnnnnnnnnnnnnnnnnnnagcgcagcttaatcggaggtattccataggctcgtcctgtggatgtaattaactggtagcctcattgctaggcgccgggaatcagcgaactgcacgcaatctccagtcagcataccttttcattaagcatttctcgcgaaggcaaaaggcgaactcctgcgggagccctcatgtatttgtaaatattcattaaatacagggtttccctattttctgtgtgttcattgttttgttttcatcaaacagtgtgaatcgctgcagctgatcaaaatcccaaaggactaacactgaaaccaccccttcttggtgaatattacatttttgctgttgtcgccgtgcaaatgctcccccccccccccccccacacagacaagagacgatgcaattgtggctgcggcgtatgccaaactgccaagacggtgctgatcaccgatcagccaaaccaccgagcaggtcgcgggcgtggggaggcaggcaaccaacaacccaacgtaccagagctgacacgacgagaatcaacgacgccgccaatggcgaaccaaaatcgcaatcccggcgccgaatctcctctactctgtggaatgacgcgaacagcagagcagagacaacacccgatggaaactaccacatcatctgcaacggattgctcccccccccccccttcccccatccgcttaaccccacggattgctcccccgatcccgcggcaaaacccctcaaacctcacatcacacgcagcaacaagcaaacaaaccctagatggagtagaaaagctggagagaactaactgtagatgcgttcgcgggagctcaccgattgcggccggcgacggctggtcccgaggaatcctccggtggcacgggtcgctcccgcggtggcggcggtgagctccattgccccccgagagattttgaaatgggagtaaaaatcaagagatcaaatcaaaatgtcctcgaaatttcgaattcttttttttttttttgttgagagatggtgttgtgcacttgtgcgttagcgggaatgcggcggacgacggcgttttggcgctgtgacactggtgcgtggggcccacttgggaagctttcgcatttgcaagggatcgtctcttctttgctaggcccaccactggttttatcgaaatcattaacaggtccttccaggacttggattgaaaaggcgtgaagataagcttgtgatttttaactcttacatatgggttttgcgcttgtgtaattgtgttgcctctagcacctggccacctgctacgagaaaatggccctgctccttttataatttttctcaagatttttaccacggattatttgctcctcacttcttaaaaaatatgatttcttaaaaaaaaaaactttctctccactacagtgattagacaacctattctaaactatttttaagtttagtcttcaaaatattaatcattatattaatcaaataaacaatccgtgacaataatccaagcaaatgtatatgcatctcatgttggtgtcatgattggggatgcgtcacttagatttgtgttgtgttgatagcatgttttagattgttgggttagtagtatattagatcgccaaaagcttggatgtgacataagagttattgcctgtataaactatgcatattagcatgctcataattttggatttcctctcttgtatgtctagcaataagttgttcccttttatttttagtgccccattgctaccaaaagattagttacgctaggtttaattaaaaaaacataaccaatttactaatgaaaggtcattgagatttaaggtaagtgttatatttgctgtgataattcaagtcttgtcctaattttatcaaatggaatcacagtttcacatgcaaattaaaacatgaaagatttgatgaagtcaaaatagcttgtcatgttccgctatagacaaatacatgttttatacttgtcaaaggaaggtcattgacccctttgacaatgacagatgcggcttcatcagagaaaaggcacaaaaagtgacagaaactactgaacgtggaggccactagaggtgacgtggaccattggaagtataaaagaccaccagcggatagtaaagacctttgagagagtttataccacttagatccaacagagtaggcttgtcctatgaggccaagccccacaacaaggcccgtaggacctagaagttggaggcttgcaaaaagacatgtatgcccttgtacatacctatttgtaaggggttgggatataaaattacctatgtaccataccctagccctatacaatactgggtttcaagggaaatgcaatgaacatattttttaagaattaagaagattagggtttgagcgtacatcacatcaagggcattggaacttctctaaggctgtatttggaaccctaagttcccaacccctctacctcgtattccacgtgcacattcaaactgctaaatggtgcatttttttgcaaaaggtttctaaatgaaagttgcttaaaaaaatcattttgatccattttttttaaaaaaactaatacttaattaatcacacaccaatggaccactccgttttccgtgcacactgtgcgtgttgggaacatatgcttccgaatacagcctaagttcttgccctaacaaattgttgcctttgataacactacctttttatttgttatacataggatgatataaattcgtcaatcatacagtaattagcatttacttccccctctcaaatatatgactagcctaaaattgcaccaaaagaaacacaaacaataattaaaaggctagcatatctatcttctccatttctcatactcaaaactagttggtggtctaccctaagccttagattttgttacctagactctcgttgtaatatacagatttatgtctagatgaaaaaacaggtcttttatcctagtatgagaaagttttttttttcttattttctttttcaaaaatatattgtagggtcataaccggatttagttactcgtgatcaatctccacaaaactatatttgttgaaatgagctacataaacacgacatgtttttcacatgcaaaatttagacacttcttagataattcgttcgtgagcataatagcctttgcccacgatttcttgaaataaacacccacttaacacaaactaaacatcttccctagctaaggctaacttatgccttttatcattttgttggtcatgatgtctctataacaagctataattggcctcgaaactaaaccttggtgaggtcagcttttaagcaaatgacccccataggatcatagtctctcatgctatgtactgtagatgacagcaacaaattatatgagcgtgtgctttcaatagaattttagcaaaggttaaggagctgctgctagtctccatctatttgaccttatgttcgggcacatattcccggagcgcgagtatagtgatatatgtgccttcactcttatcttgaaaaaaaaagagacaaaatttaagactttatttaaaaaggatggtcatttataaaatttgaaaagtataaaaaaactacttctgccttactttcactacacgaaacaaatgaaggatcatgctgcatgaaataccacattccacaggcacctcccgcaaaaacaccgaaggtccccgtatgaggaggcagctcgtgctcgggcggcgagactgagacgagacgcgagaccaaaccctcccctccccgaccgcgccccgcccagatctcgccgccgacgagatgcatcgccgcggcggccaccacctccacctcctcctcgccgccgccgtcgtcctcctcctcaccgtcgcggggctgcccctcgcttccgcctccgagtccgaccacaaggtgcgttgtcgcccgctcccccaccccctctctctctctctctctctctctctctctctctctcttccttccttcctttcttccttcccttaaccctagatccgaacccccgacgtgttcctcacgctggatccgccgagtcgccgcgctggatctaggagcggcggcgcggtttcggtagctttgggttccgtggcctctttgctttgggcgagtgctgcgtggttcgaggtgcaaggttgatcttagcaatatgataggaagggctggacagctaggaatacggaagctatgggctggaggattggttcgaaggctgttctaaaggcttgctacttgatgatcttgtttgccatgagagtgaagaaaaaaatcattagtggaaacacatttggtagaaaaaacgtttttggtgctgtagtgcttcgattagcttgttatttgagcagacaagccactgcaattgtattgctgttcaaataatctgtatcatgctaggcctttgaataagattatgacagcagacttttcctgccttagcttcacatcatcaaaattttgaccttttggtggcgcatcaaaatgctgagatgcgaagcatttcatgcttgggatacatgaagcgcacactgttgtgggcttgttacagttgatttattatcctttggcgccttgacggggcagttatccttgtccttgctgcgtcttgaatgttttcattaattcttttttcctattttggcaaagcttcccaatgtcggggagcttactagttgaacgtgtaataatggcatgcaggggtggacctgggaacatacattctgggtcaatgccaatgagcaaaaaaggagctcctgtaacacggtgttcacgaatctcgaaatcccactctcacatgcagccatcgaaagagacaagagaaataactaatatttaatattacctttatggctgttttttaggtccgctattctatttcccttatgctttgttggatttgaaattaagttactagttctagattatatggctatgcaaatcccaaaaagactttttatattggttgaaccattgaagccaaactttgtgaggtgatcctggaatacttatagcaatatttttgtcaggtgttctaatgcattttagcagtcgacgaattttcatgtgatcgaataagacttggttgacattgtggtctctgtacaagaacttttggcacactagatttggataaaattatcattcttagaatcataatggtagaattctgttagataaggtaagtatactctgtagtgtaattacatggctctctagtttgatgtggaaatctgaaactgagtgtgagtctatgtctctctttgattgtgttctgttatgctgcactcatgaactgtgatatgggaaaaatttttttaccgaaagtctatgcttcttctagtaagtattactgttactattctaaaaggaaatttccaaataagcaataacatatggaacttgcatcctggaatccacctaagaggcaaacagagactaaggatgcagttttctagctgaaagctgaaatactgatttctgtcaagtctatgttacatatctacattaaaaaaaactcaggtatctaattatcaatttaaaggatgatttaataatcatctctaaaaatgagaaaattgcatgagaactttggctatagttttttatagaacacatttcatcgtggttgatattgaatgtattgaacagtctaaattcttcgtgaagcatggaagagcctgcaaaataagcaagttaggaacttaggatgaaccttaaggcgttattttcaatttggtcattcttcttaacactatcacaaactggtcatgatctttgttattctctataacttagaaaattgcacttcgtaccagtatacagattcagaagttttgagtgttactgtttaactttattgtcgcttagttgccatttctaaaaactaagcctactgatttgtaatcacactgagaacaacttttgtatgttagtaatcacttcatctacctgttatttaattttatgcagtacaaagctgaagaaacggttaaactctgggtaaacaaggttggcccgtacaataacccgcaagaaacttacaactattacagcctcccattttgtcagccatctgaaaaccccgcacacaaatggggtggtctcggagaggtccttggcggcaatgagctgatcgatagtcaggttgatataaagtttttaagtaagttgatcttttcataccctccttgattttatttacttttggaatgtgcatcaatgtatgttccttgcaactaaccgatttccctgaccattttacattaaacttctttgttttagaaaatgtggagaagggtcccatttgcacaattgaacttgatgacaacaagattcaacaatttactgatgccattgaaaggtcatattggtttgaactcttcataggtatgaatctgcatttaattgggcattgttttcttattttgtatgctatttctcatttctgagtactgacattctttttatccaactttctctgcattgctttctattgtccaaccgcctagatgatcttccattatggggtaacaaattctaaacctaaatgacatttcttttgctttaacactttctaccctctacctctcttgaataacatgcaagttgcctctgagcaggttttgttggtgagactgacaaaaacaacgaaaataagcactacctctacacacacaagaacattgttgttaaatacaatggtaacagggtatgtgctggtctgctttaagaccttaaaatattagctgaaacctattatactggctaattatttttttttgcagataattcatgtcaatcttactcaagagtcacctaagcttcttgaagctggcaaaaaattggacatgacctattcagtgaagtgggtgcaaacaaacgttgcatttgcacgacgttttgaagtttacttggactacccgttctttgaacatcaggtaatctttgttcgaaccaacattactttttatgtcttttgctggacagtttttgtgctataatttactttgctctgtggtggttttgacaaagtggtagactttattttctttaaaactctcgaggaattgaaatttacaagaaaactaagttctgctgcaaccttccatgttcagatccattggttctccatcttcaattcgttcatgatggttattttcttgactggattggtatcaatgatattgatgaggacgctgagaaatgattatgcgaaatatgctcgtgaagatgatgatctggagtcgcttgtaagtactgaacgtgaagcctcacgcttacaatcacttgtgtattccctctggtagcaggagtcattttttgtttactttaatggtctttgagatgtaatcttatttttgaatttcataatggattttacagtgaatctactcatcattttcatgcaagcaatctaatattcaacaaaagtaaactagtcaaacatcaagttttacagtaccctcccgataatgataacttttgtgtgtgtgtgtgtgtgtgtgactggacgaattatttgaatattcatagcaaatcattttgcattattttcatctaatctcttgatagttttgttaacttatatttttcttttatcaggaaagagatgttagtgaggaatctggttggaagcttgtccatggagatgttttccggcctcctcgtagcttggtgtttctttctgcttttgttggtattggcactcagctggcggctcttattctgctcgtgattgtattggccattgttggcatgttatatgttgggtaagctctaaatcagctttcttagtatcctttttttctgcatcgcatgtgcacatgtattaggcatagaatacgcaccctttggattgaaaaatggaaatatgggcaatacgagtggagtctttggtagggcaatatgaaaggccccaagtgacaatacagttgaaggtacttttggagccattaatatgcttgtctggaacatcactaattgcacaaccctaatttctacaaggtgacggatactcgaatagatggacaatgacacaatagtataagcatggtatattttatacctagagatgcctttgaccccattattaattttgatttcaacctcattgctatataatatggcttatttgtttagtccgattacaacctctgttaaaactcatccacgctgccttctggagcagtggtctctttatatcagcgggctcaactctatctaccataagacattggtgaaataagtgtactgctttcattaccatatggaataatgttatagtcagataatatgactatgaatttccaatgtcatttttcctaactaaaatatcatactcaacttgccagacgtagcttaccattacatctgtattgtgtactacactgttttatctttcatttctggattgacaataatcagtaatgtttgttcagctagctagtatttctttgcaccctactaaatgctgtacttcttatttgtcagacgaggagctatcatcacgaccttcatcgtgtgctacgcccttacatctttcatttctggatatgttagtggtggcctctactcaaggaatggcggtatgtttctatatatatagtttttgttgttggacttgcccgttttattctactatcctgaaatagattattcagttttgaaatgtttcaatttctgtgtttcttatctactgttcactgaatccatttctgatccatggcaggcaaaaactggataaagtctatgatccttactgcatccctttttccgttcttgtgcttttcgattggattggtgttgaacaccattgctatcttctaccgttcactggcagccataccatttggcacaatggttgtcatatttgtcctgtgggctttcatctcttttcctttggttctattgggaactgtagttggtagaaattggagtggtgctcccaacaatccctgtcgtgttaagacaattccacgtcctattcctgagaagaagtggtatcttacaccctctgttatctcattgatgggtggactactccccttcggcagcatcttcatcgagatgtactttgtgtttacttcattctggaactacaaggtaaagaaaacatatcagtgaacactaatgtgcttctcattctcacttctcaacaaattattttgctagaacagatggcatttacagtagatgtgtaccaacctaaaactctttttaatttgatggatagatagtaaccctatttctttggtatttggcaggtttattatgtatatggtttcatgctgctggtttttgttatcctcataatagtcaccatatgtgtcactattgtgggtacttatttcttgttgaatgctgagaattaccattggcaatggacatcattcttctccgctgcatctactgccttgtatgtctacctatactcaatatactattatcacgtgaagacaaagatgtctggcttcttccagacaagcttctactttggctacaccttgatgttctgcctcggactaggaattctttgcggtgagcatttaaacttgtattcattgtatttcaaattgccacttggtctgttttgacaccacgtctttggtttaggtgctgttggctatctaggatctactctctttgtgaggagaatctacagaaacatcaaatgcgactaaattgctactctgaacatcaaatgtgaccaaagggctactccgttgccgatagatcctatcagcgaagtgtgtgttgctggcgcaggtccattgtggagtaatgctcataagattctgatcaacttttggaagctatacaggagattgttctccctttgttttaccttttctttttatgtttttcttttacttcatttttcttcttggagctggcctcataaatgtatacctcattagttcaggaattagtctcagtaccgggaagtacatttagattctcattttgtggtggcctcttttggccagtagtaggatatcattgatgaatattggtgcagtgtggatccaatccagtggctagaattgcccctcttatgaatcgctatacatccaattttggcatagccttgtagtatatgcaaactaatacattcaagttagatatatatggcctgaatgggtgaagttctatttcttcccctgcaggtactgttgaaacatgaattcgacatgattattatttagcctttggtctgagttttcatccttgctgaattgtctctgtgtttacagcatcagaaatcaagcgtacactgaaaatagacaaatgtgtcatccacatctgtaatgttttgcttgtttaggtaccttgctttatgatagtatcagcaaatgatttaagataagataaagatatgctgctaaccagatggacatcgtaacgtcgtatatctgcaggtttcattgtacaggtgtacagaatttatatacatattcgagtatataggtatatagacacactggtgttgaagacatcaacttattaagttattatgtttatctctacgcacattgagagcatatcaacgtgtcatatcactggacactggatgaccggccatagtagcactttctagcgatcaagcttagttgacgtttacgaagcaggcacgacgctccaagccactaagctactcccacgtgaccagctcacgtgtcaccatcctgcacgttcacggccccatccacagcacacgtggcacggcctcacgagccacctggacggccgaccagccggccggcgagctttaaaaagcagccccatgtcatttgctgatcgatcaactcatcaacccgtgcagcaatccatccatccatagccgatctcagcttttccattcgcatttctgcttaattagcttagcaagcaacgaattaactgcaagagagagcgatgccgtcgctgacgacggggaggtcgccgtggcggaggaggaagagggggacggcgacgacggcgaggaggaggaggacgccgacgtcgctccgggcgctgtggcgccggatagtgcccaggacgtcgacgacgacggcgccgcgcgtgcgcacgaggaagcccgggctgctgtcgcgcgcgttacgggtgctctcctgcggcggcgggaggaggtcgcgcgccgcacggcggtcgtgatcatgatatcatcgtcgccggcgccggcgaggttaactgctcctctagtcgcttgcgatactacgtggagtacgtgagactagtggtgactgtgccgtgtgtgtataatttactgcagtaacaagtgtgttctgtgttctgctttgctttaccgggagcaattacgtgttgtatgttgtacactactatcttcttgtttaatatgtgtatgttgtactatttcatcaagtgacaactatatgaaaccagtttgttttctctacacaccatgtatgtgtgtcgagttttcgctcgaaaaaaaattgaacttctatgtttttcggtgaaccaatttgagtataatttttaacaccgaggcgaaccctgaaagaattcacgctatattttcgtatctagcaaaagaaatacataaaagaaaagataatagtaggttaaaattaagcaagaataatataatagtgggctaaagtaaggataataataagctataaatttatgtggataagagataaaaaaatatggagtattgtaaagctagctaggagtgttgtagggctagctatacacgtgtatatgtttgaagatattttcattaaatttatagtgcgagtagttaacctattcataagggcgcgagaggaaacagagaagagaaaacctattcatagtggcgcaagagaaaacctattcatagtggcgcgcgaggaaaagagaagagagaaatagggttaataaatggttcgaccgcgaatgctaagtagcgcgcaccagctggtggcggtccctcctcagctggtttcgttctctcttcttttatctctttttctgatttttttttaattttcagcacacgtgtttttaaatattttgcattaaaaatttttaaatcatgatttgaaaattttcaaatattaactaaaaaattttaaatgtgaaattgaaaatatttatatctcaagttgaaagttttaaatctgagttaaaattttccaaaacttgagttgaaaattttaaatttaagttgaaagtttttaaatctgggtcaaaattttttccaaagttgagttaaaagtttttcaaatttgagtgcaaatttaaaggtttttaaaatttaacttaaaaaattaaaattttgagttgaaagttttcaaatctagatttaaatttttgaaaatttgtcttaagatatattttcctttttattattctttagttaaagaaaatatcgcggaaaaaatctcttatcttctaccattattatcttaaactattattatctaatacttcctccatcccaaaatatttaagtcgttgttttttttaaatgttcgaccagcggcgcgtacttgcgaactagcgatcgcgattcgcgcggccactccgttgggggatatgctacagtatcgggccgatgtggggctgtccatcatccaaccgacggtccaactgtccaactgtccagcccataacgatcccgaggcccatggactatctcacttctcacgactcccgatgcctccggcttccacgggttcttcctcgatgccttctccggcgccgtccggtcgctccggcgccgtccgacgacggaatccctcagctccggcggcgccggcacgccggcgccgcaggagctttccggcgcgtgggggaggggagcaattaattaattaattaattaattaatacaagttggcaacagcagaagcacaccacgagcgccccacgtggtcagtggtcggcctcactgactcctcctcacttcgcattgattcgatcactctgctctactctctactactactagcttctgctgcttcttctccgatgcttcgatcccgcgccgacctcgatccgcattaactgcccctcttccgtacggaggagagcgatcgagcgatcgatcgatgctcgccgtcgtcgcgggcggcgggttgaggaggtgtgctagctagcggcggcggcggcggcagtggaggaggatggtggaggaagggaggtcactggcggagacgccgacgtggtcggtggccaccgtcaccacgctcatggtcgccgcctgcttcctcgtcgagcgcggcatctcgcgcttcgccaaggtaaggtatcccaaacacacacactcgcttcgctttccccccggcttgatccgatgcattgcaagtaatcgcacgattgattggcttagagtactacttttctcgatcaccaaatttttctcccttcgcttgcttcatgtgttgtccagtggctgcgcaagacgaagcggaaggccatgctcgccgcgctcgagaagatccgcgaaggttagtatagtaacttagtaaccagccaatcaccaccttcagttgttcatctgcgtaaaagtaattcatgtaattttgcagactctgtaactgtcgtcttgatttagtaatttagtcgttcattcatgtgtgcttcctctagatttgcctgcccatcatagttgccatttcccttaattttatcctcatagtggagcaatgccatatttggaatggtaaaagtcttgcttcttgcaaggtgtttgattgtattcctcaccaagggaaacccatgcctgattgcagagctgatgctgctcggcgtcatctcgctgctgctgagccagacggcccgctggatatcggaaatctgcgtgccgtcgtcgctcttcacgagccgattctacatttgctcggagacagattacgaggatctggtggtaggagggaagcgctctaccatggagatgaaccagactgttgtgcctaatggcctgtttggtattcagtcacagaatgtttgcagtgaggtagtcggtctggttctattccatccaaggatggtcgattggacgttcgaggcatggcactttttggtgattcagctggtgttttctctgcttgcagggtcatgagccttttgtttcatatgaaggccttgaacagctgcatcggttcttgtttatccttggtatcacccatgtgttgtacacttttgtaactgttgttctgtccatgattaaggtaggtgtgttgattatcggtcaaacatcttggcacatgtttgtgtgttaatgcgtttcctttctgtctttgaagatatatagctggaggaaatttgaaacccaagcatgtcagctccctactgagcagttgcaaggttaggccgtcaattaaaccatatgcttgcattagcttggtacagttagtttgctctacctgaataacgttcatatctctcagctaggagaactaaggtgatgcagaggcagtctacctttgtgttccatcacacatctcatccatggagcaaaaataaaatacttatttggatggtaagtactattttcttcacaggcaagctgctgtttgctgcattgattcacattgcactgttttttagcttatcagcatattcaaaagtagaggattgaaaattactgttttcattcactggttgcttcacctagccatttctataaccttgagtgagttttctgttttctctaatttgtgttctacaaactgtgacaatggtgcagctatgctttctgcgtcaatttaggcgttccatcaagaagtcagactatatggcattaagattgggttttatcacagttagaactctgacttctattgattgtttcaattttccgttcagatgcatatttattttgagaaagtgtttaaatgcttttgatttcctacattcctctgcattgtgcttacttgtcaattttctcatcagtaccataagttgccacactcgtataatttccacaaatacatggtacggagcatggaagatgattataatggaagtgttggcatcaggtaaaacatattattttcctctgatgaattaggcattgaaatgagcttattaattccgaacagtgtgttcctgctctttccagtgactatataatatttgttctttttttttttcatttttttgactccctgtactgtataaatgtgtcaaactgcatattgaagccaaattaaccatttgcttgtcatcaagagatgtgatctgtttttaagccacacaacttcttttacattttgttctatgttttgctggcatatttctccatgttcttaacattttgtttgttgagcagttggccactgtgggcatatgcaataatatgcatttttgtcaatattcatggtactctttctctctctgtcagtcacatacacacatacagagtttttgttagcagctttgatcattgtttgatacacttaacccttttttgttatttgaaggtcttaatatatatttctggatatcctttgcccctgctattgtaagtatttcctgtatttcttgacctaacaacaagattaagttaaatgccctcttgtttcttgttatgtcttgtcataattttgtgtattgaatattttgaagctggtcctgctagtgggcactgagctgcagcatgtcattgctcagttggccttagaagttgttggggcaacagcaccatatgttgggacacaactgaagttgcgtgatgatctcttttggtttggaaaacctcgggtcctgtggtggcttatacaattcatttcatttcaggtgatattcttttgcttcactccatatgttatattttttttgaagacactccatatgttatattatgatgtttgtatgaacatcatcttcatcctaaccttactgttgctttcagaatgcttttgagatggcaacgtttgtgtggtctctggtgagaattgcctccttctatttatgattagtcctagatttaatttggttcatagtaacaaatattgcattagggcaagtctataaggagaatgagatggctcctgtattatgtaatattttcttgattagtatgttttcagcatgttaccactaaaacatgaatataactgtaaacttaagctatcaactagatgacttggtagtccacacagaaatgagccagttgtcatcagtcctctcttcctaatgaaaatttcctatggattattagatggatattttcatgtttatcctatagttatttacatagttgccttcatctttttcagttggaactgagtgcgcaatcctgtttcatgaagaaccattacatgattgttctccgtttgacttctgggtgagttttagacatcataggaaggtggcatctaaatacgttttatcattttcattttgagaaaaaagctggcacaaagaagcgaatttcagtatgaactatattagtcgacttgggactcaatgaacttcttccgatctttcaggattctagttcagttctggtgcagctacaacacattgccacttaatgtaatcattactcaggtattctggttattgaaccaacacatctcagagaatcccttgcctaatttctcagaactttttactactaatttcttgaacggaagggggtaaaatcatcttgtcttactgattaagagtcccttagtttgaatagtcttaatcttaccccctccgacacatcctatactagttttgtttttttatgggatggagagagtatctgactatgcagattcactatgtcattcatacatgaaaaattcttatcatatgctgtagaattgggaggatagctttattcacatttccttctctttctttttctttttttgaatctcagatgggatccaagttcaagaaatcactggtctcagagagtgtgagggagtcactccacagctggtgcaagagggtgaaagacaagaacaggcacaacctggcatcgagatccgtctgctccctcgacaccacatacgaggagactgatcatgagactgctacggttggcaccctgtcgagaaccgtgtctgcgacgtccctggacgaggagctgacggtggccaccgtcgaggacaacgacgacgacgaggagatgtctcgcatcgagcaagagattgatcgatcgttgtagctctcgtgaacttgtttgttaatcctcgttcacagaactacacctgtgcagaatgactgaagaggattctggtagagcacacgacacgctaacaatgacaaaatcgaagcccatctcgtggagttgtaaaatatagcaaactacagaattcgtaagatcgaattataagacatgttcagttgatgtaaaatggacatttgccataacttcgatgtgctgtgatctttgcactcgatgaaggtttttacaaagtgattttccggtctgattgcttgacgctaatccaaaaagtgaacggttatgcaaggtaccgttcctcctattgttcaatggcgagtcttttactactcccttcgtttcacaatgtaagtcattctagcatttctcacattcatatggattttaatgaatctagatagatatatatgtctagatttattaatatcgatatgaatgtggaaaatgctagaatgacttgtattgtgaaacggagggagtagtaagcaaaactttgtttctttctcatttcttcatgtaaattgtagtgctaatgagatgctcatctgttggctagaacgagggagtgtgtttcttatttaacttttcgacagtgtgttactggttttatccaggatattgtaatctctaaatgtttatgcaatgaatgagccagcctttgttataaaggaatataaactcatgaggtagccctttctattggaccgaaaaaggcccggcctactaggaatcaagcagcccaaaggaataagacgccaacacgcgtgcggtgcacgcgactgtatccagtttgcggctcaaactccggtaggctaccacccgaagccaagagaggaaccacgaaatttccacgaacaaacaccccaaattccaggcagtaatttttccggaatcaaaaatcgaatggaaaaacaaaaattaaaacaagagaaaaacaaggcgtaggcaaagtggcaaaccacgaatcgaagaagagcttctccttccctttcctcctccattccaaccttccaacccaacaacctcaaccctcctccctcagtatccccccaagaacgcgaggagccgagtccgtactaggcccaggtcatcttttgttgtagaggcgatgcagacggcggcggcggcggcggtggcgtgggcgccgagcccatcgccgtccacctccacctcatcgccgccccccttcaaggttagggttacgcctttttgctgtttgttgtttcagggggggaacccgatttccttggttctgccaagctgacgagttcttgatttggggtttatttacaggtggggatcgcgtcgccgtgtgggacggctgctcacgcctcctccgcgccgaggttggttgctgcggccactcaccgggggcggcggcggcagcagcaaggtgagagcaatttcttggtgtgtgtgtgttcttttcatgcttttcttcattttttgttaccttattgagaacttttggattggtaggggggctattagagctttaggaacatgagtgacagcttttttattgcctgttgtgcccactaatacatggttaattgattcgtatctttaagatgtgtcggggcaatgaattgtaagctacaagcacttacttactgatgaattcagtaatcgctaattagctgcaaacacttacttagtgatgaattcagtatttgctaagtagttatccataggccatagcgcacctcgcgtttagtaccaatccagcatggtttattctaatatgttctccaatctcaatgggattttattatactccagaaccaatttagtgggagcttagttttcatattgtctccagatggtgatgctctagcatacgaacatctcaaatcaattataagcaacaccaggtcggtaagtttggaccaagtaggatgtaggaacaccatctactgttgctataggttagacataggtacagtctagaccttttgcttgctgtactgttttttcaggggtaattaagatgctgggtgaattgggattcagtatgatgctaattctgtttggatgctgctcttgcagtggttaaggctattgccaacccagacccagcagttgagctgccattgacagctgaaaatgttgagattgtattggatgaagttcgaccataccttatggcagacggaggaaatgttgcattgcatgaaattgatgggaatgtggtgaggttgaagctgcaaggagcatgtggatcatgcccagcttcagtaacaacaatgaagatgggtattgagcgacgcttgatggagaaaattcctgaaattgttgctgtcgagcccattgctgatgaggagactggccttgagttgaaccaggagaatattgaaaaggtacttgcttatatttctggctaaataaaattatacgcaaaaggtctcttgtagagtacatcatgtcgaagtagcttaagctttaccgtggctaattgattaacttacataatagaagataaaaattcttctgaaaaatctttttgtgccacactaattactttaatagtgcaattgaaaaggatgttgggaacaataactgtatggcatttgctgatgtcctgctttatagttcatatttaaacaatttgcttctgatttcttgctctctggttctgttttatttaatttctgtattgtgataatcttctttgaaaatagctttgaagatgacaatttcctttgatccctagtcactgtataatgttccatcttttgagtctattttggttgggaaaaaaattgctgtgatggaaactaaactgctggagcatgctaaatttctttttacctttattaggtactcgatgagattaggccatacctttctggcacaggaggtggtgagcttgaattcgttgcgatcgaggaacctatcgtcaaggttaggcttacgggcccagctgctggtgtgatgacagttcgcgttgccctaactcagaagctcagagaaaagatacctaaaatcgcagctgtccagctattgtcgtaagcctgaaaacatttagaaaacaacccctgcaatgtaaatgtgccgctacaataatcgccaggaaagattgtaatgggcttaaagctttgtaacctgttactctattctacttgaactacgaatagtgatcatcaatatgaaatgttgtaagggtgttcctactggatttatttacaaaaggttttgggcttctatgattttgtctgtacaatttgtgaatatcactcttttatttggaagttcgttgaaatagaaaagggcactacaattttaatttcacttgatctcttattgagtatgaggccttcaagtatgggattagtggtagctggtgaggattgtattatcttctgtcaattcataattttggtttactagtgaacaagcacatgcatgaccaatcggaatgaaattcaacatggtagtagctgtaatgaggcatattaatgactgataatttcttctttattgtcacataagcagcacatagaagtcgtccttaccgtatgctgaacagtgacaccatttcagttaggctctgtttagttcgtgaaaagaaaattttttgtgttatatcggacgtttcaccggatgccgaaaggggttttcggacacgaatgaaaaaactaatttcataactcacttggaaaccgcgagacgaatcttttgagcctaattaagccatcattagcacatgtgggttactgtagcactttatagctaatcatggactaattaggtttaaaatattcgtctcgtgatttccatgcaaactgtgcaaatagtttttgtttttatctatatttagtgttttatgcatgtgtcaaaagattcgatataacgttttgggaaaaaaattttgaactaaaccggccttaagtctgacggtgagtttactgggtgtcaatcaccttattaaactaatacatatatcgatagtaaattccgaaattacatgaggcgcctgtggcctaatggataaggcgtctgacttctaatcagacgattgtgggttcgagtcccaccaggcgtgttttgttttttcttcttcttttttttctctacaagatcggagacagatggacggtcagggacaacgagcctattcaatatcagccgtccacgtgtctgatcgttggtcaccaagcacccactggccactcgtctctctatagtgaatagtctatcctcgcatcgcatactcgtgcaacacggcttgcgagcggcggcgcggatggggctctgggagtggccgtgggatcgccggcggcgaggcccgtcgggcttaggccccacctccaccgccgaagaggtcaccgccggcgtagacgccacccacctcaccgccatcgtcacaggcaaccaaccacaccttcccattgcagcagcagaatcctcttgatttggtgatttttatttattgatttggtgatggaaagaagaaaaaaacgaaatgcaggagcgacgaacgggatcgggagggagacggcccgagttctggcgaggaggggggcggaggtgatcatcccggcgaggacgatggagagcggcaacgcggtgaagcagagcatcgcggaggaggtcccggggtccaggctccacgtcatggagatggatctcgcctcgctcgactccgtccgccgcttcgccaccgcgttcgactcctcccacacccacctcaacatcctcatgtatgccacactcactcactcactcacatgattgcagtttgcaaaatgttcagaagatgaacagtttcgtgcaggggaaactcttttggtagctgggatatcagttcatttattgcatgtcaaatactacctccatattttaatgtatgacgccgttcacttttcgaccaacggacaaaaatacagagggagtaaatggttatggaaaaaaaatcaaaacaataagatagattagtacttaatatattatttaaaaaatgcaagtttaaatttgacttttaccggttgttataaaaaataataaatttgactgtaaatatgcatctactagttagagtttagttcgttattttcgttacaatttataaaaatcaaatttaaaattgcgcgtttgtggagtgataaattttatttataactatttagttaacatgtaataaatgggtagacgtctagccgggtgattgaaatccctctcctttggtgcagcacttatctgaaactgaactcccttacaaaagtctttttttcttttgctgtgcttgtctgaagaaacaatgcagggataatggggtgccctttcaagctatccaaggatgggattgagctgcagttcgcaacgaatcatgtcggtgagaatgacgcgtgaacactagttcgttgcaagtttgttacttattttttgagcatatgctgaattttacttacaagtacaggtcatttcttgcttacaaatcttctgctcgacaagatgaaatcgacggctaggaagaccggcgtgcagggcaggatcgtgaacgtatcgtctattgcgcacaagagaagtgatggttcttgctttgatctgaacaagctaaacgataagtctaggtcagcaatgtgttcatttttattgttaccgcgtacattatcacaatgtaagtatctaaaagtattgttcttgtcctgttccgaaatttataggtacaaaccactcattgcatatgcacattccaaattagctaatattcttcatgcaaatgagctagcaaagcgttttcaggtacacatttttttggccttttctcgtttatcttgttcatgatgattgatgactttgatcgttgaagaaagaattagagtttctgagaatgtcgaaaaacccgactagtagtattagcaacaattaagacaaaatgttagtgcaagcacagttgttcagtgcttgtacttgtgtggtagctaacccatttgatttactcttcattttttagtgatgaaataacagtgtggatatatcaccccttgggaaataacaatcttgattccattcaggaagaaggatgtaatttgactgcaaattccctgcatcctggagtgatcctcaccaatatcactcgttatgtcgtcacaaacagtaatgtcaacacaaacctttcttcagttattattacctgttccaacctccaaatcccatatcctctgaatatttcgcaggcgtgatggtttcaatcctttctgtgggaaacctctttctgaagaacacacaacaggtaatcgattccaatcttgttaccactcaacaatccaactgtaaaatcttcagtaactagctagtgtcacaaataagatatattttagctggcatgatgaacttcaatctaattttttacagggagctgcaaccacatgctatctggcactgcatcctgaactgaaggatgtctccggcaaatacttcgcggactgcaaggaagccacgccgaggcctgctgcgagagacgcagagctagcgaagaggctatgggatttcagcgaacagctcgtggatactaatcgtcgtggagaattcaacagacaaaaatgacactgtttagactgtctgaaattctgaacctgaccatgtctcaacctgagatccttcagatacagaattttattttttatttctattttttattttttttcaatggaatgatacagcttatataatatgaccatagagctgtttgtcagtactgttgtttgcatgtgtaaacaaattcaaatgcattaataatcagcctgctttttttgccatttcgtttcagaagaaaataattggtcaacctgtttttcttgaccgttctcgagctccatccatggatatggctaaggctcttccaagaatcgacgaaatggactaaacggagaagaaatgtcgctgccaatgataccaataactctggagtctgtagtacgaattgtctgctcacgtcagtgtcatttttgtccaatcaatcaatctagacacctctgaaaagtgaaaaccggttttccacaggtgatctctgaaaattccaagtgtgagatccttctgaacctgttgaaaaatcatctgatcagaaattcagaatcttcttcgccaaacaaaagcatcttcagacaaaaattcagaacactgcgaccggtgttgtcatgtgtgaagttgtgttacactgtgcgccacacaagtcactgtctcctcccagatggagaacggcaacaaatacttctgcttctgcacaattctgatttctctgaaacttcggctgctgaccagtttgtagttcaggagaacaaggaggaggaggaatggggtttagctggggatggctgtgtggacggcgcaatgggccatcgggcttcggcggggcatccactgccgacgaggtcaccgccggcgtcgacgccagccgcctgacggtcgtcgtcacaggtttgctcggcctgtcgccgtttcatgtctttgacaatgttcttgatttcctttttcccttcattttatcagcgtccgtatatataggactccgggattttgtccaacagtttattggataaatatgagtatgaaacttgaatttagaggtgaatttgtatagtttgtagattcatccggtaagaatgtagtgcagcactggtacacaccattctgaatttctgaaagcatggtgccaattccactcaaggttcagaaaacaattgaaaagaaaacaattcaatgaatcttcgcgctgtctgctgcggatcgttcaaaaaaaaaaaacaactgaaaactagctggtagcccaaacctggtaaactccattctcaatcagcttttgtaccaatagaattctagctgataccacaaattcaaatatctgagagaagaagaaaatcgaaaattcaaataccctgatcctacaaattttcatctttatttcattctttcttccatcatgtgatccatttggtacataccaggtgcaacaaatggcataggaaaggagacagctagggtccttgcactaaggggagcagaggtgatcttaccagcaaggacactggagagtggcatgaaggtgaaacagagccttgcagaggaaatccccagctcaaagctccatgtcatggagatggatcttagctccctcgactccgttcgcagcttcgcaaaatcgttcaactcgtcttataggcatctgaacgtcctcatgtatgtgtgaacagttcggcatcactgactgaattgcaaagtttcagtaatggaaaattgtgttactgaattcactgacaagtcattttttgttctgtgtttctctgaagaaataatgcaggggtaatgtcctgcccttttggactatccaaagatgggattgagcttcaatttgcaacgaatcatgttggtaagtatgttgtatagaagcttggcaacctgagataccgatttcttggagcaaagcgaagagataccggatgaattaatcacttctgaaattttactttgtaaacagggcatttcttgctgacaaatctccttctcgacaagatgaaagccacggctaaagagactggtttgcagggcaggatcataaacgtgtcttctatttcgcatcgaggaagcgatggttcatgctttgatctagataagctgaacgacaagtcgaagttagtaatttgcatttgtgttcttcaggctgactcagtacagcaaattgaaccaacgttcttactattttataaaactaggaaggtagcatgtatcgtaagttgtgttcaagaaatttataagattggaatattaaccagacagtatatgctacgcttcaaatttcaaaaaaagtatttctctacgattgtttttcaacgatattctttgataatttttataagctatttgttagttttatacaacaaaatatttaattcatccctatgagtaattatccatccagttatcgagaaagaaagtagacttatttttgttaataaatcatgtttaataaattaaattcaaattaaaattgaagtgttattaacaaaacaaacattatacactgatgatttgattcatcttcaccttggcaaatcagtattgctgcgacactcgtgatgaccttggtaaatcaccttagctgtcttaggtgtggtggttcatctcggatgttttacttttctctcagaatttcttggatttttctaatttattagagcgccacgttatggcttaggagcatttgtagaaagtttaatagacttttagtactgcctctgtcctagaatgtaacaacctaggataggatgagacccatcctatattctgggacgtaaagagtatatgatagatagatagatagatatagtattatgaaatttactctttttatttatataatgagttgctagctacaaaatagggaggagaaagtgagcaaggagagaggagcgaagatcatatatatgttattaatttaatatttaattactttttatttttcatgtaaaagataggatttttttccaaaagatatattcttgtatatccaaacatggccaatgtagataaataaaatataatataaaaattataatcatttagagaatttacttttatttacatattgaattttgctaggtagaaaattggtagattgaatggaaaatggcaagacaaaaggaagtacaggagaggaagagacgtatgtacgtacgtacgtcaggggagaggaggtctcgtacgtacttgagggccacctgagaggtggtgggttaggggtgggaggagattatggattgggttttaggatattttttaagataagatctaatggtgaagaataatgggtctaccatcttaaatgaaaattaacggtcggatgttttgcttttttcttagaatttcttggatttctctaatttattagagcgccacgtggcggtttggaagtgtttgtaggaagtttaatggatatataatagatatattttcaggtaccgtccgttcaaggcatatggacattccaaattagcgaatattctccatgcaaatgaactatccaggcgttttcaggtctgtaatctcggacatttcaatgattcatgaagaaaagaagcctccagaaaatttatattcattaaagcaaaccttcattaaaagtagtattagaaatgcactttccaacaattttctgcatcttgatttgctgctccagccgaacacaacttggcactcttattatctataactcagggagttcttgttatatttcaggaagaaggatgcaatctgactgcaaattccctgcatcctggagtaatcgccaccaacctccctcgccacatcctgacaaacagtaatgcaatcaaaaactcaacaaaaacttccatcaaccaactgtttgacacaccacaatgctccctctgcaggtctgattatatcaatcttctcagtcatgaaaccttttctgaagagcatacctcaggtaacgatagaaaagcaagcctgactaaacgaacaacagcattctctgcccaaatgatcaatgccaagaaatgatcaatatttcagggagctgcgacgaactgttatctagcattgcatcctggattgaaggacgtgtccggcaaatactttgccgactgcaacgaagctacgccgacggctgttgcaagagatgcagagctagcaaagaagctgtgggagttcagtgaagaacttaccagtggagatcagaagctgaaggagaagtgaaggtagcgacctgaacctgaagtcggcggcgacattggaaggagcgcagtgcgcagagtttggtggactggagctggagggatgcgacgcaatggaagtacgaaaccatgaaagcaatggcatcggttttaggctagactgaatatgtcactgaaaattttgcttgtcctaagtatactattagtatatgtcttgttctaaacttgttcggttgttcctttaggcaagactgaatatgtcttgttctaaactattagctatgtgagtgtgactatgtcatccgatgacgattgtacccctacattcaggggcgaatccacagggtataacactgttctaaactttataatcccattggtgttagctcatgttagcacgtaaagagtgtaatatactactccctccgtttcactatgtaagtcattttagcatttctcacatttatattgatgtcaatgaatgtgagaaatgcaacttacattgtgaaacggaggaagtatatatttgataggtatatgacacccggtatttttgtatttttcgttctagattcgccgccgcctacatttgtattcttttttttttctgacattaggtgtgaggtttgaggctttaagcagtgatatttattgtttttttaagagggcaagcatccttgaggctttaaaaaaaatactgtacataagtttttgggaaggttcatacaatggtatagtataccatagaattaaactagtatactcaccagttctgtagaattaaactttccttcaaaattttagaagttttatgagcctggtcatatgaaaggaagttacgagatatatctattctaagtattaatatgaaaataaactattaatttgtaattttacgcacaaaccttaccactatgagcatcttcaaagactaggccagcaaatccatcctgtagattgacgaagttacaataagcaccatcctagagattgcgatacattgcctaccactaaaagcacaaccatcctagagattgacgatacgttgcctaccactaaaagcacaaagccgttaaatcctggaaaattcgctcccatgaggagtcaaacccaggacctatggtgctactgaggctcttataaccattaggctacaggcattttcgctattaatttgtaattaatattgaataacgctgcgtgagtattattttaagatatgtaatataagtaaaccatcatagtaatcacttgcattatacttccttcaaatatttatatatggcaattttttaaaaaatatttaagattataccttttttttcaattatactttgctattgattcatcataaaatttttttattagatatactttgaaatatagacctattagcataattttttttacactaaataaaagtttgtatcggagtacaatttaaataatcattgctaaaatacactactattttcaaacttgtaaatttcctagcacaagattgtaatcctacttgtgagtaagaataaaaaataataataatacaatgaagaggtctttttctttctctctctctttcttataaaaaaaacttatcatcagttctgttatagagggtccaatgggcctccagtgggtgtaaaaaaaaaaaggccctccagtgggcctggggcatctgacgtgtcaaaaagtgcaacactaaccgcattgttttgtattagtagttaattaccgcgctctctaatacgcctgggaccgggactccgggagagagcaacactaagcactgggcactaagaacatggattaagcgcaagtaatcctgtaattaagctaagctagttaattaagcaatttggattctacgaagcagcggcgcggccaaaatcccccaaatcctctcggagcccgaggtcgcttggagtcggcgcggcggcgcacgcaatgcccgccctgcagcctccaccggcgtcgtctccggggcgggagcgggagcggggcgacgcggctgcttcctccgccggtgggcgccgccgctctcgctcgccgccttggagccctcgcgcgcggtccccgtccctctcgcggtcgccgccctcgtcgtcgtcgtcgtcctccgaggatgaacggtttgtgtgtgctgtctccgctgctcgctccattccttcctcccctcctcttcgccgatcctcgtatcgatcgtcttggggttttggtgggggtttcgtgcgggttttggttgggatttcgtgcacatcgtgctattgattctccattttttttaaccctgcagtgagaattgcgagacccaaactgaaactgcatggatggaattgggattctcaaattcagggcctcgaggtgtaactgagatcacttatcttctgaggtcccacgagctcaagatcagtgagttggagtcaaaagagcagatttactgcaacagcctggttcaactcgaagagagaatcgcatcactagaatattacaaggtctcttcttgtgttcagcaagaggatttctgaaacctagtttcatattgtacttttgtttcttatacatgagcatgagaaaaaacatattgcaggagaaattgcttacaagactttcatggacagaagaggccaattcgactttgagatctgacaattccaaattgaagaatttggcatacagtcttaaggaaagggtggacgagttagaaaaagacaacttcatgctagggctgaagatgaatgagtttgctcaagagatggaacgatttcagatgcaggtaagctagcgttgtagcttatgcttttatagttactagtaatcagttgcacgtattgataaatatgaactaattaaaccacttaaaaaaatgcccatatttaacatttaccttttcacatgcacagttagcagctatgactatcaatctgtagcttcaaggaacgcataatacatagacagtggagaaaccagaaaattgagaaccataggatatccttgaagagaaatctgtcagccttgcggtgatctttcctttgctatataagagtagcaatgtaccttagaaatctgtcagcattgtgctgatctttccattgctgtataagagtagcagtgtaccttagaaatctgccaatgaaaaaagtgaaaattatatgggagctgtatctctattatcaatttatcataaatttataagataccgttgtaacaatattattttgacaatatggtgcatctccaaggtgaacaaacgcaggtcctgttaagtactttgaaaactgagggctgatcatcttcagaaaattgcttctgcttaagaaaaaaaaggctgattatatgcaagttctttgattggggcactaatgcatgcatattgaaggggttttccgagaatcaaattgtaaacaaataaattgtggatttgaaaccacaaacatgatctcgtggaaattttgttagggataggccgcagattgaagtcgcactggtgatgtcacgtttctgttgccggtgacctcctaaagctgcatccaaattctagagctgcaatggtgtagttgtagcacacaagcaagaacctaaccctaggatccagaattcttattgactactgcatgtgacaatatcaaattcattatgtcatgaatctagaaaaaaaagaagaaagggtggttaattggatctcctcacaacctgacaatatataattagttcatagcttaggtttccctggtgagtataacagtgaatagcaaaaacatctatgaattttcttcattaactaagttattgattgtacacatagaatatttaggacatctgttcatgtagataaaagcaaaggaaagagtgacatcgccaatgtcacaatgagaaaaggctggaaataaaattcatatatgcgataccataggagctggaatgcacggggatttgaatcaatcgcaagatatctgaactgtgatcttcgaaattcagagcaaatgaattgtgcgagtcctgatggctgatacctctaattgccatacttttcagtccaggacagagcatttatggctagatgaagggcaaggatgtaatgctaatatgttatgtatcacttttatcttgttgttcccatgaaaatgcacttgctacttggctacttgcaacaaaaaatgtacttacaagttcagccatcaacccattgttagggtttgggtcacttagcagcaaaccaatgcttgtcaaaacagtagcaattttgagcaacggttgccaggcaccatgcacattagtacttgtacaatataacataaactaatgctggatatttatggttatttgttgaatacttgaatatgctgat

SEQ ID NO: 66895 - DNA, 763 bp, Oryza sativa
gcggttgtgatagcatgttggcattgtcctttatgaggtgatgtcgttgaggaggtcaaaacaagtggtgataggccttggtgacagcagcaattaacaagctagtgtgtcataagacatttcatttttatctcttgttggatatgctgatccttattttcttggcaggtaaaatcaaacaccagtcaactggaaaccaataataatgatcatcattcgcttgagaataggattcaagttttggaatcaacagaaaggcagaacgcttctagattggtgaaaatggaggagtctattatccatcagcatgaaagaaccataggagtagagcaagacttgagtgcaaatataactcaacatggtcagcaaattcaaacgctccagaacaaagtaagtaaattctgtttattatgcctaacattttgccctgtataatttttagaaattccttactgtataaaatgtgggccttggggcttgcaaatgtggtagtaacagggggcggacccaggggtgtgctgggtggggtcacagaaaatttctaggatcagttatgcagtccatatccttacagctgtaagaacaggtgtaagcaccgtggaaagctcattagatcattaattcaccatacgcctgtgtgcaaacattaagcacacgcaaatagcacatcaatgcagcactgtcatgacccaataagagctctagtgtcccatgggggagtagcaccgttgtgtgcttgtcagcctgtggcacctaggaggct

SEQ ID NO: 66896 - DNA, 6264 bp, Oryza sativa
  unsure (1)..(6264): unsure at all n locations
tcattattcggcatattttaatccaagaaattgaaacaatgatcatggcataagcagtgtagggtgatcttaacgtaaccagtagcatactatgcgcatcatgaatgtcagaaacatgaacataccagtaacgcgataacatgctagaggcatcatgtagaacaggaacaagaacatagcgcacatagtatagcgctaacaatgggaacaggaatagcgctaacagcagtagcaggaggagaagattataccccgagaatggccctccgctggatggtgaggcagaattgcctccgttgttgtagtcgttcacggcacctcctcctggcgcagcagctccggatctagatccagctcctgtcggtggcggcgtaccacctccgccagcagtggcggcagcaactccagacatggcgatgagcagtcgtgcgggaggcactccccaaaaacatgatcacccgcctacccggtgcagatctcaggcgaaggtgtggtttcggaggcactgctccttccaatctctcgtgcgcgcaagagatcagaagcggggaagcgagagcaactcaggcacggagaaggagaaactaacaccgggggagaagcgaagaagtcggatcggactcgcggcctccttatctatcaggagaaagaacgtggacgcgctgttgcggagggaatcgtgggaacgtgggttagtggctgcaaaaggatagtgacgtgacgcctcgcctcgcccacgcccacgcccacgcccacggcccggcgcgcgcgcgcgcgtgtggcattccgacccccacctcaactggtcaacagggagcctccaataactccctatttaggttgagatatttctcgcttaaatccagaggtggtattattatcctcaacatttattatgggcctttgagatttaatattataagttgggcctagcccaattattctaacaaaaacaagtggtgataggccttggtgatagcaacaacaagctagtgtgtcataaactgtactataagacctttcacttttttatctcttgctggatatgctgatccttattttcttggcaggtacaactgcaaaccaataatatgaagctcatttgcttgagaataggattcaagttttggaatcagcagaacggcagaacgcttctagattggtgaaaatggaagattctattatccatcagcatgaaagaatcataggagtagagcaagacatgagtgcaaatataactcaacatggtcagcaagttcaaacgctccagaacaaagtaagtaaattctgtttattatgcagataattttgcattatattcttttagaaattcactatattataaaattacatctcttgactgtcaatattgaaaataatcctttattttcgccaatctaaaaaataattatgtttttctcttaatttaactttgtagtggtaaaggataaatacatgttatttttataagtcaagaaaaaataataatttacactcttaattaaatttcaggaaaatgatgttcttatgaagtcttttcagtcgctgctcacttgtatggtaccatttattgttgcgtttctgctatcaatgcttagcagccaatctgatttcggtgaatatgagaaggatcttgtgattcaagtttcgttggtgtgtggattacctggcgtaatggctatggtctttgctcacttagcaagtggaccattttggacttctatcgtagcaagcttgacattatactttgtcatttatagcatcacattagtgtattatgcattcataagacttctaccatggagtccatggacaagattgcagttttatgctactgtcattcttcttgcaatattcctgatcgtggtccttaccatgctgattgtttgggggagttttgttaaaaaaccaaaggtacaactattgctggtgttctataatctattcaaatttatatgttatactaattatatgtttaattttcaacaatagttcacgcgttggattgcaagttacttttcatgttgtccagggcctgaatgatagatgtctattacaggaggtatgtacctctcaaacacaattagaagtctccaccctatatgcttaacatcgttaaatattatttatggctgtaggtaaacaagtgactactctggtgccttgcaaagtttatcattgaagacaagttgccaatgaagattcagaagcttgattgtgtcacatttgttgtacagatgttactactatgtctagaagttttacatacttaggataacgttgaagaacttttgctcatagctaatagaaagcgagagatatgctaacttggataaagtctagatatttctactgccttcaattccttttttttaatcaaccgtaaacgaagttatgcatggttaggaaatacttcacattattttttttttaaaaaaaacttatttcacagaattaaaacactgaagaaatttctcttttattagagaacttgagatgctaatatggatgatgctatgtttaaaagggaaataataccaagacaacgaagaagtaaaatataacatttccattgttttggtataatgtaacatttcgcttgtatatatggaatgtaaagattaatgtttgcacttagcagatgcgatgatatttttactccttggtgcgtgcgaatttcctataatagaactatccttcccaatgagtattgacatggatttattctatacctattaaaatttttagttaatccctttcttattgggattaactgaacaatctacttacctgaacctgggatttcagtaattcataacccatcaacaaaccagcgtcgttggatctccaatcccttttgcataaggattaaccgaacaatccccttactagagggtaggatttcagcaattaatcaacccaccaacaaccagcgtagttaatctccaatccctttatactcttttttatctcactatacaagacgtgcatgcattcactaccatagaacacctgataggcgtcggttgggaaacccccttagcccttattcggttaatcccatgagtgagggattgaaggggatttattctacacctattgcggtgtggagttattccccccaatcccctccaaaccgaacaaagccttagttgccgactttcctaactggtgccacggaggcggcaccgatgactcgagtgattggtgtcggtttcaaaaccgacacctttgagacgtacgcgagccaaaagaaaaaggctcgatacaccgagtgcatccaccccgcgttgccccgaaatctcaatccacaacatcatagaactccacatcacatatctataaacattgcagaacaagaccgacacggaaggagagaaggttgactccaccactgcttaccgtcgctgtacgccagatccgccgcgggaaaagccgacgccgccgccaccgtcggatccgccgactcctctattgctggcgagtgagaagagagggggaggggacgggggcgagagggagtgagagggagagagngnngagngngnaggnggggnggagggggggcgtccttatctacgcagtattttatctcgatgcccgccccgtgcgctaaaagaaaaaaaatggctctaagctcggctcagtttgttttatagggtgtcgttttttttaaaaaaacccagcacctataatatattatggatgttggtttttaattaactgacacctataatacgtcaaagatactgattttttttaaaacccggcacatatagtaaaggtgtatgtttttctctagaaccgatacctatagtatattcaaggtgtcttttttcttattttcagcctgtggaggtgggaataacactataggtgccggttttagctgttccggcacctttagtgccgacttgtattaggggttatggggtagtgattttaagatttaacatttaaaacatttgactaaaaaatataatataaattaaattttatttgctgaaaataatatcattgaattgatatttgaatttaatttacactagcaaaagtgccggtgcattgcaacgggaagtgtaaagacaagaaaattaaggaaaagttgaaatagatttacattatgtaattaattgaaatacaaatttccttaaaaatttggatattttttaagttggtaagtgtataattaaattatacaaacttgtataattaaattataattacactctttggaattttattgaaattttcagagcttaattgctaattttgataatacaaacatagttttagcatttattcttcagcctttttttttgacgggaaacagaaggagagactcctactgtgctatattataataataaataatttacaggggtatgtacaaatttacaagggaaaattaaagaaagttgtcaatccatgattgccagtttggaagatatgttacttttgctctgtacatatgcagggcaaattcttgatgaaagtcatgtttccacttgtcaaagctgtaggcgatgtttttgaatatttgttcatttcttctgttccaaatgtgtcagcatccaaatgctagaacttcaaagaaaaagctatgaggaaactggttgtgtgctgaggtgatcatgttcatgatgtctgactgcaagttccaatggattccaattttttgccaacattgttgagcagtcgggcatttgaaaaataagtgtatcatatcttcagtgaggctggcattacacatgacgcactgtatcccccctgaatgttaaaatttttcttctggagcatctccttagtgttaagtctgttcataagcaaaagccagaggaacacctttaatttcattacacacttgcttttccatatcaaagtaagaggtcgttcatgttgcagatggacaaagaacattttataaactttgttggcatgaaatcgatcagaattccagggtaagtccatttatccatattactgccattgtataagttctgcagtctgtctgtgagagtttcccattcctgcgttgcttggcttgaaagaggtatgtgaaagttttgactgagctctgatgcttgtaagaaactttgaatcgtggaatcttcgttccttgcaaaggaaaatagaatgggaaattcggattccagataactgtcagtccatttatctttccaaaacagagcagtatccccttgccccagggtgcattgagcgaacgctctaaagaagggaatcaatctgaagatatctttccaccaaaaagatcctttttccttgtgagcctgaggtggtttgtctgaattagaataatgtttgttccaaattaactgtacccaaggcaggttctttttgttaaaaaaatttgtccaaatgcttgagaagaagagctatgtactgaaactccagattgattactcccataccccctttcttttttggcctacagactagatcccaagctgccagggagtgagtttttgtttccatattagaattttttctccataaacaatgtcttctggctcgatcgatgtgttggataaccttttttggcaatttcagagtgcacatgtaataggttggaagtgatgagaactgaattaaccattgtaagtctttgtccatagtttaagtgaattgctatagatgggagtcttctttgtccatagtttcaattcttcagcctgcgaattgaaatttcccgttcgttctcttctgggtaaccgaagttgaagtgctatttgatgcggactctgtatgatttgttgtgtgttggactgcggatgttgcggacaaaaataggtgaggacgggcaaaaatttcactggaagattaggtataggtatatagaatgttagattagaggtagataacgtataaacgatgaaaccaaatagaaatcgaaattttttcgttcttttttttattttagacggaagatggaaacattttcaattttttgaagtatataagtagagatagagattagccattttcgttttcttagagagtactatcacgaaaaacgtggtagtttattaatctataattaattaagtattagtaaaaaatagattaatatgttttctaaaacaactttcgtatagataatttttgcgaaaaatgcgccttttagtagtcttagaaggaaacaacagccttaagggacctaaactgaacttattccgtgtggagcatacacgcggcccaagaggcggcatgggaatcgcggcccgacgcaggagcagccacagc

SEQ ID NO: 66897 - DNA, 22495 bp, Oryza sativa
tcccccaccggcggcggggccgttcccctttcccctctccctcccacggtgccgggcagggacagcgccctcccccccgccggatccagtgggaggggaggcagcggcggcccggtgtccctgcgacgacggtggcatcctcctcttccggcgtcggtgtttttatgcttttatgcttgtgatgttcttgtgttatagttgttgttgatgaaatatgttcttgtgatcttgtagtagtgttcttgtgatcttgtagtagtgttttctctaggattttgtgatgattctgatttgtatttggattgagattgagattttgttttttgggttggatgtgggatttggagaggaggtgcgcgtgaggttacagacggacgaaaaatagcagtacggatgaaaaagcggtgtgacaattggaaaaatacgtacgaatcttttaattatttatatggttataattttttactataaatcttaaaatatatgagaaattataatctatagattagttttggagaccgtactgagtttgatcgtgccttatattatagttaactagaaaaactgcccgtgcgttgcaacgggtaaagacgctgagcaataaattgaaatattgggatctctatacattataatttaaaaagttaatgaaaatcttgatattgggatggctatagattataattaaaaaagttaatgaaaatatttcctgagttttgggccgaaagccatccttccttttcagccctaggccagtccactacctcccttcgtttggcctgccagtctgctacctccctgtttgggctgcttgcttcaaggcttcaatccagccatgactgaagtcgtttcagttctaggctagtttgctacctccctcagtttggtctgcttccttcgacctatcaaatcccaaatctttctcgattacccaaaattggttgatggtttttatccactcgatcttctctttccgttttcccaaaatcagagcataaaacttgggataaaagcgatccgggaagatcgccgtcatcatcgacaactgttagattaaatccggccaaataaagccgggaaaatcatggaaaaaatagcgagggaggagtgggaattgatttttttaatccagttggagtagaaaacacacaatcaatatgcaccggcgcggcgctagagttcaactcgggagacgtgtagcaagtagatatgattaaaaaaccggatgagaaaaaccaaaagcgcacgggagaaaaaacatgtgacaaaaaaattgacaaaaaccaaaagcgctcgggaggcgcgcggtgaatagattggatttaaaaagccggataaaaaaataatagcgcttgtgaaaaaaaaactctttcgcgtgaaaaaaaagtcgaaaaaataccggtgccaaaaaaccaacggatttttttttactggccagacttttttttccctttctttacttgagtcggacaattttttttacgatgagatttttttttcttgtttttaccgacgacaccagcttttttttatagtttttgagtcggacttttttttttacctttttagtcggacttttttttttacctttttagtgggactctttttcttttttttttactatagaaatttcttgttctttttaagtagagatagagatagagattaaaatcgaaacatcaaattaaacctactgaaacacggatgacgtaccaaagtaccagaaaaacatctttaatttttataatagtagagataaagggagtacaattaaccatacaatctgttagaatatatggataaaatcgtattgtattatcataggatatgattagtttccatctctatctctctgagtttacttagatctaatccatgtactcctatatatatcggtccctaatggcatgtttaatagtaaagacaagtatggtctcttaaacaataaattttatttagagaccgtatctttacaatagttgaaacgataaaggctctaatcattaactcaaaataatttcttttgttaatattcttttcatttttttaccctcatacaaccatatttccatattatagtgactaagagtcgttgttaagccgttgttatgcataacaacgatgttttgtctctcctctttatctttcttccatgtcaataagcattcctaattagcaacgctaagatatcactattgacaatcattgtacatgccctgaggctcaatacagtgtatcatattcgcagtatttctcccctcatctgctatccaacacaatccccttatctctgtacgataggatttcatcaattaatcaacacatccacaaccagcgtcgtcgtcgaacacaactcagttgagtttttatgtcccgaaaatataatcgtgacgagtccgatcgaactcggacgcacactccaatacgagttgcaaacaccaaacttgcataatcggacgtacgctagctcaaaccgtttcgtacatgctcaataattaataataataatacctgaacgctccgacctcgatttgatctctctctctatataatagacacacacacacacatatatgcgcgcacgacgaacgttaaagtggacgtgagatatatatacatacaattgaaccctaacaaaaagtagcaaatcaatcaatttaagcgcaggcgatcgatggaatcaagccgccatacgtgcgctttctttagtggcgctcaaccgggcttctgttcgcggttttgcagatctgcggtgagcaccctatattttgcattggtaaatcaaaaccttgcggattcgctccttgatatcgtgactcctttttttttctcttcggatttgctagtgtaaaaattaggcggcaaaatatttacaaatttccgaccatttatctggattgatgggctgtttatatagcaataaaagtgggataaaatctggattgttaaattagtaaacaatttacaaaatttaggttgttcggttcgtagcaataggttgccacgctgaatatatattgggcttgggcgtgccatagtttgttagacaagcttttgattggttgacgtcatatactcagtttgtgctaaggtttaccatacatgtagctaataatttattgcctgcactttgtgtgagcttccacttgcttggtaagttaatatgtggtgaagttagtcaacatgcttaccttctatcttattcttattctagtacctctcttttttaatatatgatgccgttagtttttctacatcatatttaactattcgtctcgttcaaagaatttaagtaaatattttttcttttgttgtggcttgacttatatcactaaattaagaaactttaagcattacttatattgctaagattaatataaagttattttgaatggtcacacgttataacaaaagccaatactattatatatacattagaaaatgaagggagtactaattttcttatatacacaaacttcatatatagatcctcacttttttaataccacttttgctatcgtttggttaattattgcttatctatcaactaatgaattgaagtttatacttcctatgtcccacaatataagggattttgagtttttgtttgtaacatttgatcactcgtcttatttaaaatttttttacaaatataaaagacgaaaagttgtacttaaactactgtagataataaagtaagtcacaaataaaataaataataattttaaaaaaatctcttatattatgagacggagggagtatttcttatttttcaactaattaattaaactaattcattgctttttgatgatttgggggtgattttgtttgttgcatgcagtgcatcacgggggccgtgttgggcacggcattcgtcgcctcgacgatcgttgcgttggtggtgtacggggggggccttccggcgtcgtgtcggcgttcttcatactaacttcaatcggcattattgcgtcgacttgttacggcatctgctaccatccgccggaagattgttaatttaatttggccatacttcctccgtcccacgatacaagggattttaagttttacttgcaacgtttgaccactcgtcttattcaaaatttttttgcaaatataaaaaacaaaaagttgtgcttaaagtactgtagataataaactaagtcacaaataaaataaataataatttcaaaatttttcgaataagacgagtggtcaaacttgcaagcgaaaactcaaaatcccttatattatgagacggagggagtatattatacctacatgtgtattacatatatatatatatatagtgaatctattctacaccccctcccatgggtcaaactcacctcccccaccctccctagggcccaaaatccccctcccacctcggtcaaagcgtcctcccgccggtcaaacccgcccaccactcccacccccacccaccactttgctgctctcgtcttgcaagaatcgtgtagtaacaggacggttatcgtgcagtaacaagaaaacattatcgcagtaacaacgtcaaaaagtagccatgatggatcttgtttcgttaagcgtttttttatgaacttcatggtgcaaatggattggaaatacaagatatgatgtgagagatattactctctaaagattgagatttacctcttttttagttctcgtctcactgaaacagcgtagtaacatgatggccaatatgcagtaacatctctgcttttcgcagtaacaacgttaaaaaatagttatgatggttctagtttcgttaagcacttttttttacgaacgccatgatgcaaatgtgttagaaaaataagacataatgtgtacgttagtactctctaaagattgagatttaaaatactctagatctaaaaacattactactatagggccactgttactatgcatgttctctgttactgcaaatttcgtcatattgttactgccaaaagtgcagtaacaacctataaagtttacagtaacaacctatacatttttgcagtaacatatgatgttactactcttctgggataatgttactgccgaatcataataataaggtatgattgttataggtacataactgatttgttcacaaattagaagtgcttgccattaactatgagattatgggttcaagtcttgaatttaccaatttatttttaattttttctaaaaaagagagaagaaggagggagagagaaaaaaaaggggaatcggagggagagaggagcgacaggcgggacggggatgggaggtggaagggggtgtagaatagttattctaagggaggggtgtataatagagctaatatatatatatatatatatatatatatatatatatatatatatatatatatatatatatatatatatatatattctttactattaaaaaattgaagatatttttgtctagtactttggtacatcattcgtgtttaagtcgatctttaattttaattttatgttatctccactacttcaatttccattgtctgttaaaaaaaataagtccgactcaaagaggtaaaaaaaagtccgactcaaaagccataaaaaaatatctgtcgtcactcgtcagtatcgtccgacttaaaaggaaaaaaaaaaggtctggccagttaaaaaagaaaaaaattccgtttggatttttggcacgggttttttttcccatctttttgcacgtgaaagagttttttacgtgcacgcgtttaggctcttgttttttcgtccgtttttttaatccgatcgcgcctctgggtgcttttgttttttttcgtcaattttttttatcgccgttttttttttctcctgtgtggttttggtttttctgtttttaatccgattgttcgctgcacgccttctgagttgaaccctgacgctgcgccgccaccgtaccgattgtgcgttttctcctccaatttgattaaaaaaacttccccactactctctcatcattttcttcattattttccttttcgattcggctttaattcgtcaaatttaatctacgtttaacaattgccgatgatgacggcgatcttccccggttgtttttatcccgagctgattttggaaaaaaacggaaatagaagattgagaaccaattttgggtgatcgagaaagattcggctggatttgatggggaacaaagagttttacactctgattttggaaaaaacagaaagagaagatcgagtggataaaaactctcaaccaattttgggtgaacgagaaagattcgaccagatttgatggtgagatttgctcctctggggagatttacttcgacaacggtacggccacgggactatcttcgggaggttgaagatagtagtagactctgcgagctgtgcttacggctctacttgtggctgggtcgaagggaagcaggccaaacggagggagacaacagtctgaccgaagatggtagtagactgtgtgaactgcggttatggctcaacttgtggctgggttgaagtgaagcaggccaaacggagggaggtagctggcctagggctaaaaaggaaggaggctatcgaccctaaacccaggaaagattttcattaacttttttaattataatctatagcgatccctgtcgacgtttgatgtcgcgattccggtatttgcatagtatggggatcgttggtactaggatatatgcgagattgtaataaaagaaatggggacgaggatttttatacaggttcgggcccctgaattgtctggtaataaccctactcctattggccgaagccggtcgttgctcttattcaccataatcacaccagtacaatatttggggtagcctatctaactgttgtcgacttaaggtctgaagtgctgactcgtagtcgacaacaggatagccttcctcctcgaatccgcatctggcgagatcaaagacaacgctatgtctctcctgacagtatccgtagacaccgtagggcactagccatgtttatctctgaagtcgatatctagtgtcttgtcttggcacatgttggcttatatgttgatcttatgtcttgatctattgtttcgtgtcccctctcctcctcctatggggccttgtatttatatccataggtgtccccttgtccaagtagaactagggaaattaatatggatacaatccaagtagtctttgtcatttctatgtagaactctattcatccttccttatgcagaactcctcctatatccgaaggttgttttcgtataagacatggtatgtggtggatcctgccgagatttagtcgactactattaggtatgtggtatctataacactgacaatcccaatgttaggattcccatcaactttttcaattataatgtatatagcgattccaatattttaatttattgcttaactcttaatatattagtgaaaaaatgtctttacccgtgcaacgcacgggtattttttatagtatatatatatatatagttagttcttcctcttgctatatttttcaatgttgatgttgaagcagatatattattgctgattttttctgttgataataaaaatttggtggtaatattgttgatggtgatgagtgaactaactcactgaggatgtgtggagaaatttccccctactctgaaatataccctgtaccctgaaatataccccgtaccgtagtgaactaatgccaactttgtggtgggctggtggcacgtccggatttcttcttctttttgaagtggtgaatctaattaacaaatttaagtaatgcatattttcatggttgtttatgggatgattattagcaaatttaaatatataattttccaactagttgccaaatttcactttggtaagtaattaaaaaagaaggctttctctgaactggcaccatgcatgcctatctaaacgcgcacatgtgcaatattcggaattagttatgacgtggtcactgatatatgagcctatgagtgtgatgggttctacatgtcaatgaccatgttttctcttaactttacatcggaggatctcaatgtgtaatcttgacggttaatgcactagtttaacagcaacatatagagtggactctccactaaaatgaaatgcaatggagtatgtaaactgttcatgtctatcttctttacacatgacacacacaaacagccaccagtctgatgtaatcgatcgaactgggctctctcatcctcaccacgcaacaaaacgcaaaaattaaagctgctaattcctttaatttctcctagctaataaatccttcacaactttaacttgatcaaatcaacaatggcgacatgatgatcagaagaaccagctgccactggccgcctccacctcctcctgctgcctcgctccggcggcgagcctgatccggttgccgccgccgcgagcgaaggagaaagacgacgacgccgaccgccgcagcccaccgcccggctcgccgtccgacctgaagctgccggaggagctcgagccgccggagccggacgaatacccgccgccgccgcgtttcttgctgctgcctttcctccggagcaacgggagcaggaagcacccgtacgccggcgccgccgcgggctcgtcgtgatcagcttcgtgggcggcgccgtacaagtccggcgccgtggtggctcggggagcgaggtcgaggaaggcggtggggcgggggcggtactcgctgccgccgccggcgtacctgctccggcacggcgaggccgacgccgccgacctgcacgcggcggcggaggagaggcgcggggagtggtagtacggcgacggcgaggcgcgcggcgacgtcatgcagggaggcagcgccagctgctgcctcgtcgccaccttggccagcgccggcggcaccggcgacaccaccgccgccgacgccgcggaggcgctcgcgctcctggcgtgcttgggcgtccccgggcagatctcccacttgaacggtatcgcccccgccctcctgaacgagtcatccattgccgccgccgccatctctacggagattacagcttcgatcctctcgatctcttcttgatttctctcttgatctttcaattcaaatgcaaatgagctgagcacgatgatcgccatggctcacaactgctgcttttataggaggacacaaggctgtcttcgttaacgtgggttgggaactaattcttcacgcgcataaaacaagcaatagattaacacattattaattaaataatcccttcataacaattagtataatatgaattgaatttatttgtttaaaataatatcattggattgccatttgaatttagtttcatatggttataattttgttactataaatcttgtgctatataagaaactataagtcaaagagtatcgagtttgaccatatcttaaattatgagatagagggagtgttaacttttaaaacttaaaaattaatcaatataattttaaaacaacttttatatacctatatttttttaaaataacagcatttaccgattaacacagaaaataagagattagaaaaactgatacatttcaactcagtccaaaaagctgtgattcaggagtgattggaggagatagtggcaacttatctaaactttttttgtttagtggttggagagattgcacacactactggccggccgtttaccactgagcacacacacaaacatgcatgcgcggcgcccatgttcatcttgacttggtgcctctgaacaagacaaaacggcgacgaaattcaggttaattttttctatggagggtttcagtagtgggtcggcgaattcagatagatttcagttcggcgcatttttggggggacgtcgctgtcaggtttgaccgtaccgcacgtcgatgatggcgggaggagcactactttctccggtgattgggtcggcggccgatttgatccttttggtcgtgggctcgtcagatcgatggtgtgatgatgcagagtacaagtaatgctccctcagttattaaatatttgataccgttgattttttaacacatatttaatcgttcgtcttattcaaaatttttttatgaaatatgtaaaactatatgtatacatgaaagtatatttaacaatgaatcaaatgataggaaaagaattaagaattatttaattttttaataagacgagtagtatttgttttctcttgttcagattgtggtggtaggaattatggtcatgagagatcagatagcgggatgctgccgatttggtgtgagtggctgagtgctctggtctaagcaaggttggcttggcacaagtagcagattgtgtgttttttccttgggcatcgatgtataaattggttgaagtgttttgggaatgtaaattttattcaccaaaactctaaaaactcagtagaattgttttttgggtgcggttgagaggattggtagttgtatattcggttgttccgttctccgttgggtatttatatccagacgtcaacttatcgataatgagaaaaaaagtatgaagtacctttgggatgttaattaatttataaactcgattttaaacatcggattataaaactgagagcaccaacagaagaaaaaaaagaggtgaaatccgtgtaataatctataaggcaaacgtggatattgaatagcaaaatggctgagcacaacatgtcgtgtgctgagattcctgcgaccagagataaccatgtttcatatcaatcaagatgattgctaaccacgtctaccacgcggtgccacagggagttcttgttacgcttatgaccgtgtagaccccgacttgggtaagcgatgtggtactaaagcaaattaaagaaaggacgtcaagatccacattagtacgtagttctattcctggattaatttggtctaggcccaacgtaattggaaattcagtcccataatagaacatgcttccgaacgaaattaatggggaaaaaggcaaaatgttaattggttcttgagaagagcaagcacgccatgtatctaatgccaaagataatcagattgacgcacatattttgttagtatctttcttaatttaacgtgaattcatgtagtaaattctttaggttaattaactcaatgcttcaatcaagtgttgaagtgatcaactacatccaacttgttgcgctcattttcttgtatcttctacaacaatccaatatgccaagggtcctatgcttgtttaattcgggacggagggagtaagcgcttacacaacatagagactccaactccagccaagacaatctattaatttgatacatctcaaagatcacgtagttaaaaaaaaaaccatcatatatatcattgacgtatcaatctagttctcatatgaaatagtatattataactcagtatttttatgaggatagtttcaaaattttgtcattttataacaattatgatgatgctcatttaatattataaatatcattattttctctataaacctagtttaattttggataatgtgacttaagataaaatttaaaatgattatattttgagacaaataaagtatatatttttttagaattacacggtacaacgcagatactcacaacatgcacacacacactcatcttcatgaacacacatataaaccctactcctatgagcgtctttgaagactgggtcagcaaattctacccctactacataaaaaggatgtggtgttcatctatcgtattaacgttcctaactttttccaggttactacttgtaggcctattctaatttgtgcggctaaagctcaccatatgttaattagatcactataatgttagcaacccaactcgaccggcccgttagaattcgaagttcgaaccaccagcattatattgcaagaggtcggttcggctcggattggataggttgaggaacgagagaccaacgaacacggcacgatatttattttcgaaaggttttaatggcaaggaacacgacatcgttccgcatttctggtgaatgttttactctgttttttaccgcaaaacatatgggaaatgccccaaatcaggcgcccgcaatcctccacggccacgtgcgccgcccccgccatgtgtccccaccacgcatgccgttgcaataaatcacccatagaaccatctattaagagaatccgttttattttttattccacaaaaaatgcttcacctagtatactcataatgttttactatgtacagatcaaatgttgcagtgaattgaaatattcttttgtaacaaatcacccacatattataaaaaccctctattaagggaatccgtttcattttttgttccaccaaaaatgtttcagctagtgtactcgtgatgtttcactatgtatggattaaatgttacagtgaattgaaacatccttttgctatttgctgaaacattgttttcatataaggtgaaacaacgttcgatgaaacattttcgatctacttagtgaaacaattccgatatacttagtgcaatagcgtgcaacatttaaaaataatttaataataaaactatttttttcgtcggattatatccatgtgtggtcttgttttaaatatttaattgtaacagatttaatggtgcaatcggatcatgatttggataaataatttaagagaaaaatagtttaaagttcgcttagatacatacatgtaggatgacttcatcatgacttgggcgtccgatccgtagtcgcctcaaaaacatatgcaaccaatctacaaattatcaatcatttgattattatatatccgtgtgtgctggcagggagaaaacacaagcagctaagaatcaaatataaatatcggatctactaaatggcatgcaacagaaattagggatgaaattttacagattttggatcatcggattcgcaccaagatttatacctgggctcctccaactcctgtgagctctagtaaagtgcccaactcctgtgagctctagtaaagtacatgtaaattagggtttgggtaggagggggagttggagggtttagctagggcttagaggactgacagtggacacaggcaagcggcgaggcaccggtggttccatcagagccacgaggtcggtgacgggcggtgggacggtgttggtggttggggcaaataaatcaagtggttggttgtggatttggtgacggggagccatcagagacggggaagacactgctactcttgaggagaagacgctgttatcggtgctcggcagccctagaggtgagctcatcgggcttgagtgtgcgtgcatacggtagtgagggaaagtaaaaggggatggctagtgcgtgcatacgcgccagcaattttgctggcgcgcacgccagctgtcccctccccctgggcccttttatttttttcgtactttttttcttgatcttaggcgcgtttttctttttcttttttttcgtttctttccgatttttcttctaatctttcgtacacctctttacaaatgtagaattgaaaagttttttattttgatttaaaagttttcaaatattgacttgaaagtttttaaattttgtgttgaaaattttcaaattttgagttgaaagtttgcaaattggggttgaaagtttttaaatctgagttgaaagtttttaaatctttcaattcaaaatttgaaaactttcaactcgaatttaaaaactttcaattcaaattttgaaaacttttaaatcaaaatttgaaaactttcaactcaaatatgaaaacttccaacttgaatttgaaagcttccaactcgaatttcaaaactgtcaactcgaaaattcaactttgaaggcaattttttgaaaactttcaacaaaaattttaaaaatgttcatcatatctctgaaacttttcaacttagctatttatatattattttgataataaaatctttaattagattaatccatacgcttagcatggttattagcgttaatgacacgtgattatagtggcccacgtgcgacgagaaacagaaaaaacggaaacaagaagaaaaaaaaggagcgccagaagctacggactcgaaacgcgcgcgacttgctaatccggcgcgtctgcgcggattagcaatcctgaaagtaaaacgataaggttacagtacacacgaatcttaaagccaacccaacggtctagaatttcaagatgcaacgtgggattttctgtcataaattgtgtagctagtcccaataaatatgcgcttacacaacacagagaagagagactccaacaaagccaaccgacacatgctaaatcaaatcctcgggtacacaaacttggcacgaagcaatcgctcgaactcctccacatttgcagcctccatacacatgagcacccgcacggcggcggcgtccccgccgtcaccatccgctgccccgccgtccatcacgtagaagaaccctccgcgcaatgactccgcacgggacatcgcccatggcttcccccacccgaagtccaccgcgtcgtacagcggaatgcccagccagctcaccacccgcagctccgtctccggcaggctgccattgtccggacgatcgggcatccccgccatctcgttgtagtcgatcgccgaccgcagcatctcgtcgtcgtttaggcggccaatcacgcccttaattcgggcggcgatggcggccagcgtccccgatacgatgtcctccaccgcggcggcggcgaacacctcgacgagcgcgttgccgaagtagcggtccgggaggggtggcctcatgcgccggcggatgttcacggggaagcggacgagcgtctgggagcacagcggcagccggcgtgcgacgcaggcgcactgccacacaagggcggtcacggcgctgaaggtgctcgcgccgccgccgcagatccgcttgagggtggcgatctggtcgttggagatggagaagatcttggcggagatgaggcccgagcccgacgccgacggcggacggaggtttagcttggggcagaacacggaggaggcgtcagggtggatggcgagccgggggcgcgcgcggaggagggcgcggtcgtggcagggcagctccaccacggcggcgtcgccgtcccggcagaaagcagcccatgtttgcaagaagtggaacatgctatggccgtcgacggcggcatggtgcatcgccgtccctaacactataccgccccatctcaagaaggtcacctgcaagaaaaataaatgctgaaacctacgtattctaacttcgatccaagcaaatcaaattgaatactacttcattagtttcacaatgtaagtcattctaacatttctcatgtttatattgatgttaataaatttatatagatatatatgtctagatttattaacatcaatatgaatatagaaaatgctagaatcaatatataaaatatataagttattctaacatttaccacgttcgaatctatatagatatatatgtctagatttattaatatcaatataaatataaaaaatgctagaatgtcttacatcgtaaaatggagagagtaccttcgtttttaatagataatactgttaacgtttagatcatttattaaaaaaatataattattatttattttattgtgagttattttattactaaaagtattttaagcatgatttatatctaatccgtttacacaaaatttttaaataaaaaaaacaatcaggtccaaaattaacggcgtcatcaagtaggaacgaactagcgaaacgaaacactgacctgtacggcgagcacggcagacggcggctcagtacgggggatgaacagcctcttcaactccggcgacggcttgagatcagtcaagatgtcatcgacggcgagctccgaccgagccaccgcaaagaagacgccatcggcgttgcagtcaatctcgggccggccgtcgccgccgacgcggaagcggccggcgagggggtagaaggccaccagcgccttggccagagcctccttgagcctgcccacgtcgaagaagccgccgccgccgccggcggcatcatggcggcggcggtagaagtgcacgagcggggtgagggctcctctgttggccaagacgatgtcgaggggagaaagccagaggacatgcttcggcgtcttctcgctgggcactacgaagcaacactccatctcttgcgtcccatggccggccataggtgaactgaactactactactactcatcgtctttatagatagtactccctccgtcccataatatagcaatctagcaccgaacgagacactttatagtacaacgaatccagacatgttttttttcagattcgttgtattataaagtatcttatatctgttaaatttttaggagaaaatttatcgataaatgtattggtggtccctatacccaacgggaaatgcatacgtcatttgagatgtcagcattcagtgggctgattcagtggttcagcccttgcatgcagatctttgacacctactccgcaggcaggccacgtgaaatccaatcattgcttacgacaaaatctgcccttatctctttggtctctatgagggcatccactgaaaaacgcacatagtagtatcatcaagtgaactataggtggacttaggtactcaggccctgtttagttcgcgaaaagaaaatttttaggtgttatatatatcgaacgtttgaccgaatgtcagaagagatttttgacacgaataaaaaaactaatttcataactcgcctagaaaccgcgagatgaatcttttgagtctaattaatctatcattagcacatgtgggttactgtagcacttatgattaatcatgaactgattaggctcaaaagattcgtctcgctttttccccctaactgcgcaaatagtttttattttatctatatttaatacttcatgcatgtatccaaagattcgatgtgatgtttttgggaaaaactttttggaaactaaactgggcctcattagacacgcatctttcaatggagggtactccaaccagccctaaccagccctaccaaatctaaggtaacagtggaggtattctagtccacaacggtcgtgctctagcccacgaagccacatgtatgtttttccttccctacccctagcccaccgactgcccagcttctccctcatcatccctttttgtttgctgctccgaccccatcgtcgcccctccacccgtcgcctccggttcctcctcctgcttatctctctctccgttcgtcgttgacccaattgtcaccacccgccccttcacccgtctccgcctgcccctccttccgctcctctctctctcccttgtcgttgttgacgaagctcctcttcaccgcctctctctcctagatctagcacgccggcagccagatctagtgggccagcgccgtccccaggtcgccaccgcctctctctcccactgcccattgttgtccatcatgctggaagctggatctagtgggctgcgtcgtccccagctcgtcgccacttctctctcccaccgcccgtcgccgtccacgacacaagctagatctccccaccacgtcgccgactcgttccatggagctccaccaccctgccgtctccaactcctccccaccgcaccgccggctcggagcttcaccaccgtgccgtctactccggctcctccccacggatgagaccgagggtagaaggagaaaatgcatgtgccggaacaaggaccatggctcacagctccacgaaaaggagcggaggagcacagggaggcgcgtgcctcgcagaggagtcacgaccttctgctgggagatggctccggccggaaaagcgacgtttgctcgatggggtgaacagggctatgctccagggacatgtattggggatggcctgagtgctcacagtacatcgtttccaaaggcagattttttccgagacatttaaccatttgccacttttaagatatggtgattaaggatttgccactcgttgtctatgatatgtggcccctcatgtgtctatgacatgtgggtttagtggcaaatcctttagaagcactagtaaaaatagtaaaagtggtaaatagttaattattccgatttttcatgtctaggctattctttcgtactttactttcccttaattttcttcgtactaggcatctggtcttgcgcttatcttcgtaactctcaagcaacactcgatctcttgggtcccatggccggcccccggccataggtgaactactcttcgtcttgatcatgagcgaaaaaacactcttggcagcatgcatcgaccgatgcaattcacatgcatgcagtatacgtagaacctgggctttttgaggagctactgtggtaattaaacacccgttggaggggtccctgcagggtttcaaatctctcactatagctgccctatcttatgtaattatttgagaaggattctaattatttgttctcatatataatttagctgctatagttttatttagcccgctatagctgtttgaggagctatccgctaaatgttttagcccgctatttaaaacattgggtccctgccgtccgtgtccgtttgttggaggaggttagggaggtgttgtcggttctgcaaggagaggggaacaaggagcgacgccaggaagaggactagaggagggctcgagttaggggctggggtgtggatgggcgacaccagaaggacgacattgagggcgacgccagaggtagacaatggagtcgggggcgatgccactggcaaagggccgcagcatcagcgaaggacagcgccgagggtgagcggtgaaggacgacggcgacagaggcatggatgggagcgagatttttctggtctcgagggagagatagacagcccagcaggtggtgtgattaatgtgtttttttcgggagtagctatgtttgtggcgccatattttttaccaaaaattagtcggtatgtatttacattgtaagtccctaaattacatatgtaattttagtgtatttacaatgtaagttctaaaattacatatgtaaatcctaaaattacatactaattgcatatataagtggtgtgtaagtggggtgtaactaccatgtaaatttataaatttaaatcttacattgtaaaagataaaatgcaaaagcatatgcagtcctaacgttctagctaggagatgatcaagagaagaaatcgaacggtccgaacaggcacagccgaagacgtttagcgatcagacggatagcaaagccgactgagatcagccccaaaaagtgtcgacatctttttagcaagtccgtttttttctaagaatgatacttttcgcgattacagtgcagtcctcaaaaacaaatttttttcttcgcattgtattttcataaatataaagatttttatgtaaactttataatcgtgagataaatcttttgagcttaattagtccatgattagccataaagtgctacttactacccacgtgtgctaatgacggcttaattaggctcaaaagattcgtctcctagttttcaggcgagttatgaaattagtttttttcattcgtgtccgaaaaccccctctaacatccaatcaaacatctgatgtgacaccaaaaattttctttttgcaaattaaacagggccttaacacgagaagacatagacataaagaaaaaaagacgtgtcgccactctgagtagccagaaaaaaattttaaaaactgtgaaaagagatgagggtagaggggttatcagctgatgattatgttatttccacgagattagtattttatttccacgggttagataagataacagatctcttctgttaggtatatatgaatcaggccagcctagggaatgagtacgtaggcagtgcggcaatagtgtgagctagcaagcaggaggaagttgatgaaatagggatcaaatgaaatggataatctacttgacacgatatattaatatttaaaaaacaaacttagcatatatcttaacatcatgatcatataatcaatacaatgcagtaggaaaaagtcttttgagaaatcgtactgttagtgtggcaagccaccagttaaggaaccttctaatcctccactcaaaatgaaaaaaagaacctgctaatattgatatttgagtgcacctacaacttgagtatcctgtgagaactgaaacaaccaacaataatttgtaaaggtatgagattaattcaacataactcctgatacaacaaatatttttgcacaacacaacagcatggcatactatctggcattgacagatgcagaacatattttcgtctaattttacaaaaaggggggtcgttaagcatcataacaaagtgtctggctccggatgatcattctaagaactcttcgggcgaaacttccagacacggatgtagttttcgccatgtgtggtcacaattttcttcatgcctactgccaggcaagtgatctgagggcgcaggcgtgtggggatgttgtcaagccgcgcatttggagcaacctggcggacgcttttcttttcgacttgctgatgggaactggatgctgctgggcggtctgcattaactatgaaacttcggatggtttcaccggttctttggcatatcaagcgaagcacaccgtcaataccgccgactgccagtgttgctgtgtcacctggcaagtgatgtgcgctgtagatgacatttgggctaactctcttttcccagagaggcctcagggtcctgagcacgaataacagagaatataagtatggctctaatggagatcacagctatgacttactgtggtacaccattagcagtttagtactataagtgtgccaatattcttgccatgcacgaactaaaagcaatgtaaaataattacagactccataagcatcacgaaagtgaaaatgagaaaagattctaaaaatgataaacttcatagtatatttcaaaagataacttaataattgtcagttgttctagaatgttaaagtaatctgaactctttaactaatctcttctgtgataaataatgacaggtaggatgtaaactaatacttgtaaactaatagaagttttgcacacacatactcctgaaagatcatggcaggtatggactatggagtacagacaaaggcaaatggtttatataggccatgcatctctctattcaagttcactctactgaaagtctcaaactaaataaaatgtttaaaaaacaatacttcaatgttcatgatttgttctataactccagaggagagagcttcagttattacacagaccagacagctcaatgatagtaaattactaaattctatcatcttacgataccgacctcaagtcccagcagtgcgcataaccagcagatgagcccgcgaatatcaaatggccacttgtgctgaatgacaagcatcttattgctgaaatcattagaaaacatgaaattagcttagtattgattaagctcacagcactaaatatctaacatactgaaatggatcatcattggtgccttttatttacaaagatttaacaaggacaaatactgccagtaaaatcttagatatagttcttcatcgaactgagacgagattataaggcatgatttttataaagaacaacataactaaagaaattgccaaacaagaaaaaaagagttggataagattgtcactcagcatcctgccatttttctagaacaatgctattctttttaatggaagccaaccttttagagggaagaaaggggacactgcataaccatgcattaacttaatatgcaagtcatcatttctgttcaaacttctgttgaacaagcattatgctgcaggtgtattattctctttatggtaaatgaaaatgttttttgtcatggtatgtcaattcatttggactttttttttttgaaactgatacatttgaacattttcaacatggaaagagatgaagagaccaagaacatccccaatccccatcaatcatcagcaattggcagtccatcatgcttattcaggatcagctgaggggttggttacctgttggtgcaaaagctgatttcagaacacctaacttttgtccagaggtttgatctgcaatagctacatttccaaatgtagaaccagcagcaatgagctggtcatctgttattgtcaagcatgtcaagggagaagagtgaagcctgtataacacagttaaataggcatcagctgcaggacatactaatatagaatgcagaactgtacatcacaggggcaaaattgtctctttttttctgcatttgtaattattaatccttcaaaaatttcttaaatatgtacactatgtcattctcaaagatcaattgtatccaaataagtgttgcttctcaacttttctgcatccatagaggcccatataaatatcaaattagatacacctttagaaggaagattctaaacctcagcacaatctcatttgactttaaaactatgtaaaacattcaaggggaaacaacttcatgaggtgcagacatgcattgataaacaagacgaaattataccagctgaaatggttattagggctgcagga

SEQ ID NO: 66898 - DNA, 3287 bp, Oryza sativa
  unsure (1)..(3287): unsure at all n locations
caaagttgaccagcattttagaacttggaacaatgtactcattcatgtatttgcaactttcagcagaccaaagtcggagagtctggcaaaaatcaaatgccaagatgatcagcatgattataagatctgtgacggtattaaacaaaattaaaaaaaaaagcagtaagcactaaaaatcttcaatcatgctttcaattatctaaaaacttcgcaatgtactcaggcagccatggtttccacaatcatgtcatgtcatgtttcatctggcattctgcactactatagcatcacctgaatagcgagagtggaaggccattgaccatacccctattttttaaaaaacaaatataaatataactttttttttgtatactacatcactacatttctttttgctaaaaggacctaccaaaaaggtctaaagcacaaaaattattattgtactagtacaaacattaattatttgtgcctgttacatcttacttttttatttcaaaaaacagccatttcacattgatgaaggataataagaacggcacatgatgcaaggctcaccttatctccaactccagttaagattgaaccactcttcatgcggcatatggtggccctgaaacaagaaatagaaaactgaaagaaaaaaatgtggatattgagccacaatcccaacagtgcagctccagaaaagaagatacttgatcaaatcgaacaatatgaaaaaactaaaaagaaaatgtttgagaacacgagaactcttttagttgatataactaattcactatgcacaagaaacagcctaaatacagaagctcagcatagtacagggctacaggcttactggttaggatgaccaatccactgataaacttcagcaggacctctagagaaagacgatgcatgttcatcaagtgcaagctccttgaagtaactctttattgaagtattagaccctgaacttcttgcttgtggattcctcttgtaatatagatccctcatcagatgagctgtgtcaataactctattcctataaaccaagcagagtagaataagtacgtacaaattttaataacaactgataaattgcttggtaactttggaattttcacaaggaagatctggcggcatagacgagaaacatgcatgaataaaattaccaaatgaaactaaaatgattagcaccataaatgtatttgtcagtatggaaaatggtagctggaaaccagaataacactgaatcactgaattaatagtcaagtcacgaactactggacagagtatgaataatatccaaactaaaatgattagcagcataattggcatagttgtcaggacagaaaatggtagctggaaaccagaaacagcgctaatttagcagtcaagtcacaaaccactggacagagtatgaatatccaaagaagaaacacacaacactgattagctccccagaggtacatggttaagatgcagataacaaacaaatgagaggttaaatgcatcttcaacaaatgttaccatgacgaaaactcatcaatttgactagtcattcagtgttctaagcaacagttactttgaagcatatatatataccatttaaggaaaaaaggaaaaccgcagacccggagtattgggacatgcttcatagttatccacttatcctgcaacctctaggcataaaatccaggcagcagagttcaatgcaatgcgacagcagagtagtaattgaggctatttcttctaatctcgtagtagtagatacctgccgtattgtactgtaaattagagcaaaaaataaacatccccagcgaaacccaaacacaaacacacagcgtgcgtggtagcagtaggagggggaacatgggagtgaggaggggagaggagacgattcgcgcggcggatgggacgaaccatgagttgcagacggtggagcagcgggcgaggtcgaagtggtcgtcgaggcgggagaagacggagcggagggtgtcgtcgttcagcgcctgcgccgtcgaccccgacccgccgccgccgccgccggggcccctgcggcgcttcaatcccgcgctcccgctccgtccccggctgctgctcgtctccatggccgaacccctctctctctctctctctctctctctctctcccgatctctctggaggcgccgccgtttgctcgttggtttcacggtggccggtggccggtggccggcggcgactattcggtccttccgccgattgtgtggtggataacggcgtgttgacccagcaaagtcccgagtcgatctggcccaatggcccattacactgacaactaactcggtacatttaggcccatcaaattttggatcgctccatggtagtaacccaactcggcccaacttaattttgaatatgtaccatgtcagctatcgaacataaccacccgaattttgtagggaaaagtgcactttacagattataattcgtagccctcaatcacaaaacctggtatagcgtgtcccctaacttttaaaataagtgacatatgaatctcttggcagttttagacgatggtttcattctaagtgacatccagatggtattttgactttgtcatcattaacgtggcatgtgcatagcatttataataattaataaaagaacagtgtgatccacatgtcaatggcatcaccccttattcctcatctgcctcctttgtctctctcgcgatcctcatctcttcttctttggcaacgtcggcatgggaaagggagcagcggtcacaagagagaggagaaggttgaggccattgcagtggcaagagaaagacagttgaaggtagagcagtggcgcatctgccacgacctatagcaatcactgcggtgtagcctctgtaacgtggccgcagggttctcctttccttcgccggtgcagcaaattaaacgacgagttggatgaggaggtgaagaacctccatgaattgatccgttgactcgctcattcctgccggttcccctcaacgctctcccatgttaatgcgccgagcaacgcactgactctggttttgggtacagctacaaatgtgtgaggatgatggggagttcctaaaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66899 - DNA, 756 bp, Oryza sativa
aagcatttgatctcctttgccttagtgctatgtttctttttcgaatgtgaatggaaactgcaaaatagactatttatgctattgatccttacaagtattattaatataacatttgaagcaattcgattatatattagtgagattcaacaagcataatgagaatgattgcttagttgctgactcttgtaggtgcatttttcccccccacgatagtggtcaacatatgggaaaatggtgtgcatataaaactggagatggttatggtctcattagaaacaccagctgtgctttgtcctggaaatctttgtaggttgggatttttaccattatgtgcattaggttgcacataagtagtcttggatgttctatattatcatcttcagcttaataacattggctgaattggtgattctaatagttgtatattgtataaacttttctattcatcatggagatgcagtaaaccaggttcaaacaactttgatttaagttatgaaccacaccatatctatagacttattatttacatgttataaaattccaatcctctgtgaagattgtaggtttgactagctcccagctttgcatatggagacgtagtgagccgagaagtatttttcaatctcgtggagcctcattcaaccgtggcttatgtatgaggtgaggaacatgctttaagtttgtaaaatgacatgccttttgtttcgaacaaatgaaaagttagatgttacatatactactgaaattactgaattg

SEQ ID NO: 66900 - DNA, 828 bp, Oryza sativa
ccccatctcgaccaccgctctagcctcccgatcggtccaacaaactcggagaagacgggaaacctaaatcccagatctgaatagtccagcaaacgaaagagagaagcacgagcatccgtagcgtacctcgcgcgtcgtcggcggcggcggcggggagcggcggtggccgagaggcggtggagctagagccctaggggaaaggagagagaggaggacgcggcgcagaaaagggaggtaagatagccagccagatgcgcagaggcaggcggcacggcagggaggcagccagtggggagccgtcaagtccgccaccaccagtccaccacccggaaaaggcaaaagcggaggaggagaaaaaaaaatccaaccgcacggcgggtgcttgctatagtagcctagtatactacaactagcgtggctttgcttgctgctgctgccggtgcgggtgccgggtgcgtcccccctggtctttcttttctctccccctcgcgtttgtctccacgctacagctagcgctttgcttttgactgcctgcgttcggtgtggcccacgggggccacacggcccacacacctcacggccggctgagcggtatggcatcggcggggggaggtggtcgactggtcgtgatgggtggtggtgtgcggtgcgagcagcggagaggtgtaggagcgaggtgcgctgtcgccgttgccggcggttcgccagtaagacgggtgtttccggctaaggggcaacgttgccgtttttaccttcgtgctcactgtagcatttttgttggttgagtagcagagacagtgtttgagatatatgaaacgaaaaaaaaat

SEQ ID NO: 66901 - DNA, 2603 bp, Oryza sativa
tataaaagttcttaaaagacgtaccgtttagcacttgaaaataagtgttaacgaaaactaaggtaaaatcatcatcttaattacctttcatgaagatgaagataaagactaagtgtttcaggtaaaactaggaggtaataacgtgtgattaattgagttttaattattacagacttgaaaaatagattaatcttatattttagaacaacttttacatagaaagttttcacacaaaacacaccgtttaacagtttgaaaagcgtttctcaagtatccaaaagtttattcaactttcgttgcagaaaagaacatgccaaaagtagcatggtaatgcttccaacctcactcacagctcctcacaccaaccgagcatctatgtatagtctaggcaaaaaaaaaatttcccttcatatttctgaccacgctaacggtttagccaaatctcaatgactaattcactagctaaattttttatattacaaataaaaaacacactccaacaagctagccaaatcccactcatcaaatcacaatggctaatttcatactccctccatcccataatataggagattttgatttttttgctaaatcccttatattatgggacggacggaggattacaattgattatgttaaattttgcaataataacattttttgtacatggggctgctcagttcttgatgtatagattttgagttgaattactgagttttgtgattgatatgatatgttcatcttgatttttgggctagttttgtggcccatgttgttgttttattgtttttggttttggtgcagtcaaaataattcctattggtatgtttttcttttcattggatctagatcaaagggctgaaaaaaatctgtttgatttttgtcaaaaaaaaagtcaatgaatagttagacaatcccaattagtttatcaacacacattataatccatcatatcctttttgttaatctggccatttcttattttcgtgtgaacaatgaagttttctaaagtactccctccgttttataatgtaagtcattctagcatttcccacattcatattgatgttagtgaatctagacatatatatttatatatatccattaacattaatatgaatgtaaaaaatgttagagtgacttatattgtgaaacggaggaagtaccacataatgtaactatgtctctttggtgatttaagttggatctacttgtccagtgatttgaggcgctatttgtccattggtggagaaaccatctttgctcggttgacccaaatccatagtagtcctggttccattaaaaaccgggagtaaaaacgatttttagtcccggtttataagaacaacaatactagatgatctttattcccggttggtgttaccaaccgggactaaagatcatctttagttctttagggaaccaaccgggactaaagatctaactttagtcccggttgttgttactaaccggaaataaaaatctaacacgtactatataatccctattacttatcttcttatatcgtccacacaacaaactctctctatctctttttttcctctctaactctcttcctctttcctgccttatctcattctttttggatagatcgagcgagagcgctgccttatctctatccagatcgagcgagagcgagagcgggtcggcgcggcggcgcggaggcgcggaggcggcgggctgcgcggcggcacggaggcgcagcggcgtggaggcgaggaggcggcgtgcggcgcggcagcgagcggcggcctgcgcggcgggcggcgcggcggtggccagcggcgtggcagcgagcggcggcatggcggtggccggccggcgtggagaggaggcggcaacggccggctggcgtctctgtgaatttttttttagaatttgtgatttattgcatgatcctgtaatgtattgatttgtgtgtgatgtatttgcgatgaattttgtagaacttgtgatgtaatttgatttgtgtgcaattttattttaggatttgtgatatatttgatttgtgtgtataagtaactttaaagatttgtgatatagatttgggatgttaccttgatttggtatttggggtttaatttggaatacgcatctcacttgatttgggagaaaataaaaaagaagaaaaagaaaaaaaaaggagggggcatctagactgctgttatctcatctttagtcccggttgttcccctatctttagtcccggttggtgttaacaaccgggactaaagatcgatctttagtcccggttatttcactcgggactgaagatagcaatctttagtcccaaatttatagtcccggttgaataaccgggactaaatgagggttacgaaccgggaggaaaaatggtttcttcaccagtggtccttgatgtacactaaagttgccaaagaacaagaggcttcttgttaattgccaaaaagatcaggtatgctaccacacttgatagaaaatgctaagcacatttgattggatatcagtgcctgtcatgttgctgatttttcttatgcataactctcgtggtacagggatcttcacccgtatcaccttgttctcttttgaaaaaaaaaaacaac

SEQ ID NO: 66902 - DNA, 1421 bp, Oryza sativa
tctggaatgaaggtttacctgatgaatttggtaaatacacatgggctgatggcaacgtatacattggaagatggaaatcaggcaaaatgaatggcagcggggtaatgcagtggataaatggtgatactcttgactgtaattggctcaatggcctggctcatggcaaaggttactgcaaatatgcatctggggcttgctacattggtacatgggatagaggactaaaggatggccatggtacattttatcaacctggaagcaaaattccttgtaaccttgaagtttctgactgtctaacaagtcatgatggtacaagtgcttcaagttctagtaatgaaaagatcactattggactgttatttctattgcaaaaactgtgcaagaattggaggttgcgtaggtttcttcatcggcccagacgtatttcaaatggtaccacaccagttttcgatgataattctggaagccatctatgccaagatgtatcaagtaaatcattttcagctgatgatcagtgtctacaagacagtgaagttgataaagattcggtttatgaacgggaatacgtacaaggagtgcttatcatggaacaaccaaaaaacgaagattcaagaatgtcggagagcggtatagcacaagaaaataactgggagaaacaagctaaaggaccaatggagactatttacaagggccataggagctattatctaatgcttaacttgcaacttggcatcaggtaagcttcattgtatgaatgcatcattgtttgctatacaagctttggagggttacactcagtgcttattatattttctggtttgttctggatatatccatttaggacaagggcaccttccatttagatcgatacatacgtgtaaagcaaactcttttttgacaattcaagcataaattagtgactgaagaatcaataatcatttcagtggggaaaaattaaccaccagttagaatgttctcactatgagtgacaacaaaagtagtttcttctttcgggaaaaagtgccttctctttttgaaaaatgacataagtagttgtattttgatatggagggagtatgtcataatgcatctagtcacgagccatctgttaattttttactagcatgttatttgtcttatcataatagtgattggatggtataatagccatattttatgaaaaacatcgattacctcatgaaatataattttttttatgttattttttatgtttacctcacgacatgtaactagttgatgttctttttaatgattaccccatttgactatacagtacttctatgcaggtatactgtacgtaaaattacccctgtgcctttgcgtgaagttcgttcaaatgattttggacctcgagcacgaataaaaatgtacttcccttgtgagggatcccagtatacccc

SEQ ID NO: 66903 - DNA, 2169 bp, Oryza sativa
cggcaacgtgcagctgctctgccacgggtacggcgagcacgaccacagccggtcggtgtggtcggcgcgcgccgacatccccggcggcgcggcggcgcgcctgtcgctgcccgccgtgcgcggcgacgaggtgttcgaggtgctgtgctcctaccgcggcgccaaccggtgctgggcgcacggcgtgcgcgtgttcgccaacccgggccacgacaacctcttctgctcggagcacgccggcggctgcgaggtgcggttccgcaaggacggcggcgtcgagaagcagtacggctccacctccacgccgctgatattcatgggcttcgtgccggacttcgacaacgccagggacggcgcctgcgcgtcgtcgagctgcgtcggcaggacgatcaacagggtgatcggccaggagagctgctgcgacgattcctgtgggggttgggagaaggcatcgcccaagaaatcatcatgaatccatccatgcaacacatgtagatcagtcggtaattacctgactttttgtatcatgtagatgtaatctaatcatacattaatggataggtaaaaaggacacctgaattgagtctcaatccaatgcaatcttggtacatgacaattcggtaatactagcgttctcttttctttaagaactgacgaacaaaacatagggcttcttttgaagtactccaaaaataaatagtctgtcaaaattcagaacttgtggcagttgcgttcctcagtacatcagcataggcaagggaataataggatctttaatcagagtcttcatagacgccctcatcatcagaaagctcatcaaaagaacgaatgtccagctgatagcgcaagatgccaccgatgccaccaaaacctctgcaaaactgtgacccctcctgggatttgttggtaacgaactcaagtgtgcatccgaactttttgtactcgttagcaaaccactccagaagggatgttttgtcctgaacttctaactcagcattggttgatgtgtcgcggaaattgctctgatcagcttcttgctctttgttcagatgttttattgcagtttctccagtagcactgttcttaagcacatatctgttgacatcaaggttttcccacactatcaatgtctcaacagcacccatttcaagagtcttaagggtgtcatcaacgccaaaaacgtacttcccggtatcttgactaatctcttcaaagtacttcccaatcaactttttctcctgtatgaacttcacattcgctagaatttcagctgataactcaatggcttggttgaaaccattttcaccaccataggaaacatcaacaacattaagtatcttggcttgaagacgctgatcaaacatgtcagattgactcagttctgtcttaaaatcagcagaaccagccaaaattagtccagaaacattaggctgactggtagctggattgatgaagaactgagtagcaagttcagccgtctttcggacatagttatgacgcttttccatccgaagccgagcaaaacgcagagcagattgccctcctcttccatgtttctttgggagatctacagtgaatttgtgaaggatctcacgagtattgccactcagtgtgccgaaaagagttccattaccatccataacaataaagccaaacttgtcatcggattccaagagctcattcaaagcttcggtgtggaatttgttgtcacagagatacaacgatgcattgatgggcttgaatggttcaaaatcaatagtgactttcttttccttgccatcttcagtaacaattgttcctgtgtagaggacgagtccatttggcggaaccttgttgtacagcttcagcctctgttgagctgatgtgatggctgccaaaacagattgtcgattgactctactcttgatgtttgaagcagtaccatattcatcacccagcatcttggtcacacgggagacttgatcacgtgggggcataatcagagagatcatgcttgtgccattgcctctagcagactccagtgccttgatcaacttcttaatcttccaaatctcaatattcttgtcagtttcttgaccatctgacatcttgacaaaattaggatgcttgattcacctgcagaataccaaattcaaatattagtaacaaacccgagagacagaattcaga

SEQ ID NO: 66904 - DNA, 13181 bp, Oryza sativa
attggtggtagtctctatatttataccaacatataatacagaaacaaaactctctccatacttggatggccattttggaacataggagtaagtcataaacaatcatttctaggtcaattgcatagtatggaaacaccaaaaccaagagttctgggtagacagaaccagaacaaggctgagggtcatccaaataggtttagcgactcaaaccacaattttgtcaggtcacgtcctgtgtcccttactcagttcctagtgatcatgagttgtttggtcatttcatattccgtaccaaaatgggcctttctagttctagtttgcaagcaacatggattagatttttggctggtaaagaattactcatcaaagttaaacctagcacatcaagctattatcaaagaattggaactttagtcaaccaatttagcttgaaaaggacagtaaggacaccatccaaaatggttagtgctgatgatgctaattggacatttgggacaattacaaatcagtggcggatctaacatgggacatggggtttcagttaaacccccaaacttcttgcgaaccatcaagctgttattagtactaaggttgagttaaatttctagaacagaagctagggttaacgcaaattcgagaaaaagtgcgtgggtagagagagagagatgggaaagaggacgtgcgtaacggatgcggcggaagcagcaggaggaacgacggcgaccctatgcgctcgctcgcgcgatggatggggatcgacgcaggcggcggtggcggaggatgtgctcaccaggatggatgcggcggaagcagcaggacgaacgattgcggccttcttcgctcgcgggatggatggggatcggcggagtcacagggggcgggggcaggggcgcgggcggcggtgggcaagggcaaactgacgaggggtcagggtaactcacgcacgacagaagagtcaaaatggcgagggtaacttagtaatttctcgcatcaattcacccggattgcacacccatcccatctccaacctagctagacggtcgaaatctgaaaaatgaaaataatatccattcgtcctaatctcatttttcagatggagtctctagtttaacccttgagacggtagattttttttaatagaataagattgagatggtggataaataataaatatgtttggacattgtccaattaggcatggctcaccgaatgagtcgtgttgtgtcgatccacgtggtaaggctggagcctaggcatggtctagtgagatgtcgggttatgttgtgttggcctggcacaattagggtacatgtgttatgtggagaccgcttagcccaaatttgatatataccgagaaaaagaatacgaacagaggctattacatcctactgcacaaactccgatgaagctctagtgaggtcctccgctcaccgatagcatattcctcttcctcctcatcaagcactgtcgtggcccttcactttctacttccttcacaccgagctagtgaacgcctaatgaccaacatgcttagcggttgtgctcacaaatgtggttggccacgccaccacattgtcatgtaggcttacatcgatgagcgtctaccactgcttcctctgcctcgagcccctagcttcttctattcttacattctcctttcttcctagctcctgctcggatggcattatggtagtttctcaattggcggttgttcgccagtcgtcggtcatcatcgtgccgcatggaccatgccatgtcgtgctattcctgggccatgtcgtgctgtctcactacatgcatttgtcatgtaggcatgtcgagccagatagcaatccaagcatggtgtggctagacgggtcgtgccaacgcaacccatacccaaacagatcgtgcgattcctggactgtaaacggcacatgcgtgcctgggcggataagaaaagacctagcccatttgacaacctataggaggatttagcaaactcatagtcgttcctctgtttcttcggatgaaatcaagtaagacaactcagacactccaaaataatttgattagtgttaaattaaagggaactttaaatttttaaaaagatattcccttccatgatagcgattacactccaaccaacactaaacttacatgaggttggatcaaatcgaaccgagctgcaagggagcggagacggagcgggagcgggagcgggagacggagcaagggttttacctagaggtagggtgtgcgagggaagataactatctaggcaggtagacggctctcgtctgacgttccccttcggctacctctagggctgcaaagagagccatattcttccactactacactgcaagtggaataataccaataataacgggacaaaaggaagtggaatggactagtgtctagtggtggcaatggttagatacttttcgattgcagaaattttacagctttaaatctaatttctctaaaattcttcgttccaaaataagtgataacccaaagatggatctccagtatccataacagccgaaagatatgagaccagaagcaaacataagtatccacttcacaagtcagattgtcacaacttctgctacatactctatgtgtctaaaaaaacaatttaggctaggcaagaatgagacatagcatagcataatgaatctggacatgatattattcagatttgttgtattaggtatatcctttcattgtctaggtttttttttttatcggagggagtactttgttcgccgacctgcgaacttgggttctatcacagccacaaatccaacatatgccggtggagaatggaggctgactagccccgtgcaaaagtgcattgcgtagtcaacgtggatttgtggatcgcaatcgttcctttccagcgacaaaacagcacaatttttgagctcacatcgcacccgtccacaatttttgagctcacgtcgcaatcgttcctttccagcgacaaaaacagcacaatactggattcgggtcaacgtggtaacgaaagatacattgatcataggccatagcggcggttcattgataatagcggtagcttatcggaaggtaggaattttacagcaatcggtgaaattatcgtcgagatgagatattcagatacacccatggtgcttgctgtagtacagagacggaaaatggaacaaaatatccagaaacggaaacaaaactgcaatacaaattagcatctataaaatgctttacatcgtctatggtctgctaaacattttcaatatgctgggttaataagcaatatatatctaacgcaactaccaaattgatcccaagtactggtcaaacatttgaccctatccctgcacttttctctacttcatctccaggtgtctggccaatacacattcagttccaactagcaaaatataccaaggtgaatgcaggactattcaccagagcttctaatatggctatagtttatcatcctaatacctctttcagactccccaggaggaaagctggttaatctggggcaaagtttgctccctcaactaactcaaaacttcagaaaatgatggtcatctgctattgaagctgccagtttgtgtccgggtaacataggagaggcgtgaagaaggaatcaaaggggcttcttcatcaacccctgcaccttctgacgccagacttccaacagtggtttcatcattagaatccatgaaattgtcaggcttgtatatgtttgaaatcttcttatcctgcaaaaagttgaacatttcaacagttatgtgacttgtaagtacaagaaaaatgagcaatcatttggttttgcctattatcaaagttacgccaagtaaagtattaaacaaaattggaagctccaatactatatttacgtggtatctgatttgttgacacggggagaaccaaacttcatggagtaataaaatgttgtggttaggtggacaacgcaacagccacccatatgatacaaattggaactgcaattgctatagtagtggaagctatggtactaaaagtaaccatttttagacaataacttggtgttgtgtgacaacaacgcaatgcgtaatagcagttttttttatgcaaccgataacaagggcagagacaagcaaagaacaagaaagaaagtcataactggaacaatattgtactataaagtagtgatacatcatacatgaaagatctctatggatgaacatgttcaagaggaagaccacaaagaatcaagatatctaaataaagtaagtgcagagaaagtcgtactctgaccttcgtagctctgtcaggagcgatatcagctggaagttggttcgctctgacatctttcatcttcaaataattgtacatgacaacgccagagagagctacacattaaagcaatactaattaagaaggttaatcacaaacaacatatttgaaataaaagtataagcaaatttcacaagccccggatttatgtccctttgtaactcaaaagaacatgttagtatgttacacatgttaacataaccccatgtttatgctatgcaatggaacacaaaaccacaggttaagattatagatatagattctactttagagaaaattgaatggataattaccaacagcatatccaattatattgaggcttgtaataatagattcaggaaagataatggttgagagggcaatgagtatccagtccttcagaactcctgcgactcggatggtgactgctcctgttcttccaataactagaaagatggatatgttcaatgcaaatgcagcaactgcattaaagaaaaatatccagtagttgaactgaatttgagaaacatccatttctggcttttcaagtaaaaaccaaggaacaaacaggaagatgaaactgcaaaacagaagaatacatataagaaattgcagagagtaaaatggcacaaacattttagtgacatatagaatatgcaaagcttagttgtatggagacaaaaacagtgcataataatcacagaggctacagaagaaaaaccagtgagtgcaaaagttgaggcagcaaatggttgttcctaagtcctaacaaactactttctgcttctcaacaagaaaccacacatataagtcttacagacagatgccataaacctctcgaatgctcttgttgcctaatacatgcaatctaatacgacgaatatacatttcaaatctgttcttttatttattcattcaaacaactgaggttagaaactactacaaatgaagaacagtgttctcttcataaatgtcataggaaaaccaattgtgttataagttttagtgatttttatttacatgtgtacattacaacagcacttgcacaataaagtagcactagcaccatttggttgtacatattatataaatccaagtcattaatatcactaatggaacctcaagaaaatggcagtttacatgttttttataagagcaaactaaaaaattctctttgtttttcgtacaagtattctgtaagactttaagagagaagtcgttatttcattcaacggtagttggttgaaatcatatcaagcaagcaaacttttcagatatagttgcaatacctgcaaggggctatataatataggcttgtgatagggtttagagttaaccccttcttttgaaggaggacctgtgtcagaaccagcctgagggcttccgcaaaaatgcctgttacttggtataatgttcctatgatattaaaatgaatctcgccatatgatgaaactacgacaccaacactgaccaagaccatgttcaagaaaagatcccatcttaatttgtcagtaccacatagaacagccattataaatgttgccacaggcactgcattacaaagtaacacaaatcagtaccagaaatgataaattgatttacagggagtttcatggtaactcactcaaggccttgagcatctgaatgaaggcgactgaaatatacaagtatgctgtgtttccaaacctgtaaaaataatcaaatcaattaaagtattgttagaattttatgcaagggaaactcattcttcatacacatgattcaagataactttacaggagaagtagcaaatttccaaatattcatatacagtaaatgctgtatgggggttaataaaggaaactaatagtatagttcacatactgagataagatactactgtccggtattaacaaaaatagagtttgcatactgtgccccatttgcaaaaataaccaaagtattagaacacattatacacatacagagcatgcatttgttaattcacatcgcaattacacataatacacaaaccattctattcaagttatggtatacatggcaaatagtacacacagaacagctaggtttgaaaacaatctcaatagcaaaaactttatcaattcaaagcaatcaatcaggtcatcataaaatatcaaaactgcaagtatcatgccatttgtgtaatgttgatagtcagctttagatcaatgcatttaacattttaggcctacatatatcacatacatgagtgcatatgctttcaaagccatgctttctcatacaggagataataaagaagtgatcgaggaaaaaaatgaaatgaaagatggttccatatcttgtctatgtttagcttaccaaagacttgacgcgaagaaggcactaattggaatcacacatgtggcatatctgcattaagtgaaagaaatgactaagaatcaaattccacacagtgaatgacaaagttaagtgctcttacatttggaatgtcatcttgactggtgcaacgacctgcatcaccaacatagcaagatgactccattagctttacaggaaaaaccaaatgacagcaccagacaaactacaaacttaaagcttcaatacagaaactaccttgcctattcttgcataagaacagtttctattcgacaatcaacactttgtatgccatttggttgaaagttacaacaagcaagtaatccagtgtgcatcgaacatggaaggaggtaataggaaaattggcacaaagaagcataccttaaacacacggacaaggaagaacgttacgactccagaaaacgccatgtgaatcattgtaagggtaataggaaagggaaatttgaagtactttggagaaagtacccactgcaaaaataggaaaaatgagagcattaagttcatagtcagcgtggcctctcataattaaacatctacttacatccaagcaagcatatagcaccgcaaaaaaaataatatgcaaagccccagatctgcattatcagcatccatcaccgacattcgtcaaatccgttacgctttgagcccacattatactacagatgacagtgtgctgtaccaagaaccctgattcacctaacaaccctaaaatcctacagaaagcaaagcattgtaatagaccgtccaccaaactaacggatatagcaattaaagtagcactcactcatattgcagttctccaaaccacattagaagtgaagtcgttcaaggagcaaacactacacaaaagacactgcgaacaaaatggacctcagatcatcgcattcctcgatttcttctctagcccagagcaaacgcaaaaaagcaaaagcatacacgcaggtagagcgaatcgcaaccggcatttcgaaggaggagaagccctaccttgttgaacaggatgactcccgacgagaggcagacgtagattagcaggtagaggtaggtcagcacgagctgcctgctgatcatcatcgcccccgcctccggcgcccggttcacctcgcgttcctcctggggttcggttcactcccggggccaggcggcttcggcggccgcggcggagggccggtgcggcggcgagtcggcgcggcggtgggggaggagtggagtgggcgcgcgaaccatagatctgggacgcgtgcggcgcctctctcggattggaagattgggggaggaaggaaggaagggatcgagagggggagggggtcagggggaggactgaaatgagatggtgggagacctggcagggtcttttctgcaaaaagtgggattaattagcgcagtgctgtttcgggcccacatgtctgtcactgatccacgcgtttctaatttattgttttctgcttgactatgcggtggttaggatttagggggataattgtcgtggtttgcaggcctaaaaaattgcgtacgggtttggaattatttttgttttgttttgttttgctccctaccttttgcagcgtgcgatgataacactggatggagtaaaatttcataggttagagtgaatttcacgttgaactctatgtattttgttaccataagtctcaaaatatgaaccgtttaactcatattttcaatttaggccctcctttttttcactttgatttttttttctcaacattgttttcatctagtagacgatgatgattttggcatggcggtggaaacaagagaagaaatgtatccaatttgaaactaaaaggtaagaaaattagatccattgtaaaaaaaatggaataaagggaatccaaggtttcttttaactaaagaaggtcgaaggtgaaatctactctaatttaaatatgcgtgtataagactatcatgacgaaactatataatactccctccatgcacaaaagttacacatattactattgtcacaaagaccaaggagaaattaaattacctttgatgttataaaatcaaagagtgaatgcaagcatgtaatcaatgagtatttagatgactccttggattctaataaaacatttaatttatctcttcatctaagtcttgaatgcatagagactacaaataggaataacttatttggaaaaagtcaaatatgaaataggtctaacttttgtggatggagggagtaccaaataatggattgagcaattaatatttaagtgcccatattcaaccaattttatcatatttttatgggaacataaaactaatacataaaatttctaaaataagtagattttctgtaaatcgattttaagtctataatttgtaatcttatggcttatacatctttagtctgcgaaaagtattttaccttaaaagtttgtgacaaaatcgataaaattttaccaaagtataagcagtttgctatattgttataacttatcccttaagacacgacaacccattttgccaataaacacaagacgcaaagacgtgccaactccacagttgatagtccagatcaaaagttttcagagcacatcatcttccacgtggaaaatccacacatgacaacgccatcaggagatggaagaacatgatttttttttccactgtccgtcaacaatagagtatgtgtcacactgactggactagatactctctgtttcggggtgagaggttgggaacctctcaacgtgcatgtaaaaccagtagcgtagctagaatttaaagtaaatgtggtccatttatatgtaatatgttaattaaaatagtggtcaactatacaatttttattatattaactagcacatatactataattttaaatttttaggtggtccatggaccacgatgccacctagctggctacgccactatgtaaaacaggttacttattaacataacatatgattagttaggtgttatctgaaaaacttaaaatatatattaatataatttttataccaactttcatgtatattttttctaaaaaacacgttatttagtagttcggaaagatatgcacgcgaaaaacaatggaataatggttgggaaatgggaagactcccaacactatcatctggccgagttcggttaccacctctccccaacctttacttcctcattttccgtttacacatttttctaaactgctaaacggagtgttttttttaagtttttttgaaagttattttaaaaatcatgttaatattttattttattttatttaactagtgtttaatttatcaataataaacacttcattttatgagtggggaggtggagtttcaacctccgccctctaacaatagaccagtcggcagagcaactcaccccatttccccttgtaattttcaggtccattctgtactgtagtctgttataaaactagccccaaaatcgacatcggtagctaaacgtggaagaaaacgccataggagatccaaaacgatagcgacaccgaggcacgatatttggtaacggagttcagccgtagcctacatctccggggcactgattacgggcactcctccccgatccagcatatacaacgtatcagagttacaacgactcacggccggtcgccgccggcagccgctccctctcgctatgctaagtcaccatgcggttacaacaggcacggccctctatttatgagagaacctaggatagagtccgactcatactctagtcctaatacctattacaactccaagtcctaaactgtaatcgactatgtacacatattcaacacaaactctaacacagtctgcaggctacagccacacactctggatttggttagtctttgtccttactactagtatgactgaagatattctatatatctatgcttaaggccataataatatatcacttcttcgccgttagctagctaatctacatagactaagtagtgtggtcgttgtcaaacattaattaatcttgtagtcaaaatgtctactttatacaacgtacccaacggagaacggaccatcgagcatcgaatgagggggtgtttgaaccggtagaacatccaaaagagaatctattacgctagagcccttttccgccctcactaggaagttggaacacagaaatttcatgataattttataggatttttatcataatgaattctcgtatttagaggaggccaaagaaagaaccatatgaattattatattaatatatttcaaataggcccaaaaaaataaagcaaattaagagcctaaggttctcttgggagctgggaggtcgcaggtttcatcttttccttaatgtcatagtcatagcactgaacatggtattgtctctaagttgtgattcgtcgacaaaatatgagcagaaacgccggagagaagagagtgagttgcctccccgtgaacaattgaattaagcaagcaaatcaagaaagattattgaccgtccattcaattaataacacataaatcatccaacaaaaagtatttcgaggtaccgatacgttacggtaccaaattgttttcgatcattaaatctaacaatgcacatctatccaattagatctaacgaacgggttacatgaccgaggattagactccatacacaattacacacaagttttccaactaccggaattcgaaccagagcgagagtgcagcagacttgcaaaactaaagaaatcactcctttttataataaaaaaaatcaagaaaaatcactcaaggagtgcaacaaaagtaagcagcagtgacgtcggaagcactggcctccgaatattttaccgtccgactccgactccgactcagaaagggcccaaccgttccacataagctaacgaccgggtaccgccacggcccactcacgtccccccgctctctcgtcgtgttcaagtcgcgagcgcgagtttctccgtaagctacaaggacttgacctgggaacccgcctaattgccactcattaatccttttcttttcctcggtcagtttagagtacggattagtagactgaatccactaacccctagcgctgttgcatattaacaagctcataaattcttagccccatacgcatagaaggagtagtgttgcacgctcgcaccggtgcacgttggtggatcgatcgatctccatggcggcgcttcaccaccaccaccaccaccacagccaccagatcaaggcgccggcgccgacttggctcatcgtgaaggctaccccgccgccgagggacggggccaagaagctggccgcggcggcgtactcgccgctcctgctgtcgccgtccgtgtggcagaaggcgcaggacgccaagaagggcaaggcggacggcggcgacggcgccctcccggcgtcaccgaggatcacctgcatggggcaggtcaaggggaggccgaggagatgctcgggcgcgcgccgcggcgaccgtccggccgcgagggccggtagctcgggtctactggagcggctcacgctggggctgttcgggcggcggcggagggggaggacgtcgtcgcgggcgtgctccaaggtcagggacgtgccgacctgctcgtcggcgcagtcgcgggggaagatttattgcggccgcggcggcgcggcggcggtgtgcacgcttgacccgccgttgccggtggtgatcaggcggcccgcggcggacgacgaagcgccgacgctctgggagaggcggcgcggcggcggcgggaaggccctggagactctccggttaacgtagatcgctggctcgctgcagagttgcgcttggcaaccgcagcccgccggtgagtatattgacagaggaggccaaagacaaggaggcaacggacgacttcagccgaaggctacggatgcggatgctaatttcctaaaaatttgtccataataccatgtatgtttacagtttaatcatttctttttgctaatttgtatagttgtatctacttgtatgttgatcctactgtccattttaaaagtcttgtctctacgatttggaagctcgcccctttttttctccccacatatcttctccatccccttcactaaggcatctcctcccaaggtctctaggacgctcccggtggctctgcctccgaaacactcacgtacttgctcccgccatatcagtcctaccatgggtaggatgttgggagcggcgggctgcaatctaagtgaatcattaagtgtattatcatctctgtcaattctttttctctatagtttctacaaatagattattttgctggtttgctgatttttcctacttcagatacaggaacaaaaaaaaaagaagagatatctttgtttccaaggagatgactgaatcgaacccttccaattgttgtatgggaacacatatttgatattcagactaattgtttcgtatgcttgctggattggcattgaattgttaataccatatcatcattcttgacaagtctttactcatgtgcagcactgacaacacatattcacagtatcaagtcgtccaaattagccatgataagg

SEQ ID NO: 66905 - DNA, 11475 bp, Oryza sativa
ttgtaaactcatattcagattttcaatgaatgattcatatcaacctatctggttttctgttattaccacaatatttatgaccattaattcacgatatatattggaaaactatctacttcgcgcttcagtttgacaaattcagaccttattatataagctataatgatgagtaataaagggcaagagctgaaattagcatttctatatcatactataatggaagcactaagaacatatcattcagctttgataataattagaaataaaaacatttgtctaagcgaaagatgttttaaggtgcaagaaagaacatacgcatcctcacaataattcgtcaatttaattcagcaagggacagtgcttctcacttattgagttgaaaaaaaatatatatctagaagtgctaaactcatgctggcctcatgtcaaaatggtgttagttcaatttcaattgttagctgagtcacacaggaggaagcaggctgctcaactcaagatggaggaaaccattcttttgtgcgtgtgacaaatatgtagattctataattagcctcttatttgatcctaccatgggtggaggagattcctatataaaaaacttcagtacagtcacagttgttggaaacagaggcacagctcttccgcaaaaatatgctgattgtggaattcacgaatttttgtttgtctgaatagtgcaaaagaacataaacgagataaaggaaccacttaatttcaaagccattgttaagtctgaacaatattattagtataactttcaatagaaggtcgattatatgttccaaataggacatggaactttgtcaaagagctttgaattgatgacgggttggctgaatactttagcactacatatacatgcaatctctaatgttgtactgattaatctttctacaaattcttgaaaattcaaaaagaaaagtgtcaattgctacttggtgtttttttagcaagcactcttttctgaaagatctacaacacaaaaaggggctctcattcatgaagaaagagcgggacgcactacccttgggttttactgcctctcgtagtcctgcctcaggaacttcaggtattctcctttctccacctccttagcgcatatttgatctgataatattgctgccttgctggtatatatcactgaagtatgtctcctcctacaggagaagaggctgctgcaaaacgtacggcagttccaggtccctctgcagcgttacatggtccttatggaggttcaggtgagctacatacttattgcagctaactaagcaaatatgtcatgttcttcttgtggatgatcagtttgaagaagagaaatgagtggattcactgacagcaagacaactacaacactgccgccaattatcttaaaccaacgatcaggtttaataagagtttctttgattttgagtgtaatagttgactgatttcatcttgcctttttcacttgcaagctcaactaatgctctttgttaaaaccatgtttgatatgtaatggtccacgtatacatgcttcttaaacagacatcttcagtcgcgcaaagtgcgaccgaagatgagatgccctgctctccagaatcaagattatcctgaaatcaactgaatcagactaatgagcatgtggcctttaccgtttggacagcaaaggcgccaatggcctcggtggcgagtgcctgcccgagtataattaactgtacaccattttgatctgttgagttaagtaccttctctaaagcatctaattatagtaatatttgttattaagatataaaagaaataccaaaactaattagtacaaataatatgcaaatacatttagaacacagtcagacatggatacatttagaactactcctttcgaactgataatattagtcgttttgaataaggataaagtcaaattttaaaatctttaactataaataatttctaaaatatttatgttaaaaatatggaaaccatatgtgtagattagttttaaaaagtacttcaataaaatcatatatttgttgatattcctatatatactaaatagaaaataattatcaaagctattttttttggataccgtgctcttgtaaaaaaggacaagtataatcaagccggagggagtagttctgtttgtacttcacttaacgtgaaggtgcgctaggccgccagttgggcctgtgctagctttcacaaaagaattaggcccaaaatctaaacaacgcccaccaacgggaacaagacggccgacgaagggaaccgattgaaaactatggctggctggctggctgcctgcctccttcgccgcataggactcgcagtcccggtggatccccaccgaattaactcccacgagcagccggtccccgcgtcatttacaagttcaccccggtagccgcccgaatggggaagagacaagcaatgccggccccgctacactcgggtcgtcgaatcagcgagaaaaatcgacacttgcactgtgtagaagcacacagttttgtgttttctggatagtaggagtatttttcgatctgaaccaaacaagcacataaccaaaacctcaaaacatgtgtagccaagttggctagctttcaccgagtacagtatataccctactacggatattggccgtctgaattgttcttcagctcattccaagacgtcaaatgctggacaaattcatcgatgcacctctcttcgcgctccctgtccgccacgatctcctgcagcttccgggcattggcgaagaacgtcttcccctcttcctccaccacgacggcgcggacggctccggcgacgccgcctcggtcgaacgacccgtcctcgtcgttcctcggcaccgccactccgagcttcctcccctcgagaatccgcgcgttcgggccttggtcgcctaagatcggcagcatgatcagcgggtgcccgaactggagcccctcgacgacggagccccacccgcagtgcgtcaggaacgcgcacacggcggcgtgcgccagtatgctcacctgaggagcccaccgcgtcgtgaccagcccgcgctcgccggtgcggcccaggaaccccgctggtaggacgctgtccgcgtcgacgccggcgggcttcctcatggcccagaggaagcgcgtcccggcgaggtccagcccgtgagccagctcgcgcagcaggtccgcgctcatcggcgcctcgcttcccagcgcgacgtagacgaccgacttggccggctgagcgtcgagccactgcatgattgcgtcgtgcttgccgttcttgctgacgccgcgggcgccgtccggccgtggcgggagcaggccgaacgggacgaccggcttgccgtagaacctcgtcaggatcgtgaacgcgccgggctccagctcggggcagctccgcattgcgacgagcttggacctctgcagcgtcaggctgtagcgggtcatgatggacacccccgaggcgccttccgtcgcgaactcctccgtggcgcgcttcgcctcgaagctcggcgccgccgtgcccatggaccggactatcgcctcgcgctggtccgcgctcgactcggttggcggagcagacgaggccacgacggctgcggagcaggggaggatcatggcgcacggcaccccgcgctcctgagatgccagagcgacccagtgatgcatgagatcggcgagaacccaatccggcctcttgccgccggcgcacgcggtgtcgaggaacgcggagaacggcgcggcgagcccgtcgaacgccttcctgtgaagctcgaacttgtcgaacgggacgtcgctggtggcctcggcgccgtcggggagcccgtcgacgcgcggcagtgggagcgccacgaggtcgacgagctctgccagctcggggcgaaccggcgggaggcgggcgaggttgcgcggggtggagacgaaggacacgcggtggccgcgcgcggcgaggcgctcggcgaggtcaaggcaggggagcaggtggccgaaggcgagccacgggaagatgacgacgtgcagcggcgactgcgaggaatgggcgtcgtccattttcggccggcgcgcaccggtcagcactcaggcgtcagcgtgtgtgtgagaagtttggctctgatgatccagtcatgagtgtatagggagtactccgtatgcaaatcgtgctagttaaaggggagaaaacgaggaaagattcccgaacgcgatgcgtattgtcgagcccagccgagtgcgaggcagccgggactactcatctcctccctccatctactacctccctcaaaaaaaaaaaaaacttttatccagattcattattttaggaggaaacccctccttagagcaggtataatagagtatgataagccagcgatacaagcatccatattatagaaatcataggtggaagagagagaaaaccggagagagaaggcagcgggcgccaatgcaatcgtcgagctccagcacaggaaacgatgcaaagtcctgagaaccagccctcagtcctagtcctagcttttgcccaatgactcaaccattactccatcatagcaagttcaatagtagagttaactgccggctctaaaattcaccacatcatttaagagataactaaaccccagtagatacatcaattggctacacccatgctttaaccaaggcatcctgtcaggtgttggtaacttctgcatgttcaagttctaattttctattggttgtcccgagctgcaaggggccagagtgcctaggcgcttgtgcttgagccagcgactggattgtcgtccgctttgctctctttgctttctctctctctatcatatatgttaaaatattagataagcaggctattagcccactattgtacctgctctcaaagattgggaagaaggaaacaagtctgattaaaataataaaaatcaactgcttagggatgtgtgggtaggtaacttagcagctagttattatacgtatcatctattggtaccatctattacttacgtgtacaaattttcagcccatcaacgggcgatactattaaacttgctcttagagcaggtacaatagcaggctattagccagctgtaaatatattttaataagataaaagatgagagaagagcagcgggctacagatctgtagccagctgtagcgcggactccaagacgcaatgtgtatatgacaggtgggaccatatattaatagtatagtaagtaactattgtatgaattaactactagattaactataaatgaattagagctagtgctggactatactattaaacttgctctaaattgagttattttggtatcaaaggagattttgactttctgagccgtgcaggtcgattacttgcttgtgtgggccggccatcggatgagcgcctcatccacgcgtcatgaatccgcgtcgggagtcgggactgcacgggctgctgtttggaattttttttatttataattttttttattaaaagttttacaaaaataattttccattttgaaaattgacggaagtagtcgcctaccgccgccctcccagagggcggcgaaaatgacgcggcagccggccgttcgctctcgggcgacggccgtcaacgaaatttgcaggcggcccccttgccgccctccgctagggcgattttatactgtgcggggggccgcctgcaaatgggcggcgagggggggcatggaattttgcaggcggcccccttgccgccctcggggagggcgattttatactgtgctctatatttttgtataaatatcaatagttatcaaatctttttatattgaaaactatacaagattaaaatctccaagactggtaaaatacaattttattattttttaggtcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgttgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggctaacccgtcctgcctgtacaggtgtgacctctggctgctctgagtgtgcgcctctggagctcctccaagctgagaggagcctacttccgtcaattttcaaaatggaaaattatttttgtaaaacttttaataaaaaaattataaataaaaaaaattcctgctgtttgcaccccgtctgcaccagattttttttccgcagattggcagctgcggtagtgacatgtgggccctgggccgcacgttggttacggccgaggagttgcttcttcgggaccgaaacctatgtgcaatgggattttttttttcatttttagatttttttaaaatatttacagaaataatctatcggccaaaaaaattgtaaaactagaccctgccgcccatctctgaggcggcaagctgacgtggcaaacggggaaggaacgggcggtgacggagggagggtttttttgcaggaaagcccttgccaccctctgttgaggtggcaaggggcctgaatgcaaaaaaaccagtcggggccggtcattttgcaggcggccccttgccgccctttggccgggcggcaggcctcgctgcctataaaaggcatgctggccagccctcagccctcattcctcccccctcaaatccagtgaaaaaaaaagaagaaaggggaggagaagagaagaaggggcgaagccctgccggattcagacgccgatttcaggtaatattcatatatcctatatgtgactatagagttaaatattgtgtattttttaaaactttgtttgaataaatgcattatatttttagggttttatctgtactaatctagaagtgcgtattgtagatatcggtaactacgtagatctgctagtttggaatcaatactttaccgttgcattggcatacacaagaagatattacgttgtagatgtttattgcatgaaagagtaatatgatctagttatttcgttgacagatatgtcgaacaaacaaatattccaagtttaccatggcccaggaaacgtccgttacgggccaactggggtagatctgtcagattttattgtatcagaaaggggaattgatagaccggctgagaggagtgtaccttctataaaaggatggttaatgaggggcttgagagttgatccatagacaagtgacataacaatcaatgttatagtaagtcgggcaactgagggtttttattgggaactaatgccggttcaaaactctcaattgtggagatggtatgtggaaaatgcattgcaacgcgggtggcctctagctatggttccgtttgttcacccgaaggatccaggtgtgcagatgaacatggatgatggcgagggaccaagtgctgaagtaaatgagacttctgtggaggaggtcaacgcacgagaggacgggggcgtagtagctccagtgggcattcaaccaggtggagtggccgacgagggggaaactgtcggtgccattgtggatgaaatggagagggaggattctgacaacgagcgtgtagaggaaggtgattcgtcagatgatgagacggatattaatccagcagaatgggctagtgaggatttttctgggctggtcgtctctgaagaggatagtgtgagatgggagtacaaagaaaatgaggttatccagggagcgatttatagtagagcagaagatatgaaggaggcggtaaaacattttgtagtgtcacttcatagagagttttgggttgccaagtccaccggtcgcaatatgaagttcggtgtgttaaggaaaaagatggttgtccctggagagtgcacgcgtataaggggaaatggaaggattattggatactgtcagtcgttaccaagcatacatgttttctacctggtgttcagaaataccacaggaacattacatgtgcatttgttgcatctgagatgtatgcgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctaggagctcttacgcagtgaagaaattcccctcaattgaacatcctggcaagagtgtgctgcaaagggcgttcttagctctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtgtgcctgatacatgataggcacgctggcattctgcgagcgatagaagagttgcagtttgggagtatggaacgaggataccctggtgtttgggaagatgtacagagtaggtggtgaatgcatcatatgggagctaatttctttcttcaagcaattcaagaacaaggagctcatgaacatgttcaagaggctatgtaatcagaactaggagaaaaaaatcaatgagctttggaagagattagatgagttgacagccaaatgcagtgatcagcgtgcagcggctccatcgaccgccgttgctaaccctcctcaagctcttggacctctcccaacgaatagtccaacattggttagaagaactggattggagattcggaaattttctcagtagattatgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcagttattttagggatcggttccaagcagttcttccctctataccgaacaacagcattttgtttggaactttcatgcagaaaaagctagaggagttgcgtaaaaaggccatgaaacatcgagctctagtgcaaggtacccaacagcacaggtttgagatactatgtcaagataaggcaggcaggggtatctaccgcaagagagtgaagcaggagtgtgttctcaaagccgacgacacatgtcattgctcttatgcaaagccgaagctgctccacaggccatgcacccatgtcattgctgccgcaacggagtgtggcataccagatgcagtatatgtgtcacagtactttaataagcaagcaatatatcatacatggagcggcgagatttatgggttcggcatagctggggagttcacagagactaacgatgaagtactcaatattcctgacccatcgaagctccgaggcaaggctggaaggaggaagactcgtcgcatccacaacgatatggacgagtcggaggctggcagggtgaagcgttgcagcaaatgcgatgaacgtgggcacacctacaagcactgtcctaaagacaaggagaaaccaagtgcggcggaggcaggactatcaggatcagcagcagatggagctcgccctacgggtgaaggcactacctccactcgaccacgtcctaggcgtcgtcgtgccacgtctagctacgtggtgtagttcttatgttctatgttggcatgtggatttgcttgtaatttgtttcaaacttatcgatgtgtttatgttttgtcgtgtaatgtcagacttcggcatgtcatgtctttaggtctcgtgatgtaacgtcagactaaggcacctatgtctttaggtatgctgatgtaatgtcggacttcgacacgtaatgttatgttatgttatgttatgttatattatcgaactctacatatatgttaaattgcacgtcatcgttatgtacccttatgtaacatcctgaaaattcaagacaatgaaaatcacgaaaattttgaactttttaaaacttttgcatcatgctggttgttatgattgctattgcttgccaaaccgtaaatgatcaccaagaaagtaaagaaaagaactacatttaagcaatagatatgatttacgggaatatatttaatcctacaaataattatgcacaagatattaaaatcaaataaaagaaaagttattattaacctattttatcaaatattaaaatatttgaataatgtaggtgggtgccataatatgtgtacacatgaaatgatgatcattcaaataaactgagctctatgtatatataatagaattacgggagtatttaattcgatatgtagatcgattttgcaccaagttcctaattgcatttagggattgaaatttgatatattaaacccctccatataaaataaactaacatataaataaattgagctaatgtgctattgtgttaataacggtctcattagaaaattatagaatctttaataaaccttaaatattggacaatattaaattttgggcaaattcacatttgaacacttaatacggtcacctaaatgcttaggagtaaatacaaatttaatttgcaacttttctcaatttataaatcaaccaaaaccctaaaagaagaaaaataggaaaactttgaaaaatatataataataataagaattaaccctaattaaaaattcaaataaattatataaataaaatatgagtaatattaatctagaataaatccattggttggaatgacacaaatattgggtaaacttcatttatacaaaatctaggatttatagaatcaaatttacacaagaaataggctaaaatggggattaaataggaaaagacactattcatcggccgccaggtgtgttcgatgtggtcccctaacccagcccct

SEQ ID NO: 66906 - DNA, 22101 bp, Oryza sativa
gtcggtgagccgctgccccccccccctatttgtcgccgtgccgccgggtagagagggagccgagaaagagaaaggaagggagaagccgagggagagaaagaagagggaaggaggagagaaaccggaaaggagagagagagaaaggaaaagaaaagagagagagagagaaagagaagaaaagaaaagagagagaaaggaaaagaaaagaaaagagagagagaaaggagaggagagattagagtgggccccacgtgtttagtgaatagtaatccccttcttaatctttattagttgaatctattacatgtgggtccgggtggttaaaaatctaattatagaagttttttggtctcgagtttatgacatgtgggccccacttgtcattagctcttcctatttccctttagaaaataattcggtaggaaaaaggaataaacccggggtcccacttgtcaatggatatgtcttggattaaaaataaatcgtttatgaacagtagcttttcgtaatttctcggattaattcaaatttgaatctttacactagcataacttattcattttaactcggatttgagtgaaacttgaacctaaattcatataaattcataagctttccaatgatatataattcactattcaataaaatatatttataattataaattaattaatatcaaatgattagataataattaacctaaatagtgtgccaataaataaaaaaaatggatattgtacagtagcataattatctttaatatatcttgtcactgtagcaaccaaataaattagttataatcaatccttcaaattaatgggtgtaaaggaaaatattagtgccatttactagcctatgtccaaatataactaattccatgacttataaattatttacataaagtttagcctcatattttgtaactaaactataaacacatatagatgaatctttaacttgtttaggagagtaatcacagagctagttgtatttggaccacttaaaaaaaattagttgataccatgtcatgtgaagtagaatatatatatatatatatatatatatagtcggttgatatccattagttaaccaaatagagccatcttaaaatcaacatgtattatatagcttacagtaaaaagaaactactcaaatatatgatccaataataagatattgttgcttacacatatactatacatcccattatagtggtacggtatagtattaatttgcgtgttgcatatatgaaattaagagggagtgtatgacaaacatgtatattagataaatactagttataaatattgacctcatataattataattatagtttaactgtaaattaggattattcattgtaaaattatgtgatgggataatctgtaaccataatatgattaacctaaacaactctaacatacaaagcatggataattattaaccttttacaatttattgtgacaagtaaaatatgttcataattaaagtaaagcttccatcaataaaataaataatacaaatgattcactgtaattatttgattgatcctaaatccatccgacaacagaacctctagtatacgaccattttatttagatagatgcatgtgtagccataatccttccatagccattagctagactaaaccacaaattagccagatacgtatctcattcatactacattggctagctcctaaatagaccaccatgataacagaaagattaagaaactttagcccttagcatgttggaacccattagcaagcgcgaataatatgagcaaccttaggttcaacctcaacaaatatattttgtttgtgcatatttgattgttgcttgaatattggtttttctcgcgtattatagactttgtgtatcggatagtcgtgaggcaacgtcagcaacttccaggaggtgaaggttgatcaagaattatatcaagaataaggactatcctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattacctttgggaaggtaattgagatgcggcatgtagagacatgagcgccacattgccatgatgttgatgacatgatttgtgaaaggagaaataaaattaaacaactattttcgactggggcggacggaggatttgggtggtatctggaaaaggctagtaccgtccccggtcaattaaggaccgagccatgaagttaagcatgaaacgaccctcgtacaaccgcacttctcgtatgggtatagacctagcggagtagatagccgagcggaggcagtatccctgcatagatggttcacccctgagtgaggcaggtgcgctacggtgggacagccgttgaggtagggccgagaggcgtgccctacatcggtgtcgccattggtaggactgccatgagtgtgtgagagagagaacttaacttgagccataatttaatatgtgtgtgagacttctctttcccgggagcgccagaactcctctcactgctagaaacatggacgcctagagtgcatgaggatttaagttcatggagcgggtactgccaatgcgaggttatcaaaaggctttgccgtggcgcgtctcatgtgttgggacgaggctcatgtgttgggcagtcgcggagtgcgggtaaagtgtacatccactgcagtgtgagtaaaccaaatctattcgaatagccgtgctcgcggttaatgagcaccgggacatgtattacacttggctagactctaaattcttaacttgtgttggatgggatattgcatggtgatttttatgctgatggagccacttcctgagaggagggaaggtggacgtcctcagaaaaccatgacgactcaatggcgggaagctatccttgggatcacaatggatggtggacagaaccgtcgttgtttaatgtgaacactggaactaaaatttgatcagtctatgataggtcttaggcttgtgaaaatatttgcaaaacgcagctttatgcaaaagaacctgaaaccattccttgaataccctctatcatatgcattgttgttgtggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatattattttgtcttctgctgttgttctctgatagttgttggcctacctggccctaatgtaagtatttaactcttttagtctaaattcattcgtgatatgttgtgatccaactatgtatgtgtgtaccaactactgatccagggattggtacggataaacacagaagatttccgatttccaaaatcgggggtctacaccttagtaacgtttgataaatttaaatagcctgtactctagttgtacataattattctcatgattttattactatttcataattttacaagttatcttttgttttacattagtactttttgaattgttctaacacgaaacactatatttttcagagatggcacgtcaggatacacctcagttgttggacccggcgatagatcaccgacactggtctcaccttactgcggtgcagggggctcagcttgggacgttccgggcacggacgtgcggtgagctacttacggttcacgactcctttgtcgagaggtacgaacagtgtattactataacttagttgcgctgtactaatttttataatgacatattaatttgttattacaggctgcgtgaggccagagacgcacacttttcacttgccgtgcggtgaggtagcccctaccctacaggacgtatcgtacttgttggggctaccgctcgcgggagacgctgttgggccagtgaccgcgggtgtggactggcaagacgatctgacggcatgtttcgcactagtacagcgcgcaccgcatctcccgctcgagccgttggcacaccaccgcaacaccggacctacgaagaggtgactgcttcagttcaccgtgagtgttttttgtaccgaaatgacaagcgtactacatatttagtccacaagtaaggtgcctaacattttatcgaacgcttgcaggtcgagcagctacaggcagaggccgacgagtactcctacagccgctgtttggaggcgtacttgctctggctttttggctgagtgatgttctgtggcggtcacgggcacgcggtcgacaagggactcgtgcactaggccaggagcatcgccgacgccgcggtaggcgaggtgcctcagtggagctggggttccgcgttgttggcggctctgtatcgtggcctttgtgaggcttgcacgaagacggatcctagcgcgacctttggtgggtgccctctctttcttcctatctggacagctgagaggattgcgatcggtctgaggtggaccagcacgcgtacgaggagtcactgtacgcggagcgaccagaggtcaactaccctacgatcggtactctgtggtgccgtcgtcaggtacatcacatcgatcttctcgtattgttaagttaattgctaagttcattgtacatcacatcgaacgtctcgtattgcagcaccgatgggctcacgtccaggttaggcggtcgtatcctgagtttgttatggagttcgaccgccttctgccgattgacgtcgtgtgggagccctacagtgtcgcggctacccaggctcgtgcgccgttgggtcagtccacactctgcaccagggaccaggcgtactggatgactacggttccgatggtcttcgacatctgcgttgagcctcacgcccctttccacgtgatgcggcagttcggcttccgtcagccctttccagtaccgtttccgacgaccgtcccagctgttgttcaccggtaagatctttcactatgctttcagttgttgcattaaaatctacctgtccacaataatttgcaacatctgtcgattcacactaatatgacacattaattcgcaggtactcgcgcaagggtcagcagtcagctggcgactggcccgccaagttggcgacttttgttgaggactggttgctcgcaaccgaggaggtcgtggaccacgagggagagccacacactgaggaggcgtaccaggcctacctacgctggtaccagccacgcacccgtactagggtcaccttcgctcccttggagcagcagccccacgttgtgagcactagagacctctacgccaggcaccgggaccaggacttcgctcgtgctgtgagtaccctgcatcacaccattcctttatgttttcatgtctttctctttatcaaattttacgaatatgtacgaacaaattaaccatgcaggtcgacgacatcaaccgggtcgtcgttgacggttcaacgacgatccaacgtttaggcgcggggattccggtacccgtagaggagcacctgacgacgtacacgcagatggtggagtcgatgcgctcgattctccgagtgctcacctgtcgtgcagacgacgttgctcgggcagacgtagctgtacagcggccacccgtaccgactggtccccgtccagctgcgcacgttcctaggccgactccccctccgcacggaggtaagtatttttaaggatttttctgcacatgcctcgcacatatatgtgagccgtttcacttgccgattgcttcagggtttcgtgcaccgttcagcaccccgccttcctcggctaggccttctgttgtgccccccacaggtacttaaaaaataacattacttcgacaatcaatttacatgcattttatgtcttagcttacaagggtcccgttgtcgatgtgtaggtttcgcccagttcgctatgacgcaggccgcccacttctcccaggctgcagggtcagcgtctcaggcagctgcatcgacctcgcactcagcgcagttctggcagtacaccgggactttgtcacaggcagccggcacgtcgagtcagggtccaccactggaccatgctgggacctcgtcggaccgcttggtgccttccaccttgctcttcgacatcactgacttcgacttcgcttcaggctcgacagaggagcgtggtcgcgacgcggggcagggccagtagagcagtcttctctttgtttatttgcttcactttccagtactgtatgcttgtgtaatgaatacgttgttgttatatgtgcacgatacctgttggcgcatgcacgatacctttcggcgcatgcacgactactttctgccgcaccgatgcagcctcctttattcgcgtacgatacgagtatttgctcgccatttgccgcatacgactaatgtaactttcggcgccgatcaggcatgtaactttcggcgccgatcaggcgtacccaccatgccccgccacgttcacatgtcagggatatcactcgattttttgcgcccatataagtcgccttaacgagtgaggcctcacaatcttccagaactcagtcacattcagtactctcttccccacttgcttcattacaaatcctaccggctttcgtcaatggctagacgccggggtgttgaggatccgaactggcgtagcaatacttgtgtatacctactaccaccttggtgccagcgtcctctctgcctatgcggtgatcgatgccaactaatggcttcgaggaatcctgatattcgaggaaggcgcttttttaggtgccctaactatgatcgtgaggtattttattatctgcatatgcttattcattccgtatgggcaatcgttttattcttcgtaacactactctattcggcagacccgcactacggcttacgcatacatcgagtgggtcgatacagaaaatcccgttctcgacctaaccacttgtttacaagaaggtcgctggtatttcgcatccaaaagtactgagcaatacttacagagaaaagcggcttatgaacgacaatgtcgtgaacaacagagcgactggcaggtgctaactatagcactccctccatgggaagcccgtccaagatgcaggtgtggtgatcgttgtcaggttcttcattccataaagcctacaacattgggtcgaaggttctttgtttgtccaaatattcttgacgacgatttcatggtaagaatattttgattacatgaatcctttttttctcacaacatttactaactttgctcgctttaaatctattctttcctcccaggaaccaccaaggagatgtcaatacagagaatgtatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatggaaatagttgtatcatgttcaaattgtactactatttcttcatgttacataactctccttgtttaagtccatataatgtttctacgaccgagactgcgataggcctatattaattatccgagtactaatacgtcgaataagttacaaaataataccttacttaacatatgaaattgcgaaacaaccaacttcaatacatttttataacaatattaacatgttttaccaataaatacttctttatttattattaacataacatagaaaaatcgtttggccgtactttttgcatctgggtcccttgccgccctctactggggcggcaaggggcccaaatgcaaaaagtacgagcgcaacctctttatggcggcaaaaattgcaattagccccttgccgccctctgtatgggcggcaagggggttattgcaatttttgccgacggcggcagacggcgcggtcgacccgctgtctgccacgtcagcttgtcgcccaccactggggcggcaggttctagttttgcaatttttttggccgatagattatttctgtaaatattaaaaaaaatctaaaaatgaaaaaaattctgtgcaatggcagaggatggtaggcatggtgcacatgagcgaaacctatgtgcgatggctgctttcgtcgagccactgcgcgattgcatcgcgctctcacaggtgcagttgtctgttttgggagcgtgattgtggtcttgtagacgggcatggccgcatggccgcaagggcatacattgccgacaaaacatgagataacttctgccaaaaataattgaaaaatataccgttaaaattttcttttcttagaaatatatgacaagcaaaaaggttttagaagagagaatataccgttgtcacgagggagtaaagcaaactcatgacgacgagatcgtatggtgaatctgcaaagtggcgatgacaacaacgatatcgcgggactttggactatttgccactctcttcaatagcacattctcaaatgccatcttccctaataactctaattatttgtgttgaaagtatgtcatgaggggctttgatcgaggatgccaaaaccaccacacctatgaagtgctgctcgacgatcaaggggttcgactggggtgaagccgagggggcaaggccgaaggacgaagctagaagggttcgccaccctgtccataggacttgtcgtcaagtctctgtcagaggcgaagccggaggggttcgaccatgagctagatgccttcgccaaacatgcctgagagtgcgggatggcccaagaaggccattcgccacacatgggctggcccacgaagcccgactagggccccatagctaggatggacactatgtgccctcactaatgtccttatcttaagggtatcaatataaattctcctatacacactaaaccctagtgagtatgagtctttactaagactataaaaggccctataggggcatgtaataggggatccaaaaaaatatcatcaattaataccttgttttactattcaaccactccaccgagagaaccacgtctttcgacgtgaagctattgtcgcttcgacaacaatttgccatcgtgattcatcaaattgtttctattttgccacttttaactgccaacacactaaaagaaacagaaaatgaccttactgctcctctcatctcctctatcttttcttctttcctcatctctcctatgttattcctctcctacgtgagaatcccatgtactgttgcagttggatggatggcgcgagcctccgcgatttgacggcgaggtctttgacgagcgaggatatgtcgaggtcacctcgaccacaagcgagatactcgcgctggagcatacaacttgacccatgccggctccctccccccctcctaaacatccatttgcaccgtttctcccaacatcacaggatctatgcgaagggcctgcaaccaagatgtactaccttggccccgatgacccattcgatgaaccatcaaccattgtcgcatccattgcttgtcctgctatccggttcatccatggcgctagccgtccctactgcttagcttgtctcacaccagagattggttcatgccatgccagagaggaagaaggtagaagggagatgaatgagagggtaatgaggttattttcttatagttttgctaagttgtcagtcaaaaataacgaaacagagacaacttggtggatcacgatggcaaataacaaaagttattgggaatgataacatttgagaatgtgacatcgaagagagagtggcaaatagcccaaaatccctaacatcgtgcccgacaaatgcgaagtggttgtttgcggaggtggacccggtgacgtcgccactacgcgctttgagtccacgagagtgtgggcccctatcatgtcctgataaatccaccccgaattaaaaatcactttataaaagaaaagaatagaaattattataaatctaaaagaaatctcaagcactaaacctctgtaaatattttctgctttaatgaaaatacattgctaggcaaatccctagcagctttccaggtgattttttttttcaaattgagcttggagtatttttcctaaaatctccatgttcaaaattggtccctcgatttttacttgatttctagagcaaaagaaataattttaaagcaacaaaaaccaaatttgtagttaattaaaatgaaaacctaaaaataaatctctccttctctttaggccatttccggcccaaagctcttagttgctctttcggcccgccaccggggtcctcttctctctctcctccttctcgggccaacctcctcttaaataaatactctctccgtttcacaacgtaagtcatatatatatctagattcattaacatcaatataaatatgggaaatgctagaataacttacattgtgaaacggaggaagtagctacttgttggttttacaacgccgtaatcttgttttgggtttttttttcttgtaactttccttgtaagtatttttttatgcttttgtaaaattacactattgggttaggcctggtagtattccctaaaaaagttttttttgttttttaagttaattaattaaacttgttcaatataccggataaaaaaatcccttttttctttgttaacatcaattccacatggacgcaatatatagtctgccggcctaatgaagcgatcaaacctccagactccaaagtccaaactcacctacggcctagctttgacagctacgtatcctatacgaaccatctcattattatgggaaactactctaaactcgttgttatgaattttttttaaaaaaaatagattaatacgtgttaaattattatactaacatgcaagatcaaattctatttctatttctatgagttgcaactgaaaaaaatttgactacaaatatacgttaactagatattatttaatttgtctttttcgttgcaacttatagaattcaaattttaccttgtatgtgtatagagtgatttatcgtatattaacaatttatcttgttattttttaaaaaaaatcataatcatttgaatcatatgtaaataaggattgagaatttagaatccccttaccattattaccagcacatcaacgcccgtgctgccgcacgctgagcaccgtgcacgagcgcatcgttccgacgttccctttctttcgtcgtggactccggctactcctccgctgccgccgccgccggcggaatgcacgtcgtgatctgcccattgctcgccttcggccacctgcttccgtgcctcgacctcgcccagcgcctggcgtgtggccaccgcgtgtcgttcgtctcaacgccgcggaacatatcccgcctccctccggtgcgcccctcgctcgcgccgctcgtctccttcgtggcgttgccgctcccgcgcgtcgaggggctccccaacggcgccgagtctacccacaacgtccctcacgacaggccagacatggtcgagctccacctgagagcttttgacgggcttgccgcgcccttctcggagttcttgggcaccgcctgcgccgactgggtcatgccgacgtcgtccgcacctaggcaaacactaagttctaacatccacgtgaaccattcatgagatggaagaagagaggcagaaccattgaagacatacgcacatgatagaattgcagagaaactcgtcccgcccaggcaccccggcgcccagcggtcgcctcctttgcccaatcactcctcattcgaacacgctcgagcgcgctgcagagaagctcgtccgctcctcgcgccaaaacgcgcgagctcggtcccttctcgcctttacctcccctccccttccttatcgcgacgtttttcggtctctgcttggtctgcaaatgggccgaaagcagctgaacatcgcgcatgagacgaatgggaggaggacaggaacgcttccactgaacttgtgccgttggatgtggaagcaacggcgatgcggaaagctacgtccctctgacgtagaatttaatacgtcgcgcagtaatgaagcaatcagcccgatcggagcaagcttggtaaacctccaaagtatacaaagtccaaacccacgggcggtactgcccatcgcatcatcaggcgtccgggcggtattcatcggtcgcgcccgcacatcgacgcccacgccgccgcacgctaaacccgcccgctcggccgctccacgcgcgcaccggcccccttcttccgtcatggactccggctactcctcctcctacgccgccgccgccgggatgcacgtcgtgatctgcccgtggctcgccttcggccacctgctcccgtgcctcgacctcgcccagcgcctcgcgtcgcggggccaccgcgtgtcgttcgtctccacgccgcggaacatatcccgcctcccgccggtgcgccccgcgctcgcgccgctcgtcgccttcgtggcgctgccgctcccgcgcgtcgaggggctccccgacggcgccgagtccaccaacgacgtcccccacgacaggccggacatggtcgagctccaccggagggccttcgacgggctcgccgcgcccttctcggagttcttgggcaccgcgtgcgccgactgggtcatcgtcgacgtcttccaccactgggccgcagccgccgctctcgagcacaaggttgcaccaagtcctactaatagctcaatctttgcactaaccttaattacataattccatcattgatgctacgttattcgccttaggtgccatgtgcaatgatgttgttgggctctgcacatatgatcgcttccatagcagacagacggctcgagcgcgcggagacagagtcgcctgcggctgccgggcagggacgcccagcggcggcgccaacgttcgaggtggcgaggatgaagttgatacgaaccaaaggctcatcgggaatgtccctcgccgagcgcttctccttgacgctctcgaggagcagcctcgtcgtcgggcggagctgcgtggagttcgagccggagaccgtcccgctcctgtcgacgctccgcggtaagcctattaccttccttggccttatgccgccgttgcatgaaggccgccgcgaggacggcgaggatgccaccgtccgctggctcgacgcgcagccggccaagtccgtcgtgtacgtcgcgctaggcagcgaggtgccactgggagtggagaaggtccacgagctcgcgctcgggctggagctcgccgggacgcgcttcctctgggctcttaggaagcccactggcgtctccgacgccgacctcctccccgccggcttcgaggagcgcacgcgcggccgcggcgtcgtggcgacgagatgggttcctcagatgagcatactggcgcacgccgccgtgggcgcgttcctgacccactgcggctggaactcgaccatcgaggggctcatgttcggccacccgcttatcatgctgccgatcttcggcgaccagggaccgaacgcgcggctaatcgaggcgaagaacgccggattgcaggtggcaagaaacgacggcgatggatcgttcgaccgagaaggcgtcgcggcggcgattcgtgcagtcgcggtggaggaagaaagcagcaaagtgtttcaagccaaagccaagaagctgcaggagatcgtcgcggacatggcctgccatgagaggtacatcgacggattcattcagcaattgagatcttacaaggattgaagcatctcaggatgtacacctgcaacagtgcaactacaaaatccttggaataaaatgatttttgttttgtagtccacttacccaaaatatgcaaaggccgaacggtggggaaaattctaatcctgatttttttttcatttttgtttttctttgttatttatcaatttgataccgcccagacaaagttgaaatttaattgtaaaactttttatagtacatggaacacgcacaacatactcatttcctgtagagtaatgctccggtgcaatctacttgcagtattctactccgagtagaattaatctcgaccgtttattttaaagggcaggtaagtaatctcctaatatcgtttaggggtaattttggtttgggatgttttcttcggttcgcatcgcatcaggtccggactccgtcgcatgcagacacctcgctattcctcccccggcctcgccgccttgtccgccccctccgtcaccgtctgtatcccccgccgtcgccgccttgtccgcctcctcagtcgcatcgtccgtctaggagcggacgagcgtggcagcgtccgagcgagcgacgatcttgagcaggagttctggtggtagtaaaaattctggcatgggcttcggcggcggcatcacgcacgcacgcaacgtcatttgcgtggcggcatcgtctcagctcattcgtcttcttgtcgttccgattgtttcatggattacatggatcgattaagatcttgcacgaccaactccgacgaggatgacatggtgattgatctatggattggaaaacgataatacccctacgcgaattatttttcctggatgaaaacacccctccacatttctacttccactaattctggtgggagtagaactagatctcagccctacaattaaatatgatcaagggcccaaattactttctactccgagtagaaaacaccggagtaggactgtttcctgtatgtgaaacttttttcgagattttccaaagaaaacattcattattcattatctggcatctcggagagggcgagaggcaagcatgatgcaagtgtaccatgctaataatactgtacttaggagactactgactactccacgcgggcgtcagtcgtcaaagttcataaatagccggcagcggaacgtctgattctttaattggtggagaacttaactttgcactcagcttgacaaattgtacaggcaagatatcaagatcacgggctttttcatctccaaacgatcacaatcttaacttaaacaaaccagggtggaaggtaggcaaagaagaaaagtacaaagttgcattgtgaagttgcagtaaaaaaatgtcggatgacatgcagatacagcaaatgcttgacttcctcggtggcggtgccggcctgccggcttaactaaagtagttccttccctgattggatctttcaaagtctccacgactccaaagtgcaaacatatatttgagcggttcagcccgtgctaaactggaaactgttttttggatggacgcccacctatttattacatatcaactaaacagttataatttttttaaaaaaaacaagatagattaatatgtaatatatcattcgacaaacatgcaaattcaaaatcgacttctataaattgtagcgaaaataacaaatttaattgtgaattaatttgttatttaattgacatgttagagtttaatacatatactagttagagtttaatttgttgtttttgttacagtttagaaaagttaaatttgaacttgtattttttggagtgatatattacatactaatctatattatcgttttttttaatttttttataactatttagttaacatgaaatgggtggacgttcatttaagatattagaatccatcttcatcccgcgtctgctcgatgatatccatgttcttgaaatagaatccagattgctctacctctgccttgcgtgttacaggaagaaagctgctatacgttcgaccgacgcgtacgactcaacggcggaatacacgacgtgagccagcagcccagcactgacttggttatatggtttgctgctcccactgtcccacagtcccacataatccacgtggaagcacatcaaagctcatatataaagcccaaacttcaggcatggaaaattaaatcaaacaaaaccgttgatgtagatgtttgtaaaaaaaaaaagagagatgaaaaatttagaggagaaagggaggagactaacaaagttcagcggcgaggtaggcgaagctgcgaggcagccgcccggtcccctccccactcgcggctacctggcacctctccgacctggcgtggcggcggcggctcccagctagctccggcctggcgcgggcgagggaggcgaagctgcgaggcggccgcctagtcccctccccactcgcggcggcctggcgcctctccggcctggtgtggcggcggcctggcgcgggcgaggaaggcgaagcggcaaggcggcgatgcgaccacgagggatttgggcgtcgggcggcaggaaacggagagcgtgggctgaaaacggaggctgcaggtgggccggcgcagcagaccgttcgattagatttcaacgctccagatcgctccaatgtcacaccatgccatgccataacaatgtcactgaatttgaatccctaccacacggtcatcaccgccggcgacagctattccttgcttgcgctgaggtctgctcgtcgtcgtgtgtgttcatgtagggaaaaggaggatgtaggaacactcagaaaagtaagaatggaaaaggaataggaggcgctgacatgtggatcctacatgttgattcagcatgttagactaagtcaatgagccatgtcagcaagaatcgctttcaaaaccaccgagtgattttgtatcagttttaacaatttggggttcaagatatacggttaaaggttacaaattagattagacctatatttgagggagtcaaagtggacttattctcacctagcaacacttgagtttcccaactcaatcctctcgttttctacgtgcacgtttttcaaactgctaaatgatgtattttttgcaaaaaaaaaaacctatacgaaagttgctttcaaaattatattgatccatttttagaaagaaaataactaatacttatttaatcacgcgctaatggaccgctccattttatgtgcaggaggatttgttcccaactgcatctaccgaatgcatccttattttgacaggtaaccaggaaggcaacaggcccggcctgctcctggccagcatgttagactaagtcaatgagccatgtcagtaagaatcgctttcaaaaccaccgagtgattttgtatcggttttaacaatttggggttcaagatatacgattaaaggatacaaattagattggacctatatttgagggagtcaaagtggacttattctcacctagcaacacttgagtttcccaagtcaatcctctcattttctacgtgcacgtttttcaaactgctaaatgatgcatttttttgcaaaaaaaaacctatacgaaagttgctttaaaaattatattaatccatttttagaaagaaaataacaaatacttatttaatcacgcgctaatggaccgctccattttgtatgcaggaggatttgttcccaactgcatctaccgaatgcagccttattttgacaggtaaccaggaaggcagcaggcccggcctgctcctggcccaaaactcgttgtcctaataccttcacgggccggacttgggcacggattttcggcccgtacaaaatgggcttttcttctacgcggcccgatcagacccggcccattcccaggtctgccgcggggaaatcgccttcgggcttcggcccctttgcacttttgcagaggagcaaagcttacaatagggcaacccaaaccaaaccctggccaaccccacctccaaccccccgcgcagccgaaggaatcctcgacggcgacgacgatggccgccgcgacggagaagacggccgaggagatccgccgcgagctccaggagctccagcgccagcaccgcgaggtcggtttctctccctctctccctcccctgagagaccaccctgtactcagcacgatctcctctccccgtgcgcagatcagcgagcgcctccgagacccccgcggcctccgccgcggcgcgcccgccgctgcaggacccggcgggccccgcccacttcgcggattccctagaccagtacggcgtcgcgattgcgtctcctcttccctttccctttattttgtattcgtgatttgatttatttccgtgttcttgtgttgcaaggctgtggatttggtggaccagtctgcgcctaagcggaggattctatctgcagtggttaaagtatccgcctaggctttggttttttattttccttagtcaaacttgtggtttgtttgtcgataaccctaatattctgtgcatttgtttggtgtcatgaatggaggtggaggatactgaagctaaggaggatgtcaagaaggaagcggaggcagaggggccggagggcggttcggctgctgctgaaggcggtgagaggagggatggtgggttcaggagggatgggagccagcgcatgccgaggagggtgagtaggctggaactataggggattgcgggttgagtttgcttaactgtattgttttggttgcaggagtttgatatgtcattgccagaacctctcccgagggaatttcccaaggatgaggatcaaagccttgtgaagaggaacaagaggatgctggggaagcttcttgtcggtacattagaggtaaccgattcaatagacatacaaaggaacaatccatgggtcaagcgataataagatatcaacagttttcagtgtttcctctccaactgatacacacaaaagaaaattttcagtatttgttaactagctttatcttgggtatggcaacctgtcaattaggtaggaatttaatggaagtactagtggcaagccacccttagtccccttcattgtgaatatttcaaatcagtgtaattgatttttccttgtgcttggtaatccagaaatttcagcaagaggacaaaaaactgtccaacacagaggcttatatgcgcagatcagaggttcagcgaaaggtactaacaatttctcttggtcttgggccaatctacatttaagcatgatttagtggctgatgtcagttgcatccactttattcacatgatgacatgtgctaattagaaatttgattttcatacatggaattatgaatgtaatattgctgttggaatttaactattgtgtcccgtgccatgacccatgaatgaaccaaacgatctcaataaaacacatacatcaacagaaaacgtcttgtctcctgatactacatcaatgaaatttagataagtagaatgcatttttcaagcagtgttatgtttttctgttcctgtggtcctgaaaatatctattcccataggaactatctagcgcacattcactttatacaactacctttttgttgctatatgcattgccctagtagaactttggacagtaccatgagttgaatggaccgtgttaaattctttttattaccattcttttgctggacttaggctaagtgatcttccattattgagatatcgatttcattctctagggtctcagttctttctttcaaagtaatctcgcatatactatggtctagccttgattttattctcgctattaggtctgatgtagcatggaatattgaaaaagattgcgtgaatgtaggctgatcaaaaggctcgtgaggaaagtgaaaggttgcggcagcaagagcgagagcaagcaatagagaagcgtaagcgtgatatggtaagctcacatcagtgtttatgacttgcatttatttatgattggttcacctgagttaaattgatgagtttatgttgcaaatggtttcctgatatgctcttgaatagatgctgcgtgctcgagtagctgctaaggcagaagaaaagaggttggagctgttatacatgcagtgggctgagcatcacaaaaagctgtccaatttcttaaggtcgctttacttctttgcatcattctgcacctttttttatccatgaatggggtccctttttgtttccttttgttgtgccactttgcaatatttttatctgtatttatcttactcttttatgaactggtcttattgtgtgctgcaggttatttttattcctggtccaaaagtatccatattgacaattaaattgagggaagatgcgtttctgattgtgcaaatcttgatgtttgatgttcataggggtttctatatccattttgctaaattacacattagtatctttttgaacattattgttgtttgtcaggacaactgcggaaccaccaatttactacatgccagctaaaccaataattgatgatccggctattgctgaggagaacaaggaaaaggtattttctgccctatataagtcaaagtaaaaacgctaagtttacaaatttttgaaggatgaattgcgaccctttatacacacctccatctacatgcaacttgggaggcagaacactacagatgtacacaatgaggacaaacttgtgcctactacaaataataaattgtctattttgctgctgtagtatttgtgtggcatagctaatttcatcatagggcaccatcagaatgccagttgcctgcatatatccagtcctgttggtttctgctctgtcatggttcaatcaaacatcaaataagtacaacggctaactgatcagccagctatgaaattgctgcccccctcccccgcattatgattattttggtgacatgatataaaatcttaccaaaaaatgcatatcgaatcagtaagatttctgggcacttgaaagtacgtggtcagtgctatgaatttgtcatattttacaaagctttatacttgaaagtgctctggtggtttgggtgggactggctgtattcgataactgtgcatcaatgctcttcctttgcatgtatggagcatattgatctaacctttcacgggatagtccttggtcaagtgcaacatattaagagaatgccacttccgcaagtcaatactcatctttcacattttgccatttacatcatatgcttgctagtttcctgggcttccttttttgtacaatctggggcaaccgatttttctttgtcctcttcatccatcatgaactcatattcaatgttgcaggcatttcaagaatggaaatctgaacgcagggctgagctaactcagtttcaaaagcaagtcgaagaacagtacatgtctaatgttgagaggcagttggaaaggatgcagaatgcgcggaatgcacggaggggtaatggtccttcaaacatgcaagaaatggacaaggagctggacacgcacagggcggagcatggtccaaaaactcgacgagttcttgagggtggcaatgacgatgaggatgatatggacgatatggccgtggaagatgagctgatggatgaagtccttggcattaacgagccaatcagcgatgagcaaaccaagccgtctgaagaagctgctgatggtgttccggtgtctgaggaagtgcaataggtaatttgttttgtattgttgcgaggtaggcatctaggagttccacatttgatatccttcagctgccctcattttctgacgcttgttgtatgtctgttgacgcttgagattttccccgctgttatcaagccatatattgttgcgggatgtattgccgttgagcgatatactctgttaatcattgcatcctttgcgtttctagtataaatcgagcaatttactgatgaatgttggcttgcccagcgacaggggttatcaaactgtcttaagattaccatgatggttgacatacgaaagtttagaactattttctgaaaaaaaaaatcacagttgaactgaaattcgttggagcttaataagaagcttgccgactgtaaagtaattccaatgggggtatatgttaattctttacaagaagatctagatgtgtggccgcatcgctgctatttattgttcagtctcgctcagggaaagccttctccaagaaacttgcaatatctatttactgttcaatcttgctcggggaaaaccttctccaagaaacttataaatcgtc

SEQ ID NO: 66907 - DNA, 1502 bp, Oryza sativa
aaccaccgccgtatgtgcactaaagaagacaggcaatgtatattactgatatttctttccaaatatatgaacacacacttgaccttgttttaccatgcacaaaaatgataattcttttgacacagcctattcaaatgcacgagctattatatgctctacatctatgaatgcttcgagaattcacacttaactatcaacttgcaaacgtagatgttgcattgaatagtcataaaattatcgtgttgtctggtggagctgccatggttcacccaacgttgagttgtattgtgaatgtttattttaaagctaaagggttgatataaaagttcaaaaaatcaaataatggatcaagtcaccaacaagttcgttgtactttgtactttagaacacactgatatactaagaaatctttcctgaagagtgtgatagctatactacgcaatttatattctttcttctatgcatgttcagattgtgcagcaacaaatatacccaatgctaagttgaactttgaaataattaagtacaagtcaatctaccttccagtgcctggcaaaacaagatcaacttcttcataaccaccttctgctgccctaaccatgcttcctcttatgtgcgaaccacgtactgctggacctggctcatcagcagcaactagtagaaatccctttgaagaaattgtctcctcatgatgcagtgcaacactacctgattaaggtgaaaaaaagactaagatattaccattaggcaacaaatggaagtcaaaagctgaagataggcaattggttgatgtaatgatataaagaatctggtgtagtcctgacttcagatttagtaaaaggacaaattttcagaggaatataataaagagaactcagatgtacttaaggtttagtacgtacattccgtttcagctgaaattccagtactttcaagagcgttctgacatgatgtgatacgcttcaggtgattgggagctcggaaatggattcccaatagcatgctatagtcaattatagattgggattccaggaacatacaatcaagagctatctgcctgaaaatagtacaactgttggctctcaagatatcatcgtcaaccatgttaagaaaaatagcacagcagaaatggagcagtaatatgcaaaactgaactagacagctggaattcaatctcttgtatgcatggtcggacactgcttaaaatctggtttgcctctttaatctagttgtttatatttaaaaaaatctatttattgctatagtataaataaaaattgtccatcttaagtattcttcagatctcaagaataggataagaatcaatatcaaaatagtagaaaataattttgatgtccaccaatcatgggactgaagcaggaatctgcacaagtcatttaaatctactgttctttttaattttccagaagggactacccagtgaacacaatctccagaagtaacatcataaacggtaagttatggaacctggacttcaagcc

SEQ ID NO: 66908 - DNA, 1226 bp, Oryza sativa
atgtccccatttggaagggtattacccctagccagaataaaaaatatatatgagattcaaattacattgtgtggtgcttgcaaaactaaattgcccaatcgtaaagcaacgcaattagtgctggacagctggagagtgggggcagtggatgattgcaaactttgcgctgattttaatgtgcttttcaatatgtgggaagaacacgatgaagcacttgtaattcctaccaagaaaaaaaaatgaagaatacgcagagatagacacgagaattatcacacctctggatgctccccttgcttgtctctgctcgggccatgtcaagattttaccagaatagctcagaagccacaagatgcattccagaagatctgaaacaaggcagcaaaaactatgatccagtattcgagcataaccaattctgaccgaaaacaggtttaatctcccagatacatcgaaatacatcgcagacataacaactctaatgccttcagcaaagcagatttccgttaccacgtacaactgaaagcagttgcaaactttgcaatcacactagcccagctcaaagtgacaaaaagcaaatagagaaaactaaatatcctcttgtactgttcaagcaaaccggataaacgctgctcccagaagagcatcatctcgagctcgcatcaacaagacagatcaagctacccagaacgactcctggttacagcgcaagcggccttccagatcaccgcgccaatccaagcaagcaagaacgtacctcagctgcagcagtagcacaacgaggaaggagaccacgtggagccccggcatccgatccgcctccgccgcccccgagccgagctgagctaagctaagctagcaaatgggatcacggctcaagcagcagcgaggagggagaagaggagggcaatcaatcgaggaggaggaggaggaggggaaagggaaacagtgcgaggaggaggaggaggaggaggcgtctgggccccggggggaggcaagcaaatgggaatcgcctcaccaccacgttgcgggttcgcggggcctttgctggcgccgaccaaatccccccacatccagctccttccccccgcgccccctcagatatttttttctctactctctccactcctttcggcggcggcgctcgcggagagagagagagcgacgcgaacagaggcagagcagccaggttggcgcgcggcgaggggggggggggggggggggct

SEQ ID NO: 66909 - DNA, 977 bp, Oryza sativa
  unsure (1)..(977): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcatgctccttagccaaggaaagccattcaaacaattagaatctttacctgaactttcaaataaaaattgtcatcgcttgcagttgggtgaaaatctggggttctgaattctcttaaagagtcagccttcacaacagaagctacaagtgtgatgtggccctcctttgtaaacttaacagcattgccagagatattcaaaatagtttgcattagcctcttttcatcaccgatggcacataatggcaagtctggtgccaacataactgacacagacagtctcttgatggctgcgattggcttgatgaaactcattacctgtaagagtaagacgaagtaaaatttcaggcaagtgcaatttgcatatttagtcattaaacaaccataaatgatgaagtttcagagttcagacctccttgaaaacagcatgaagattgaatgctttaatctccaattcaaggctaccatcctcaagtttggaaagatctaacacatcattgatgagtgttgctaaaagattgctgcttttcaagactgtttccaccatcaagcgctgctcaggagtaagttcggtttccaaaagtaaggacgaaagggctattattgcattcattggtgttctcatttcatgattcataacagccaggaaatcattacgagcacggatagccatttcagcctcacgtcgagctaaatccagagcacattttgctccattagcagatcacgcgcacgcatggactcttcaagaatagctgcatgagaaagtgcaactgcaacctgaaataaaagagaaagatgattaaaaaaacttgcttaccacactgcct

SEQ ID NO: 66910 - DNA, 7212 bp, Oryza sativa
  unsure (1)..(7212): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagagaaataaaaaggactttataataagtggtaatatgcacctttaaattcgcatcaccacttataacccggtcaccatcctgttattgaattttttttgttttcctatgcttcccatttgcaaccaaatgaaaatatttggtatttgagtcaccttccaaaatatctttagtcttagctcgctgataccatttaatttcctctcttctaagcaaacaagctaatctattctaaaaaaagtctagtatgaatctcatcctaactcaaccgagttaattcagctttttttttaaatctaacaaatctaatatttccggcaagaccttcttttcttttttgtaagtgccactattttgtttggccaatcctcttaataattgtcgtaatctacgaatttttgcctgctaacactctataggagtatttccatcaataatatttgaccagatttccttaaccatatctacaaaaccatctcttaatagccaacgcaactcaaatttaaagttttgatgactgttacaaacagaagatgattttgtatttaggagtaaaggagcatgatccgagatgtctctatgagatgtctctattaagagcaaatatcgaggacagtgaaaatttttgttcccactccgttgacattagcactctatctactttttcataagttaacactggtaaattatttgtccagatataattttgactaaaaccatcaataatagtattaaaaagaaaaggccatatattatcaaaattatcattatttttttccgtaggtctatgtaatagattaaagtcaccaccaataataattggtaaggtttcatgactagacatatgaactaattcgtttcattaaatctaacattttatattttgacaatatatttgttttgtgttaaaaatactaatatgttgtcaagtttaaagaagtttaacttggaaaaaagtcaaacgacttataatattaaatagatggagtatcatcaatctcctggtttgctggaaagtatggatatgtcacgggaataggggccgtggctgttctctgatctgtatgtggaacaggtggaatgtttctattttgcccatctgaagctgttacagtattacaaagtcaatatacaaatcagaacaaaaatgtatggagactaagagaaagtgtatataattttatgtttacctcaaatacatattatatgctactgtttatgtgagtatggagacaagaaagtgtatataattttttgcttacctcaaatacatgttgttctactatttctgtgacgctgtgaacatcttgttgctgaacgcttggtagagtgttttcatttttagtgctggatgtgtgtggattgtagttaagtgaatgcttgcttttaactaatctgaatgtcaactgagaaaattttgataattttttattatgatcttttttggcaagagatgactattggtttgctggttcgctgatggtattgtttttgtcagggttaaaagataatgcataccctctatcctatgagtcttgagatatatgaatacaatatgtcttatcttatatatacggaaagattcgtgtgagttaaggaaatcagtcaattcgtatgggaaatatccttcacaagtagggccatatcaatatcctactatcctactcagagggagagaagactataatgtatcgtgcggggtccgatgtctccgagttctacctggaaatcaaggtgatctaggtataaatacataccccctaaggggtatagggcattgaatcctgagcgcaagacacccgcaaccacataagtaatccggaggacttgaagtctattcgccaatagatcttgtcgagtccctctcgacaaggatctcgtcagtaatctcggagtttagttattctcttttgtactctgtggtttcctctataatcccatataaactggattagagctattaccttacgaggggcttgaactagttaatccttgtctttttgtgtgcttgatgtcgtatcgcgtagatcctcataccaacgtacccaaatatccttagaatatagtctacgggtctcccccgtcgacagttttcaggtaactccatgctcaatggtcactctatgctctggtacaaatataatattattgcctatatatacatattgataacatagtactcaccctattgaatgtgaactagcaaaaccaagcgttgactacgaccaagttgtatcttttgcgatactcttgattcgcatcatcaaatgcgctgtatgtcatcacaaaaataactagccattggataacccacaccactagaaagaacaatgtctggatcaaggagaggtcgtcgtggattaccaggcaaacataggtgatcaccatggcaacagtaaatatgctaaacaagacctgcaaaaaaaccaatcgtttagcatgagcatgtggtgttagttacccccttcgtcccaaaatataagaacctaggatcagataagagatttactagtactacgaatctggacaggctgtctgacgactcctagacaccaccttgagaaaagaggctagactaacaccgagccgactgttgctatgcgggatcgatcacattgattgtctttcttagacacggtaaaaggaaaaggagagtggaattagttcgtatgtactcacatcttttagggttctacaagggcgagtagtcgtgaagccttgatgatctgcatctaatttgctagtagtagggtcatccagatcatacggggtctcctcaaccgtcacggtcattccaagaggcatcggagcgtcggcggccattgcgatcagatcttgcatttcaagtattgtcagcacctatcaaagacaaattcttttaccacgagtttgacagcctagctctaatgcagacagtatcagctcataaaatctgattgcgagatacataagaggatcaattttggaattatcaagattagaaagaagataattttgaagcatgagttctcatagtccaaaattgggtggcatatgttagcgccaaaatttggtaagccccgaggtcatcatttgcttagaaaccatatcagcttcagagtcctggaattgaccgatgggaattgtcactcactagcagtcggattcttggttttggttaaggaaattaatcaattaaaggaagtttatttagaagagattgagtttaaggaggatacgacataacaatttatctattaattaagcagagttagttagttcccttttgtttttggaaagtgtgtttagtatccgatcaggacttgtgcttttccttttatctttagaaaagtttgagttgtgtccaataagggcttgtatttacccatgcgtataaatatatacacccggagtcattgtaatctatctctcgatcaatacaactttggcacatcgataccctttttattttcgtctttctcaacaagttcctgttttgagttaggctacatcggcttcgatctctgatgaggggtaaggcttattgtggctgtttgtatcggtgaggctagggcttcgacaccctaatcttgtcgatgtaaacatatatttatcatatatcttagttaatctaagtcgatgtctcaatttacctatatcggctagatcttttctagggttttttttatcagttaaattgtttcttagatctagattagctaaggtatccaccaccctgaaaatcagtaaaaggcttgattgtttagactttatgcttctttttcatactagcaaaatgcccatgcgttgcactgggtgaagacaaaaataaatagtaatgggtgtgtgggagcataatgccactaggttaattgagatccttatagttaaattgaatcttttcggtgcaagtaagacgctaacatgacataattatttgttgttctaaatccatttacatggattataagaaagctattaataccactttaaaatgaaattatgtattatacatactaaagtttgaaacccaaaaagtatttatttttttcatgtattattatgagtcggttgcaatgcatggttatatttttatacttgatattgataaaacacttttttttacatactgcaaagagtagcaatagtaaaagaaatgtttctcgctagctatcagatcaacctcactgcactctaattgcataattgctttcactcaaaaaatcaaaagaaatcgtgatgaatggaaagaaaaaaaaggtggtgtatcacataatagctctcactctaaaaaaacagaacaaaaacataccatgaatggaaaaaaaattgatgaggacgagggaaaaaatctggatgtaaatacgattcattttgttggtgactatatatttttttaaaaaagaaagacgcgtgattgttttctattttctaaaattaatttattttgtcggtaaataattcattttgttggtggttacattttttttaaaaaagaaagacatgtgattgtttttttacttttccaaaataatgaaattgttcccttttttatctaattcctggtagacatgggcccaaaatttatttagtgttaatagtcttaggcaagaatcctatttaggtggtattactcgtgctacagtgctcagttgctatagtatcacgcagaactgtgctgtgttgggctgctgcttctctgctacgtgggctgaactgtgctgtgctgggctgctgcttctctgctatgtgggctggttgctgggttgcgtttgctttttgttgggccagcctgctgccgtcttggctgggctgctcgctaggtttctcttttttttttcgtttctcttttatttgagaagcgtcagataggggtgggtggaaaaagaccgaacaacaaaactgagaccgagaaatttagtcatcaattcggtcctaggtagtgaaataccgaattttattcggtcaattcggttagtctcctcgggtaaccgaatagaccaaaaagatcgacttaccaaaaaatatctaaatgcaacctacaatccactatgtttaatagaattaaactctaattttcacatccctacttcttctaggcatgcaacctaataagagtctttacttataagtgcttacaaattttttttttgtgatttttatgttgaaaatttccattatttctttgcatatatgaaaatattgttgaatttcggtcaggaccgagaccgagaccaaaaagaccgagaccgaatttgtcagtcctgacatttttgcactgaaattcggtcttcacttttcaaagaccgaaaagaccgaaagaccgaagaccgagaccgaaattttcggttagaccgaatggccgcccctagcgtctgagatcgccgtaatgcatccagattcatggattagcggcgaaataatcacgtgggcccaccctttaatgatggacgaaaaaaatcaactggaagccttacttattttttaattaggtataggtatagatttagtgccgcatcaattggatttgattgccgataaaggtttcatcggggtttcagctgatgagttatctggacgttgcatcggctaacaaggattacatacaaattggttttagccgattgcattaaaggtttcactaattatctaatcttgtggatttaatgacatcggatcacaaaccgatgtatgcttaacctttggaacaagcaattattctatacgtattgatcaattggtttctacttaattatattattgttttattacattatcatcagccgattgttttatatcattatttactcaagtgtagaaatctacattgaacatatagccgattgctcaaaaccctattgacattggtcagtattggcatcggctagtataattatatcggtatgtcagttgcaggatcaaactgactgtcacacccgcatctcatcaatattttggacctgcactggagctaagcagatcttctatgccgttgtgttcatcgccttacataggtagtataatttgaacccgaagtaaagtaaggactcgatctaatcaatcctgaaggatgaatcataatattttttgaagctctatttctaatcataatgatatgaatcgaagaataaacaattcacaactattcgtaattacaactattttactcatgtgcacctctacatcacttttttttaagataataatagacctgtacataatgtggttctcctttcattctatacatacacctgtacataatctattcgagttcagatcatcctcctgttttattaactaggaaggtagcccgcgcattcgcgcgagcatgtaccgtatgtaggatgaatttgagaaacttatagggacagtataccagcgaaataatatctgcaatgtttcaaaattgtgattgtttttcatgagtctcttcattagcattacaaaatgaatttaattgttatttataaaattacctattgaagattggggttggtaacttatggtacctaagacatgactcttgaagtttcatatggaaagagaaaaaacttaggcctgtttggatcatttagtcctcagattaaaaagtttgtcccatactgtttggatcagggactaaaaaagactaaaggcatgtggactgagggagaaagaagaaagaggctgtcactttagcccctatataatccaatatgcacttttagtcaccttgtttggattcttaggaactaaaatggagggactaatgcattagccccattaaccaaatatggcgtcagttataaaagacattacatatactaccatatataattaatggttctactgatttatatagaaaaaatatataataactttattatttgatggcagacatcgattggtcatagctatggataattcctcatagaaaattatgaatatgtgtacagtatagggatacaaattagaaaaaaaatagtagaagttatgagaaaaaaaacaaaatatatgactctcaatttttacttaattcggtagtccatcatttctaaccattggatatttagatgacctaacatattgtgtacagtccaactaactaaattattcgt

SEQ ID NO: 66911 - DNA, 2052 bp, Oryza sativa
aacgccatgtggcggcttacaagcgtttgtaggagtctcacgtggcggcttgagagcgtttgtaggaagtttaatggacttttagtatataatagatagatagatagattactgaaagcacaggctatccctgatttcttccattttgcgtttccgcaagtgctcttggcatcactaccacctcccttgatagtgagcttgacgtccttcaaggttattccttgacaaggtacatttctgctacagtccagtttgatagcctccttggaagcacttgtgcccctgatgttcttgaagaccacattgctaacttgcaccgcagatgtctgatacaaaaccactaaattataagcatgcacattatttacacacatggataactgaataacagaaaagctatcactgagatttgtacctgttccttgcagggtgtagcagaatcacagtagttctggtcgataatgattgggttccaaacattttccatgatcatgttctggaacacgatgttcttcgcgtagccccaaccgccctgccatgtcttgatgcgagctccgttggttgtgccatatagcctgacggtgtcgacggtgacattgttgacatgagcttcagagttgtgatcgcctaagctcccgatgctgatgccgtgtcccggtccacacaccatgttcttgacatgtaagttctcagttccatcctcaatcgacatgcagtcatccccggtcttgattatgcagcctgtcacttgtacatttttacttcttgtgatatggatgccgtcggtgtttgggctagtgcctggtgctgtgattgtcaggctagagatcctaacatcagtgcaatcctcaactgacatgtggatttgttggctgtttagtagcttcaagttctccactttcagatttgaacaggagtagaatgtcaaggcctgtcagatgaaaaagaagtcagactttgtttgagcaaaatagccaaagttttatgaattgtgatgtgctagaagattaggatttgggaagaaaactcaccgttggagcttcagtgcatggctgaaaagaagagaagaataatatccacattagagatatttccaaaataaaaatgaaaaagagtgtaatgattcataactaaataacttcagagcacttacaagttttgcattcgttttgcaggaattttgccaccaaatcttgccgttttcatcgacagtcccaccaccagcgacagtaaggccactcacaccattgaacataatccagtgcctaatagtttccttgctccaatctgacctctttggaggagccaccaacgtaccctctatctgaaaatgttcaggaacttaacatttttgagtaattgaatttcatatgaaagtaaatgcaagtgcacgagtgcatatttcttaccatgaacgtgatgcttgatttgcatggaccagatagtgtaatgtgcttggtgaggtatctcttgccctttgggatgagaacaatggaaggttgcgaagaggagcaagctgcagcccatgcctttgccaatgcctgcaacaacggtattagttaagttttgctatttgtcagtcgcctgaaaataaaacaaagacattatacggtgtcacattttaccttcgtgtcatcatgttgtccatctccgtaagcgccatgtttgcgcacatcgaacaccaccttctttgactcaagagacctgcctctgagactatcatctccactagttaaatggaatgatgcattcatgttgaccttggcatgaacactacacaagaagaacgacatgacgacgacatatgcagagaaaatgagcacattgcaagccatctttccaactgttaacatatgtcaacacagtttcggacgatgaacagtgcagaaattctagtgttgttgtgagttctggactttgtagaatgtgttgatggatgtggcgattgatggagaccaaggattcgatcagggggtctatttattcgcgccgaaaccggttggaaatctttggatgttctcaactcaaggttgcttgttgttgatcagctag

SEQ ID NO: 66912 - DNA, 7081 bp, Oryza sativa
gtccctgactctttgttgcttcactacctagtctacttgtatggctaaattacttccagagaaactaatcctgctattgaaagaagttcagcactaaaagaaaaatcaaggagacctggatcacagttgagtacagacaatcatctaaaatcctatgcatttcatcagtgctgcactcttgagacccactctgaattaactttgacagatttacgagccacaggtctccttgtgtcattaaagtgtatgtattattgtaagcttaatcaattctaatgacaactcatcagtcatcaacgagaaagaaggcatgtgtgtgtgaattccaatgtggtattctctacagatgcagcctatgatgcacggatacgcgatactggtacggcgatacagatacgttgatacggcgatacgggattttaaaaaaaaacatcaatacgtcgatacggcgagtatatataaaaatatttttaaaaataaaatataggaaactacaaaagggtaaagcaataagattatcttaaaaaatattttatgtattgttgcctgttacaaaaaatatagtaaatatagccttgtattacaaatagagcaagtatattaaagttataaatatatcagaagtatagcattgggtctttaatgggctattacactgctaggtatcggagaagtatctgataagtatcgtgtgagtatcggtatttattttttctttttttttcgttgtttaatgaccgatactcctctgatactgtatcgacatagtatcggacgtatcgccgtatcggatacgtatcagataccggtacggcaagaaagtgaagtatcggtgcaacattcgcagcattataatgtttcacataggtttctgaatcttgtgaagttaaaaattcaggtgtaaagctagctcttagctgagaaaggaaaagtacgggctccaaggaagcctatgaagaggaaaccaatgcagatttcaggtgatttctcatagatatctcaatgaaagtatggacaattcatggagtaagcagatgaacaacctctgctgtttgtggcttacaagcatggtgaagaggtgcagaaaattctagagagcagcctctgttgtgggcttgtggcttccaagcacatatttcagtgctttaaaaaattaacaggtgctacatgattttatcagtcaaaacatttgtggttttgaaagtatgcaatgttgcttagcccagtttgtactgtcaattaatacgcaaatttgcctgacaactctgaaaatatccaaaaaaaaaaggaagaatgagggatgattctgaaactgttttggtctcaaaattgtatgcttattatgccaaccaatttcagaaagtaaagtcttgaaccagctgtaagcaatttatttttttttgcgcaccaccttttttttttcttttggcactcaacagccgagacgagctaatgtcaaacattttctgtaagattcttcatctgtttttttttaattttctaaaatatcgttgagaaaaagagagcataaaaccgtggctgaacttgaagtatttgctaaactctgaaaatagagggttcctatttacctagcatggtgtttgtgcatatgggtatttcacgtaatcgcaaacaaaatttgcaactaacttggacaatatgatatatttttcagatattaataaatttaatgctaataaaaataatcaaagcttgaatttgaatatgaatagttcccgataaaattatttgaaaagttacctcgatcaactgagctacaattggtatacccatgccacacgaatgaagaaaaaacaatttataggaaatagttttatatatgcattattagctgttcaacagccaagactaaaaacaaattaaaataacaaatcataaaattaattaattgagttctgcattcatattttcggaagggacattcagatccccttggttgccctaataagcaaaagccaaaactaaaatttgaattttcaaactaaattttgaggttgattttaaaattttttcaacatgattctttttcagtattaacttttaaatcactaagacatatataaaattttacttataaactaatactcctatttattttctaatataccattttaacttattagtagagaatatggacaacccagagggcctcaaattttgactcgctggtaagacggcaaagcacagtagcacacaatgcgaagaccaacggaacgaatccaacctccaacgtccctgagcaccccagccgtcggatgcgtcagatccggccgtccatttggctcccctcgtaaaacgcgctcccacccggcaacccaacgacatccgggcccacccaccagtctcctctccgtttgggaacacgggattcccagtcccggccccaccccccctactcccattcccattcccgtcggatcccattcccacgggggagattactcctcgggcttgggattccgcctcctctctctctctctctctctctctcctcctcgcgacttgtcggcggcgacggcgacggcgacctcggcggcgcacggcctcgctccctccaccgccgcctccttccttcgccgccgcaccgcgcgtccccgctccatctccggtatgcggtgccctcccccctacctgcgctccttctcctgattcctcctaattcctcctctcccctccctcacactgctctctctcactcggctagggttttctcttctagatctccgcgggcggagctcccgggcgcggaggaggctgcgccgcgcgcgcggggaaggcgcacgaggtagggggtttctccttcctccatcttctcactgtggagtgtggattttctggcttgcttgcttgggcgcgcgtgcgtgcgtgcgtgccactggttgcttcgttgggggggggggggtttgcttgccgtgtcctcctggatgattgggcgcggtctttctgactgatttctccttcgcgtggatccgtgatttgttctgtgtcgcatggggggagtgaatcccaaagtcgagcgccactgcttgaagtttttgaaatgcaaacaggaagagcgaaggggtttttcgaaatcatgttcctggtaaaaaattgggggggtttttgaagtcatgttcccggtaaaaatttgggggttttggttctgtgggtaaatcgaaaaaaacaggataagagtgctagtactaaatctgaagtgtgcgtatgagctccatacacataactattgtgtccaaataagctccgtgccttcaccatatgatgcaacatattatgaagctttgttgcgttcatttaatctgtgtttttggggatctatttgaggtacattgatgtactaaactcttctgtaatttggtgatatcaaggttttgtcttcacatgactagatatggctcggcatctgattatgtgctttcttatgcaattgttgtcaactgttatcatctgaaatttgaaatttccaatgttagggcagtctagagttaagtttgaactgcattctttgcattccctgtgaacttattcctcacattcacttattttagctttgcagtgctattttcattctgaaggaaattgcacggttaatctgaatagattggtcagtggttgtctgcattctacatatgatccagatggtttggagatattcagtgtaatcaacaatgcagacacggaaaaagggtgctacgaaaaatgcacttggggatcctgccagtactaaaactagtaggcaacccagaagagcagctcaggcggcagcttctgaaaagaaagtgaatgatcttattacttcttctgccaagaagaagaagtctggtaaagttctatttttcaagtgtacatgatgtgtatgttaatgcaaaatcaatttcttctaaaccaaattattggtacaggcatgcttaatggttgtttgactttcatttattcaaataaactgacaaaacttactcatatgatgtataggataatttatagatgcttttctttaactactaagatgtattttcatggttcgaaacttgcaataacatattgtgaaatgatacatgcttctagaataaacaaatacattttgtccttgtttaagttgttgactattaatctattcctacacgtaaattgtttgtttaatttactatattggtgtagtgcccatgtgctggaacagttttgaaataaatttatgtcattttctaatcttgaaattccaaaacaaatatttaaatataaacgaaacaaaatctaccagccagctattgacatatatacatgtaaacatgatatatttttctgtaaaaaatatcctgcaaataatgcacacatgtctacatggatccatccacagaagataagcataaagcacaagatcactgtcaccaactctttcttttaaggagtagattttcaatttgagcttaattcttccacctcttatcgcgaaaagaaccaaacaacattctttatgtgcataaccgtttcttatttactatttaatgctgtatatctggtgaagttatgatactgattaggatgtagcaatggctgtatttggttctttgcattttaaaacatttgcttgccatgcagttggagccccttcaaagaaaaaccgagcttctaaaggtggaaggaagttgatatccgcatgtgatgcagctaattctgaaaatgaagtttctcaggtggtctctggtataccacacgatcagaaggtaaaatattttgactgaagtgaacttttttggctacttttctttttgaccactgtagagtaaatttcgtccaaaaagaatagagaaagggggaacagtacattaactacttaatgcctgttccggcacatgattattacacttttattattgagctaccaaattaacatctgaaaaatattgtactcttttggtttggttgttttagatcatctataatgtttagcctttttgtaacacctgataatcgtgcattggcatgtacggtgttgcttcactacaaagttttcacaacaaaatttggaacttatttttcctttattatttatattggtataattgctatgcgtacgtaactacttatgcatttatttttactacttgggcagcagtcagatgacaatgttgatgggaggccatgcaattccatattttcccctgcatatcaccttcagaaagaatgtggtgcgagtaacttcgccaaaggtatatataattgccatattttgaattcatcttttgatgccgtcattgttaagttttggactaggacgctttaaacatctgtgaaccataacatcgtataagtttcagggtataaagatttttctaactgctatcaacattcagcaatacatccttgcaaaaaaaaaaaacccaacaaaatgatcctgccctgatacatgctgcagtcaaattcttgaacgaaaaacttttactagttttgtgagtggaaaatatatcataacttttacactattgtgttgtcttgtttgcctgagaatgaaatggaatattcactcctgcattgtcttaggtgatgtccatgagaaattatgacttttaggggttattatataaatattatgagctccagcattagcactaggaattctgtactctgacagatttcaatgcaagttttgaatttaatttgctcacaggtggatatttcaatttaacgagatggtttatctgtcaacaaagggttcctttctgattatcaaaattagtttgttgtcatctattgttggaacctgtgccctagtaatagtacatgtctcatcgtgcatgctgtttctatgtgacttcattgtggctgtggtgctcattttgctctccataccatgttgctccagtagttgattcttgaagcgttaatcatgcaggcttagaacataaaggtgatacattgggttcggttagctcagtagaagaaaggacaacacatgctcaaggtagaaaagaagttaccaccagcagatctgaatccactagccatgcagttaagacttgtgttgggagcgatcaccatacactaaatgcacaatcagctttctgtaacacaccgcttgaagaggatgaattcagtgaactcggaaacctttcttcagaagtgtcagcaatatatcttgccatgcagcagtccaagttggagtgcattgatgaacatagtcaagattcaatctcaacagaaggttatgttgatcctgaggacactgaggaatatgatgattttgatccatatgcttttatcaaggatttgcctgatttatcactagtggtccccaagtttcgccctgtcctactccccaagcaaactcggagttgtcctacaactaccctggtacttgatctggatggtaatatatacttcctgtctgagcacttgtgttcactactacactaaggagccttctgttccatttctgtgattaactccaactactttcaagcaggagtctatttatgtaataatagttattagtgaatggatgaagttagctacatctgtttactgttattttaacttcatcattgtctcctgcatctatgaattggtgttaatggtacaaatttgaattcaaataactctagtactctacctaaaggctggaaactggtaaacaggagccactgatggactttcaaatgcatcatgattttattattaccaatttaccataccttcattggcatgaaatattaatagtcaacatacatttgatgttggtgtttgatttttgcctgctgcgtggcagtaatccttggacatagcagttggtaccgcccccacaaacaaaccttgatttagctttatcctagttttatcctattcttttttgttcatttttgtttgatctatgtgtgctcttttataaccagctagacatattttcgaaattgtcttttcctttctcctttgatgttcattttgtgtcactccaaacaatgcagaaacacttgtgcattcaactcttgaaccatgcgaggatgctgacttcgcatttccagtttattttaacttcagagaacacacaatatatgtccgatgccgt

SEQ ID NO: 66913 - DNA, 4840 bp, Oryza sativa
tgctattggctttcactggtagttcaaactctaattaagtaattatatttagcagtagcaggtaccttttagttctgaaattatgcattttattcagttccatatttgtagatccccatcaactattattgttatggttatggggacatgaaaatgtactgatgtcctgcttacaggcttttggattccagttagacaatggcattcctattgaaagctggtttgatgatcccaatgatcaggagctgttgaaactgctcccattcttggaaagcctggttggcgttgaggatgttcgaccatatatagccaggaagttcaacctccgtgagaaggtagcaaccgcatcgtctctttcaatggacctgcaaatgtgatccacttttgctttggaatatgtctctgtgtaggtggtaatttcgataaatgcagaagggctggtatggtgattctgtagagtttaggctgtagtgtatcaggatcccccctgtactgcaaatcttgtatgtctttagaaccgccatgtacaatgttctccagatgtaagttcgtactggaagaatttggggatcccatgtatggctaatcaaggttactaggttcatggtggtgaactttccagcaatgcagataaaattgttcaaaaaatgtgttctattgtgattgtaaatgccgtggactgcatgctcctaacatctggacgattggtcaggtagctgaaatagtccgttttttactttgacctatccttagtttaatttatgatttcctgtcatggttgttttgccaacttatgtatcttctgccctaacaaaatggaaaaacgggtgcgaaatctgatactactttcatgcctgtctccagaaattattacctatccagttgtggtgacggtctcattagtcatttcccaacaagatgtgtttacttaacgcaatggtactgtggaggaatgctctggttgtaattgtataaatttcacgcaactctttgagttgccatcatgtgtgccctctgttattcagttgtgaagatgctgtgagcatctgagatgtcgtattgcttttgttgttctttcatatgatgggatgagacttactttgcatcgcttgtttgatttgatatccgaatgctgcacgagtcctttttgaagcagaccgattcgtgtggtttttcattttaacagatgtagtccaatttctcagtttggtgtcaatataagcattacagcaactctacaatgtttgatttaattacactagaggaaaagaggagaaaaatcttgcaaacagtaaattactgatgctcctcatctgatggtcaacattgatgattatattttgccatgatttagagtggtacgagttacaagaaataatctcaattgcaaattcctatacacttctgtacatgtcatgtattcctcctgtacatgttcttctgaatatatacacctgtctctctagctccacgatgtaaaatactcctacttctctacatcttccaaggtccaaggatgttcatgtttcagatcaattcctgaaaccacatggatgttcatgtttcatgtcagttcctgaaaccacatggctgtggactgacactcccggatttcttccattctgcgttctggcaggtgctcttggcattactgctacctcccttgacagtgagattgacattctccaaggttatgccatggcaaggtacactgctgctgcaatgcagcatgatggcctcctctgatgcacttgtgcccctgatgttcttgaacagcacattgctcacctccactgcagatttctgcaaccaaaattatatatatgaagttaagctttgactgcacagattaattaatgccaagaaattaaccgtgttaaacgtaattttgtccaaaattcagttttaactttgtatacctgttgcttgcagggtgtagaagagtcgcagtagttttggtcgatgatgatggggttccagacattgtccatgaccatgttctggaacacgatgttcttcgctgaaccctttcctccctgccatgtcttgatgcgagctccgttggctgtgccatacaacctgacattgtcgacggtgacattgttgacatgagcttcagaattatgatcacccaagctaccgatgctgatgccgtgtcccggtccacacaccatgttcttgacatgcaggttctcggttccgtcctcgattgacatgcagtcatccccggtcttgatcatgcagtctgtcacctcaacatctctgctgcgtgtgatatggattccatcagtgtttggggctgtttctggtgctgtgatcgacaggcgagacaccatcacatcggtgcaatcctccactgaaatctggatttgctggctgttcaccaccttcagatactctaccttcagattcttgcaggagtagaatgtcagtgcctgcgataggtaaaaataagacagagtttgtgagataaaatgtcatcaagattttgttgctgcattggaatgttcatggtagtaagcagaggtgtaaggacacgtaccgttggagcttctgtgcatggaagctttgagttggttttgcatgaattttgccaccaaatcttgccatttccatctatggtcccaccaccagtgacagtaagaccagtgacaccactgatcagaatccagtgccttatggtctccttgctccagtctgacctctctggagaagccaccaaactacccttcacctgaaaatttcgcagaaatggaattcagattctttttcttacaaagaaatgtatataaacttatgcatttataatcaattctaactcaccatcaatgagatgcttgatttgcatggaccagacagtgttgtgtgcttgatcaggtatttcttgcccttggggatgagcaaaactgcaggttttgcagaggagcaagctgcagcccatgtatctcccaatgcctatgcaaggtgacacaagaaaaaacaacggttagatctcagaaactatgatttgctcctgaaccaaaaaccttttgacatattctggtgtcattgcattgtactcactttggtgtcatcatgtcgtccgtctccatgagccccgtagctctgtatgctgaacacattactgccaacatctgcatcagcactatgcaagaagaagaagagtgcaaggagagatgcagagacaatgagcacagtggaggccatttctcagactaaatttgacaagttatgacaagtcagagatgaagtaaagtggatgtgctgcttcttgatgtggtgattgatggagaccattggtttgatcaggggagctatttatatgcgccgatacgtgttggaaatctttggatgttttctactcaggttgcttgtggttgattagctagtttggtgtggatttttggggtgtagtatcacaagattctgtcagcatgggaaccgaaatatatggcagtgttcggattccctggatgggtgccgcacggaaaacggagcgattcattagtgcgtgattaattaaatattagctattttttttcaaaaatggattaatttaattttttaaagcaactttcgtatagaaacttttttaaaaaacacaccgtttagcagtttgaaaagcgtgcgcgcggaaaacgagggagagtggttgggaaacttgggtgccgaacacacctgtgcctgaatcctgagtttctgttttgcttcagcaaaaggtctaccttttaaggataattccttccaaattagccatttatgctctcaaatttcaccactaggagagaaaaaaggacattaggagataaattttacttagcaaagatgctcaattgaaacaataaaatttcttcagtactgctgcacttcagagttcagcttacatgaaaactgaacccctgactgatgtacaacctggcctcaagaataaatattaacatagcctaattgaaagtgaaagttaattacacaaaaattccattgaaacacaatatgatgacctatgctcttgtttgatcatgtttctctcaaaaatcaactgtctagatacttcagatgtgagctcttagctcaaaaaggaaacacttggggctcaaagagagcttagtaagggacagacttcctatctgggaattttcgcatggccaaagattgatcatgtatatcttattgaaagtttgggggaatgcattgagtaagcaagtgaacaaccttagttgaataggggaaggaacaagtatatcttttttggtttctggaaaccttttaggacagactcacagctgacagatagtatgtatatttcagtttattttgttctttcagttcatctattttgattataatagtagctctcactctatggttatgctaagtatttccagagcaaaaatcttgaaacgcgcaagcaatcagaccaggttatttttatttggaggaatgccttattttaataaaaatatgtgtgtcccaagtttttgaatttgcacctgttcaatttacgaaaattctgagaagatatattgacatgtagattagccacagatatgcacacacaagatcatgccaaaaatatatgatgacacatgtattataaaagaataggagattgtttttctttgacagttgacattttcttcaaatcttggttgaaagttaaattatcaaattcttcattgaaattgcccctacaatacatttggaacttggaagcaacccttttcccactcacaggttgaaaattaaactaaaatcgacttcattttcaagttgtaagtgaacaaagctaagcatcttttactaacaaacgaaatcgacttttttttcggattgtaagtga

SEQ ID NO: 66914 - DNA, 1534 bp, Oryza sativa
aatagttgacatttgtttttctctgaaagttgaaatatcgagagaccttggttggttctctttttcctcaccaaacaatgagaaaatgaaatagaaggggctgtggatatgaatcctcaaatgctagaagaaagggactttttttttttggtaaatctaaatcaagagcatctcgatttagtactaaccagcgacaggacattgattggaaaattttacttaactatagtactagtccatcaaataagtagagaaatacatttctatcacctatgtttcaaataaaattttctcttaaattactcatgggatttacgaatccgattacaccattatgttcgtaacaaataaattttcttaacaagatctcacatgattatatttttgatgaaaaattacaaattacttttataatatatctaaattacttttagatatcattaaattacttcttagacatataaaagtaaattcaataaagtttataagtaatttatatatattatagaactaacttaaaaaaaataacttatcacgacattagaagtaaatccattgtgggggggggggggtaaaaaaataagtctatctaaaatttaaatttaatcaacacaaattatgaaattgactaaaaatgataataaaataaacaactcataacattattaatgtataagaagtatcaaatttaaaagtaatttatatatatatatgataaaagtaacttacatattaataaaagtaatttacaacatagatattttttaatcaaaatataatcatgtaagatcttattgtaaacatttaattcattgtaacgaacataatggtataattggattatagatcagataagtaatttaaaaaaaaattctataagaagaaaaaaagatgtggtagacaatgcaaccggacttgagagtgaagtctctggttaaatacagcatacggtctctgtatagtcgcgtctttttttttttcatatatcccggatgtcccattgtggatctatctctatcaaatataatacaaatagttacaaaaaaaattgttattagagtatattgacatgatcttttccaatgatactcacgggtaattgtatcgccaggcatgataatattctagagacatcaaactaatttcaccttgacttaaaattaaccgctaaacaaaattaaactctgagtttaggacttgatcagattcagtctccgaatatgttactactaccatagactagtagaagtagtagccttataataggtctagtattcggactgctcgtcagcccttgtgtataaggtgagtgagctactgtttcacttctgacaaaacctgcacgccgtcagcaatggcgccaccgccgcggaaaaggcggcgagttgacggcagcggcggaaatggtggcaactatcctctcgtcgccacccccaacgacggcgtcctgccagtggacctgctcaacgccgtcctcctccgcctcccggcgaggccggcgtgccgcctccgcgccgtgtgccgcccgtggcgc

SEQ ID NO: 66915 - DNA, 2298 bp, Oryza sativa
ggctatactattaaacttctctaagtacttacgtgaactttctaccattgcccacgttcatgtagatgttaatgaatctagacacacatatatatgtcgattcattaacatatgaaatggaggacgtagtacatacaattagaacttcaatttccaacggctacatatgtttactctcgatcaagacctaaaagcacaccctcgaactggcctctctttcataggaacccagtcttgttcgagtcaatcttattgatggttagaagcagagttcacactttgctctaaactgatgtctagccagtagatagtagagaggaaggctaaatccaggttaatgtcccgtcgctcaattcatctttttcataataagatttgattataccattgagagaagtgatggattttatagagatacgcccataataagtatattgattccttatattcttatatatctatttgatgttttggtcatcaaaccattgagagaagtgatcgattttatagagatacgcccataataagtatattgattccttatattcttatatatttatttgatgttttggtcatcaaatcggtcgatgctatactaccatagaatcatgtctaaaaaagtgaaaactatttacaaatgctattatatgaatgtgttttttttattgataagtcaattaatatcatgttgcaaaattacattatattttgtttaaaatttgaggactgactacacacgtttgttctggggcaggcgtactgtcttcaccagatagactaatcgccaatgtgccccactaatcgtgcaattttgtgagcggattaggcagagcagcaaagcaacaaaccgagagaacacaaatagctcgcagaaaagttttcagtaacttgtaaaagatcccaggaagtttatagtaacttgtaaaagattaggagtatcaaaaaggcaggcacgcatcatgcaagattctgagccatcatacgatggagaaaagtacagcagctcactcagtcgccaagcaaaataaaaacagattggggggtaattcagacataggagacaataatcttaacaagttctcagactcccactactaacaaagctcttcttgctaacacctgagaaaatcttccatgtgagatgaatatctctagtagaaaaagccgagcaccttgcctccgacgttcttccgcctcgcttcttcgtggtccatgattccggcagaggtggtaaggacaatgtacccaaactacataacatatcatagttaaagtcagagggcattttcacagaaataactgaagctaagtgatgaagtatttctcaggcgatgtaacttaagctaagtgatgtctcttgacaagttggtggtttcgattttgtgaactaacctgacgggagggaagcagcctagcagtccaggactcgatttccttgacaccaacatcaaagcgtgggctgatgacaccacacttgttaaggcgtccattcagctcaaccacgatcttgccagaccggtggtcatcaacaaactcaaactcaccaatgtaacctgcagtcagaaatgtaacagtatgggttgtggcatgagtcctgacatcattgtgtataaacaatcaatcacagcttcatgtctacagatcagtaacagtacacgctgagagaagacataccatgcttctgcatgacgatgaggaacttgatgatcacctttgacgagggccggataagaacttggcgcttaccacgcttctcagcattgtacatggttttcagagcgtcattgaggacactgactctcaccatcttgtctgcaaaatatgagaagaaatttgtattacttaaatattttgttaacaacaaacctaaagacagtgcaactaccaaatgtttttccattgtattttccacaggtagaaaatggtctaaaaatagatgatcactaagctcaatatgacagatataattatagacaaaacaccttaactacaaataacaatcacaaatgcatgtctgttttgtgatgagtgtataacatatacatgcaacacacaaataatcaaggatcacatttgaggaatggcctgaaagaagttgcctaatggtaatcataagcattttacatcataactgttatcaaatcaagtaattgcaactactatcatgggcttcttcagaaaacagcgatctgatcaagctgcaggttcttgagcattaagaatccaacaaagaaaagaacatatctaagcaaaaaccagaccaagctgccaatctgacgatgaaaaacgaaatggctg

SEQ ID NO: 66916 - DNA, 3849 bp, Oryza sativa
gccgcggcgagtccccacggcggcggcggcggcgtcatctccggcgggaacggcgttaggctgggcattcaagggcagggcgacgagcggccggtgatggtgggcactgcatccagcgcgatgaagcagcggccgcccgcgtcgagtccacggcggcagcggtgaccgaggagacggcggcggcgatggcgatgagggttgcccctagcttcttccatggcgcggacagctcgctgtgcagtttgttgctccatcccccgacgagcggcaacttccattgactgggaatcaggttgcatagtagcagcagcgactgcctcctcctggatttgaccgaaccggcggttgaagaagaagaaggtggtggagctccatggtggtaaaaccattgcatatgcgttgtcctcctcgttcttccatttctcttaatttctcctccattatcaccaacagagctagacaagccggttcagcttccaatttttgatatattatatttttttgtgtggaataaacctaggaaaaataggaggatgaggagtcaagattgcagcggcaatatcactaggtggtgcacttgtttttgccccttttgtttattactatcatcttgtcttctttccaggaacaaatcttttactatacattctaatgcattgatcattcatactctaagagtgaagggggaaaaatcaactctaatttcctttctcaggtttccgaacagttgatgcttaatctggtgtttgttatgttcattttttcataatttgcttattatgccttgttaggttcattctttgaataattgaacttaatttgtttggagaaggggcggcatggtaccaatgaccaacaaagaggtaactttccagattgctatgtagatggtgattttactgtcctgtgtatgatctgcccccataatcatcatgatacagtaaagttttatatacaagtcaccatggtacaaaattaaagtgttacaaagtgctccctccgttcttttttgtttgacgtccaacgtcaaacattgagggatgtaggtagtattcattatgaaaattttgaaagcagcagtgattgctagtatgatttcctggacatgcctgtggctgtgttgctaagaacatagggaagcactttattctgaaagtggagaacctgaaggtggtgaacagccagcaaatccagatttcagtggaggattgcaccgacgtgaagatgtctcgcctgtcgatcacagcaccagaaactgccccaaacaccgatggcatccacatcacacgcagcagagatgttcaggtgacagactgcacgatcaagaccggggatgactgcatgtcgatcgaggacggaaccaagaacctgcatgtcaagaacatggtgtgtggaccgggacacggcatcagcatcggcagcttgggggatcataattctgaagctcatgtcaacaatgtcaccgtggacaatgtcaggctgtatggcacaacgaatggagctcgcatcaagacatggcagggaggaaagggttcagcgaagaacatcgtgttccaaaacatggtcatggacaatgtctggaaccccatcatcatcgaccaaaactactgtgactcttctacaccctgcaagcaacaggtatacaaagttaaacttaatttttgacataaaatcatgatgatcaagttgaatttaatttctttacctattattgaattcgtctgcacggtttagcttaactagagataattttgattgcagaaatctgcagtggaggtgagcaatttgctgttcaagaacatcaggggcacaagtgcatcagaggaggccatcgtgctgcattgcagcaacagtgtgccttgccatggcataaccttggagaatgtcaatctcactgtcaagggaggtagcagtaatgccaagagcacctgccagaatgcagaatggaagaaatctggtgtgtcagtccattgccctgtggtttcaaaaattgatctggagctggttggaacatcagattaagtggaggatgtagagtgtcagatgatctttagagaagattatatgtagagtaggaggataaatacgtagcggaaactacaactttggtgtaaacttgaaatcttaggagggatacatgatgtgtacagatagatactagatagagaggccctaaattgacagagtgtgcgaagcaactctctgggttcttgagggatacatgatgtgtacaggtatatactagatagagaggccctaaaaaattaaccgtgtgtgaagcaacactcggagttcttgtactgagttcttgttctcgaagcctcacataagtgatcaaagcccattgcgagctatttttttaattggatatttgtttggatggcttgaatcttgtgagaacataatgatgtagaacgttgtaattagttgttgctgcaagattgtctaggcaatatgtactctgtaagatatattatcactttctgatatatttagtatcattgtttggtcatcttttggtgaattggtggaataatttatctgattttgaatgttagttgtatttcagtatgcggttgttattaaactgggagatgattttcgggtttgctaaaaacatgaattaaacattccctactatgtaaaagttcaagaacaaatgtagtggaacaacttctacacactagagaatgtgccgtgtaggcatgcggttccctactataaaaaatcatagggaacaatttcccccctacgttttctcgtgcaaaatcatagggatatttttctttgccaacgtttgtttccctacaaaacatggtagggaaagccttccctacattttttttgtctttccctagtaaaacaaagcataggtaaactagtgatttctggtactacatctgtcccataaaaattgaatttctagctttgaacttttgtccataaaaattgtatttctactaatgtgggacccagtaaattgattacatttccttgtaatcttctttccttccatctcctctaacccattgttttgacattccttttaatcaagtttatatatggaatgtgtacatgtactgtgttcattaaataggttattgtagtcatttgtctatccttctaatatgtccttaattccctagaaattcaatttttatgggacggaggtagtagtgcattattgtattatagaaccccctaagaacacaacgtatatttctttttggaataatcaagcggggccattaataaaatggaaccaagcattagttctcgaatacacatgaaaattataaggaatatcaaaatggaggaaataggaatgcagtatccaatacaaaagcttgatgcagtggctgatggacgcatgtaagcagagagactagccaccgaagggccatgcaagcttggttcccttggactttgccagcagacgaatttgcaaggccaaccagaggatgtaaagtgatgagaggactataatggggctgggacaggatggtccgaccgagcaaaacgacgcatgggggatgattcaacatgctggaagatgaagacaatggtaatttatttgatggggatggactatggagaggagatggtgtgaaggacgagatgtagagaacgcaaatgggaccccccacgaacagggattgcacctcaaagagtacactgctagcaatattgtactatgaaagtttttaatttttgagatgaaagttttcaaatttgagttgaatgtttttgaatctgagatgaaagtttttaaatctaagttgaaatttttcaaatcttgacttgaatttttttaaatctgacttgaaagttttcaaatcaagatttttg

SEQ ID NO: 66917 - DNA, 14207 bp, Oryza sativa
ctgacaagttgtagtagtgtttgcagttttggttcaaaatttccgagctccacccctcggcatgaaaatatttcatttgaaagtttcatcaatttttatgattttatcaaaatttattcgaactcgatcaaaatttcaaaattattcattctgaaatattttaatccccccagtagatttgtactcatcgaaactgtaaaccctaactggaccttcggcgcaaagcaaatagtgggagagagagagaaggggggggtgaggattggaggacaaattgaggatgatagaagaatgaaccaaaagtaaattatattatagggcttagtttggaacatgttaagttgttgagatgtgttgtttaatgcatcgacatgtgtcagaagtctgtctaccaatattattgaaaaactatagattctatatgataggatataatccagaacattcttccattcacctaataatgttactcatctttttggtagttggtttttttaaatggtgttcaacctaggctaaaatattaaatctttgttggtatagtggcattgtgttgggcggtatggttaaacagaaaatggtgcagtctttaatggctcgaaaacgaactcatttttataggtgattttcaagggggacatcttgggcgcaacattggtcgctgctgcttaaagagaatcatggcaataggctgaaagaatgctgcaagccattggaatctagagattggagttcttttctaagtttggttggaatgtgagaaagagaatagatgtgtagtttcttttctccttgagtttgttgtttaaatgattttatctagatggttgtgtaccctcttgtaaaggggagtgggtctatgtgctcatatttagacttttggccgtgtacatccttgattccttgttggtgtagagaccaggttttaatccattatgtaaaaattcagaacattctttcatggtttcagagcaattcttgtattatctcagttacgacctacagatggggttgtcaattgtttgatgccctaatataatgacatgtcattgagataccgatggcatatctcaaactttgaaaaattataatggtatggttccaaattaccctataaaataagaccaactaagacaagaattcctgtatgaaattaggaggtacttctttttgcaaggaaattagtaggctagatgaaaggatttaccaaccaattaaggatgatcaaaacatccccaattaagcttgagaatggtagttccagagctgtcagacattccatacacagtatgcatggtcctctgaacgtcgttgcatactatttccagaaatccattaaaaaaatttctgttcttccccattcttggaagcaggttgtccatctgattactccatgaattctccatactttcattaagatatctgtgagaaatctcctgaaatctgcattgttttctcttccataggctaccttggagccccatacgtttccattctcagctaagagctaaacatcttatacctgaattttatgcttctagattcatcagagacgagtgatcggaacagatcatgctgctacatctagattataccacgttgacattcccatacacatgccattttttcctgataacatgtcattagcaaagccattaggcacataatgacttgtgaaactgcaaatggaagcctgtggatcgtacatctgtcagggttcagttttcatgtaagcttaattagtgttagtggttctcaagagtgcagcactaacgaaatgtgtaggattatatttgagctgattatctgtacccatgagtgctccaagtgtccttgattttgctttcttagtgctgaactgtccataggaggattagctaagttggaagctattactgattagccatacaagtagaccacatagtgaagcaacaagagtgaggattcaggcacatttgtctcagttcccaacttcccatgctgacagaatctagtggtactaggctccaaatatctgaaccaacctagctgatcaacaacaagcaacctgagttgagaagatccaaagatttctaaccgctttcggcgcgtataaatagaccccctgattgaatccttggtctccatcgatcgccacattcagcaacacatctcacaagaccgaaactgcaaactttgcaagcatctctgcatagtggtttcgtctgaattgtagtacacattttacacctggaaagatggcttgcaatgtgctccttttctctgcatttgtcgttgtcatgtccttcttcttgtgtagtgttcatgccaaggtcaacatgaatgcatcctctttgactaatggagatgatagtctgagaggaaagtcgtctctcgagtcgaagaaggctgtgttcgatgtgcgcaaacatggctcttacggagatggacaacatgatgatacaaaggtacaatgcgacaccgtataatgtctttgttttattaacaggcgactgacgaatagcaaaactgaactactaccattgttgcaggcattgtcaaaggcatgggctgcggcttgctcctctttgcaaccttctattgttcttgttccaaagggcaagagatacctcaccaagcacattacactatctggcccatgcaaatccagcatcacgttcatggtgagaaagatgcacccgtgcacttacatttactttcatgtgaaattcaattactcgaaaatcttatgttcctgaaaattttcagatagagggtactttggtggctcctccaaagaggtcagattggagcaaggaaactattaggcactggattatgttcaatggtgtaattggtcttactgtcgctggcggtgggacggtcgatggaaatggcaagatttggtggcaaaattcttgcaaaacgaatgcgaaacttgtaagtgctctgaatttatgtagctttacagtcttccattttatttttggaactatctgatgtgaaacttttttcttttgttttctttcaggcatgcactgaatctccaacggtgagtttgatttctaatcttctagcacatcccaatgcaggaaccttgggtattttgttctgacaaaatctgaattaattttatctgacaggccttgacattctactcctgttcaaatctgaaagtggagaacttgaagctactaaacagccaacaaatccacatgtcagtggaggattgcacaaatgttaggatctctggcctgacaatcacagcaccaggcactagcccaaacaccgatggcatccatatcaccagaagtaaaaatgtacaagtgacaggctgcacaatcaagaccggggacgattgcatgtcgatcgaggatggaactgagaacctccatgtcaagaacatggtgtgcggaccaggacacggcatcagcatcgggagcctaggcgatcacaactctgaagctcatgtcaacaatgtcaccatcggcactgtcaggctatatggcacaaccaacggagctcgcatcaagacatggcagggtggtcgggggtacgcgaagtacattgttttccagaacatgatcatggaaaatgtttggaaccccgtcattatcgatcaaaactactgtgactctgcaacaccatgcaagaaacaggtacagttcttagtgatagcttttgtgttattcagttgtccatttgtgtgaataatatggaagcttataatttagtgtttttgtctcagacatctgcagttcagattagcaatgtggtcttcaagaacatcaggggcacaagtgcttccaaggaggctatcaagctggactgcagcagaaatgtaccttgccaaggcataaccttgaatgatgtcaagctcactgtcaagggaggtggtggtgatgcgaagagcacttgccgaaacgcaaaatggaagaaatcagggacagttgttccacagccttgtgcttccacaacaactgtatgaccagccaatccagccaacacgctaattctactagcacaaggaaaaaaataaattagagtgggctttgatacaatatcacttcagataccttacttcaaaatggcatttgcatatttgtatatttagctcattttttccccattaggtggttttaagcccactattatttctctaccactctttaaattccatagctatctattacgcacacaggaaatgaaccaaactaccccatccccagttcaattaaaacggctagatccaaccacacacctaaactcgtgtagcgtagccactgctgtattgtgaaagctcgaactgccgcggtcttttttttgttaccacaaaggatgacttcctttgacgtgccaattattactaatcataaacaaatgacttttgtacgaattcaaatatcaacgctctccttagaatatggtatttgtcaggttgctttgcaacaactacctgcttctttacagaacaatttcactcatgtgttcgtctaggaggcattagcatgatgcaataattttacacaagcatacgtgtgaggcaagaggacataagagactgagttggaaacatgatctaagcgttctaaaataggggaaattattttctatatatctattcctgcacccattgcatatacagaacttgactgttcatcactacaacctggatatattgatcttcccattacttgttgcatgacacacagaaatggtgctttaatttgccaccaacatgcattttctccctcgttatgcttatctgggaactgatgataagatgcatgcctgcagtcatgcatgtggcataccatctccccaacaaaggctatatattcagatccttgttggataatgccagttaaaaatatcggtttgcaaaagctagttgtgccaaaagatttgctttttgaaatatggttgatcagtttacctatttggtgaatacataggctataaatattgcatgggattgtggagaaaaccaataatatacaaaatattattattccgatacaatacaagattgttaaacaattaaatttgaatatgttggttgactatttctaacaggtaggagatggagttagaactacaaaatgggtgtaatgtatattgtattttgttgcaacagttgtaccttatatatttttgtcaatgtggcatgagaaacaataaaaacggtaagaattagtcacatatatctaattaaggacctaacttatgcatggttgttagttgaatcttgcatatagatccaaatcacttcatatagatcaaccatccaaacaaacatacccattcataacagagtttaaaggcctttagctccattttttaaaagtttcactgttacgcgattactcatttgtttattttagctacaacgggattattttatttggctccaacgggattattttattcggctccaacaattgttctatggtaattatagctacctcaaagagctatggctcatgataatgatagaacgtgcgttccaagtattaaatattccatttttctatttggtaaaatctaaatcactatatcaggatatagatagagtgccgctgctaatttattcttttgtttattgacatttgctaaataaagggccttaatttctgttttgcacctaggcctgaaattcttgtggtactgcgacacatcatccaatccgaggttagtattcacaattaatattagaaatccactataatatcatccaaaaaactagattgtaaacttaaaggtgaacatggaactgatatgtttctgaataggtgggaatgaagccattagaaataaaataaggtataatgtataatgcataatgtgttgtgttgtagcgattataacttagtatatattttgtcaatatagcaacaagcacaataagaaacaataaaattgtgttgtttttctttttcttttcaaatattttttatttattttgaggactatccacctgttgaatcagtcactgaaaataacattagtccttttaatcactcatcattaatcagccaaaaatcgctctaggatataggtattggatacacacagtggagtagcttgttgtcctacatggcgaaatagagcaaattaaattgaaaatataatgttgatttgttttttcttagaaatatatgtgatatatttttttaaacagaaatataccgtcggtctcgcacaaacaatatgtgaaaataacgtgacgtgacgacacgggcagactcacatggcgacgaaactgcgagaccgtgtggcaggccgattcaaattgcttaattaccctctctaatcaaggtaattactcactaattattattaattaatcgctaattggtgattagtcactaattaagcgagagctcaccagagaagccgttcgctctcgctcattcctcgtcggtctcgctgttttctcgcgcgagaccgcgctctgtttcagcgatatcgcccggtctcacgccttcctcgtgcatgcttcccgtatcgtcacgcccgcgccattctcgtgtaacggttgtgcaagaccgataatatatttctgccaaaaaatatcccgaatattttaaaaaaccaaatcaacagtatatttttaaatttatttcaaatacagctgcccgcgaaaacaccattaccattagcttgctagtgccatcaagccactgaaggggtggccctcccacagttaaatcactgaagctagcatgaggcagcagtatgctgacctgccaattgaaccgacatgcaaaattcaactggtacaagagataatacaatttatttgcaaatcctaaatagtcatgacattgcacgttttaaattaagttccattttctcctgtttgggggtttcaataagcccattttgatttctttaccactatcttttccacagccagtgccctccaagtgaaccaaattaaactacctacttctcccttgttagagtagactggctggatccaaggaagatgaccgagaccgcctccgacctcatgcagcagctgcagtatcgctgagctcgagtcaccaccactgccttcttcaactagcatgactttcttttagttaccactgtgatatgagttgcatatgtgccatttttcaatttctcaaggcgctatatcgttactatataaagtacttcttttgtttcatattataagattttttaggattgcccatatttatatatatgctaataaattcagacatatatatgtgcctaattcattaacatctatataaatatgggcaatactaaaaagtcttataacctgaaacagagatagcataaatattagttcaaatatcaacaccattactagaaatgacatttctcaggtttattttaagaatatggtacctcctggtaccttctaatttataaccattacttgcttcataaggaatagtttcactcgcatgtgcatcaaggagccacattttgcatgatgcaatatttttagatatacgtacatatgtattagagagaagtgcgtaaatgaccaagatggaaacaggacgatgaaaatgttctataatagttgttgtatatctattcttgcacccacaagatatcatttcttcctatataattagtacccactaaaagtttttttttttctgtagagctcaaattctctgaggccacaccatcaagatcatcttgacctttggatcatcatgcatctatgcaaatcaaccattagatcaagttcttctcgttcatatatcaggcctaaaacaactgagcaagtcatggccggcccagcccaactcacatcgcgcacactcagctaggctcttccccatcatctcatcgtcacctcatcttcttcgcgtttcccaagcacaaatttttttgcctgtattcctttgtcctggcacaataaaaagaaacaaccgtaatctatactttctatgtagttagtaccgacttacaattattaagagtaaagcacaacatgcaagtataccgcctcatcacctactagtaattagcatcttaaatttcatacaagcatgacacatcatcttctcccacataacatttttgcattctcatttgtacaatattccatccatcaattccgcagcaaagcgcttgatatcacctagtttctactatcggtcagctcagcaactgctgatggcatccaccaatgccttttgtcttcctcttaattaccccatgcacatatagatatccctttatcactaacccctaagagcatctccaatagatgactaaaattaaactcccaaaaatcctgtattggggacagccaaaaacatatttagcctaaaatacaccctcttctccaatagatgactaaaatttggttcccaaaaatttaaaatttttccacatcatcattagtgggcccttcccaactaattttctacctgctcgttaaaatcacaggcgagagcggagggggagatcgcgtcgcgcgtgagaggcgaggaggagatcgcggcgtgcggatgcggaggggaatgggcatggtcgacgcgacgcacgcggacggaaggagatggctgctcatcctagtcgcgcgcgagatcgcaactgataccgttggcgaggttatatatcagacgcagcgatatacgaaattgatcgaaggacacagtgctatagacgcacatagagctcttcctctgtcagcgccggcggcgttagcacttcactcaatcagagctcttcctctgtcagggccggcgacgttagcacttcacttaatcaggcaactgcagcaagcagcaacgattggtgacaggcacaagctcttgtgcagtgcgtgagtagcaaaattttgctagcaaccatgttttttactttgttctatttcctttttttatgtttctgatctgacaatgtcttgatggaaaaaaaaacttaatttgatatgatgaataaatatttggaaaaacggaaggccaatcacattttttttaatttgatctgacaacgtcgcaaggggaaaaacttaatttattgtgatgaataatggtttggtagttgatttgatccaagatgagtcgacctcgctcctcgtttcaacagctcgtggatgaatcatcgtctgacgatgacgatgattttttttttgccacggcacaaatcgtccatagctattggcactctgtcaatgcaccaagacatggtgggtcagtcatgggacatgaagtgattgatcgcaacagagaagcacggcacttgagattataccaagactacttttccgataatcctacctatggcccagttttattcaggcgcaggtttgtataagtaaattttatataatttatttttgttatatgcatagatatgcatgtctcattagttatgattcgcaggaatagaatgagcaggcctctgtttctccgcataatgaatgcagtagaggatcacgatgactattttgtgcagaagagaaatgcagctggtttaattgggttcagttgtcaccaaaaggtcactgcagcaatgcgtcagttggcttatggtatagcagcagatgctttggatgaatatctcggtattgcagaaagtaccgctatagagagcctgagaaggtttgtgaaagcagttgtacaagtttttgaacatgaatacttaagatcacccaatgagaacgatacaactcgattacttgaacttggggaggacagaggtttccccggtatgttaggctccatagattgcatgcattggaagtggaagaactgccctacagaattgcacggtatgtaccaagggcacgtgcacgagcctacaataattttagaagccgttgcttcaaaggatctctggatttggcacgctttttttggtatgcctgggtctcataacgatatcaatgtacttcatcgatccccgctatttgcaaagctagctgaaggcaaggctcctgaagtgaactatagtataaatggacacgattatatgatgggatattatcttgctgatggcatatatccttcttgggccacatttgtgaagaccataccagaaccacatggcaacaagaggaaatattttgccaaagcacaggaagcagtaatgaaggatgtcgaacgagcttttggggttctgcaagctcgatttgccattgttcgagggccagctcgacattgggatgaaaagactctgggatacatcatgaaagcttgtgttatcatgcataacatgattattgaagatgagggagaagttgattgggaagaacggttcccagagggaggagaaaatgtcagagtgtcccacgatgaaatacctgatcttgataattttatccagatgcacaaaaaaataagggacgacgaaactcactatcagctacgtgaagacctagtggagcacttgtggcaacattatcctgataaatattgaggttttatttatatgtttgaattccatgtaataaatagtatacatatgtgaggatttgcaaaatcattttaatttgttcttcatgtattgaataaatggtgtactgttcggtttaagaatagtacaggagaattaataaaagtgcacttcctttatgcattttgttgaatatgtcggctggcagtgataaatgtgtcatgtggtcttcctgtcaatcatgaaaagccacagatgaggtagaggccccagaagcttttcaatcatgccaggaaacaatcaaacatcaggctctcagtgagagacaatacagattaccacaggtcaatagcaacatcaggctctcataaagtctgattcattacacagactaacaccaagggcatgataagggaagtacccatctactaacaccaacttcggacaaaacaaaaagacacaattctgaatataaatagtttgcattgcagacttagtaaacctagataaatttctaacaaaccactgatctaaactgcagctacgattgccatctctttccctcccattctctgatctggtcacaatttgttcagttgcttcttcacatgtacgaaggtctcagcgaggtggcttccctgttgatagcaataagatggagttcgaattaaccataatacatgtacagagtatagagctgccaagttttctagtctattttaattagtaatgtacaatatttgaagctacctatatgtttgtactgtaaacaataattgaagctagctagtactgcaagtgatttttttgactgatcactgtcgaaaatatggattcagtaacctatcattcaaactgaaattgaatatgcactcacatggatcagttgatcatgcagcaaggtatttgatcttcggctcttcggtctctgtaggttcattatcttcatcaacatgattggtagtatcatcatttgtgggtatagcttttcccaaaccatctgtgcttgccttctgttttttggtggcacagggtttttgggatgttatttgcttcatcttatcatgccacttggattgtgacctcaagagagtccaacagtgcaggaattggaagggcttatcttccaactccttaaatacagcaatggcctgagcaatctgcacatgtcaagtcaagtgaatgtggttagcaaacatcatatcttttatttataaactaacataaaaacacaagctacataactatgtagtaccttgtcgtgtatactaaccccgctttgtcttctaccctcaatctggctcagatatccacaaaacttgttgacattctcttgtatagttttccaacgatgcataagtgaattctggctgcgatctggtgtggatttactcgttttgtataagtgctcgtatattctagtccaatatgcagcacgagtttgatttgtgcctagcactggatccaaacttacatgcaaccacgccgacacaagtatcttatcttcttgttcactaaaattcttcgatcttttttgatttggtctagccacggtagtcctctcaatagtggggaactgctgcgtgacaggctcactactcatgccattctcatcaagctggttactcatatcatcctccacaggcatcgtactcaaactatcccaatctaaggaatcgttcccctcattcatcaaattagtatagaatccttcttcttccattatcagtaggacctacaagcaattatctccatcatgtatgttaaatggaagatgattattttgtttacatgtctatctaagcaatgcaatgttgtctgtctgcctaaaaaaacaagatgatagatgctattcagatttttcgtttgatataatattttagatttgtagacagcagcctttcaggtggtgtgctgacttaagtgcacatgcaccatggcagatagcatgccacacctgaagatctaaaatatactaacattgttcaaaaaaatttcgaccttaattttgaccttaatcatgatagaagtaaaagtgggcacaagcatatgacacacaacagatggaactggtcaatggaaacatacctcagattaggcctcagtgcagtgtgatactgacttttatgaatacaacattcaaagcaaagcagttcagtgaaaaaaaaacttaactatagcagtttagggaaaaaaaaaacttatactagttcaggggaaaaaacctcaactataccagtaaagaaataaaatcttcagtagaatatgaaactagcatgtcccatttgtcttcttgaataaaatagttttagtacaattaagtggacttcaatagaactttagggtgagaagaatatggtctgttagcaacttgtgaagactattttggacatattcatctaagacttgtatcaacgaaaacaaagaaatacacataaggaccttgtcagtactaggatatcaatggggataatatcagtgagtcaacctcaattgaacacaaagagagttagatccatggagagaagcagaaaataaatgagttgttactctgaaattacctcaaacaaatccagtagcaactcacgtcgttgagaggcgaggtggacgaaggggcacagactgccgacggtccctggattgacagtcgatggtgacttggacggaggccgctagcgctctggacggaggggcggcagcgacctagatgggctgccggcgacgccctggacggaggggtggcagcgacctagatgggctgccggcggcgccctggacggagggccggcgacgccttggagaacctgcggcgtcccggacggacggacggctggcggcgccctaacggagttggcgcgaggagaggaagctggcgcgaggaggggaagaaaggcgcggctcctcccggcgaacgaagagacggtggttgagggaaagccgggcgaggaaaaaaattggcgccaggaaaagaaaaaacggcgcgggcaggaacgattgcttcgattgggagcgcttctagttgcccaatatttggttcaggttggtcctggttttggaggtggctaaattttgggaccatgtttaggagtctgttggagagctgattttcaccaaattcctaaaatttatgttttagtaacctgtttagcattctcttggagatgccctaacaaatacatctcccagtcgaaacctacaccaccacctctgcatctacatcttcctcattccctttaaattgtatactggatataccaaccatatttagattgatccgatgggttttcttgggaaatctgtgcttgaaggcactcccttaatcgtctgaggaaatgccggtgatgaaatgaaatttggtttgccgctatcatagatgacattgaaaaattgttagcacagatcaccaattgaaaagacatctctaccactggcctggcgaaaaagaaaggacatctgtctcctaaggtgattggcttttggtactttatcatgctttagattattttgatatctgatttctattcatttatcaccaatcttaatatgccaatgtatcacaaattacaaatatggtaactttcaattttctggttagtttgcagcatatcaaactatcaagaggatcgagggatcgatctactctcagatttgaccatctacatctgattaaaaagttgtgccaaatctctatgtcttgtcttttagaccgccaaccactgattttttttctccacagttcctctcattcactcataggtaaacgtgtttcctgaaaaattatttccagattcatgtactcaacacttatttctaaaatcgtatatcag

SEQ ID NO: 66918 - DNA, 803 bp, Oryza sativa
ggacaaggtgcattttggcaaatatataggagatatggaatgatcatttgaaaaatatgttgggaatggaactttgggggaaaccaatactatctttagatataaaaacattattatgtcgccacaagagtaggaaacaaccaaaactgaacatgaaaatataattgattatatgtatatatgagatctagagctaggttgtctaaaacagtgaactaattaaaataactatgcataaaggattgtgccacaacatcagtaacttatgtattagtttaatttggcaaacatttgaataagaaaatggctgatgaatggatgaatgccaaaattcaaaatattgtgaaatcaatgttttttatttatattttttgtgatgaacatttggcatgagaattatattggttttgatatttggtagatatttgtctgtggtgagatggttaataatgatcgtacgaagacaggagtttgtttgatgcttgtggtcaaaccggtcagggtgcgacggttagaccggtgtagtgcacgcagacggcagactgaccggctagcccggcagtctggccggctggctcctattaagagttggtttcgggttgtttctttggatacttgtgattacttcatgcaatttctatgtgtgtagtactattgtgcgctaatgttgagccaagttggaaattaacttgtgctcaatatgtttcttgttcattcatgtgtaggtgtgtgatgtcttgagagagtgttgccggtgatagatcgggagttgacttgggagaagttgatgtccggatgattag

SEQ ID NO: 66919 - DNA, 1566 bp, Oryza sativa
aaaatatgttcacctatataattcacctaatagcacagaaaacaaacggcaaaactcacttctaagtaaatgtgtttgcagctagctcatttgacatacctttgagagtttgcatgtgtgcagctttttctttgcagaatttatcatgtgttgcttgaaacttggtgtactcgttcttcagtaaaccttcacactacatcaaatacaaatgaagctgacattagcaaaaactaagaggggattgttaccagatgagcatcactgcattggatacaggtcagtaacctcctttgaagtctttgatagaactttcagataattttgcctgctaatgcaaataaaaaacagttgtcagagttcatagtatatttgaatgatgcacagtaaacatttccaagaattagcttcatattcgtgttatcggaatgagttcaaaaccactttaaatctcaccacagatgtacaacaaaaaggaactgcactcatacaagtagaagttcacaggcaagtgaaatgaattggtccttcacctttctttctcaacttgcccttggcatcctgtacgatagtctgaatttctgttgcaacactgaaaattgagcagaacagttagtcatgtaatctaataatgcacgtggtagataacttcagaaacaggccacattgatacaccacattaatattgtcatgtggatatgaaaaccatgttagatgaagctatttttccatatcactggtctcaactcattttccatgcttcgggagtgattcaattagcgcactctatatgcctcacgtctgctaccttgagtacagcctacgggagatccaagacttgcacagacttctacagtctaaaatcagattcaggagataagtaacataagcagttggcgcacttgcacatcctactgtatcactggttcataaaagatagacctaaacagtatctgttcacaattccacagaaattaaagtgacgtggaccaactactgatggtcaacacaacagaactcataacatatcattggtgtatagaaacttgagcacaattctgcagaaattaagcaagtgtggatcactgatgttctgtgtgtactagcttgtgtatcctgggactggtacatgttgcacaggtacagtactgtggccgccggacccacgaggtttgggggcgccacatagggtcatatatgtatcgaggaagagctacgtcgaagaagagctacgcctcctgcgccgtcccttgtgtcttctcctatgccccttaggtgtagatctcttgtcatacttagcatccacaagtctcttgccaactaatcttccatcaaattcaaacgatgtctcaatgtcggatatagtgatgaattcttcccgcccccgctgctccttactcgggtggtcactccccaccaccttttcttgtccctgctgctggtcacgctgacggctcctctgctggtcacactccacactcctatgctggtcacgcttcacactcctatgccggtcacgctggtggctcctctcctggtcacgctccacactcccctcctggtcacgct

SEQ ID NO: 66920 - DNA, 2465 bp, Oryza sativa
tgatggtgcacctttaaaatccaatcaatggagtggatgaacaattgacaggagtgacaaactaccatagtaaacaaataagctagggacagtacagagtacattgtcatggttcaagcaaaaataaaagcaagtagatatctatactccttttaatagggagtagtggcggtggtgagaggtgaatctgccaccacccccaccaccaactccctacttttttttggaatgaaaaagaagggaccctgcatgtcaacactcctaccaccgacttcctactttttgtggtaagaaaaaatagtgggttaatgataaatttctttaactagtcttctgcccgtgcaacgctacagcgatattttatatacaaactatatacaaatcaaagaactatacagtatatgttttaggaagcaatgataataagataatttaaattcacacaaaaaagaaataatagagaatcattattgtcaataaattatatagcatgttggacatttggaatccatcctagtaatatatcatttggaatcctgcatgtgaaatacatcatgtttctgttttgttttttttttaagttgggaagagaacatgtttctgaaattgctcatctgcccgaatggctcgatctggaaaaaagaaaagcaaggtcctcacagcccagcatgtttatagtatgaacagtttcaatcaaatacactccatcaatttttctaccctgctgcatcaacgaagacatggcagaaaaggaggaactgaaggagccactcacttaggctaggagttcagatggtgaattcccaggacgatggtggtccagagccgtgtgcggttgggggatcagcggcgacgtagtcgtggatgacgggcggtgactcggtgaaggcggcgatggaggatcggcgggcggcgtggtcgtggtcgtggtcgtggtcgtggtcgacggggatcggcaacggaagacgggcggcaactcttggaggcgcgacggagatcggcggctgcgcggaggacggggatcgcgaggagctagggtttgcgagagagagagagaggggggatcggagccgggactgggcggcggattggatcgacgggagagaggcggcggtgggagggcagactggggcggcgacgggagtcgatagcggcgatgcgatgcgggagaggaagcagcggatctcggagggaggcacgggagagagagagaggcgcggatgcggtgcgggagagagggagttgcggaagggagaggagcggatgccgtccgatgcgggagagagcgcgatcaaagggaggtgcggagccatccgatctaaggttgcgttccgaacagtcttccctacacgggcaggatatgcgcacggaaaacggaacggttctctagtgtgtgattaattatttgctaattttttaaaaaatggatcaatatgatttttttaagttactttcgtatagaaacttttttaaaaaaatataccgtttagcagtttgaaaagcgtgggcgcggaagacgatggggtaacgccgaacacagctgtatccacaaatgaatttggatcgttggatgtgtcacacgataaacaaataaaactatttgttgaattataaggtaggtagattaaacggatgggcaatatgctagttaatgcaaatggcacaagacaagttatgttgtgtgtcaaggacaataatacttttcttttcttcgatacttcgatccagacttcaacagtttgtcaccataaatttacagaaagttgattttgatataaaaaagactactgacaagttttacagccatgcataactcatacagagtagaaggcagcattagaaggtaaaccatttccagtagatacaagaacgcccagatattgagcataatccactccaaatttgataatctaaacttgcaaactatacttcaacctaaccacatttatcggctacatatgatcgagcagtgccattgtttttttaccctgaggtgtcaaatgtcataaagcgttatctcctactcggcattaagcctgctaatggactgggttaaatggactgggttctagtttggattatctttggttgggtgaaaatgggttgctacttcaaatggattggatcggtttgggtgacacagagaagtggattggtgcgcccaggatttgattcggtgatttccggttgaaaatggatttaacccatggatgtatagatggccaaaaggcccgcctggtacggcccggcccaggcacggcccaccagccatcgggctggcacggctcaacaaagtgccgggccatgccggcccatgggctgctcctctcgcctaggtcgggccggcccgaaggcacgagtggcccatcgtgccttttttttaaataagtctattttacttccctcctctttgggtcgtgacatatatatatatatatatatatatatatatatatatatgtata

SEQ ID NO: 66921 - DNA, 3604 bp, Oryza sativa
  unsure (1)..(3604): unsure at all n locations
atatagctaaaatgagtctattttacgtctctattctttcgaccgtggcatataatatgtctatttttactccctattgtttatgtgtcgggcttggcttgtggcccatcatgccttgccggcccggtccaacatgccggtggaggggccaggcacggccccaacccccatcgggtcgtgccgtgcttgggccgggccaaaatgtcgtgccgtgggccgggccatcgggcctcgggcctcgggccttttggccatctatacatggatagcaagtggattcctttaatggactgagtctgactactttctgtcgtcctctgccgcaccgcacatgacctggacttggcggctgctgctggcggagaggccgcgcatggcgccacctcatccgtgggagccgagggccgaggcagccggtacgtgtgcagttgcatctcttcaaactcctcccgctttgccgcctagagctagccactcttgagccaactgggcttctcgctgttgtcccactgctcccacatggggacagggcctccttgccgtggccggtgatggcgcgctgagcctggacaacatctactatggcggggacggcgccgctgggcatgtccaccacatctaactgcaggtgtgcgacatgtacgagggaccagctgcgctgtcggcccgtcgctcgccgccgtcgtcgaggagatggtcgtggccgctgctgttgtggtgagctggctggcctcacgctgcgcctgcaccgacgtgacagcagctgagaacggcgccggtgtcctgtcctccgccgccgccacgacgccacagctacagccatgcagcacatactttgtccggctgcgtcgccgccagcaaggacggcatggctaatgaaggatcgaagtggatttaaagtgggtttaaatggtttggaaggtggattgacaccataaaaagaggaatgggttggttcggtttggactgacgaggaaaatggattggtctggtttggattttatgggatggatagtggattgggatggtttggatagaattgttagctgttgtggattggattcgatatggggtggatcttgccctacattggactctagaccctaggccatcactctgtttattgaccttatgaacgaaacctccccatgttgccaaccaaaaattggatcaagctacagcaacatcagaacagagtaaactgcaagagaagaattaccacacgagctaacagcaacggagcaaccccatccccatgccaaaatccttgtacatgccctttcccaagacgaaaaagaaaaataaaccgtgctgatgtgaaaacatctgcacaacccggattaggatcctctgacgtgaagtcagagggacgtggtgactgacatgtgggtccccccgctngtgnacccacatgtcagtgaccacgtcatggggcagttcacgtaagaggaacggcttccgcacaacccatatccgcagcacagcagagccgagcaagccggattagccgtccgttccaaggatacactgggcatttgatcgcatggctggtttacgagatccagtgacatgccggcggcgtctacagcaaccccgcatacacacacggggatcaaatcatgggaagcgcaagagatattgtgaactggggggaggagcgtcgggagaagggggaaccaatcaccacggaggtcgggagaaggggggaaccaatcaccgcacacacgcaccgtttagcagcttaattgagaagcgtgcgcaccagaaacaacagagtggagccatggaggttgggaaccggccaccacagacgaacttagcctatgtgtggttaatgctatttctattttctctcgttaagctatgtcacttcaattgtttctagctcctagatgattgatctatggtccaaattacttcctccctccctcctattcttctcttatgaattcatatcactttgattttatctttagataattaatctatgttacctttcttcttttccttctctcaatgagtaatatcacattagttttgcattcgaatgatcaatctatatatgatttaaatgttataagccacattatcttagttgtttatagatttttctcaatagttaacaaatatgaaaattatataaagtatataaaattatatcgtctagctatcttacatattatttttattattatgtaacccatgaggttttagctacttttaatactgaaggagtgcaaatcatcataagttcataaccacgccacatggacacttgacaagttgggtggtttaatttagggcacgttctaattagcacattgggattatagctaggattgttgtaccacgcttccaaaggtaaaggcaaattttgctacagaacacctaaattttgtgtaatttgctgatagatatcgaaaaaacatatcacggctgaaagacatattaaaaaactggtaatttgctagatgatactttcggcttaattggattgataaattcttaataaagacgagaatgtccctaacaccacatgcttcaaacatgatgttagagtaaaattttagaaagtatgcaactctaaatttgccatctccccaagtatatcactagcatacattatatttcaccttcgctccagtctcagcccaaaggcttttgacactaggggcattcttgtctttttgaaaaaaaattccctccaattgagccaaaagtgtcctccagcaaattatcagttttttagagtgtctttcagccatgacacgtttttacaatgtctaccagtaaattacacaatttttgagtgtcccgtagcaaaatttgccggtaaaccaagcaaatctctctgcatcagcattacctacgtaactttttctaagctattttcaactttataatgtataagtcatcttataagtaattttggctaatctatcattttagcatgtgtttggttgggagcatatcccgggatgcgatgggatcatcccatttttgcatatgtatggttgagaaactaggagggataggatggttccaaaagagaatattccttcaatattcgggatagcctcatccgaaaaaaagtggcggacgaagccatcccacctccgcacccatgactcgcgcctcatgtgcggtaaccctttcaccgcatctcaattttccccttcgttcttttctcctcacgagtctgttcctagggttagcagcgggagcagtgcgcgaggcggctgcgcgagcgggggtgagccggcgagacaaggcggcgggtgtaacgccccgattttcgttcgggaataaaaatcaattaataatacattttctagaaattaaataaaagttaaatcaatttaatcaagtgaaataatgggagaatttgaaattttcctttaaaaatcattggccgggaatattttgtaatattctttgtgccctaatgtactctccggaattttccgtgaattttcggagctcgagaaatagttttaatagcacaaagatcattgcatcaattaaaataaaaagaaaaaaaataaaatcctccctgctctctttgggcccctttcggcccaattcccccccccctctctccctc

SEQ ID NO: 66922 - DNA, 6515 bp, Oryza sativa
gcccaactttcccgcactccccgcgctctctcccgctctccccacacgagcccaagcgccgccgatcgccggcgaccctccagccggccgctgccgccactgtcgacgtccccgcgccgcgccgcttgcaccaccggcttcgccgtgccttgccgcacctcggccccactccgttttcccatttcatcgccggaaccacctccccaccgcgctccctctctccaccactcaccgacgagctccggccgccgctcctcgccgctccagccactgccaagccgcgccctaccaccgtcggcttcgctgcatcgcgtggtaccccggccgctcttccaccttcgttggagaccgccgaatcaccgccgtcgtcttcgccccgtggagtgctgccgcctccctctgctcgagccccatcagccgcctccttcgccgccatgcccctcggtgagctccgccgcctcccttttcgcctcctccgctcgttttcgccgctccccggccgccccctcgctcgtcgggccgacgccgccatcaccgttgtcgtcgtcgtccttcccgcgtcggtgagcatctccctcctcctcccctccctttctttttctctctttgcccgccggccgccgcatgcgtgtcgccgtcgcgccgcgccgcgccgccgccggtgtcgccgccggtggccgtccggccgcgcgccgccgtctggtcgggttggtcggcgagccaacccacccctccgccttgcacctctaccgtggactcggtccacggtgggctagatccttttgcccgctgacgcgtggggcccgctcatttggtggacccggtccaagcccgcacctccttgacccgctaacgtgttgggcccacctgtcggcgtcggcgccccttgctgacgtcagcgaatgccatttcctttgagaaaatatttaataattgcgcaataaatcgagtttaattctagaaattcatttaaatggcccaaaacttctaaaattcatgtctaattcattcgaactacgaattgagccattcaacttgcaaaattcatctaaaattgagctctacatgtttgttaagtttttatgtactgtttccttggtttttattagagtttttcctcgttttgcgtgccagcgtgtagtttccgtcgtttcggaagtctgcggtcgcaaggaaaagagttcggaagatcaaagtgaagaagcaaggcaagtcacacattccccttgagcattttgatcctaatttacaaatattttactgtttgcaaacaaatatgcatgttttgctaattacatggggtcagggttttacctatctgctcgcttgtgccatgtttacttgatatctgttctttgtcaaccttgggtaataaatcgactagctcatgttacttatgtgacctagctagaactatatgcttagccatgcttaattactactagctcagttgatgggataattacagtattagacctttttagtatcagaatgagctatgtgctcaagacatctggccatgcttcatggtcataattatccaactaaaatgcgactgaatggtgggctgtgggtgcatggttttgctagtcgcacccatggcagttaaggaccggttcgcgggatgccctggaagaacttatcgtacttaccacaagccagcgtgggcaacggctggacttgtagtgtatctttcctctagtcgacgcatccaggcaagggtgggcgtgatggagcggggcgggccctgcgacggcctctgtcgcttccggattcacctaggcacgagaggggactgcccgttgcccgctgggaacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccatcttaataaatcgacccaatgcactgtagttcaggtgggttggttgggcctgttcaacgtggtgtagcgttgatcagtggagattcaatattactttaattactcaaccgtttacggttttctcaataaaatgttttacaaccgcctttatgcaaatagccacaaacccctccttgtatcccctttgcacgtctgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgtcttttccgctgccgccgcttttgtttcggtgtgaggactaagtgcctctcctgtaagtattttacgctttatttacgtttggaactgtatattacttgtcgttttgtgtaccctggctggtcctggacagggatttaatacgcaaaatagtctggaaatttgggttaaatttctgggcgtgacagcgggcaagcaggggcgaggtagcagcgcgagcagggcgcgagacggcgtgcgagcaggaagatggtggtgcctcctctcttgccggtctcttctcactcttatatcctttgttcgtagccaacaaccacagatcttgccgctgctatactaaaggtcggtgagccggacaataagccaccagaaggtttacttgacacattgaaaatccttctcggttttcaggagatccacaaatctttttactatgctcatttggtttccaatcttcacattgctagaactttcgatggacttccatttgaaaacaagctgcattgggttgctatgttcattagtgagaagtcccctagatcaatgtagggttattggaagagttgaatagttcttttggtattatgtgttgttggttgacctatgttgttattatgtaaggcttaaactgccaaaatgagaacttactattaggtgcaagacttaaatttgctatttatgcgtaagaccttaaactgctataatgtgtaagactttaatttgctattatgtttaagacttgaagttactatgtgtggcttgaattttctatgtacagattgatacaagaattggtgtatgctaattatttatgatttttttgaatggactatgtgatatgaattgcattttatttccaaatatagtgatatgaacagtattctatattccaatataaaatatagtgtgatacttatgtctaaatgttatttttgcaatgtgtatactctgatgggtaacatcaccaaactaatggagtaggtaactctatacaggaatcccaccttcatccctccatccaaacaagggttaggatcattccattccaacccataatatccctcaaaccaaacaaaaaaacatggttcgttctatcccttgaaccaaacgaaaaataggatcatcccatcccattccaaaaacagagatggaactaatccatcccacctcgtgcccaaactaaacaggatcattactttgagctttgaggacggtttaaatagatatatgggattatttcccctcatttctcttcaacttgcttgaagcatccatggtggcatggctacattgccatgagcataagcacagatcaagaagcgtattactcctatatatccaatcagccgatataaagtgcaagtgcaacatcaacacccaaaaagaggttaattaaactaatcccctatgtcaaaatcgaaacatgtcataattgtaatttgtaaatagtaatttggttgcattgtcacatccaatgctcacgaccacccatttgccaccacaaccttgctcacccagtcactatctgcttaatttgttattaggtaaatgcaaatcatatataatgtgtctgcatcaggattagattgtcactgcttgtaagcctgttattagttggcctgcagctgagggcagatctctgacgaaactgaaattcccttccacaccggtcatcacacagcaattttaaacaaaaagttcagtatgaaatggagcaggatattaaggtctgtaatggctaacatttcagatttaactgcacaaacatacagtaggacagtctaagtaattaagcattagcattatgttctataaggtcagtacaaatcactactttgcgaacactcctctgaactctgaatgtttacaatacaaaactaagcacacatttctacagaattaagtaacacatatatatacaacatatatcatgattatatagaagcaatagagctacttgatcaaccatatgcaaagaagaagatgatgtgaaattgattgatcaattaagtagaaaacaagtaataatcataattagctagctagagatgatataattgagcaaggctagctagctttggttagaactttagaaggagaagaaggagcgcttggatggcaccctgccggcggccttgcagaagttggcacggtcgagcacctctgccgtcttcctcccgcgccgcgcctccgccgacgcccgccgctcctccgccttccgccgcgccgccgccgcctcgttgcgagccttctccgtcgccttcgcccgctcctcctccagcttcctctgtcaatggattgatcgatgttatagctgatgatttctgcatgatcgagttcttggtcggatcaatggcgaattagttggttttttttacctcgatcttggcgagccaggcggtggccttgtcgacttgctggctctcccagccattgatgacgacctcctcgcgcttgaacttgttgttgatcttggccacctcctccgcctgccacgccgccaccttcgcctccacctcctccttcttcacctgctccaccggcgccggcgggccgctgcccgccgccgccggcacgatggcgagcgcgttcgcctcggccgccggctcgttctcgccgatgcgcgccagctgcagcaggttcaggtcggcggcggcgggggcgtcgccgggaacgtcggggctgggcgcggacgacgacccggccgccaccatggcggtgaactcgcggctcatggtggcgaacagctcgacgtcgccgccgccgcccgcgccggaggacgacagcgagcggtggctcgcggcgtcccacgacggctgcctgagcggcggcggcggtagatgcggaggcgacggctccgggtggatgtcccggaacgcctccacctccacgtcgtcggcgacatcgtccggctcggcgcggggagccgacggcgccgggcggtgctcgagctggtccgaacccagcatagctactggctgatcagtatcgatcggatcagagggcggtggtggccatggatggatgcggggttcttggaggtggaggagaagagtggaagcagaggaggggaaggggattgggtgggaggaggtgggaaaaggaggcgcgtgcacggctcgtgatcggcatgcagggggacacgtcgctctcggattaacatgaggttttaccgttttccctccgtcaccaaataggttaatttagtctcgtagtactaaattaacttaactattaattttcatcagtagcaatagtgtaccgatggtagatgagtcatggcttcttcaacagtgtacttcgtttggcttattaggctgtttgaatttaatgaaggtaaagatgttgttagcgtacataaaacgagaaaattattaacgtgtgattaattgaattttaattattataaattttcctatttatttgatattttaaagcaaattctatataaaaagtttttacacgaaaccctccatttaacagtttaaaaagcgtggtaacggaaaacgagaaaaaaaatatgtatcttaatgaaaaaaaaaccatttccaaaaaaaatactgactagatacataactaaaatatctatattttaaaatagaggatgcactaggggactcgatctagttttaaatgcaagcccatgaaatatcttttttttatattgagaatacactataaaagtcacattggttgcccaaataatccaaaatttaaaatttcaaacttaatttagaatttgattttcagataattttaacgtatttttttataatggcttttaagtcactaagaacacatacataaaaattatatctataaattaattttattccctaataagccattttatcttattagaaaatatgggcaatcgatgaggagctaaatttgtatcctttaagtggcgggcaattactttactgatatcaatcgttggatataattttagaaactagttcgctcttttcctgtaacaagacaaccatatatatgtagacgattctcactgtaacaagacacaagacaatcatatggagacgctttatatatgcaatagagacattctagcttgtctccacaggattgtaaagatgtactcctccgtttcgaaa

SEQ ID NO: 66923 - DNA, 16280 bp, Oryza sativa
cggtgtcaaatatttcgaaacggagggagtatttggaaagtgccataggaacgtctgtgttacaaagagaagagatagaaatgagatgaactcattggtcctcttctctgataatatgccaagtgactttaccagatgatgccaagcgactggcctaaagacttgggtaaaaaggtgtggttgtgtgaggtgggaaaagaaaaatagttcaccaatgtaggggtttagatgaagatcgatcatggcatcagatgcctaccgacaagaggacataattaatttggttacatgaacaattggagaaacataagataaagatgaaagagtgtaacttgctagatgtaacgacaaatctaaagggcagcaacaaagacggacgacaaaggattatgatttttttaagttgctagaagatattgaattcgagagaatgaaaatctagaaacataggacatgagagatgattcatgccaattgcaatgtgtacttattgagtgatatcattattgtttttcatgatataattcaatgatatcctaaaataatcgaatgaaccggctagaaatttaacccatgatgatgaacctctcaactagtagctatactctactatctactgttcatattatgttgattgcaatcctcaacaaagacaaaaaagcaacccccagaaatataatactaatataatacaattaccaaaaagccatgtccaattaattatttgcactggtttaattagtggagaaaatgatagatcaccggggtccctttcatgtggatgagttggaatggaacaggcatggttacaaggtgaggcatcaccctcacattgacatggaccgtctacctctaagcttgtgacagcccagggccaatacacactgattacctgtctccttgctgtgcttttctccagggccgtcggatcaggaaagtacgtcctaaattaatttggatttcttctttaaaatttctacactctcacatgtggaatacctttctgaactcatcgctaccttgtacatatactttctctatttcacattataaaatattttaagttttgaatagatttatacatagatccgtttacgtgctttatatatgtttaaattcatataaatgttaatgaatctagatgaaagattggacagatatagacatattataatatgaaatgaagagagcatatatctagaattatgatatgctgatcttaccctaggagcaatggagaagaataatataaaagaaacagtatacctctgtaattaagcatggtgatcttgattaattaagttccaaagtaatcactcctactaatgagtactgtatataagaagctggagttcgacctatgtgttgtccaaaaacattgatggtttaattttctctcagttactccagacaatgccagggcatggaatctgctgaagaacaagttcagtcacatgaggtggttagcaaaccaaccttcctctgactaatttaatagcatgttgcattgtttggttgagattttttttcccttctctttgatatgagaacaaaataacaagaagcaagtcaattatatgcacatgagtgatagatcaggtgcagccggtgagctgtaccctactgttcatattgcaatatcaattactaattagttatttgcacttggaagttgccacactgttcaggcatggccatcaattggctaactagctaggcatgccatttcagaggcattagtctatttctaggttgtattaagaatggcttattccataaagattagggttttttaatttattcaaaaagtaatggaggagatactaaaaccgacacatctttgaccactaaatgcaaaactcactatctcaacactagtaggcgacattatagttgagccttgagataaaattttctaattaagatgttttaagagagcacttgtattatatttttgtattatatgttttaagctggagtatgtggtttgtactcttgtatctgcatctgtatagtattatacgactacatgtatttacctcttctagtaatattaaaagcatatttaaacttcttaggtgcgtttgatttagattattgagcaaactatcgacttgattatataaataaattaaatattttaagagataaacttaataaatagattaaaataagtggtcttgagaacacacatttttcaaggtgtggatgaaataatttatcttaataatttaactgataatctcaaaataaattgtgtataaaatccagacgatcttcataatttcattgaagaggcaacgtactttagccctgtttaggttccaccttaaaatttttcaccctgtcacatcgaacgattaaacacctgcatggagtattaaatataagctaaaaaataactaactgcacagattgcgactaatttgcgaaacgaatcttttaagcctaattgcttcatggtttaacaatgtggtgctacaataaacatttggtaacgacgaattaattaggcttaataaatttatctcttggtttactgacggattatataattagtttttctattattgtctgaacaccccatacgatatcctttacaatactcgatgtgacacgctaaaactttacaaccctaaatctaaacaccctttaaaaatcggaacgtgaacgtaaaagagacctcaaatgataagatgaaatcgtgaaacctaagattaataaccggttttccatttctcccaatgtcgctgctgtccggacaggcagtgagacaggcacatcccttctacctcggctctgattaactgaaactgacacaaagtttcagaagcccaaggcaacacgtaacggtttcgccagaattacgtaaatggccctgggtggagagcccaacaaccgcgcggccgggctgtcggtggcatcgaagaaaaaaaaagaaatgagatccacacgcgtacacctaacatgcaaaacggaaaaaaaatgaaagaaaaggaagcatacgtcacttaccggtgggcccggctcactgttgtgtcggtcgtggatgttctgctgctgctagcagggctcacagctcgcaacagttgttgggtgtcagctcggtggcttcctccattttcacatgatttaatttctctcttgttttttttcctgttgagaatgaatttcacgtggcaaaaggaattaaatcatgtattgttgaggatgcataaggcgttgttttaaccacttcgaataatgaattgttagcgtatacttcgtctgtcccaaaaaaaaattaatctaggagggaatgtgactcctcctaaattgatgtatgtggactaggttaatttctttggacggagggagtatatatgtaattattttcaacttattccatggtgtgatattcgtcatagatagttagaagactgactttacatatacatgatatgttctatacattatttaattaccaaacgatatgtacatgtcatggtgactacatatattagtaacaattaatgtgattatagttgaacaatatgtgaaggagccatgatggtagtacagtgcatcatatctcgttatctcccactaaatatctgctagtgacaaccactgtacaggaaacttgtttgctattccattgttccactttagttggtgtggctcaagccacaattaaagttggcatatacacttaattaaaaggcatacgtaatcatttataaattttattggcttgccataacacttgaacaagcttgctttgttacaaatatatcccttcttgaaaaatctatggttattttagcaagaaaagaaagcatatctatcactcattacaacattgtttgtacctaaacaactaaacataatgtttttatttttgttttcatagcattcctctctcaaatacacacgacataagtcccctattactattactattatcggtgcctggttccttatacaagttaatttcttagggaaaacacgttcattcagagaaccaatagatttatgttgtcgtgtatcatttgtttttcttatgttattttctttcccattggcatgcgagcacttctagtgtttagcgtactcatattcatgagggtcaagcaataatagcttcctctcatttctcatcgtcgaattgaccgtgacagacagagtattcgagataatcacaaacgatgagatgagaatattggggatttgcaaattaatcaggatacaattaataatataccagtcacatttagccatacgtgatatagaggtggatttgttatcgaagagaggtaaaaccattacttattatttgaaacgtaattgctaaaaaactgtcacgagtttttttggaaaaaaaaacttttagatataactatagtatagattgcaatgcaatagttatagtgaaaaaattatagttacattataactgcattataactacagtgtaagcacggtaactccaatgtaatttctatataagttagatataaagttacatatactattttaatacttatatataagttacattatattttatttatagtagaattatattacaattatactataagttatggttaccgttatacttgtgacagttttttttaaagatatagtcccattttgaaattcttagaagagactgtgtgggcctagcaatttccccgcaacagccgcgatccatgcccgcgcggtgatttcctctgtcggtgcccgaccgccaacgcccgctgacacgtgggccccgcttgccctccagctcacctttcgtctacctcccgcctcacactcctcccctcacctcctctcctcgattaaattaacccccgaaatccaccaccaaacgctcgcgagattaatccgattttaatcctcgagatttgtttaatggcagggctaatctcgccccaggccttgtagaaagcgacacccaaaccaactcacctccattggtgaggtgccctgtccttttctctctcctcctcctcctccatagttaagctccccaccaccactactactagtagtagtagcgctgccacctcccgctccactcccgcgtcctctgctggaagccttcttctcctcgccgggaggattccaggtaatgcccgctccgccgccgccgccggtgactctgctctggtgtgtttcttgggtatcagttcttgatctggatgttgttcgattcgtttcttggcagcgcgggatgcggcggtgctgatcccggtgtgcacggatcttgggtgtgattcggtgagctgagagctggtttgctgctgctgcagcgtgcgccatggacggcgacgcggatgccgtggtgagtgccccccgcccgaaatgccgatgggttttcggccgcatctcgtgtggatcttgtggaggagactccagattttgatttgatttggttttgatttggttttgtgggtgatctatctgttgcgcagaagtcggggaggcacgggagcgggcaggcgtgccagatctgcggcgacggcgtgggcacgacggcggagggcgacgtgttcgccgcctgcgacgtctgcggcttcccggtgtgccgcccctgctacgagtacgagcgcaaggatggcacccaggcttgcccccagtgcaagaccaagtacaagcgccacaagggtaaatgctaccatctctctcttctcctctccctcctctccatttccgccgatctcgccgccatcgactgtaaataagttcagaaacatctcagaaaaaaaaagtctggatctctagttcagaacagtcaaaacgagcattcttatagatggatcctgttgctttcttgttaggaaggtcatacaagatccaatgtttgttgattttttggaaattcagaaaaaaataatgtcgattagtaaacgatgttacagtcatgctaaggctttgctgaactgtgtatggaattattcagggagcccggcgatccgtggggaggaaggcgaggatactgatgctgatgatgtcagtgactacaactaccctgcatctggcagtgccgaccagaagcagaagattgctgataggatgcgcagttggcgcatgaatgctgggggtggtggagacgtcggccgtcccaagtatgacagtggcgagatcgggctcaccaagtatgacagtggcgagatccctcggggatacatcccttcagtcactaatagccaggtgggtgcgagtttttaacagatcgtggtatcagttgtccgggtatgctcaaatgattaatcttgaattggattttgcagatctcgggagaaatccctggagcttcccctgatcatcatatgatgtctcctaccggaaacattggcaagcgtgctccattcccctatgtgaaccattcacgtatgtttatttcttgatatgatgtcacttctcattaggtacatccgcttgagatctaagatcgtaattatcttttcttgcttctttctagcaaatccatcaagggagttctctggcagcattggaaatgttgcctggaaagaaagagttgatggctggaaactgaagcaggacaagggagcaattcccatgaccaacgggacaagcattgccccttctgaaggtcggggagttggtgatatcgatggatccgctgattacaatatggaagatgccttactgtgagttctgacatcttcccctcagggaacataatcttatacgggatcattgcgctgacatttacaaatgtagtatgtgtggattctatctaaaacactgactaaccgaaaattattatatcgatgtttattgtttttcaacatagacatcaacatatagccaagcaagtgggtgacctaaatgtattaagagctgcacttttttccactaacacttccagctataatttttggtacatcgaattggtactaaacaaaaagaggtgtctgtcctaagttcctagtcaactcattagtgcagttgccctgaggtgaatgagggttttctgtccctgatagaaggaagcaaaaatatatctgaaagttacaaattgaaataatttagagattaaattatgtgagcatttttgatggtgcataaacaagtcttgtggcattaactttatgcatttgaattgcaggaatgatgaaactcgccagcctctctctagaaaagttccccttccttcatccagaataaatccctacagaatggtcattgttctgcgtttggttgttctaagcattttccttcactaccgtattacgaatcctgtgcgcaatgcgtatccgctctggcttttatctgttatatgtgagatttggtttgctttgtcctggatattggatcagttcccgaagtggtttccaatcaaccgtgaaacctaccttgataggctggcattgaggtgatctcctttttagttctgttgtacttaatccaaacaaacatccttattcatattgctgatgccgttaccatctcatttccattaacaggtatgacagagaaggtgagccatctcagttggctgctgttgacatttttgtcagtacagtcgaccccatgaaggaacctcctcttgttactgccaataccgtgctgtccattcttgctgttgattacccagtggacaaggtctcttgctatgtatctgacgatggtgctgcaatgctgacttttgatgcattggctgagacttcagagtttgctagaaagtgggttccattcgttaagaagtataacattgagccaagagctcctgagtggtacttctcccagaaaatcgattacttgaaagacaaagtccacccttcatttgttaaagaccgtcgtgccatgaaggtttgtttgctttataaacacattaatattaattttgctatcttctgctccaatgctaacagtcttcccaaaaaaaaaacctgttacagagagaatatgaagaattcaaagttaggataaatggccttgttgctaaggcacagaaagtcccggaggagggatggatcatgcaagatggcacaccatggccaggaaacaatactagggaccatcctggaatgattcaggttagtgtatttcaaataaaatctactatgactatggttgatgtagcttcttttacttgatgattatgattattgctttgctgattgctctttctgatttttcttaggttttccttggtcacagtggtggccttgataccgagggtaatgagcttccccgcctggtctacgtatctcgtgagaagcgtcctgggtttcagcaccacaagaaggctggtgccatgaatgctcttgtgagtagttgaatatttacaaaacttacactatctagttcattttcacttctcttctaaagttctaatggaggattaatctttttctgcaggttcgtgtctcagctgtgcttaccaatggacagtacatgttgaatcttgattgtgatcactacatcaacaacagcaaggctctgcgggaagctatgtgcttccttatggatccaaacctaggaaggagtgtctgttatgttcagttcccacaaaggttcgatggtattgataggaatgatcgatatgcgaacaggaacactgtgtttttcgatgtaagttggcaattctcctttaagattctcgctcatctgcaactactagtgatagtgtaatcatatttgattaacaaatgatgctaatattttttgatgcactaattttaaatttctaacaaattcaatattttttttggggatatttctgtcttctacagattaacttgaggggtcttgatggcatccaaggaccagtttatgtgggaactggttgtgtattcaacagaactgctctatatggttatgaacccccaattaagcagaagaagaagggaagtttcttgtcatcactatgtgggggcaggaagaaggcaagcaagtcaaagaagaagagttcggacaagaagaagtcaaacaagcacgtggacagtgctgtgccagttttcaatcttgagatatagaggagggtgttgaaggtaccatccatatgttccagttattgcataatttaggattataagttgtaatcaacatatatgcatcctgacatatcatctatatggcaggtgctggattcgatgatgagaaatcacttcttatgtctcaaatgagcttggagaagagatttggccagtctgcagcgtttgttgcctccactctcatggaatatggtggtgttcctcaatctgcaaccccagaatctcttttgaaagaagctatccatgtgataagttgtggctatgaggacaagaccgaatggggaactgaggtaacatgggctttctcacagcaacattggttacattcttttttagtaacttgtgtaaatttacaccaggctatgcaacttgcaatggtatgttaatgctgacatatgttgcagattgggtggatctacggttccgtgacagaagatattctcactggattcaagatgcatgcgcgaggctggagatcaatctactgcatgcccaagcgcccagctttcaaggggtctgctcctatcaatctttcagatcgtcttaaccaagtgcttcggtgggcacttggttctgttgaaattcttttcagtcgccattgtcccatatggtacggctatggaggacgccttaagttcttggagagatttgcctacatcaacaccactatttatccattgacatcgatcccgcttctcatatactgtgttttgcctgctatctgtttgctcactgggaagttcatcatcccagaggtaagcaatgactgcttatacatacccttctatagaaaatgtttgagacaaccaaactaactaaattaattttggaatgcagattagcaactttgctagtatttggttcatctctctcttcatttcaatttttgccactggtatccttgagatgaggtggagtggtgttggcatcgatgagtggtggaggaatgaacagttctgggttattggaggtatatctgcgcatctttttgccgtcttccagggtctcctcaaggtgcttgctggtatcgacaccaatttcactgtcacctcaaaggcttctgatgaagatggcgactttgctgagctctacatgttcaagtggacaacgcttctcatcccaccgacgaccatcttgatcattaacctggtcggtgttgttgctggtatctcatacgcgatcaacagcggctaccaatcatggggaccgctctttggcaagctcttctttgccttctgggtgattgtccacttgtaccccttcctcaagggtcttatgggtcggcaaaaccgcactccgaccatcgttgttgtttgggcaatccttctggcttcgatcttctcattgctgtgggttcgcatcgatccattcaccacccgtgtcaccggcccagatacccaaacatgtggcatcaactgctaagaaagcaggggattgtagagacagaaatactgccagttgtgttttttcagaatacaaagtgccactgccaccaattgtgttttaagttattaggaggtggctttatttacagctacgtacagaccagaaaatattgctcatcagaaagttacttgtgtcgatatgtattcttttgttgataagttatatactattttgatgagagtggctgacactgtcaacgagttttgtatcttatgaaggacacaataaactattagtttgcattctttaaatttccgttcagttttctgtctttcagccttatgcatgttggcagcttaaactaaatattctttatctgcataatactgttaattggctggttgattgctgtagaagcatagcttaaataatgtttgtgctaatgcattgtttcgggctgccgaaaagaagatgcctgacaatagtaaatgcaatttaaagaaaatctatcctttttctgggctgccgaaaagaagatgcctcacgatagtaactgcaattttaagaaaatctacccattttttctttgttctttacatcacatcaaacaactttaggtatgttggaaactttttgatgaaatatgcttgaaattatatcatattgagaagaataaattgtgacttttgtaacgagttgtatatctatttctaatttttcattactcacaatatagaattttaaaaatatcatttgtgtataccgaagatgatgacaaaattagaagattgtttccctcgcttacatgtgaaggaacaattctgatatagatgaaatcatcatcggcaagatgatatggatcgaacaattctgatttagatgggataacactaccatttgcttgtctgtcttctcactattataaaagagataatgtatgtattctcaatgttatgaaagggatgagtgatgaacttcaaatatgtcatgagtgatgaacttgaaatatgtcatgtaacctaagtgaatttaacacaagaagtgttgataattatttactcctttgcaagttttgataatatgtaccctgaaaactcactcaatccctttcattcccctgaaatttacccgatccgttctatacccctgaaatttcaacgtgtccactaccgttacattttccttcatttcactaaaacatttggttgcaaatgttgatgcttaatttgaatataagctcaattgaaaattttgtttgagtacatagtatgtgcattattttatgaaactaatgaaataattagtgcatgaaaatttgacataaattttgaaaataaaacaaatataataaattaaaatttctatttgaaattttaatatgacaatatatattttttatcgggagcattcattaaaaagttactgtgagcatcggtagtccaatctttgtatgaatgctcctcatttttatgactttttttttaaaaaaatacatatttttttatttcattatctaaaaacaaattttgtgataaataatgcatcgcataacaaactcataatgatagtctcatgtgacagacttttatatttttaataatgtagctcataaatttctatgttcatcgaaaagataaaatggtcatttttatagaaattagacggttactaatggtcaattgatgggaggagtatggaagggatctaaatcaaatttcgagggtataccagaagtaaccaaaatttaagggcataaaagtgattagctaaaataaatttgaggggtatgcaagagattttctcttctagtaactcaacaaaattggtttccttcaaagtcccaactatttggtctctccacctcagtctaacaccgtagttttatagctcttaattcttcctataaggtacaaaggaaccgatatatgttggctttatagctcttaattcttccccataaggtagaaccaatatatgttgagacaccaagcgtgtgaaatgtttcggatgtaagttgcatcatttgttgtcatgcaagaagttctttaaacatcaatttaggtggactcacgctacaagtgtttggagatgagtactgaagggtggtatggatattcacagtgaacatattattgtgcagttactaaggtggataagtttatatgataataaaatgtatcctttttctgaattccttttttttttcctttttgaaatgatacttttctgaattctgaatgaaaaatttcgaacattttgcatgatgtatgcacaatttccattcatgtaatcatgctgtctctgtggactttggctcaatatgatttggcaaactatggctacatagcaaaaaaaaaaatcattttgcttaattcgattcgaattagaattgccaaaagatgctaccagtgaaggactttggaagaaggtattcagatttctgatttacggatcacaccatttgattaatcgatttatgctttttattaactccacccacataccagattaaaagactaaattagttctcagtttctcatcttttttttggtgttgggggggggggggtggggaattgaaatttccatcgagtatcacctatactagataactccgcctgatccacatctagattgtggttaagaaaaaaaaagtccaatctgcatgaacattttcaaattaaatctcgcaaacaacattgttgaatacgcatgatctactacctcatattcagctagcatttaggtggcttttattgttaaaaaaagtccaatgttgtttggctgatcaatcaattgaccaataattctttgttttttccttagtactccctcatccgtgaatacaagagattatgatcctctagtttgtccaaaaatataaggtatttttgttgtcccaatgcaagcaaggacagaagttttgttatccggaggcaaggacaacaaggacactatcaacaacaacttttcatttacccacattcaaaaaatatagaaaaagtactactagcactactccctaccatcagcagcagtgtgtacttctacagttatttaatgtgccaatccatcatttagcaacagatccttaattagtgctaaatggggaataatcccttataatcctagacggagggaggaagagagaaccaactcacttgttttaaaatttggatctgacaaagcatggtagtggtaataagttgcaacaatccaatttcctttgaagaataaagttcaataatcctttgacttagcattaacgaacgctaagtactcacaacagatcacaaattcaacacccaatacagggatctttgcatatcgatccaacaatcatgcatatgctgctcaggtgaagaacatggatgtgctgtgcaaagctgcagctgttgtaccaacaatattacgctttttcagcgttatgattgtggatatagagggtgtgactccatgtctcgttcaaatatgaattgaaaatactttttttctttgccatgatgaccgaatgtaaaaaagttacaagaaagtttttcgtccacaattagttatcaataaagatgtgcacaagagcgcatgttctaaaaccacggaccaaccgcacaaacacaagctataaaaggaaagccgaccaacaaactgactattgctatgtgaggctagtggtcacggagccaataacaacaccatacaccatagaacggagactctaaaaacaatgtttccatgaaggttgcgacgtcaaaagacaccactatcatcgtccatccaaacaaactgtacagacacctaactttatgcgaagacataacaactacttagacatggccggtacatcagaacatgttgagtataacaattactcatatgatgatgtgaaggtttaggtgctacagattgtatttccaaatcaaatatactatctccgtcctaaaatataaagttttagctataaatctgaacaattgtctgtttagatttatacctaaaaatgttctattttgggatggagggagtgcttaatagcttaaagctcacgtatgactcaaatatatatacaaactatacacatatttttttaaaaaataagtaacataaataggaagcaaatatttacggattctttgaaatgcaaatcaactaaaaaattaaatccctaggaaaacaacaactatatgggttgaatatgaaggtgacaaattgctaagtaaacattatctaggaaggtaaaacaatgagtacagtaacaaaaatagagtgaaacttctgctctcgaaaatttatgaaactctagatataatatgcgcacaatactgtgcaatgcattgtgcctgcaacccactaacttcagttgcagaattgcagcctataataataattcaactatagtaatacaataaatttggtttcttccaaaatctcactactatctcaatcatcccaaattaaagtttttcttatatagttgagatgtcacatatatacatgcaagacatgcaacatgcaatattttcccattcaaatagatttctaaataccatacgaatttttgaaagagaaaaagttcatgtgagagaggatatttgcatttttcacctcatgcaaccagcattgatgaaaatgccatatgccttgcgagaacaccaactctgtgactcccagataaattacgcaaggttcaccgcaacagattgtggttcctaatctttttgttccatcttgtcttatctctgctttgctctcttgtgtttgactatatcaatttgctcttgatttcagccatcattaatggaatagcattaattgtactaaccaatttggagaagtgtttgccagcgttgttttgttatccaatttagtcactaactacttttataatttgaggtgaattttttaaattttggtagagatctttaatttttagtagaaagttgaaaaatttgagttgaaagtttcaaaacctgattgaagctttttaaatgtttagtgcaaattttaaaatttgaattgaaagtttcaatttctcattagaaagtttacttcaaagttcaaacttgaaacataactatttactaaaaaaaaatctgtattataaaattttacaagaaattttaaaagtattcagagatgactacaaattgatatacaaaatttaaagctgcacggccacacggccacacgggcaaagacttgcagtctgtcttggtcttgttcggtagcgtggacatgtattagcttgtttggcctatgattatttggaactaattgataaaattctagcagtgttccattgtggttcaatctaacaatatattttccaatatgtgttgacattattaacataatccaagaaacacatttaacaatcaatacattcttccccgcaaaaaaaaacaatcaatacattcggggtggagacagacctggagcaattagggcttaagcccaaggcctagctccataattctattgagaccacatcaaaccacatcaaattaacatggaaaatattttaagaagtcaaagaacagctaactcaaccctaggcgtcatctattcaccgctagaatactaatatttgcttaatgtccaagcaaaaatcctactaataaattaataaaatgcttggctagttaacctgtggccaatgggatatttatgtaatgatatataccactcagaaatagttgtaaataccaacagggcacatttgtaaacaagtttttaaatatacttctcagaaatgcttataagtgatttgacagtgtatattagtaatcgagggttttgatataacactaaaaaatgattgcaaatcgttgatgtgcgtactttttccgaagtctaagatcgggacactcggtaacatgcaaaaatt

SEQ ID NO: 66924 - DNA, 2076 bp, Oryza sativa
attcctgcagccctgggcatttatctgccttccttttattgttcatgatctttgtttggatgatcaatccattgacctattatttttttcctggtaggagaaccatactgttctgatgtgtcttgctgtttgatgcttgatttaatatttttggatttgaaaacaaaaaacatgtcatgggtctgatgtgtcttgctgtttgatgcttgatttaatatttttggatttgaaaacaaaaagcatgtcatgggtcagctacattctattcagcttgttggctgagcttatgacgtacatgcaaaacgatgcaaatcattagtgcgtgattaattaagtaggagtataaattattatgaacttaaaaaatgaattcatttgctttttgaaacaaacttctaaaagtttttgcacgaaacatactatttaaatttcggaaagcacgctcaagtaaaacaatgatgtagcccagtcaaaaagctcttacgaacatagcattaaatccaagatgcatccatgtgtttttacagagcttacggacaccaaacgatccggcacaagctgctttgttgtttcctctacgcgactctatatctttcattggaatctgaaaatattatatctaactccctatgaaaagtaacaagtcgagcaagttgatacaatcatgatgattaaggtttatgcggaccatgttgtgaaatcaaacataaattaaaaactaatagtcaatgttcagctaatacacttagaactcaaatagatatagtgctgtcaaagccaaatccttgtgatgcattgtctccatgactcatcaacttcagttgcagaattgcaatctatcctagtaatgtcttgttcaaatcaatcccgtccacaagggtattgagctggatttggccaatccctcctttttagggattaaacgataattcaattacactatataaataaatctagtttcctccagaatctcaatgctatactctatatgcaaggttccaacattaaacaatggttggtgatgtgtcccattatccaaaatcatggttggtctcaatcatactaaagtagaactgcactgctggtttacttatgagatggcatatgtatgcatgatcatgcaatattttcctatcgaaataaatttctaaagaccgtaccacattttgaaaagagacaaaaaggcatgtgagaggaaatttacagttttcatctcttgcattggtgaccgcctttcggtcagacattgcaagagcacccacacaatcacacaaactcgattccatatcaaatgaacggattatacacctccatatgttccatatatatagagacaccaacaagatttgcatgggggaaacacatggatgatctgcccataatcgatatgggcagatggagcatatatgcatgatatgtaatatttcccattcaaacaaactttaaagacctataaatgtctgagatagaaaagacatgtgtgacaggaaaaaatcgcatttctcaatctcatgcaacaagcattggtaaatgatattcaggtattgatcaacattggaagagcatcattaactagattgaggggaaaaaagttgcgaacaacaaaatgcagttttttaccatatgcaataactgctatgtggtggtgtatgctgatggaaatgatctcatgcaaaaagtattagagtacgtgtagtaattaaccaaaccttcttactacctcaattctccgattttttttcataagcccaaagcagaaataaatcaaatacataatccttctctagccatatttagaactgtactctgtcccacatctcacaataagttgtctctaggaatcccaataaaatttagtgaggttttacagtgtttgcgaggtacttagaggtattgagaggtaatgtgaaccgttgatcaagagaggggcaagtgggtgagtaggtaaggggccttgagggatgaaatttctcaatttgttaactgagggtagggtaagagagtaaaaattatttgaactatagaaatcaactttctatacgacgcatagtagttttgatcgttgtgttgatgaca

SEQ ID NO: 66925 - DNA, 711 bp, Oryza sativa
tcactaaatagacaattgagatatgattcttattacctggaaaacacattcttatcatagtcacggaatacagttcatcttatcatcgaacatttattggagcagagagaaaataattctttctactcgattcagtggaacagaaagaggaaatttgaaaaaacgaagtgaaattaaaagatcacatcgaaatatattaattaaaataggaacacacaccgatcaccttctactggtgtcgtgtcacactgtcactttgctacatctctacctagtgcacattagcaccacatataccaagtcaaacatatatccgtcacttaagcaatcccgttgagagatatcatgtcagctcgaagtagttcagagattaacctttcacccagcggctcgaaattgtcaagtgaaccagttaataactatgcacccgtcaacaacagtttcactgtcgttacgcaaatcggaaagctcccaaacgacctgacctacgagagcgttgggcgaaacactccatcatcctgtgcgtgaatcgtctgaatatacacgcaattcatccggccaactccgctacggaatcacggatatgcatggatgatggaggcagttcatcccaggtcaactaacccttgcctaaaacggccggagtttcagttcaggccgggcggcgtacgtcgtttggacgctgcaactacatgactgggctgcaggaat

SEQ ID NO: 66926 - DNA, 990 bp, Oryza sativa
ggatgagggaatccgtatgacatgtgggtcccacaattaaaaaaaaagaaaatgctgctggattgccacgtgtacgccacgtaggacaaaatcgttctggattggatcgagggggtaattcgtccggtattaaaagttcggggtgaacaatgtctggttttcgggttcgcgggtgtaattcgatcgaccgcacaagttcaggggggtaattcgtactttttccaaaaaaaaagaggagaaaaaaattgggggaagttggaagccgtcgcggtaggagtagtcagtcgtttgtgttgtgtgatcttctaatctatctatctatctaccctataattcaccaactcactcttacacctacgttactcattcatcaaatccaacggaccagaatatctcccgatcatctaacggtccagatcactcctcctcccccgcgtgcgtgttctctccccaaaacccgctcccctcgccgcctcgcccgctcgctccctccttcgcccaaccggcgtgcctcccccacgtactcccccgagcaaaccctaatcatcgcactgcctctccggcgcctccatcccctcctcctcgccgtactgccttcacatcgtcgccgtcgctcctcctccccctactgcattcctcttgcggccgtcaccaacgcactctccaccaaatccctattgctcaaaggacgaacaaaaagaattagagcgaacaaaaagaattagagagatggggattggaatcaagagacagatcagtaaggaccgacaagccagattcgtcgacagatcacaaccgatttttgggtttgatgtcttccatttgatttttggcgctcctccctccttgctccgatctggcctaagtgttgccgcccgattttcgcggtcgatcccggcaccagccccttcctccggacgtgtgtgagtccgacattccaagtccccgcggtcggatttctcaaccccggcatcggcctcgcactgcaac

SEQ ID NO: 66927 - DNA, 7589 bp, Oryza sativa
aaccacttgtattcatactgtagtttaccttgtgtcgtttaagtttgtctttgcatatattaatgaatggcatgcttgcacacacacggaaagttctgatttgtgcatgcagtgacaatttttccctttaaaaagtcaaatttggtttacatttttattcatgacacctaaatatgtaaaatgtcgtgcattagtaatgtgcaagcactttcgatgtattgtctaaactctaaaggaacaacttaccagtttattagtgaattccggttgccacagagcatgcaagcctagatgagtacatggagaaatggtttggactggatcaatactgggcatgcaacaaattactgcgacagcacgggcaaaggttaattaagcttgccttgcgttctttactgaatggtttatgcatctgtttaggttttatgattacaattttgagtttgcaaatgtttcagtagttttactcaatgccctgtaaccaatcatgtatttgatccaatttagtaatttacgcaattgagtttagaatagtttcacaaatcaattcggagtcaaactatcaattgtttttggtgtttcaggtcttcagactgaagtttcaaagtagcttcatcaaatttttgaaagctttcagagtgattgtggaggtagccatctttgccctccttgtttcaggattgagtatatgagagactgaagtgaaggaggatttgtgcatgaaaaatattgcagaattacttagtatagaattacatacatagtaataaaattctctaaaagataagagtaatctgcttctctctttcttgcagtagcctttggaactaacactactatcaaacgattagctctactaactttcttccttgcaggaggcacaattagcggtgcatctctcatgctctgtgttacttcttttgataagataaactacagtgagaaattattttcatgataaaatgtgcaaaattccatatgtagactgtattttgcttcatactgttttgcatgttcaagaattaattgtattgttatttacttcctcaagtcatagaaaaatccttatatgaaaaaggaatatgacaaattaaagaaagcgtgttatacaagaccatattcatgcttctatgttaatcttgtcaatattggaaagcctggaggttagtgctaactaatataatgcctttttcactcttaccgagttttgtgcccttgcatctattatagattaccgagatatactgaacaatcagtattagagtttgaccagttcaaagggcagtgatgttgatattcaaggtagagtatatggaattttatctgcttgctatctttgctttcctgtttggcataagcatctttaaatcattttctgcagcatggcctaattaataatttctttcgctgatcagacaaggattgattacctccacataaaaacgcagacaagtctaggctttatgtggagtgctccatggttactgataactccaatgctaacatatcttctgaagatgttgattttttgaaatgtaaggtatatttcagtccccttagctctccgagatatgttgtatggcacagtgaaaaagcatctgatgaactcacttcagattgtttattttcaagatagctgaacgcctgaaccttcaactagactcaagtatgagtctgtagtaggtttcaaaagtgaaggttttattatagactagaaagagttacttcttattttacagtattctgctttgattggtatatattttccagtgcaacagaaaagtgcctcaaaccacaatgtgttttgtatatatatagctgcagctttgatttgagacattggagagtcatgatagtttgatcattaaccacattttaaaaatgtaaaatgtataaaatatacaacattgtaattttaccccttgtgacgcgggttccacgtgcacacaaatggtttctctttgtttatttgcatattccacataagtcctccatatttagtgattcattggttcataaattacaatataaatgcagaaactttagtcatatatgtgcatataattgtaagtgaaatgacaagacatgtaattttttgggcaaaatttagctatatcggctgtttcccgttgtttatttctacacatagatgaaaacaccgatcaactgactttgattacgaatgtattaaatgagcgtcaattttagttcagaggttcattcgttagtcatccaagagagtccaccttgcttatcacagaagtttatcttcaagttatgaaatgaccaatattcttttttgtgtaaatacaaataactacagtgataatatacattttggttgttttgtagccttgtccagataatcaggaccacatcaagcggaatggatggcttaagtcaagctaattttagatatttattattttgtgtatttgagaggagcaatacctgtactttatagcatagcaagggacggcttgttcctagatggtattgtggatacatgctgattaatttttttctaataactctatcgctcttttagcctaactatctgttctatgtaccattgatgaagcatatattgtgtcgctgttatttggttgtttcatttgcaatattagttgtcaccgtagcgttagcacgggtatgctactagtgaggaggaagaggatttgcttcgccgcgtcggggcgggggggcgtcgcgttgagattcgtgctggggttggggttgggtcggacagtccgtgcaccgcgtccatgtgtgaccggtactggtaccagctccaaatcatctgtagtgttcggatgccccttttccatcctctatacgaaagttgcttaaaaaatcaaattaatccatttttttaaaaaaaattagctaatacttcatatagacatatatatgaatctaaacatatatatatatgtatagattcattaacatctatatgaacgtgggcaatgctagaagtcttataatatgaaatggagggagtagtacttaattaatcacgtgctaatggaccactctgttctccgcacgtactgttcctagttgggaactagcaactgcgaacacaccctcaattcatacaatagttatatgtaaaggtatatcttacactattaatatctggtcacgcctgttatacgcacattgcgtcgtgaaatctgtgttgcagctggctacaaatctgtagcccgctacttatctctctcttcttttatctactcgatatgtgtttatagctgacttataatctaatattctacctgctctaaggtggtgtttgaaactaatgaagatgaagatgaagattaaatagatgtaacgtaaaacgagaaattcattagcacataattgattaagtttaagttattacaaacttgacaaattattaattgaaaaaaattctaacggaaatcgagataaaatctaaatctcttttgctacagctatgtatctaggatttttttataagctggatatttctagcaacataaattcatgatatatatctatgactaccttgataatatttagataatttattttatacacatttcaaataatttaaattttaaatcacattaatgtataaactttaaatttaccgtggatgtgaaatgggataactttagacgcacttttgggtcaaattgacgtccgttttcgggtcgaaagttataggatgatttttttttttgagaattacacagtacaacgcagacactcacaacgcacgcacactcatccctatgaaagtacgcgtgcaaatcctacccctatgagcatcttcgaagactgggccggcaaatcatccttgaaattgacgaagtctccacagacgcctcgctgttgaccggtatgtcgtctaccgctgaaagtacaatgccgttaaatactggaaaattcgctcccatggggagtcgaacctaggacctaaggtcctactgaggcatcccgcggtagcgcgataactggtcggttttgggccaaatttgtgcgaccagggtttaccttatcgtttgggccggggttaccgtcaccctgcggtagtgcggtaaccgtctaaaatcgtacaaaaatcacatccaaaatttcgaattcagaacttggcggtttcgggatttcaccgtggttaccgcacggtttaccacgatattcgcacggttatcgcgagctgtgtagctgaaatcatgtaaataaaaaataaataggaaaaaaatcgaaaatacggttgaatatgtgtagaaaactaaaaattgagaataattggaagaatatgtaggatacttaaggcctaatattgtcttcctttttccaatttgtaaactattttcagttttgtccttaaatttgaatttagcttactctatttcaaaaaatttcttcaccattagcaagtacaaatcaagaactatatccatgattttttttccaattttttttttccagaattttgaatttggtcaaaattcatctaaaccatatcgccggtttctcctaccgtacccccgcggtaagcgcgataaccgccgcgcgataagtgaaactgtgcgacactaccgaccgaatttgtgccaggtttaggcagattttgggaccactttgggcctaactcacaggtgcatttgggctgaaattacaaacactgatgggatgaatttactctcgttaaatttgccggtaattaaactgagcaacaatcaagagcacatatcagctatgagcctatctgttaacaacatatactattcagtttctccggtgcggcaccaaatattagctcaacaatctgttaccctaatactactaatcttcaggcgcaaagccatgttgtccccccaacgcgaaatcagagggaagcaaacgcgtaatttcttcagaaattacaccgattcactcctattacaggacactgaactgcacgcctcgtattataggacactcctctggtagcaaacgtccagccttgcaagcacaccaccatcctcccattaatttctgatatcaatctgccaaaaaacatgcttgtgatcgaaactaatgcatcatcaaattagtagtagtaggatgtgacttcgaatatccaattgatatcataaaagataaacaatttatctacccgagatatggacatcttgattaaatggaaagtgcaaaggactatcaaacataactggcattcaaacatttgaaagcaaaatgcccagcgtttcagttacttccgtattgtaggttactgtttcagctttcaagctattgacccagcaatgtcatgcctgtagcctgcctataaaaccaaaataaacttttctgcatgcattgttggcataatctaaacaaaatttcagactttccgtagcaattttggatgcaatcagccaaaggatatttgaagtctatacatattaaaagtaagcagcttatccaaacctgcttaattaatttcaaatttacagacaagtgtctgcagaacaaacataaaaactaaaaaggacattttgagcgttgccttcttctctaacaactaatggttagcttggaagaaagctagtattgctaatatatacatgtatacttcaagctagtatggagttttatgaattcaaaaactgaaaatggacagttttgcatcggcaaaagtaaatttaatagcatgcacctcctgactgacagctaaccaaatttgaaaacaggcactaaaaaccattggccaagattatatagcaatgcgtgggaatcaatttacaccgagaaacatgctaacatttacaccaaaaaccggtggaaaacctcttggaaaagagaataaaaaacaggcacttaaaaaatatagcttggtggcgacattgcttctaagttctaactgccaagacgtgtgtatattttatagtctcttggttaacatgaactaaaacagacatgaggtgatctgcttgctatttacacaaacagagaaaagatacctcctctagtacaactgtagagtgtagtagaaaagaattccaactcagaacttcaaagctgcaaaaagcttcgaagcagttcaaagattctatagaagcctcgtatttttcagggaaaaacctacgatattcttgatatttgctcccagacgattggggaagattctaacaagaaggaagcagtggatgcttcgagggagaagtgcttctcatcaatcatgaacaggtaagtgccagccctggttatatcacccctctgtaacagtttcctaacaatggaatttagcatgcgggagtcggcggaacagccattctcctccattgaaagaaatagatcatccaattcttctagcgacccctgctctataagattttctgccattaaactgtaggtcctaacatctggcactaaaccgttagccgagtgagcagcaaacaaatccttagcttcatccattcttccacatttaagtaaggcaccaatcataatgttaaaagtcctagtctccagctgtaaatccgtcaaacataggttctgaaacattcgaagtgcctcgtcagtgagattgtttttgcaaagtccatgaaggattatgttgtacgtgctaagttcaagctgtgttccacttttggtaatactgacatagagttcttttgcagcagcagttcttctggtatgaaataaaccttgcagaattatgttatacgtaataatattaggactaacaccactgctcaccatctctttgaaaagagctaatgcgtcatccatcctgctaactctacagtagccattaatcaaggtgccataggtaacaatatcaggtttcaccccaactgagaccatgctggcaagtaacttcgttgcttcatccatcttaccagctaagcagcatccatcgatgagtgtattgtacgtaatgatatcgggcttcacaccaattcgtaccatcaagtcaaagagtttttcagattctataaccctcccttctttgcaatgactgtcaattattgaattaaagaaaatagtgttcagacagatgcctcgatccaacatttcaagaattaactcttcagccttgtcccatttgtcacaggtgcacagaccatgaattagggaggtatacacaataatgttaggggttagtccttcatcgatcatctgctcaaaataaagcatagcatcatctacactgcctgacttgcaaagtacatctataactgttccatagcacactacattcggattcaatccatgctgcctcattttgctgaatacaagcattgcctgatctactttctcttgtttagcgtatgcacatattagaatgttgaatacatgatgatccggttggataccatttcgtaccatcaaatccaagagagcatgcatctcaacaagggctcctttggtagcatacccctgaagcagggtacgataggtagcaatatcaggctctaggcccctcttggtcatagaatcgaaaatctttctagcttcggtggatcttccattcttgcaaagataattcatcagtgaactaaagtaacaacatttggttcgacgccatcactgcgcatctttttgagtgttccaatagcctcttt

SEQ ID NO: 66928 - DNA, 5047 bp, Oryza sativa
  unsure (1)..(5047): unsure at all n locations
accgaggtccaagcggcccgcacggcagcagcagccgatgaggatggcataggtgtgcacggtgggagttaccttgccggcgccggctcgggccatgcggttgtagcgggacacggcggccgcggggctgtgacgcgcgacgtcggcgagggcgcggttcaagccgtagatcgaggcgcccctgccacgccggagcaattcgtcgaacacgtggcgtgcgtcctcggcgccactgccccccgcgcggcctcctcgcccttggatcgagccctccgagcgtgggacgccgccgccgccaccgccgcgcgggcgggtagggacgcggcgcgccatgcctgcccccgcgggcgccaggcctgacggacagcggcgaacagatcagcgccgccgcgggcgccaggggaagggaggggtgccctcacgtttgatgctcgagtgagggcaatgcttttatccctcactcccatgttacagtactaacattgagggggtgtttgcatagcaagggtgagttctatttctccaactccaacttcagcttcctcgttttccgttagcacgctcttcaaactattaaatggtatatttttttaaaaaaaatatctatataaaagttgttttaaaaaagaaaataaatctattttttaaaatttataatagttaataattaattaatcatgtgctaataagctttctcgttttgcgtgccataaaaatttgtctctagtagttcacatcaaacggggcctaaattttagtccttgtcactttggaaatttaggcgctaattaagagtattaaacatagactaataataaaactaattgtataaatgaaagctaattagcgagacgaatcttttaaatttaattaatccataattagcatatgtttactgtagcatcaccccctgactatatatcctccctccgtttcacgttatatgatgttttccaggtggtgtttagatccagggactaaaaattagtccctgtcacatcggatgtttcgacactaattagaagtattaaacgtatactaatgacaaaacccattccatgatcctggactaattcgtgagaggaacctattgagactaattaatccatgatttgcctaatcaatgttatagtaaacatgtgctaattgtggattaattaggcttaaaaaatttgtcttgtggattagctctcatttatgcaattagttttattattagtctatgtttaatactccaaattaatgtccaaacatccgatatgtcagagacaaaaaaaattagtccctcgatccaaacacatatagtctctccgtctcaaaataaaccaacttctaaagtttaaaatttgttccaaaataaacaatttctaacttcttacctaccatccatctgtaaaatcgagaagttttatatcttcaataacccccacctacccacccatcaatataactttgctattaattaggggtactttgttcctttgtttatcctcttatatccacattggactttttgtgagacagagagagtacaatataagagattttaaaggaatgtgacacattctagtactacgaatttaaatagtgtccagattcgtagtaatgcgatatgtcatatcctctaaaatcccttgtattatgtgatagaggaagtgtaaaacatatgcataaatccacacgtaaatctattcaaaactcaacacgatttatagtgcgaaataggggaagtaaaaaagaatacaccagtattaacaaacattttcattaaatctataattaaaatagctcttaataacgtatttattttagtattgcaacgttaaatcagttattaaatccataattaaaataggtcatgagaatgtatttattttgtattataaatgttaatatatttttctataaacgtgatgtaaaaaccttgttatatttagaacagagggagtacctagcaaaatcacatatttttgtggatcattctctattatttttgtaagtatcctcctttcagttattgtgcagtttgtaacttcaatatccctatgacatccttcgcggaaaaacgtcaggatggtgttcactgacaagtagtacaaaatttggcaagagagagaaatactgctcaacaatggcacatattaatggggattgcaggcgcgtggcctgtatatatcatattcaacattattaatacggaccaaatgatacaggctattgtctaaccaacctgacaccaatcgatattacaccacctcactttgtaagcagtacaccataaaacgtaattcacatatgcgcagtctgaagaaaaataaaaagaggcacacaaacatgttctgccacatcccaaaaccatctctcattgaggcctgtagtagctgctctggtgaggagggtaagaaccctgggcattgtacggtggctgaggatatggcggctgtggctgcggctgtggctgatgtggattgtagtactgcccgcgccatcctccaggatatgcttgttggccatagtcatggttgggaggttgctggtgtggtggctgttggtagtgaccagggtggggcgcgccataaggtggctgttgcgacggcgcaccatatggaggctgttgcggtggcgcgccatagggcgggtatggctgtgagtaagcaggtctttgctcgggctgagagtacccgggtcttgaatcgcctccgggtggaacaccatatgggccctgagcatggggagcatgcgacgacggtggtggtggtgatggactgttctgatctggtggcacagaagtattcctctgcatgcttgcttggctggaagaagatgagaagctgaaacctgctagcttcttctgcacatcttcgatcatttcacggcattgaatgtttcgggtcattatgaagtcactgcactgctgctttattttgccaattgcttcctgcacaaaaggaccatttcaggatataaatacatatacagtggtcctcctacatacaatggtaactgtcatcatatatatcctaactacagtagaaacagagacgcgcatttacctgtaatgtcacataaaaattgaggccttcattaatgttcttcttaatatctcggtatttagcaacagccgcagcaatttgcttgtaacatctctcacgagcaactgaaaacatgcttcacaaatcaggcctacacagctcattgcttacaaaccaggatacatacttaaaaacactgattgtggtactatttacatgataaaataattgtaaattagaattaaagagaccaagttccagcatcaatggttcttcatatcttaaattgaactagaactaggaggagaaaatgtattcaacgaagaaacataattgaatggttaacagagaaaaacacatgcatacaaacaacacagcattctgttgttttagctagcagacaatttgatgactaggtatgtgtatatataagttcccaaccttattggtaagtgtaacagaaataattatcccacatccaaatcattagttgctacctaagaatgggcaaaaatccagctatcaaagtcactaagcgcacaatataatccattgatgaataaatcagaagggatacctttgtaatcctctaggttgaacaccgcagcaaactgttcattttgtgcctgtgcagaaatccaaaatataaatagtgttagacataaggacgaaagaacatgaaatacagtatagttaactcttcaaaatattttctggttgttctttctttgctaataccaactaaaccattgatgctattagacgtttaaaaatttcaatataattacattttttgggggatgtctatctagattttagcagaaaggtgtttacattgaacttctagaataagagaattgcaaaggtggactatatcaatctttatcaggaatggtggcttacctgtatttgtagcagcagttgttcttgcgccacaatgttatcagctatctcagcacagacaggatcatactttgaaatctccttcttaaaaagatcatcgtgtgatccaacaccggccatcaatttagggagtatgtcatcctgatagaaatatttgtatgtcataattctaaatgaacatgatggcatcacaggttatatgtgtcactatcagtcatgaatacagatattgaattcgaccgttacaaggtgccaaggacaaacaaactttgaaaagaaaatgcaagacctccctgaaaacttgtcaagtggaagttaaacggagagcacatgtatagcttttaattggttcctagcaggttatcacatacacgtacaagcataggactccaagaacaccacatatcaggcatgaacatgatccatccatagtgaagatcaatgggcaactggttgtaaactaattttattgccagtaaaatgcagtaaaaaataatgagtaacacttcaggagataggtccatacaaaggagagaggggggggggggatgaagcgatcgcaagaagactaggttcaaatgtaaaaaaaaaaagagtgatgctatttgtggaagggcttgtgagcccttggttgcatggctggtttttttccttcttaatgaaataaagcagctctcctgcattctaaaaaaaaagtaaaaacatggatatttccctagtatgcacatacgaccaaatgtagaagaatcagaatatttgcatgagcttttaaacataaaacaaaagtcaactacatgattatcaacaagctaatactgaacaaaagaaattcctaatctgtcataacatatgtctgggacttatagtagtttatgtacacgatatcaaaataagcaataaaagatagtacctttctcttcatttctttaagcatgtcttcaagacctgctctctgtgctcctagagattctagttgcctctgtaaaagcacatcaaattggtttttaagttttaaaacaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66929 - DNA, 3461 bp, Oryza sativa
ggctttgtatgacaagtgggtcccactttttttaaaaaaaaaagaaaatgctgactggattgctacgtgtacgccacgtaggacaaaaccgctctggattggatcgagggggtaattcgtccggtattgaaagtttgggatgaaaaatgtctggttttcgggttcgggggtgtaattcggtcgaccgcaaaagttcagggggtaattcatactttttccttttttctttcctttccttcgccgcaaagcactccaacgccgccgccccgatctcttccctccggcggccgccatgtcatcggcggcgaacgaattacttgttcagaccgaagagatgctgcagaaggaggcgaaatggatggcttaagtcaagctaattttagatatttattattttgtgtatttgagaggagcaatacctgtactttattatagcatagcaagggacggcttgttcttagatgatattgtggatgcatgttgattaatttttttctaataactctatcgctcttttcctaactatctgttctatgtaccattgatgaagcatatattgtgtcgctgtcatttggttgtttcatttgtaatattagttgtcaccgtagcgttagcacgggcatactcctagtgaggaggaagaggatttgcttcgccgcgtcaccgggggaggtgtcacgttgagattcctgctggggctggggttgggttgagattccccaggcgcccgcggcggcctcgatctgggcggcgcagatcagaggacggcgcggatcggcgagcttcgcactgggcacgtgtgcctgtgtgtgggagtcaggcctcgcagccgccgctgctgctgctgctgctgctgcacctgtcagctagggcgggcatggcgcgccgcgccgcttcccgcgctgttggctcggagggctcgatccaagggcgagggggccgcgcggggggcaatggcgccgaggacgcacgccacgtgttcgacgaattgcttcggcgtggcaagggcgccacgatctacggcttgaaccgcgccctcgacgacgtcgcgcgtcacagccccgcggccgccgtgtcccgctacaaccgcatggcccgagccggcgccgacgaggtaactcccaacttgtacacctacagcgttctcatcggttgctgctgccgggcgggccgcttggacctcggtttcgcggccttgggcaatgtcattaagaagggatttagagtggaagccatcaccttcactcctctgctcaagggcctctgtgccgacaagaggacgagcgacgcaatggacatagtgctctgcagaatgaccgagctcggctgcataccagatgtcttctcctacaataatcttctcaagggtctgtgtgatgagaacagaagccaagaagctctcgagctgctgcacatgatggctgatgatcgaggaggaggtagcccacctgatgtggtgtcgtataacactgtcctcaatggcttcttcaaagagggggattcagacaaagcttacagtacataccatgaaatgctggaccgggggattttaccagatgttgtgacctacagctctattattgctgcgttatgcaaggctcaagctatggacaaagccatggaggtacttaacaccatggttaagaatggtgtcatgcctgattgcatgacatataatagtattctgcatggatattgctcttcagggcagttgacagaggctattggatttctcaaaatgatgtgcagtgatggtgtcgaaccagatgttgttacttgtaacttgctgatggattatctttgcaagaacagaagatgcacggaagctagaaagattttcaattctatgaccaagtgtggcctaaagcctgatattactacctattgtaccctgcttcaggggtatgctaccaaaggagcccttgttgagatgcatgatctcctggatttgatggtatggaacggtatccaacctaatcatcatgtattcaacattctaatatgtgcatacgctaaacaagaaaaagtagatgaggcgatgcttgtattcagcaaaatgaggcagcaaggattgagtccgaatgcagtgaactacagaacagtcatagatgtactctgcaagctaggcagagtatacgatgcagtgcttaccttaaagcagatgatcaatgaaggactaacccctgacatcattgtatatacccccctaattcatggtttttgtacctgtgacaaatgggagaaggctgaggagttaattttttaaatgttggatcaaggcatctgtccagacaccattttctttagtagaataatttataatttttgcaaagaagggagagttatagaatctgaaaaactctttgacttgatggcacatactggtgttaagcctgatgtcattacatacaatgcactcatcagtggatattgcctagccggtgttgacgtaaaacacgaggcctgggagatctgcttaactccagtgcaggtccaaaactcgccttcgggtatgcttagcgtgccaattgatttgatcctgcaatcaacaagaaacaaagacaaagaaaccgcggttaaatccataaacgatagacgatcggctaggtgccgatgacatatcatttatctttgagccgatgtcatatgtgcatcgatcggcagtcattaataaataagaagggactaaatctattcgatcggctgtagatattaacaatatatagtccttatatcgatatatacttaaatcaagtgattgggatagatcggactccatgccgagacagtatgaatcacttagatcgaaatatatattaataatgagattatatacgttcatagcatagccgatcagatggatctagcatgtatcggttgatactccgatactactctatattaagatattaaagcaagtagaatatactaaacaaaagcctaatatacttaaatgcagcaatatcttaatataaagggcagatttaacatgtcaatcgagcatataggataaaagtagttaaatcaggtaagatcggctgaaaccccgatactaccctaatcggcaaccaaagacagactagagattgagattctaattacgactcataagatcaaactcaactgatgcagctataagtatgaaaagaaggataatatctagacaatcaagccgttggatatgtcatagagtggtggatatcctatataatctaagtcaacgtcggtatttaacctaatcggctgccttctagtaacagacgttagccgattagaggttagataacgatattgccaaagattatgtaagatatatgataactcgacgaattacataaacaagattagagtgtcataaagatggaagcactaatcccgagaacgcaagccgccataacaagttttacctcttgttaaagatcgaaaccgatgcagctcaacccgaaagcaagaactcgtcg

SEQ ID NO: 66930 - DNA, 4585 bp, Oryza sativa
gtctccacttcaacctaatccccttttccgatactgatattaccaaattttgtcgttaacagctggtaagatggatgaagcaatgaaattactccctggcatggtctcagttggggtggaacctaattgtgttacttaccacagtttgattaatggatattgtaaaggtagtaggatggaggacgcgttggttcttttcatagagatggtgagcaatggtgttattcctgatattatcacgtacaacacaattctgcatggtttgtttcagacagggagaatagctgctgcgaaagagctctacgtcaggattgttaaaagaggaatagagactgaacttagcacgtgcaacataatccgtcaaggactttgcaaaaacaatctcactgatgatgcacttcgcttgtttcagtagctatgtttgttggagttgcagcttgaaactaggacctttaacattacgattggtgcgttgcttgaagttggcagaaaggatgaagccaaggatttgtttgcttctctctcagctaatggtttagtgccagatgattggatgtacaagtaaatggaagtgttatagaacaggggttgctaggaaaaatggataaatgctacagttaggaagctacttcacaaagggcaggtaggcagggctggggtttacctatcctaaagtgatcatattggtcttttattgattatgttgatattgtgtgtttacactacttcaagtctcagccctatattatgataggttaggggtctttttttggtattgtattatcttgctgataatcatgtcggtgacttctgtttacgtttaaaatctcatgctttaaattatgattgttctacatatggtcctactctgcatactaggaaatataaaatattcatgtttttatatttgaatttagtcttcttgcgggcagttctctttctccttttcacggaactatctcctgatgaagtgcaaccctgattatttttactgcattttgctggcaattaaattagtttacaagggcttgtccatttatcttctcagtagatgtgatgtgcagaaaacatgacagcatcttttgtttgcctctataggccaatgttttttggtgcatggtctttgacctacagattatagctgtaaatcttatatagaagggttgttgcaatgattctgattaactgattgtatctatgaagttgaatgctagtggaagctcctttggccatgttatattttgtgtctgcaaagaacagatcatttctttctttttaaaaaaattgtgttaaatgcactgttgaagaatgcctaacaatttctctcggcagagagtgaagggaatgtttatttggtactgttctagatctacagataaaattcttattctactgtttctttgcttgaaattttcatgcagtggatatccagttgacctgttgcattgatggagaaaggaatcaatcagctctgaattgcctgtaacttctgcagttcctgtgtgaagtgatctatgtatgtccgcggtttgagaagacgcatcatgttctttccgtgtggaaggtttgccacagcgacgagatctggatgtatatgatttcagaacacttatgttagttgttttgagttttctagctcaatttgatgcatcgttttggtctgctcccttgtacatcgatgcagagcagaagaagcggcctgaagacttcttttttttttttaagactttgaagcggcttgaagactgatttccctgaaagcactgggaatgacagattgattcggtgcattgcacttgaccttttctctttcaatttactgctggtgattgttgtcactatttaacttgtactcctgatgttctagaccatttatattatgtatgtgtttatttatagatgatgtaaatatcagcgcaaatggggcatgtgatttacttatatttggggactggggtagtattcagcgttgaaccagctgctagcgtactcgttgtcagagaatcaatacaggttcagtttgatgggaaaatgagtttccctgataatgctaagtaattgttatggcataatcactcagttgggggcttgcagcctctgtccaactgcataagcttccagttccaccgcttcactgctaatagcattttgggctgcgctccgttaccactttcgaccttaccaaattttaatagggtctccaactaaatttgtactttcaacatctttaccctaccaaaatttagatgttccggaagtttcctctcagaaacactaccagatttcagagagattccaaattaactagcatattcaatgccaccaacattgggtaacaccaagatttggtattgcccaatgttggtaaggttgatgttggaaataaagtgaacaaaccctttttattttactactgtcaccgttttgagcttcctgttaaacccatgtcttctttctttttttactccagtctgatccatgaaggactacaagtaatcaagtcacaagtctgaatccatgaacaaaaggagagacaacattgggcagtacagcttttgccgctaaaatcaactagatagtcgataaacacaatatgaaagttatgccgctcactacagttaggtggcatctatgtaccgttctagcaactatggcaaccgatccgcaattttctgcagttgaactgaagaacaaactcagctgtgcagtgacccccctgttgcgaatgtcctccagcttactaaaaataatgggccatgcgagaggactggggcgcctgcctgctgttgctgcttgcgccgatgaagccttgcagaaggctctgtgcggctttcacttgatccggaatgccctggatctccacaatggactcggaagaaccgggatgggcttcgtgcaacttcactctcgcgccagagatctgggatcaaggggagattttcatgaggaaaactattggaggccattggggcatggttaagactgggcatagtgcgtgatgtttcgcatacgctatacctgacggatctcagctagattgacaccaccagctccaatgacagattccagataactatttggaatccgaaattcgacggagccacctggatacctgcaaagagatcatcactcaatgattatgaggacaaaattcacgtttgtgtcctgtaaaaattcagtttgcataagccatacccagtgagacctgacagtcttcggtaatcctcacgtccatggatctgctcagcggcctgaaaagaatgaaattcaaatctattaagcactgaagagaacaaaaatatacattcagatgcatcagagaggcatcaggtgaaccaggaaacaaggaaataaaaaatgagaaaagatcaacacccaactaagaaaactggtaagcaacagcagcagagaacagctgaataactgaatctagggtttgcaacaacatcgtaacaattgaatagtgttaccaatgatagatattagagtgggcacaagacagaaggatatatttggatcaccatgacatattctagaatattttggtccttttttcagacatctgaaccatcatggaagaaaatagacataatgcaacagtcatatatatggtttcatgtttctaatggaaacatatcaggcgagggccatttgcaaagaagaggcaagctaacgcattggaaatgtacctcggtataatcataagcattggaatttccagctctggtgattcctaattgttgcacattactattcccagctctcgagaggcctaattgtagtgtacccctactagagtacctatcagtaggtacttggtcaagataagaacggcgggacatataatcggcaccaggactaatagatgagggcagttctctattaggcaagcgagtagttgctgcatatctgtcgtatgaagcagatggtgtaactttgctatttccactagggtactctcttttagagaagtactctacaggatacgcagtgtaaggatcacgaggcccatcattgttcaaccctccatatgatgtatcattggcaggtcttctatatggtggatcaatggctggtcttccatatggtggatcaatggcaggtcttccatatggtggatcaatggcaggtcttccatatggtggatcattaggaggccctccatatgggggactattggcagatcgtccatatagcatgaattccctgttaggcaagatatcaacaggaggaccatcaaaaggggcaaaaggtgtcggattattggaagaacttccatctctgagtgtcctagttctaagcctcgaagcaatctctgtcagggctcctcttgcaatagctggaagcccagcaacctgaaagcttggaacaaatgtaaaagcacaatgaaatgttaacaagtaaaaactgtagttataaaggtaatatatggatctctggtgtaggtatggccaaataaattacctgcacaagctcctcatcaaaagacaagtacttaggtttatctgcttttgagtagactcggatttcagccccagtccgtcttctcatttcagtaattacctttccaccttccccaataata

SEQ ID NO: 66931 - DNA, 2051 bp, Oryza sativa
ttgttggagacactggatcatctggaatctggaaagaaaatgtaggaggatataatattgtaaagactcatgataaaaatggtaaggcaatgccaattggaataatcatctgcatattacctcctgagatgaaacaacaattaacctttcttcagaagcatttttgccaacttctttaacctgaacgcaagcacctgtctgctgttcgacttgccgaacattgccaccacttttcccaataacttgaccaatgtgttcagaagcacacagaattttaatagagaactcttcagcttcagcagaatgatactgcagtggcctgtttctatatggatcaagcaagggtatttgtggtgagtgatccacatgcaggtgtggcaacattggatttgcatgtggtaattgtggtggagcctgatgcttcctttgtgtgcttgcatctataatttcttccagaggtggattgtctttacgaggatgttgatgcagacgagtagatatttcatagagagcttttcttacaagggaagaagatccagatatctgaaataacataagcccaagtgacagtgatttccaaaaacaacaaattgacaaagcaatcatacttccattgatgcacatcatggtattacattgcaattttgcaacatgaaattacatatcattaagaaaaaaaggcatattgataaaaagttaagagaggtaaaaactccatgccagatcaaaaagttccattacttagttcattcaagagcttaacagggcatattgacaagaaactcagatagtagtacaaggattgatatatgccatactgagtgatttgtttttcacgagtaacgaatgaacacaaaccaagttaactgataccattactcaaggacattggtatgaatgaaactacggatacaaaacaagttggaacaaaagataacaaataagttttttgaagttacctgcaccaattcatcacttttaagtgcacactgaggaagattttcagatggtaagacacggatccctgctccagtgtcatttcgtagctgttgtataatggagccaccttttcctagaagacagccaacttgatttcctggaaccaaaattcgagcaattacatcatcaacattttcagacttttcatgaacaattccagcatggagatcttcatctgctgcaattttgtcatgtatcttcaacagggcatcttgggcaaaacaatgaggcttcatgtcctcaaatccatcagtagaaatattttgagcagcttcttcagtctgacttgagtagttaaagataataattactctctcatctgcaccaggaatggaatcagcgacccttatctttgctttagttgtgtctcttagtgccttaacaatatcaccgcctcttcccaagacactgccaatctttttaaccggacacagtatcctgtaaatggtttctattggctcagaagatatggttccatcatcgtgccttgagtttagccgtttcctctttccgtcatcagaattgaaatgtggcctttttctggaagtatttgatttatgccttctagatctatcatgatccatcagtaacctttgcctgcataaggaaaagtccatcaacataaatgagaattagacataatgtaggacacaggcaacacacaaataatggacatggcgcacgatagaagtatgagaaatgttccatgatggcaacatgcatgaccttgtaacttttgcataactcaacatggaaaaaagttgccattaaatgcttatgtggatactttgggcctatggaattactcgtagctgtttgcaggaacaataataacaggcaaaggctatacatctaaactttaaagtcacctcactgaacacacgccacagtaactaaatatataccttgtcatattttctaaagatgtatctatacagtgcttccacagttccacctattgtattccttcaaacaaacatttaccactatctagtttagtctcactgtggcatgatcttaattgatccaagaaaggtagtgaattttataac

SEQ ID NO: 66932 - DNA, 1651 bp, Oryza sativa
agatttccacagtttaagatttatcgatttcccctgaaatttttggcttttctaaatagttaacactgttttacgtttcattgatcgccatgatctctactttctatggaaaatggcatatacttccatcgtccaatattaaggatgctcacatatactccctccataaaaaaaaaactcaacctagtaaagaatatgacccctcttaatacaatacatttggactacctattgttcagattcgttgtcctagaagggatcacattctcttctatattgatttttttttacggacggtttttgacggacggggtataaggcaatatgctcgctgggatgcttgcatatacagggcctttttttttcaatgccacactttgacacccgaatattagaagcgccacagtttattgctgattgtttagtgcacgtaaggtccatttatatataggtttaattagatccatgacattataaattttaccgttttaaaatatatactccatatgtttaactgttcaactataaaccgtgaaactttatatatatacaaaaggagctggcaaaaccgtgaaactttatatatatactccgtatatgcaaaaggagctatatagaggcggtaatggacccaatattttacactagaaaattttgagggtttgatttaaaatgggttggactcaattattatacatttttaacctaaaaatatttgagggttaaatagggttgtgaaaggacccatagaccttgaaccatttccacccctcattgcgtttgaggttaacattcttttctttgctttgggactcagcacggtcacatatacggacgactccaaaacgtaaactaattctagcttcataaagactctcacttttgttccataaatgcaattatattttctatagaactatattgatcaatataaacagttacgatctagtcctacacaccgatctaacgatcaatatttttctctcttgatcaatgtggtaactttcatgtatatatctatacccctgtacattctctttctttttcccgttactctttcttttctgctttcctttatgtacctccctctctgtctctcttctctctaaccttaaacttgtaacctataaacctcatttctatcaatgaaatgactataaggtagagccttcttgcgtcaaaaaaatgtggtaactttaagcctccggagcaaacaatgtgtgcctctttttcttgatcccataacatgatcgattgcatatatattcttccctggcttttagtctcatttctcatcctaaataaaatacagaaaaactcacttagtgatcatcaagtaagaaaaatcccatcaggctgcaacgttgagatgtcattcataccttcatcatggcctacgcctaatctccttcggcttgtaactcattcaacatagtatctaggaatttatcgaatgtatcccttcttagccacatgttagtctcctcctcctcttcttcctcttcctcttcctcttcttcctcttcctcctcttcctccgattccacatcatccacttcaaacaaccccaactcctcctccgattcatcctccgattcctcctatacaattgaggaaagcagctcatgcaattagcaacaaagcagcaaaa

SEQ ID NO: 66933 - DNA, 6931 bp, Oryza sativa
tgctagaggtttttacactaccgcaagggtcatgaatgacactgtactcgaacataacggcaaataaactgacttcagtttaataaataattggaaatcatatcctacattcagcagcaaatatacaaatgctatcgtaaaaatatacattcaatgggtctaatgaattgagttccaacagtgtgtaatgcaatatatagagcataggtgctaagcaaaaggcagaatgcaacatatgaattcagtatagtctacagagtagataaacaaatattcctcaatccagatttatgtttgaggtaaactgtaagtgtaccaataaccactacaatgtgaatttagaagatagtttaagagaaaagtatgaataccattaacttcagtgtcaatcttgcagaaacagctgaccttccaggccattcttctttgcacatgtgtcacttcagcaaagaatagtttgccactgctatcgtcagctcccttttgttttgctgtgaaattgaaatgacaataccacatacaattctcacaaaataattgcctactcacaagatcttcaagttcatatgcatgattctacaacaataacattaccaaaaattgcatcagagagagagagagagagagagggggggggagtataccccaaaaagtttgttgtcatcattatactggtccaatatagcttgaaccaagtattgcttttcatcataggtagtcttgctactcggagaactgggatctctctttggtggaccataaagatagtgtttacaatcatgtatcatcctatccacacgagaaaattcacctgattgtgtgcacctaattcagatcagagcacgccacactattagtacttcagtggagaattcaaagtggggaatatagaagtgacactaagttgtctaaatggttataggtccaatgtagggttaggaagagtttgtgtagaaagttactgagcaaggatgaaactcccaggtacctatgttatcactgattgagtaataaaaaagtgtccttgaaattataacaagataagagaattgaacatgtacaatctccatgcctataagttatcaatcaggctaattgatacggttatcgcaattatttgatacagcagacaacagaactgtgtgtgtttgtaatcaacttacattacaattcagattaaaacataccttaaacaaagcatagtatagtatatatttactttgtggacttactgtcatgcctatgggttacgattagtactccctggcaaaaataataacagaggatagtttcgctaacttcatcattgtcataataggaccacatattatagatgcaacctggtttttttttttatcaactcttaggctttctattactccaaagttaagtatatttgctgcgttcttaactaatttgatgaaacaaaattaagactgtaaagcaatacctttatatgaagagtaatacatgagcaccatgagtagaaacaatgcatgcaaactacctagtcaagttaaagtacactgaccaaacaccgttgcttactgtggagaattaaatgaatgagctacaacaaattcaagaagaaactttaccttgctccatgctgcagttcatcaagaaagcacttgatagcatcgtcagcttcatctactctctgaaacggtccacccacatcagggtaagtccagcaagagcccctggggtctattctaatgtagaacagctggtagcaatttacaaaactgcggaccaaaatgctagacccaacagatgaggaagctgattgcagatagccatcagtggtggtgttatctggcgccgttcgtggattatcatcgaaaatttcgtccaagagcgaaagggccacatcttgcagagatgtggacagtgtagcatctgccacaggcttgtcaattctggatgggcaagtgctagatgagccatcatcaatgatgttatgactggcagtaatcaaatcttgtgatgatgtggtgtcaaaagactcccccaaggatgaaacatctggctcttgtaagggtactagaggtgcagactgagcagcacctgccacaagcttgtcagatctgaatggagaaaagcacagtgagtacatagtatatcctacaaaaaattcacatccaagaacaatcgatcactgagcaatgcctaagtaaggccgagtttagttctaaattttttattcaaacttccaacttttccatcacatcaaaactttcctacacacacaaacttctaacttttccgtcacatcgttccaatttcaaccaaacttccaattttggcgttaactaaacacaccctaagctgagtaagaaatctgtaatgaactggtagcacaaattcgatagaaatccatactgatcccccagttttatttattttatgtcccttatctcctgctgctgctaatactagaaaacaagcctttatagcaagtaccaatccccatcacctccaacgaatgaatacccaaatattgccgagctaccaatcccaattccctcccaaggaatgaattaccaataccgagcgtttatcagaccaattcgtaacctacttttttacaaaatgggataatcccggcctctacatccaatcgcaacctaatactagatcgaccaatttgtaaggcctaattggatcggtcgcaaacagaaaaaaaaaaaagaaaagcgagaggattcatacgatgatgaaggcgaaggcgaaggcggaggcggagggaccatcgccggcttggttagggtttggcgagggttcgcactcgggaccgatgattatgttgggggatttttggttcgtgcgcgggacggagacggatttaccggttttgcgtgcggcggctgggttgaagacggagaggagcgttcttttattttattttatttgcttttcttttctctttgtgaggactttcgaattttttttcatttttaatttttaattttttaatatttacagaaatattataccatccaaaatatttacacaaatggccccttccacccaagtggagagcgataaaggtgtgcgcattttgcattgaggtcattttgcaagagggtaaatacaattttcgccttaccaaaaatatatttttctagtttttttttttcaaattatccggccctcaactcaccctgccgccctaaatattttcaccgtacaatatttctataaatattaaaaaataaaaatttaaagatgaaaaaaattcaggactttccgaatcgtttgtgggccgagaccagagaaacagagcaggctataagtctatttgccctcccccatctcttgctctgattgaatcacctcactcaagtactcgtactcaaccaaaaatcggggttataagtcgtaacacctcccccatgtttaagaaccggtgcaaatcgaaccctttcagtggtttgggaagcagttttttttgttgacgtgaggtgggattcacatgtcagtgactcttctatctattctctctcaaggtagaaggagggttcctgaggcgaagggaggcgatgagaatcattgacaacactataatttttagttgaaataactatagagtaaaattcacaaaactacacatatgttgatcaaattgtcacaaaactacagatttaatgcgttgtatcataaaactacagatttaacatcaaatttataaaaaaactataaatttaaggtcaaatattacacaactacatatttaatattaaagttattacaaaactatatattttagagttcaaaccctaacactaccattatgttagagttacaaacattatagttttgtgattaaattggtactatacctgtagttttgacatatatttgctacttaacctatagttttgtgacttttcatatcttaaatattccaattttgtgacaattttgacactgaatatgtagttttatgatacaacactttaaatttatagttttatgatattttattcaaaatatttgtagtattgtgaaatgtactcatatctataccatgttaaagaaaggtccgagggtccgagggtctagcttcgagtctcatcccttaataaatttcaatacaagagtcatacccaatgttttgtttaatatctatatcgtttaaatttcaccataaataacctagttgaatttctttacatgggagcaatcaaaggtgatcttgtatgtatagatggccaaatgagccgtctggtccaggcacgactagatacaggcctaagatcaatctggccggcacgggctcacttacacgctgggccgttggtgccaaaaccccatgtcatggaccagatcatcggccccagaccatttggccatctatacttatctgggagcggctgctttttcacgagaaaaagaaaaatgaaaaactgctgaaatacaaggtgaaaactgaaagaaaagagaagaggatggatggaaggcgagcaaagcaaagaagctgttagtgggcttccttcttcgtcctcctacattccctcttcttccctttccccctccattagtactaagtactaactctagtttctctctctagttagttagtttggtagaaaattaggtaggcttttagcatcaggttggtagaaattcgaatccctctgcgtggacacgtagcggggagaggaaaaaaatcgaagcttttcatgactgcagccatcgccgcagatggccaccaagcgcgcgtacaagctccgtatcctcgattcttcttgccgcttgaatcctcggtttgggagttttagattaaatttgagttctttttttgggtcgagttgttcttgccctgcctgcttatcgttgtatgtaatctaggtttctgatcgagttggggggagtccgcgtgtggtgatcggtttcgatctgcgctcatgttattttctttgtgctgttcttggtttgatgattgggtttatcgcggtacgctgctgggattgatttggtacgaattccaatgagatgagacgatttgagaccatgtgaactctactgttcagctctagcagatcttccttttgtatgcgtgtgcaagtattatgtagttctctgcttaaagccagactaaattttgctgttttttttttttgccggaatgaccgaaggaggtcattcaatgtaattaagacggaagaaaagattacaagaaaagttttacatcgacagttggctgtcgagaaaggatgtgcaccagagcacacgccccgaaccatgtgccaaccgcctaaacacacgctacagagagggaagtccgttacccaatccgaatccaccatctgaacatcggcggcacatggcttccgccacacccgaactgacgcccctccgtcggccgacttcatcgaaccaccatccctgagagctgacccaggacccctccgttcaaccacccaccggcctcctcgccagatctggccgaaggagaacctgggactaggtggcattgcttcagcagcctgagcttcccccactgacaagctgccgcctcaatccagcttagaaactccccacaaagaaggggaggagctctaggaagggcgagggtgccgatcgacaacgaggaaaacgaccaaccgccgccaactccctttgcattgccatctgggcctgcaccaatgccagaaacgctgccgctccggctccggtgccacccgccggcgccccctttgtccggcctccttgccccacctagccgtgccgcgccgctactggccgctaagggcaccgcggcagcccagctgcccgaccgtcgaggcctagccacgccatagggcccggcggcagcgaaggcagaggcgggggcgggggaggcggcagggtgttgaccagcttccgccgccgctcccaaccgccgccgccgccgccgcacggttcggccgcacgccgccgccatgcacctcgacggcatccgcatccgcgtccaggccggcaccgccgccacgcaaccggagccgccaccgccgccgagctgccaccgtcgccgagccgcgacagcgccgccgaggcgccaccgccgcccctagccgcctcgcgccgagattcaggcgaggatggccggatccggacttggggactccggatccgccgcctccccgcaccgccccaacatcgacgtcgccaactccgaccgcggtgggggtcttcgtttgttttagttcgagagaataaagactattattagtgaagttttatttcaaaaataaatattagttagagcattgagttgtcatcttacaaaaattgactcctgtattatcttctgcttggatagtttctgctgcaaataggatcacactagggtcagatgctgacacttaccatgagaaaaaattggatggatgaattaatcaatacaaaatcttcaaatatttattatgtgtagctcttttctttaagaatttagatggtgagatatcatggataatacattcactgaaatgaacatggtttaacccgaaaagcattgttatgtcagtaaattgcgttaccttgttgaaatgtatattttgaaatacccttccaaaaaagtgattttctgaagcaacactgaaaattgcccaaatgccaaatggtaatctacaacagccaaccatgtttccttgacaatggccagaggagtttgttgcgcatgcttccgatgtcaactgtgtcaagtttgggaggaagacatcaagaatcctcatcactggtggggaggaccaaaaggtcaatctttgggccatagggaaacccagttccatcttggtaatattccactggcctctgaaaggtcaatcgttcatgtgtaatacttcttttttttcttccttgtctttgttactcagttttatggggtctttattagtcagtttgaaagttacatctcttcttacaagttaatgtcactatgaat

SEQ ID NO: 66934 - DNA, 2575 bp, Oryza sativa
gaaagctcttgcatgactttaggaatcatgaaggcccaattaactgcttagattttcacccccatgagttcttattggctacaggttagatagatgatcctttattataacacttgtagtagatgcattcactgtagtgtactagctggcagtttgatgacatgttttcctccaaaattatgctattatgaatattattatttctggcatggatcattgttgactgatgcttatttgtgtcatctagacttgacagcctatacattgctttcttgtttcaaaaatatttgcaggttcagctgataagacagttaagttttgggaccttgaaacttttgagttgattggttcttctggacctgaggtattgaatatattaattgttgtatatcttaaagcaattcaagttaatgttcagagtttgagccaatttagatctataaataccatcgctatgtagcgctctgtcatactatctcctatatatgagggtctcatgtaagtgttagatacatgtcatcatgttcttggcttcaaagagattcaattaaaaccaagttccagtaatctatttaagtttatggtaattctgcctaaacctggtcctttaaaaggggataaaagaacacagcaagtcaacattaagcagtacttctgtgcatatttggagtcactaaatggtaagatatcaatctgaccagtgattcaggcatccagcatgtcaaaccaaatgatataatcatacctgaaattctctctctgcaaatagctttcaagagcttatataatttaatattcatttatgcaaaacgatatgtcagttcaagtttttacccacgttccttaatttgtacctttggaccctaatgttttgtcagttagataatacatacccatccttaaagaaaagattgattgtaccttgagctataccatgagttatttcaatctccgctccttatcttcttgtttcgtggatgtaactaatatattctgtttcttgcagaatagccgggaatactttgtgccagtacgttgtccttaatccattctatctatatttttctactcaaatggatggcagtgctttctgtctacaaagttctcgatgtaaatgaaataatcaatacttatcttatctgcatgtactcttaattttcaggctagtgtagttcggtctatgacattcaacaaagatggtaaatcacttttttgcggattacatgaaagtttgaaggtaactgctctgttggactgtcgatatcctctgaagctttggaaaatgacctcacaacagattttatttatttattttttttacctgtaggttctttcctgggaacccatcatatgccatgatgtggttgatgttggctggtccacattaggggatctaattgttcatgagggaaaacttcttggttgctcatataaccaaagttgtgctggaatatgggtcgtggacttgatggtatggttctacactatttactttgttaccaattgggcagttctgatatgttacttatcccaaatttcagaaaattgaaccgtatgctgttagcattgctgaagcacatttgaatgaaagcgtaaataggtcaatacaggctgataatagcatatcatcagtgttgggaaggttatcagtttccagaagcccaggtaaacaattatcatttggcgtataacatcaatataatttttcttcatccattatccttgagttatgattcttcaccctaaaactatgtatattttgctatttctcgaaaccgcagccaaggaagcatcttccgatactttgcttaaactctcaatgtctgcttcaaaagaagttcctgttttagcttcttctgcagtgataaagaaactaccaaaagaacctataacaagcaatattcggctcacaagatctgattctctaccagttgtttctcctagggttagattgaacccaaagttctctgatgaccagaagaggcagacagattatgctgtgcctataacaactccaagaattcgctccaaagtggatctctctataggtgctagagcattccatcgtaactcagtaccatcggttgctcccacaaatagatccaggtccaaaatatctgcatatagtagtgaaggatcgtcgttcatccctgttgttgtccctaggcatatccctaaagtggattctggtcccaatctcagtaaagttctcactactgatttaacaattgtcgagcctcaagacatagaacgaggtggtctggctgtggattgtggagaagatgataaattggtgtgtgtgattgattcaaggagctcaaatatgggtgtacaaaatggccgtagaagaaaagccggtgatattattacacataaagaaaccccagagactgctttgacagttaatatggatcgtgacttcagaagaaaggctcctgaaactgaaagtatgcaacaggacatatttcattcagagcccattagttcaaaatgtaaatatattaaagaaacttcaagtgctggagacattaacttgtctgggtcagccattactgaaagtgtcaagtctaatgaa

SEQ ID NO: 66935 - DNA, 9585 bp, Oryza sativa
tctgcaaatagaggggtgtattctggtaaaaacacatttgtgttcgttcgtcttaacaacttttaatagttcagattcataactataactataaatgcttatatcttatgacagagagagtgtatattagtatatcactacttgttacaaattatacatgccatgtgtgtattagtcatattatatttttcatagtacttcattatttgcatatctgcacatgaagttgactaaaacaagacatgttatatatttatgggtccctatatttatttatatatgtaagatccctagaagtactgtgtcggcacaatgctgataacaagagaccatccatgcagcttgagcatgaacatgagcaattgacccatacagaaattagaaatagagaaaaggaagcggcaattatttaggaaaataaaaggggaataattgaaggtttggaaattgtgatgcgggcctttctgggactggcccatctcgtggagggagctctcccttacattgtgcatttgagcccaactattctattccggcccagaatattttcccacctctaaaaaaacgattttggacaaattttctcctctaattgctaaatgtaaatagattataattgcattataacttgtatgtaactataatataatttatgtgtaacttttacataattttaaaccattggatttatttcaagattcgtgcaagttgggaagaaaaaaaattatagcgtacgtacaattaaggagattcggtctcacaacctgcttcgtgaaaatggagtgttacagtcggattttttttcaaagttacatacaaattttttttcaaagttacatacaaattatattaccgttacatgcaagttataatataattatactatatttataagaaattttgtctgtcaaatgtatatagctataaaaaagggtgaattggatttgtgtgattgcaaatgtacatattcagataaatgtcattacaattcgtctattcgtagctaaaccactgaaattttacaaaattggggatcgtgtcactgctgtcacatcatccatctccttcctttttcgtcttcttctttatctcttcatctttttcctccttgtgggaaaaatggtgacggagctcgccattgtctgataatctcgccactgccatcagaaaaaacaggaggacaaatatggcgatggagcacacctccgtctcctagacaggacgagattgttgtcgccagaaaaatcacaaggaggaaaacaaattgacgatggagcactccgccgtctgagacctcatcaccgccacaacgagcttgccatcatcgtcgccacctggggccacggaggaggtggtacactctagggtggtgcgggcttgccgggggtagatagaggaggaagaggatgaggacgagcatctcgctgcaccaagcaaagaggagaggtgagggaagaagacgagagagaatgtagaaaatggaaaataaaggatatgggtggaaaatgtggcgtcactagcacagttttgattttataaaatttcagtggcacgactacaaatataaacgaattattatgacatctatttgaataatcacatttacaatgggatccaatttacaatggggtagatagaaaagggaaagtcactggctcgatctaggccgtcggttttgatcgatcggacggtgaagaactgcgtctcctccgacgcttcactcctctcctcgcttcgccggcggcagcttcccgtgcgccgtgcccgccggcgccgccagccaccctcgcctcgccgacggcgcgatgggatgttagagacccactcaacaatataatttcagaaatagcagtgccaaatccaacacagggaacaaccaagtctgttacaatagtggagtggttttgaggtggaagatggaaggatacaagggctagaaggttctagtagcttctagactagtagagaagaagggagatagaggagagatcgacaaagagaccagccagcctctaggtcgccgccgccgctattcgccgccttggtcaaatgaatctgttcgatcgatctcctgtaagctgctgctgctcatatatttttcagcttgggcttgcttgggcttcttggcaatgggctgaccaacccgtggtgtagccagcggcccatgtgcagcccacccgagtccctgacaatcccctcttcttgaaatttggcttgtccccaagccgatgaagaaaacctcctggatcccatggtacctgtagctcttgtatttccttggaattgctcacctgtagcttgataacttgctctgtatttgtctgtcttgtactgaatgtctcacattgcagcaattgttctttcttgatatcacctagtaacaagtggcgtattgggcacccctcttttatgaccaccaataatttaacagaccaataatccctgtttgcaattgatgcatatatcatctctgaatctgtcccgatatcaatggaaaaccttgctgcagcactaccatcactaggattgttctcacagaaatcaaaaatggaatcataaccacatgtcttgaccttcctgttctgattctcagcagcacctctagcaataatcccagaaatccttctgaccccaaaatgtatccccgctggacagttaaacaactgaccattgtataatatgtttgttgggttctgtagccagctctcaacatgattaagtgtcatgcgcatggacttacaaattttgtaagttcttcccttagctatatcatttaacccttcttgagcctccaaccaacaagctccatatatattttgagtagaagatggaactgacagaaatgttgttgtcattgtagcagcaggaatgatcaagtagttgcagcttattgtacttaggccatataacattccctctgtaactttttcctcaccacccacataatggaactgttccaagttaaatattgccaccaatgtatccttatgagctcgattagatttttcatgatttaaatctcctttaggtgcacaatatagtgcaacagaaggtgtttggtctcttatgcaatttgcactgcaaaaatcatatcccatcaaatgtgcaaaaactggtgcaggccatgggacttgctcaccccacatcacgcctccgttatattgacttggttgtgggtcaggccacggtttcagctctacttccgtcaaccatgtgtttaccaacagccaaagtattatggttccaatttgatttggtggtggccatggtggcatgaaataaaatattatccccaaataattgcccgcagcccagggcacataccactccttccatcttctaaccactccacctgagcaaggaggtggccatgggtttctcttgggatgactcatcaacagcttcttgtagcccttggagcatttggtcgaacacctgttgagcgccacccattttaggcagaaattggagtttagcttttgtgccatgactagtgtggcctttcccgaggatgctattccttctggcgcgccaagcaatagtgagtacgcaaccccagcctggacagtaccggtgttgacgttggggcccaacatcaaatggcttgggtgcatcaccttgggaaggtgagtggtgtcagtgcaagttgctttctcgtcaaccatcaactccatggactgacttgatatcggaacgaccttgaacacacccatcctactttggaacgcaatcacacctctatcagtgacaccgttgacatcggggccgaacaacaaacacttggtgtgcgtctccttggaacaaacacgggggtcaatgatggtggtgccggttgcgccatcggtggctaccaactctttggagtccacggcagtgttggaacatgtaaccaccgcagccacggtgaaatcaggctcgacgtcgaggcttgagcattttgtcaaacacatgataggcgtcaactcgggaaggtccttgctaatgatgaagggcatgcgatccttcccctcaccatccccaacctccaggatgatcgtcggagtagccccctcgtcgtcgtagatggatctcgctattgtgctcgggctgctgccattggagcactccatcgaacaggtggtgggcgtcaccttggactgctcatcctcaacaaaaaactgaaggtcttcagctttcttctattcttggggcatccacgagtctattgctgccttgagagacaggaaatctgctctccttctttggtctgcctcctcccgccttcgctcgcactcctcgagcatcctcaaaaagcatgtcaaacttgtcctcacttcccatggcagcttgcttgatgagcttcgtggggattggctctgataccaaattgttagagacccactcaacaatataatttcagaaatagcagtgccaaatccaacacagggaacaaccaagtctgttacaatagtggagtggttttgaggtggaagatggaaggatacaagggctagaaggttctagtagcttctagactagtagagaagaagggagatagaggagagatcgacaaagaggccagccagcctctaggtcgccgccgctgctgttcgccgccttggccaaatgaatctgttcgatcgatctcctgtaagctgctgctgctcatatatcttttagcttgggcttgcttgggcttcttggcgatgggctgaccaacccgtggtgtagccagcggcccatgtgcagcccacccgagtccctgacatgggacagcggccgttatgtctccgcggctcacgccggacctgcatggggtggtcgacggcgctcggtggcggcgccgcggctccggcccccaaggtggtggtgacgatgctctttctttcttctttcttggtttctttgtccccgcgagacccctccatgggtgtccctcgagatggtgatctcatggttgtctatgtggagctttacctctttcttcttcttcttttttgtttcctgttcggggatcgtggagcatctacctaattggctaaccaggctattagcgtgtataatggggttgagttgattcgttgaattgattgctcttagtgcgattgtgcgaatttgaaatgtaatatgacagctgaaacgaaaaggaagaatagaatcgagattttagcaatgctgattaatttcttaggcagtgtgtggttacaacttacaagcagtgctgaatttgccgaggtgtggattcttacgaacgttggtgtttggcattctacacgattagattgatgtatcagtaatttggtttttacatgttgctatattttgatataaacttggttgaacttgaagaagtttgacttagtaatctgccaccaccactgcatcttgcatctggttggtcataaagagtcatccttgttccaacttatacgtgccatttcttcattacatatgttttaattataatcaaatgagttttttttcctgtcattctgtagaagggagtctgtgggcttaatttgaagtcatgcagtggtttcatgctcaaaacgactccaaaggtgatatgtttttcatcccatttttcaaaataataagtgtagtgccctgaatactaatacaaatggttctgcaatgtaggtcggatgcccttcgctccgtgtgagggcatctgtctcttcaccacagaaactatactcttctaagacaacacaagttaaatcaggggaggaggtgcagattgcggttctaggggccagtggttatactggagctgaggtagttccattttatcgtgttatttccaattgcgtttgttgttgttatcttatacaagtgggttcctttcaacgaatgtacttgtaattctgttcttatgtttcttctatccggctccgcatttattttctatgactatatcctatatggagatcttcgacttcttttttgtttctgtttgttaattattgaagtacgcttgcattgacagattgttcggcttctggcaaaccaccctcagtttcatatcaaagtgatgaccgcagatagaaaagctagcgaacagttcggatctgtatttcctcatttgataacgcaggtaagattttttcttgatccatgctccttggtacccgagattgcctacacttgtttcttcaaaaaattaaaaggaagaaatgacctgagttttttttatccttggcacatcaagaatcggttgaaccttttggtagtacatttatttttattagaatttctgggccatattgtagtcattttgctgatcaaaattgtaagactctgctggttatcttttgatatgcaggacctcccaaatttagttgcaataaaagatgcagatttttcaaatgttgatgcggttttttgttgcttgccacatggaacaacccaggttgtctattattgccatgcccttctctgaaattcttcctaccaattcctgaatcatttagaggtcacaattacactattctgcatattggaggaatttttaaagcgatacctgcttgcaatatttttatcaggaaattattaaaggtttaccgaagcaactgaagattgttgatctttctgcggtatgcttcacaaggctaacagtttatttgcatagatattgtctttcatgctatctaatatccattcttactacgtctaattgaccatctttacaggatttccgtttgcgtgatatcaatgagtacgctgagtggtatggtcatgcacatagggcaccagaacttcaggttttcctggctacctgtccctacatacttgtttagttattggtgttggttatgcacttctactatttataagatctttagttctcagcgttgtttatgagcatttgcttttagtaagatcttaagttatgtatcattaaattatgtttgtttatgaactcatactctgtggcttgcttctctgtttattcagcaagaggctgtgtatggtttaactgaagttcttcgagatgaaataagaaatgcacgacttgttgcaaatccaggatgttatcccacatctattcagcttcctcttgttcctctgataaaggtgatgagggaagattaacagaagttattagtcatatatggttctctgatttctaatgaaaccaacaaaatataatcacattgagtgtacaaaactaaccaattttggtagcatataaaggatagttgccatagtgtaaagtttgttggccatgctcctctaaacccttaactctatgcaaaattttaaaatgttatcagttgaatttacatggcattgatgtatcttttaccatttgtttttaccatgcaggcaaaactgatcaagctgagcaacattatcattgatgcaaaatctggggtttgtggagcaggcatgtaacttgagatactgacgtactgtactactatggctacaaatttagtggttgtatatctgccatgattactagtcaatctttctctctaatgcatgcatttgtgtaggacgtggagcgaaggaggcgaatctttacactgagatagctgaaggcatccatgcttatggaataaaaggccaccgtcatggtaacccttgttttgccattttccaaaaagctggaatcaacatcagtgttgtagttactgtgttatagctctttaacgaaattgtttattctcccttggacaaacaaatagtcgataaagtggttacagaatgtttacttatatctggctatctgccctccaagtgcttttaaactggccctactgacacattgcaataaaaccgtgttagctcccgagattgaacaaggactttcagaggctgctaaatctaaagtcactatcagttttactccaaatctgatctgtatggtaagcacttactttctcatttttgttgacttaataactccaggttctgcagttttgtactgtattgaacgcacctggagtgtgtgcattagttaaatcaaattcttcatatttacgttgaacagaaacgtggaatgcaatctaccatgtttgttgaaatggcacctggagtgactgccggtgatttgtaccagcatctcaagtctacttatgaggtttgtttgtctgaccagtggctaaattatctgtctgactatttgaatacagacgttttctactgaaatgaattcatcaaaatgttttgagattatgtaatgttgtgagtgagagcatctcctcttgttagcatcacaattttatctacctgtatcttccccagggcgaagagtttgtcaagcttttacatggcagcactgttcctcacacgcgccatgtcgtgggatcaaattactgcttcatgaatgtcttcgaggacaggattcctggaagggccatcatcatctctgttgtatgcgtcttcaaccatctttatgcccattgtcaaactagtttcttcagacttaaagatgcgaaattcttattttcttgttcttcaactccacagatagataatcttgtgaagggagcgtctggtcaggctgtccagaacctcaatctgatgatgggcctgcctgagaacagagggctgcaatatcagcccctatttccatgatcctttgcatcggtacgtttccatttcatatgaaattctgtcaagatggtgcttctgagttcattgagccatgttatcatcggagtgtgaaaaaaccaagcttgctcaaatgcattgctcagtttgtgctgttgtttttgtagagattagctacagttggcagttcagtagtgagagcattagctgagtggctttctgccatggaaaatcctaaggctatataccatgtgctctcgtgttgtcatcagatcaaataaaattcaataaagcaaggcctttgtttgtcatttttacacctcaacaaaactttcttttttgaaagtaacctcagcaaaatatgcatttgtacacatagcccttgcttaattggcaaagcagaacaactacatcaatctcacttgtacatggctcctacccaaatatgtcggcctgagcatttacttatcaaccataatctgacttaatttcctcagtctataaatatatctttttttaacgaaccggtacttagaccacaccaatttcattgaataaagtaggagaaaactataaaaagggagttttacaaaggaaaaggaaaattgaggcaaagtttgtctaaaaatataagagatttatattcacactctccaaccatctcttgtctaataaagggtatcatagtctttacttttgatccttaatttgtcaaaaaaaaactataaccttttatatttgtggatagagagagtatatcatacttgaatctagcttggttaattaatccaaaattacatcgaaacataacactaacccttttgtcctaattactccaacatccaatcgatctcttcctctgatatgagtgatatcatctcatctgatgtactatccgcccaatgaaatgatcaacgtgtgatcaaggagggagagggacatataaaaggcattactacgtacctagatagcgagtgtggcagcacatcaaatgtacggatgagatctgagccgttcgatgatgagaacggacggccggatggc

SEQ ID NO: 66936 - DNA, 2705 bp, Oryza sativa
gtaaacatgcttgcattaaattggttttttatgaagagcacttaattacattaacttccagagttaattggacactagctactgtgtagatcagaacacagaaactgcagggtacttgatgtgcaaatatctcactcatacacaatgtagtaggggccaaagtaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatgtaaacaccacctaagagtattacatgatccaggtgtaggggacacagtatatatgtaggccagtgccacagggtgtatatatttatttactccatctatccccaaatgcaagcatttctaaagttttgcacatatattgagaaaaatagatggcaatgattgagagaagattgtaattggccgagaggaaaaatataataagaaggtaaatgaaaaatagttatgattgattaagatgttaggataagtgaagaaatggcttcttttaagataaatcttatgcaatagaaatagctttatcttggaacatcagaatagagtgaataggtcatgcagtaacagtaaacagtagtacttagttcagaattgctggtcactattttgctgtaatatattggccattgggtagatttaattcccatgtcaggatagagttgggtgggtttgttattacattgtacttttttgccggaattgttacagtgtactgcaaaagtgcaagctcgaattaatctaaggatctgttcagcagtcaaccaatcaagggaaaatcaattaatttacaatgcaatgcaaatgtttatagttggtttgtcgtcagatttgctttgagatttgtgtgtatggcacggagttcaataaaacataataagagtatgagattatgagaagtataattggatcgctggtaattaatcgactacactgaaagagaaagtagaaacaaacatgctagatgttccctggatcaatatcaagttaattaagagaaacactgttctgaatctgggatccacacgggacctcgaacgcgtgcatatactccttcacaaccaccagcatttcttccattaaagagatgaaaaatatctgaaaaaaaataacatggaatccaagtatatgcaacctcaccagcataatgaaaggatgggctataaattatactggcgacaatactacctgatctgatacattcctcctacaaacatgtcattttcctagaaataattaaacatatataactatctatattatattttaattgctaattgaataaatgagagttcagaaaactattatcttgatgagaatccagaagactggctaggtttcctacatatatatccattaatccatgcatatatacacatgcacagtaaacagcagtcccagctgcagctagcagcagaacagcactaaaaaatgagtaaatgcatgctgcctaccaacatccacctgccacagcttcaatgcagttaagtttgagtgatcagggcccgggcttgggctgcactgcatttttttgcatgagagattcatcctgaatctgcatgcatctagctattcctactttcctagtgactaccaattgccatgctatagctgttgcttcttcttcccagtggtagtaaagtactataccccctcccaaaatataagaacgttaagatatttttggaggctatatagaaacgttatactaggaaatgtttttatattttggagcggagagagtagaagattagattatcacaaactcttgtttcctcctttggttcacacattaccacaagagcactctacatgtagggtgtgtttaggctgtgtttagatccaaagtttggatccaaacttcagtctttttccatcacatcaacctgtcatacacacacaactttttagtcacatcatctccaatttcaaccaaaatccaaactttgcgctgaactaaacacagccttagttcacgctaaaattggaagtttggttaaaattagaacgatgtgacgggaaaattggaagtttgtgtatgtaggaaagttttgatgtgatggaaaaattgaaagttcgaataaaaagtttggaactaaactcggccgttcatacactctttacttaactaattgaaatgttttttttgtcttcttggatatacatctttctagtgattataaatcctaaaagtaaggtctaatcttcagtcggtttaatgcaaatacaatatgtgttttgctttattgaatcatatatttttatagaagaggaaaacaatattgttgaattttaataaaaatcatctacacggggacaatttgagacacggttttttaagtacagaagctagggcccatataataagagagctttagctaccaattaattgttgggagtgccatcttggtatagaacttacatgttagtagggctgcaggaatt

SEQ ID NO: 66937 - DNA, 2766 bp, Oryza sativa
ataataaaaaataagaacaaaggtatatcttgtagagcatgtcattgtccaaaacgtcaattaaataaaaccggagggagtagagatttgcgggctaaattcaacggatttaacttttactcctagaagccagttaatgatgttttgcatgtcacttttacctttggaccagagatcatgcaaatttggtgcaagacaaatatgaaatttgatcattgatgtgccaaccaattccaatgttgtgccacaccagttttcacgtgcgatggttaaatcgttcaaggaatcttataatcaaggcaaagtattcaactattcattatccaaacaaggaccctctttgtccaacaattttggtaaaagggaatgtatcaattaaatttgtaaccgaacgtctatgcttttgtgttctggaaagttattttcctcccgagatatccaacatatctaacccagcgtaggttacacactaggattttagagaacacaaggacttcacgaggaaaaaaattcctatactccgaacacgatatactctatccagttaaaaatattttatgattagaacaaaattcagttaaacttttaatgacacttcaaccatcaataatttattaaaaacaaaataaatgatatatgtagattttgcctcgaaaaattactactactatcatatatatcacaagctcactagattttataaagagaaaatttcttatgtgcacatgagttttcacttaatcccttctatacctctgaattttatctcatcctgttttcaaatttacgatcaagtaactatattatgtttgtttttttaaaaataaatcatttttttgttaagggctgtctttttcaatcaacttgcacacaagtacactaacagacaagggtaatatggatatttttacaaaaatctaatggtttaactatcgactcacggaatagacatggaggggatcaaaataaataaaaactcaaggctatataggggatgaggctaaatttaggggcacataagggaattggcgaaaattcgtggacataaggaattttatattttataaaacttattgtaatatattattttttttagaattttaaaagcttaactgaatcttgacctaaacattaaatatttatctcattctaatcgatgttaacaatttctcaacttttgctataaaatcttaatcgcacgtaaatgataggcaccattgcactaggtgtaaaataaaaaccttatcctctactccctcggccccaaaataagtttattttcacccatctcatatataataatagtaataataataataataataataataataataataataataataataataataataataataatataatacccccaccttatcaaatctcaatgcaattatttctctctttatccacccccaatgcatttatccactgctttcagaaactttgatttaatgatagctaaaaataaacttattttaggataattaaaaacacgaatatcagggaaggacctattatcaaataattagaaggggtgaggcttcgaacccaggtcgtctagcccacaccaccttgtggagctagctggaaaaccctgggcatttctcttattttaggataactgaaaataaaccataaatgatattattctgaaagagggaatactctcttttgcaaatgaaaaaaaaaaactataacaagaaaccatggtcgggatagcatttgtgcagcagaaagaacctaaaccgtgtgtggctgcattgcatgcatgatagtgatgagataccatatggctgttcacaacccaacaacttgcaatccagtgcatgcattacatggccaagaatccagcggttgagccactgacatgtatattccactttcgttatgacccgcatgtcagtggctcaattgcacatacagctaagtcagagaatttccttcatctctaccaatctattctctctctttggcctggtttagtcccaaaacatcatatcgaatctttgaagacatgcatgtagcattaaatatataataaaaaaaactaattgcatagttaggcggaaatcacgagacgaatcttttgagcctaataagtccattattagccgtaagtgctacagtaacccacatacgctaatgacggattaattaagctcaaaagattcgtcttgcgattttcaggcaagttatgaaattagttttttcattcgtgtccgaaaacccctaccgatatccagtcaaacatccgatgtgacacccaaacatttcttttcttgaattaaacatgccctttctcttgtgcttgcattgcatatgcatatgcacaatgcattgcttctagatcacaccaaacagctactagcccccccttatgacatgccattcatctccattgcatgcttgcatattgcatgcatgctgctgctgcttctactcctccaactctctagagctagctaccttgaccctaggtcaaacccctacacccctcattacttctgcacctgatctccttctctctctagcttctctccctagattttctctctctaacctgctcctccattactggcctttatatccaccacctcctcctcttctcctccctcataggtggtgtttgcttagctagctagctagctccatcactagctctcgcatcgcatgccacggtgagccggtgtcgccggcgtcgtacggacgtagcaagcgagagagggagagatgaagaagcagggctgcaggaat

SEQ ID NO: 66938 - DNA, 9785 bp, Oryza sativa
  unsure (1)..(9785): unsure at all n locations
ccaggggctcacggggcacgccgagccgggcaccatcacggcgctcatgggcccctcgggctccggcaagtccaccatgatagaagccctcgccggccgcctcgccgccaacgccttcctcgacggcaccgtcctcctcaacggccgcaaggccaacctctccttcggcgccgcggtacgcacgcacacctcgccgccggcgacccgtcgccactgtgctgaactgctgaccgcaacgctaagttaatcagttattagtagtagtacaatagtactaaatactagtaaatactaatcagctttgcttttatatgggattggattctgcttcagaaaatggttttctggattaaaagctgcacattaaactaaagaagtactccctccgtttcacgatgtaaatcattctgtcatttcgcacattcatattgatattaatgaatctaaacatatatatttagattcattaacatcaatattaatatgggaaaagttagaatgatttacattgtgaaacggaggaagtagttcatttcttgaagtataactgcacacagggagaatacttgtagtacaaaagaaaaaaaaaacatggaatatgtgtgtgttctttttgcagtacttcattttcttgaagaagatttatttttttttgtgtgtgtttgattagaatgtgtattgtatattttttttcctttctgttgctttcattacttgggtctttatctgaatcacctgaacaaccgatttcagaatgagaaagaaatgggtcatttttttgttgttgccacgtgccatttcttggaaccttgctgctttctggcttctgcatgtgtttggacagactgcctctctgcagatgtaatttactgcattaataactccctttcatggatatagatcacccatttctggccaagattaattgggggatctggctcaatcaattaactagtttctgcttgttaatttttagataggaaaaaaaaaagctctttcaggtatgtgtttggtaatggagttaacactcattcagtcatctagcttgttggcaaggaaaactaggaacttccccagcagatgggatgtggtttaccagttttttcagaaactatgctcatcaaaaactcatgatctgttgacaatcctgattatttgttgtacatgtagcgtgtgtcaccatgttgtccaaaatcatttctttatgacttaacaggagcttttttaaaagaaaaaacatagtccaaaagaaggttgttgctgatatttttcatgacttgtgcagttgtgcttcatttgtttctgtcaaaactgtcaacctaatatgtaggaagtagtttaacttctgtaccaatcaataactataaagtattatcaaggaaaaaaagagcaaaatttctgtatgtaaaaagttctaccttgtcaaaaatgataaggtgatacctgaagttatgtgcatatattatcttacttcgtctgatgcagtaataatctcaaggtaacaaaagaagttacctccaggctccagcttactgaaagtttcagtaaaatatgtaatttcaggcctatgtgacccaagatgacaacttgatcggcacattgacggtgagggagaccatctcatactcggcgcggcttcgccttcccgacaagatgcccatggaagagaagcgcgcccttgtcgagggcacaatcgtcgagatggggctgcaggactgcgccgacacggtggtcggcaattggcacctgaggggaatcagtggtggtgagaagaggagggtcagcattgcccttgagatactgatgaggcccaggctgctcttcctggatgaaccaaccagtggccttgacaggtaggtactgctattatatttatggcaaatcatttgttattacattaattaatggatcatgcaagcatgccgggtcggccaaaggctggccgaccaatttcattaagattgggagaaaataaagtaaacatttagttacatccaggcccagcatgatagcaatctagctatctagcaagcatgatagcaatctagctgaacttgagatgtggagatttgatttgcacagctctctaccttgctttgctttcaaccagtagtgtttatcaaactcattcctggtataactatcagaaggttactatgccttgtcatttgtcaagtgattgtaattgttacagtagcaattatctgtctaagtaactgatgtgcagatgattaatctgttgcagtgcttcagcgttcttcgtgacacagacactgcgtgggctagcgagggatggcaggacagtgatagcatcgatccatcagccgagcagcgaggttttcgagcttttcgaccgcttgtatctcctttcaggaggcaaaactgtttactttgggctggcctctgaagcttgtcaggtatgtcagttttcacaaactctattaagttgcttctgcaatgctaatatctatatgggttccctgaatcatgtactgttctttgcattttgcagttctttgcccaagccggcttcccttgcccaccgctgcgcaatccatcggatcatttcctcagatgcataaacgcagacttcgacaaggtgaaggccactctgaaaggatcaatgaagagaagagtaagtttcaggattcagtcagtctcctcctagtacctacaactggcactcttacctgtgcatgccttgactgaaattgtgctcacattttgcatacatagtttgaaagatccgatgacccacttgatcggattatgacttcggaggccatcagaaggctgatcacctactacaagaactcacagtactactttgctgcgcagcagaaagtcaatgagatggcacgggttgtaagtaactagattactacagcaacttccccaaacattcaaccacagctagaccattgtaatgcaagctaagaggactcacatggtatttttgttgcagaaagggacagtgctggatgcaggagggagccaggctagcttttggatgcaggctttcacactccgaagcgatcgttcatcaacatgtcgcgggacttcgggtactactggctgaggcttatcatctacattgttgtgacagtctgcatcgggacaatctacctcaatgttggcaccagatacagctcaattctggtaaaaatttccttcttcagttgtcacttctatttggatgcaaacttacactgaaaagtatctagctaccctgaactgaatacttgatgttaagcttggtgatctgataaaactgtgaaaacaattaggcaagaggtgcatgtgcttctttcgtcttcggctttgtcacgttcatgtcgattggaggattcccgtcttttgtggaagacatgaaggtttgtgtcaccactgaatcaacaaatgggttagaaaagttcttcagattacagcaaaccatgctcacagaatcttttttatgctctttcaggtgtttcagagagagaggctcaatgggcactatggcgtgctggcattcgtgataagcaacacgatctcggcaatgccattcttgatcttgatcaccttcatctccgggacaatgtgctacttcatggtgcgcctccacccgggcttcacgcactacctcttcttcgtcctctgcctctacgcaagcgtcaccgtcgtcgagagcttgatgatggccattgccagtgtcatccccaacttcctcatgggcatcatcatcggtgcaggaattcaggtgaattaattaccatccatcacaacaacttgatcctgtccatctttatcaggcactgtttggagtcctgcaacgcatacaaactgggattaaattttgacactgtacttggaactgcacaacataatgttgatgtttgttaatattctctcatgatcatgacatgcaacaacatttattgaagagaaaaatatcttttggaaatggacaggggatattcatgctggtttcaggatacttcaggcttccccatgacatcccaaagccattctggaggtatcccatgtcatacatcagcttccactactgggcattgcaggtaaaaatttcaactttttttacagctcataaactgaagcaaccagtgaactcaaatcagggtttaaaacaacaaatcaggaaaatttaaacccaagaccaaaaaatcaaaatcaaaattttgtccatgtgttactgctgttacttctgttgtcacaagtacatgtatagaacatgacatgagaaacaacgaatttgagaaatttgaagcaaaaatgggccaatttcaatcttgacaggtttcgtcgatattttccataatttttgtcaatctcttaaactggttatacctctgttgtcagttttcactagtatatgtaatactagaacataaaacaactattgataattatacatgaggaacaataaattcggaaaaactaccagcaaaaaagcggtaaatttgaattttgatgggtttgatcgatatttttcataatttttgtcaatctcttaaactgcttattatacatctgttatcagctttcaccaccacatgtaatagaacataaaacaactatggagaattacacacgagtagcaacaaattcaagcaaaaaatgtgcagattcgaatgtttgactggttttttttttccatctgacattgttgcagggtcagtaccagaacgacctgaagggcctggtgttcgacaaccaggacgacgagctccccaagatccccggcgagtacatcctggagaacgtgttccagatcgacgtgagccgatccaagtggctggacctcgccgtgctcttcagcatgatcttcatctaccgcctcctcttcttcgccatgatcaaggtcagcgaggacgtcaccccgtgggtgcgcggctacgtcgcgcggcgccgggtgcagggcaagggcgcccgcggccgcggggcggacctctccgccgcgcgctcgccgtcgctccgcgcctacgtcgtcgacgccgccgacgacctgccgccggcctgaccacccgtgagacagacacggcttctgaaaactctgaaactctgaactcctcaactgaacaagtggagacagaggaagaaaaagagagagagggagaggctaaaactgaactaaaaaaaaaagaacctgaatatctgatatgataattgtgtgttatagtagtagcaatgcttaattaatcgatcaagctgtgttgttgtattgtattgataattactaatatcaaggtgtatatcagcagctgaatgcaagtttagctagtgcttagtttcaggtctctgtcttatctctgatcttgctgcagttagtagtaacaacttattcaagttggaaatttgatggttccattttgtttggatggcatcttgcagcagtgggtttgtccaaaatggagctacagctgctacagattggcaatgatgcatatggcagcaaggtactgaagattttcacaaggatcttgtcaggacagtatgcagtttggttgtgcaagagaaaaacatccaagaaaggacatatgatatttatgagtattgaagagcaaactgttcgctacttgcttgtaccatgatccatcatttaatctaaacacattgcaagatggtgtggcctgttaaagaagcaattttgcaatgttgataagtaattaatgacaagctgttttatcatgtgaggagagtttatttgtatgcagacaagagcaacaaactgtatatatgctagtagtacttgatatttccatgatccatgattagtctgaacatcacaagatcctgtggcnnnnnnnnnnnnnnnnnnnnaatgcttatcagtaatggcaagctattctatcttgtcaggagagtatacagtatgcagtttggagtttggacaagaacaaactgtatatatgctacttgcgagttccatgacccatgattagtctgaacataacaagatcctgtggcctgtcaagaagcggtttggcgatgttcatcagtaatgacaagctgttctatcttcagggctttgttactgtaactgtttgaaaaagcaaagatactgttgtaacataaattggtgataatgggttgatccccatccatcttttctctgtgacctcaatgaaatattgcaatggatagggccgggtttagttccaaactttttcttcaatcttccaatttttccatcacatcaaaacttttctacacacaaacttccaacttttccgtcacatcgttccaatttcaaccaaacttataattttgacatgaactaaacacaccctaggtgtggtggcagcagcagcatgagctgagacgatgctagctgcagatcacatgtatagaagttaatgcagtgagcagttgcaataacaaacacaaatgaaaccattgtgcaacagcagcaactgggcacaagatgtcatacggtttgatgaaaggatagaaagcacaggaacctgtcatatctttgtgaacagtggtacaggaaatatcctggcaaaagtggatagtagtagtaatcttgtgcaggaaatatcttggcaaaagtagatggaaatcttgatggcatgatgccaccatgagccagccccatgactgaagagatccaataaattaaaagagaaacccaggatggtagtacaccagtactccctcctatcataaatacatttatttgttgagaacaaaatttcgtcaaacttcaaaaattccgaccaccaattccacattgaagcaagtatataaaatctaatactccctccatcctaaaatacagtaacatagtactagattagataccgcctaactccctgtccagattcgtagtgttaggtgatgtgtgtgttagttttataatattacgatcgtacttttcaaggcaaataaagtataccattttatttgtttggaattttaaaagtttaactgagtcttgttctaaacgtcaaatatttacgactagagcaagcagctgcttgcgcttaaatcttgtgcttgctgcattcagaggggaagacatgtgagacaggtgaggctcccttctcagcacggcatagcatgctggttaatccaatgacatgaagcgtctgaagttggtgtgcaattacaaccctttactggcacagtgactgaatcttgccaacttagccagctgaaattctagtagatcatggggtttgtgtgaattgtctggttatgggcgaatacatgcgtggcataaagtggcaatgtggcatgaggaatattttctaacttgcttttggaagcctgctagtatgttcaactaaattaccaatgtccttgcatgttttttctacagaggttaggatagaattcagagatcagacaggaatataatagaagatgtgattggaaatgaagtgttcatctttttttgagaactaatgaaatggtcatcagctcatgttcttctcttcttctcatctcatctacagagagaacagaaggggatgtgaggactgaagtactactgaacaggcatcaaattgttggaaacttggatgtattcatttattcattcattgattgcacgtccaaattcacaacagaaaatgccaaattgcatcattactatgaacacggcaaactgcaaattgttgaaaaaaacttaatgagaaaggacaaggcatacccttacctaatagtagtactccatggcattcatcaatcaaagcactaaatttggggacaaagtctgaaatatatctacagtaaaaactccatcttgatctcctcaatgacagataaatatattttgaaacggatattccaagaacatttacagatgctaccatctaacgacaggaatcggatgggtttgaatgaattcagttgcagtggttgaagttgtaaggatgccatcgtgagttgtccggccattgccggcagcagagacagcagtgcaggcttgcagcaaattgggggatgacctctctacatgatctcctagggtataatgtgtacggcatgagaagtggaaatttttaccctggaagtttttgacgggataccgacagccgggtcgtgcctgggctgcaccctcggcacggtgggctggcccagcatggcccgatcaaataaaaaaaatatagagatgcaaaatagacttaaatagtcgtctaaggcaaggcccaagacaagaggtatacaaaatagacttattttccagccatttaaacacaccccacagagttgagggaccaaaaatagactttttctctgaggaagcacgatggaccatcgtgccttcgggccggcccgtcacggcccgagtagtattgggccgtgtatgccgccggtggggtggcacgacacggcctagtgtgtcggtcgagccgtgccggcccgacaagcctcagcccaggcatgaccgggcctgggccatgccatgctgggcagcccagatggccatctatactctcatgtcatggaaaagaaatggctgtcttttttttatgaagaggttggtacatgtactttcactgttagaaaactaaccctgttaagtttcctatgacaatcccaaatctttttttattaattttatatactccctttattccacaattagttcatatttccctcccatttgttccaaaataggtgcattttgagtaattattacaccaaagtttatgcaattaggaataattgcattggaaataaataaaatgaaaaataatcacataatatttgataaagtaggagtattctaatttttgttttggtttgtattggtaatgaacttattttaggacaaatggattagttcagggtaaccaaagtccaatgattttagttccaaacaaaataaaatatatacatatttaagtcaattgtgtccgacacccctattttcaactacaattacgactctaaccctattttttttataaaaaaataggcatgtttggtacggctccaactctagcttcaactcttatggagctaaagcccagccaaacagtttcaactccacctaaaatatgagttgagctgagtttagattgctcaacaactccactatagatccaacttctagagctaaagagttggagctctgccaaacaagcccaaaatggttaaattttgccgaaagccttttttacattctagcaggccaaagtgcagcccaaaaggcccaaactcggcaacgaaaggccccaacgaaaggaggaagcaagcaaacaaacaaaatcccccacccaactggagagaagagaagcggcaagaaaccctagcgacatgctccagattcgcctcagcaagatcggctcgtcggactccggcgccgccgcgtccggcgcggcggccggggccggcggcggggtcggaggcggcggcgtaggcggcgccggcgccgcgccggcgggggcccgccgaagtcggcctcggcggccgcgggcggggccccggagtccgttacggtcgcgtgccccgaccacctggtgattgccgacctcgccgtggcaaagagcctcggcgccgtcacgacctccgccgtcgcggccgcccgcaccatcggccgccgctcccgccgccccctcggcgagcgcgtccacatctgctgccgctgcgagttccccatcgccctctacggccgcctcgtatgcacctatagtaaaaccctagctcctcctcatttttcctcattttctatgtgcttgccttttgctagctgtgctgtggtttgaggggaaaaaagttttagttcatcgcaagaagtttaaagtatatatatatatatatatatatat

SEQ ID NO: 66939 - DNA, 987 bp, Oryza sativa
gagagagagagagaggttttattaaccacatggcgatgctatctgattacccatttacccatcattcaggaagcagcactaattattgggtagaagaccatttgggagtggttcgatacagttggggcgacatgcagtccggtcaaagtcattttagatgaatgctgtgctttttgttctgctacaatactaatatggtaggagtagcacttggttagaggactctacatagtttgcatgtcaaatatagataatatgctgaattcttgatgctgtgggagtcattgctaaatctagttatgaccttatttccatagtgacagggtctttcatattttttaatattcggagcttttggatttatttgtattggcgattttgtgctaacagtgatacttttgaaagcttgtctgattctagctttggcaaggacataagcaagtgaaacagacttattgtgtgcaaagtatttgtatttgataaccatctgtatctaggattgtcatgatagtttcagtgttatatatttgtctctgtaggcttgaagctaatatatatgattttcctgttgcccgtattactagcctgctatagagtatagacatgaccattaactttatatagttcttttgttactatatgtttggtgaaccctacgatagtgttatgacatctctttttttttcctatttatttcagattccttgtgaacatgctttctgtttagcctgtgctagaagtgattccagctgctatctgtaagcattctcctgaactttctggaacttgatcttgttagtttattgacttattctcagtaggataacatgcagtaacaaagtgatctttctgtatggaatgaagtttctcgtatgatctctgagaattcctgattgatgtgttaatttccttcagttgttaagttttctaccaaaatgagtttcaactgagtagatcataagatatactccctccgtttcaggttat

SEQ ID NO: 66940 - DNA, 885 bp, Oryza sativa
gaattcctgcagccctagtcaagacaaacagcaaatgatgcctaatgcgcctttcatgtttcctccaatgcctcatcagccaaacttcatgatgcccatgaatatgaatcagccattaatgtccaacacatcattcaattatcctctccaacaagatggaaatccacagttcttcagtgcccctttccagatgcaactaccagatgttggactggatcaaggctcagcctcgggggtccaacctacgccacctggtcctttaagcttccctgaggggcttcagcgtccatggggcatgggattgatgggcaacccatttcagtcgatgccacttggacagggaatgcctgaaggtgcaggtgaacctcagggaggtggcggaatggttttcctgcaaggtggtttcggagtcatgcctgatggctcaatgaattcaggcataccaggtagggatctttctggccaaggtgaccggggtgttctagcgcagatgcccatgccgatgcaaatgcagatgtcacttcccccacctccccctacacagcccccttcagctggacagcaaacttttagcagaacttgatgattatttatgtacggtaatttaattgttgctgtcaaaattggattgtacttatcgagaaaacggtggtctcatcattctgcgttgctgatgagaaatgtgttgtgccatgaacgatcatatccctaatgaaattcctattgagatcgaagttttcatgatgtttgtgtgattgttactctggatgatttaatgccattgtacagttggtgtaatctttacatgttgaaacgtcagaattattaacctattaaaacgtttttggactttatctcatttcccatttcctggagatgctatag

SEQ ID NO: 66941 - DNA, 893 bp, Oryza sativa
ttacatgcatggtacaagggatgggaagaaaaaaaaacaaacctcatctttttcttatacttatacttatcagccaaaatttgaattttcaactttaaatttgaagttgattttgagatttttcgtcgaaatttatttttcggcctttacttttagatcactgaaaacacgtatataaaagttttattaacaaataatttattgtttgcaaatataccgtttggcttatttggagccgaaagctgagaaaaaaaaaatagtgaattccaaaagcggttcctcaattgtagacgtcagagggaggcgcgtgtcactgacgcgtgggccccacaccaaccacgtcagggcagccgcctcctcctccctcatcggtctcctctcccccgttcctcctctccacgactccacccctcccgactccgcctccgccgccgcttccgatccgcggcggcagccggagctcggagagagacaggccacccgccgcccccccctcctcgccttccctgtgcggcctcgttcgccggtgcgacgcgccatcccggtccgcatcgggctcaaaggtatattactccttcttctccctcttagatgagccaatccgggcttaggtttgatccccttcccctccaattaaccttaacgagacaggttcatggatttatttgagtagcagcagcagcagcatgtgaagattggaaagaattgcggttcaatagaaaggatggatggtttctttttttttcttcttctcctcctcctttcgtctagtgtgttcgattaatctgtttcaggtcaagacttaatgtgcgcacactccctttctgagtgcgcctgtgtggacgattttgccgactttttggcatatcatttgtagggatgcatgttgggtg

SEQ ID NO: 66942 - DNA, 8357 bp, Oryza sativa
  unsure (1)..(8357): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattatttttctaggagatgacttaatacgttgatttagtagtttttagttgggaggacactgtttttgaagttcttttttttttcaagaagtttagtagttctaaactatgcactaatttggaacatcttggaagcacaacacatagtggtggggttcggcgtagtgtggtgggtgtggtgtgtttggatgcatcaacgtcagcaacagcaggctacaaaaaacattcagagaaaaaaaaaaggttgccgtcggtgatgcgacttatctgaaattccccacgtacttttgtcataccctgcatcaaaacttccaagaaataataaaaaaaaggatcattcatcacaggctatgattaaagcaagttaacaaatgacacgtcatttgctactaatctagtagccgacctatacaatagttagatacatacagatacatactaacacctcataaggcttattaaagcttgtgttgcaacaggttaccgatctgtagcccgtcttttttcaagtcttgtctcttttctctaagaacacagcttaaatcttggtaactccgatggctatcacttcattatacttgctcttacaagttggtagtgtaataagagttgggtaaaagtaaacagccatgaattggggcggtgagatctcgagtcacccgagagacaacaatgcatctgttttggtatagctgcgagctgtacggccgcagggcgagacccttgtcggccggcacggattactacagctaggattaactgcagggatgagcttgagcttgcagatttacagcttgcaagcagcaggttttgcatggacccaagctagtactagcaatgcaaaggacagcgaccagattggctgcacctgcacactgcacacacacactgccatgctctctatctctcctgaccaaatctttattctttgggcaccagacgaatcagatctggttcagagatgccctgccccttttaactcttccaccatgcaacttgcctggacgactgaatttttagtcggcaatgttcagtaatcagtcacggcttgcttgcttgcttggccgatttgtttgttgctccagcatgctaggattgcttaagagtttcaggcagagcagcttcatgtgctagtgcagtgtgattaggagctttttgcagattgcagtagatagcatcctcccttggttatccaatcaatggctttttagtggatggaaagagcaaaagattccatgcatggagtagatagcttttgttttgttttgtttagaggagcaaggccacatgtgttgcaaaacattgtggcagaaatatggaaatgaaagggagagtgagagggtccatgttgaataagaccctttggccagaatgttcataggagctttaattaccatgttgataacggatgatgaggccccataaccaagcaatgctgatctccagaatgggtgaagacattttcactgattctgatctgcacaactggattatgttgaattaaatcattcatgtcgacagcttgtggagggcagatctctgaacaaatctagagtaaatgtcttagatcagatttttatgactgagtacacattaatcatctcatcagtcatccagtcaatcttggtggtccaaacaaaatcaattgacaatattgtcaccacagtctagtactactacaaagtatgtggttggtaatagatgaaaggaagtccatggaaatggggccctacaagcttggggtcagccatggattggtactgcctaactaccaaactctaaataagaggatggcagctgcagcctgcaggcaggcatgaaacctgctccacttggactcactccatttacatgtaaccatagttagtactagaaccactctctagctacttgtatagttgtatgttccagcttcctagtaggtggttatggacaaacacccgtgatgatcttagtgtcttatcagaataatcatggtactgatttggtctggtatcaaatttctgttacaaacattgttccttaatattgtcaatattatgcacatagtgttttttttttgctgggccggccaaaggaagaggctgatcaaatatcattaagatttgaaggagaatttgcaaagttacaagcatcgacagggaagcctgtcgaaccagacgccttttgagattttttgtactacagatttaatagaagctgtttttaataatgttgtgagcaactgagagttaaggctgatgtaattgtgttcctttcttcagctgatgcattggtcaacactggtctggcgaaattggggtaccagtatgtgaatataggtatgggcttttatctgatagaaactatgaacagtatttcatatgatacactagagtatggacacaaacattgttgatatattagcaaaagttaattcaattattttgtgatagaacagctagtaactcatgtctgtaatgttttccatctcttctttcagatgattgctgggcagaatatagtagggattcccaggtaaagagacaaaaatattctccataaagcaatgctatccaccgccataattttcagcacaattttaggatacaaatttgagaaccttgtctagtttgttgatgagcctgagaaattttagactggaaacaatcattaacaattacaatacacattaataagaaaacgtatgtactttctatcagtttaatgtgtcataactagaaattttatatgtgaaaaattctgcatggggggagaatgagcaattttaaaagatcaatgctttaaaattgtgtagaccaagctattgctgtcagttttgacaagttgtactgctctttttttcgcttctcagggtaactttgtgccaaataggcagacgttcccctctggtatcaaggcactggcagattatgtgcatgcaaaagggctgaagcttggcatctacagcgatgccgggtatgctagctttcagatttatcataatgacaaactactttgtactcatccagaagtaacttatgtcatcattagcctagatgaactaagaattttatcgaatataaactatcaacaaatctgaaactaatagcaagactgtatttcaggtcacaaacatgcagtaacaaaatgccaggatcacttgatcatgaagagcaagatgtcaagaccttcgcgtcttgggtaaacctcgactcttttacctgtctggttatacccaatcaacattaaacactgaaactattattctggtgttcttaattcttgacctctatgttccagggagttgattatctgaagtatgacaactgcaatgatgctggcaggagtgtcatggaaaggtaaggagacaaaacatctcaaactgtcagctttatgcatcagattgctgatgagcaactgttttcatgtttaatgcagatacactagaatgagcaatgccatgaagacctatggaaagaatatcttcttctcactctgtgaatggtgagtttactctctgtaacatttagggctaggtcgaaggaacatgaagcattgctgattcactccactgtgtttttttttctgtatagggggaaagaaaatcctgctacatgggcaggccgcatgggtaacagctggagaacaactggcgacatcgccgacaactggggcaggttctactcatcctctctttaaccctgtttacatagttcttgagtttttcagtactgatcgtaattgccctgttatttcagtatgacatctcgtgcagacgaaaatgaccaatgggctgcctatgctggacctggtggatggaatggtaagaacttgagatgtatctgttcctaggttgcttaaccatttgagagcttcaaaatgatcaacatatgtttctgctgtgcaatatcagatcctgacatgcttgaagtgggaaatggtgggatgtctgaagctgagtaccggtcacacttcagtatctgggcactagcaaaggtaccatagcatgttctatgtactaataattttgctgcaatgttgaacttctttgcatttcctcactgcaagttttgcttgaattgttcaggctcctcttttgatcggatgcgatgtgcgctcaatgagccagcagacgaagaacatactcagcaactcggaggtgatcgctgtcaaccaaggcaagccttctcagtttcacatgcttagatttagccatacctcttggatatttcaccatactcataatgtaactctctgaacagatagtctaggtgtccaaggaaagaaagtacaatctgacaacggattggaggtatgccttcaatggcttccaaatttgcagtttctcattgtcccataagccttggcatgatcatgactaactctgaagctgacaatactttgtgtaaatttgtcggtaggtttgggccgggccactcagcaacaacaggaaggctgtggtgctctggaacaggcagtcataccaggcaaccatcactgcacattggtcgaacatcgggctcgctggatcggtcgcggtcactgctcgtgatctatgggcggtaaagcctttgctttcttcagagctcaaagtagaacatcttctcttcagaattcagagttcataacaaatttctgtcaattgtgcagcactcttcgttcgcggctcagggacagatatcagcatcggtggcgcctcatgactgcaagatgtatgtcttgacaccaaactagtcagcaaagaaaagcagcacaggttagtacgtgtccggcgaatacagctaaattgatcaggattcaggaagaaggtttgcaatttgcaaggattggtagagctggaaatgggatgccatttggttatgtatgtagaaataagctgtaagcctgtaagcgtatatgtaatcagccgtcaaatgctggcgagtgtatttctgaagtttgcaacgaaagttgcagcaataaaaatacaaaaagaaggctttcctgccactatataagatatgaacatatgaattttttgcatcgcctgaagacctgattatacggctaaacacttgagacacggcaactgcaggatatcaaaatgagacgacatcaccaacggccaacatcctcaagcaacaccgcctcaccaacggccccgtcgagctccagatggaccccatcaccacctccgatgaccacgacgacgacgacgagctcatcatcgataggaggggctggatgaactggaggacgccggagaagagggcgaagaggatgctcgaggaggaacaggaggagctggaggacgaagccagatggaggaataagcttaaggaggaagcttaattaattatgtggcttagtaatttgcaagtttctttgtgatccagctatcctatactccctccatctcaaaaaaaaaaaaacaacctaataagatgggacataatctatatcctatcctattctgactaaattaagtttttttttagacggagagagtatatattatataatatatatgagttatatagatatcgtctcgtccagaaaaatcgtcttttttatagtgtatactagttctgctcatcattatattatactataatgcaatcttgcatcttactcccccgtcccaaaataagtgcacccatggtttttcgcgcccaattttgacaatttgtcttatatgaatttttttttaaaaaaaactaaaaacataagtcataagtaaaatactattcatgttttatcatcttatatcagcaaaaatactaattataaaaaaattttaaataagacgaacggtcaaagttggacgcggaaactcatgcgtacacttattttgggacggaggtagtatcttgctaccggtgatttagaaatatcaagtacaaacagctggatgtacccactctctgctacaagtcttgctatctacttctatctacttcctccgtttagattcattaacatctatataaatatgggcaatgctagaaagtcttataatatgaaacggagagagtattaattttatcgtcttgcgttaacaatttttttgggtgcaaattcagtgctcgctgggtacttaagaatgactgatgttttttttaaaaaaattatttaacccataatgctatggccaactggaattggtatagttcattactcaagacatgtatttgattaaattaattactcttcttccatactgtaccttgtgctgcttgcagatttatatcgaggttcaatcagtgttcttatggtgatgatcgatagagaaacatccggagattttctagctagctacacagggtgatgggctagacgatttgggtttgaagtcttactcttataattatttgatattaggtcattttctaatattcgtgtctttttacggcgatgatcgacaaagtgacgcctagtcattaatttactgtcttattgccacacttttaatttccctcgtgtgtcatactcaacattatgtacatgtgttcatgccataacatatttcatcttctttttttttttgcatggtcctttaagagcacaaggcttcagaagttcgccctctgtggacaaggaagggcaacaccgaaggcaaggagaccttgatcacacaaccgcaccacctatataattcatgtcacaggcagcagatttcaggttggctatcccttttccctttgtttttgcatgatgatatgttagcaaatcaaagtacccgattgatgttcagattctaccacatcacacacattggaaacagaaaaaaaaagtttctcattatgtgcttcatttttacttcatccgtttcatcgtattgtattataagtcgttttgtattttttttctctagtcaaacttggttaagtttgaccaagtttatagaaaaaattagcaatatctaaaatatgaaattagttttattaaatctaacattgaatatattttgataatatgtttgttttgtattgaaaatactactatgtttttttataaactcggtgaaacttttttaaaaaaatcaaaatgacttataatatgaaacggagggagtattatgtttccttctttcttgaactttcgtgttatgaattgaagttggtttgtcaatgtcaggaagagaaaattgaggtttttgttaaaatggtgaaggggtttattgatgttttcttacagggtggcacatgctgaggagccaaagatggcaaccggtaaagaaatttcaggatctttgaggtcagtatggcctttttgcctctatatgtctttctatttaagataccacaactgatgtcaggctatacctggtaaatgaaagtaatgaggtcataagattggtgcataaccttgttgtcagcggctgatcttgatactttttaaagcccgggcaaatacatatgtgaagaattatatacattgttaaacactgaaaatttaaggtattgtaatggtgtgatccgccggtgagcctgggcagctgctcgaggtagacggaccttggatccgccactgcttgttgtccagatgtattgtcataattgctaggtgaagctgaaaaaaccaaaatgttttcttttatagacctgtggtagcctgccctcatgtggtttatgttatctgtaaggtttcatataactggtttctgctctgctatgcataattcttcttttaaatgctccatacttgttagaaaactaaaaatagagacaacgaatcatgaattctcccgtgctgtccctttatatatagggagattacaaaccgtataaagggagattacaaacctagttaattctaggcattagtgtaatatatcaattctcattctaaagataaaaatatggttgattcatttccttgcaattcactgttgatgtgggggagtggattgcaaggaaatgaatctctcattgctatatctttagagagagaagtgatatatcacactagtgccgagaattaacgaggtgtgtaatctccctttatacggtgtgtactctccctatatatagagggacagcgcgggagaattcatgattcgttgtctctattttgagttctctaacgagtatggagcatttaagaga

SEQ ID NO: 66943 - DNA, 6815 bp, Oryza sativa
ttttggagaagagtagatttatgctgttcatatcgatttttgggagatgtccacaaagcacgtgggtcctccttatacatgtactccattttcaaatcctgacggatatgattcctcgttactttcaaggcggagtatttagacacgttagagggggcaacgttcccttcagctgtttcatctatacatctgtatagtccattggtcgacagatttactttgacatctatcgcccaagcagggattttggaaccatcaagagtgaggatatcaaactctttggttgctatctcacctacattgtgatagccaaaatttttgagaaattatggcatatttatgccattttatgtgaatttgtaaaaaataaagtgcgtgtaaaaataaaggacatggaaatgcatagagtgctgaatcaaactcatatttataataacagagagttacggggtgctgaaagcaaatgtatagtctctgattatttgcggaaagtaaattgaccaaagatcaggagctagaatgaaaattctggaaaaataaaaataaatgggcgatgagccgatacaatctcggtttcgacccgccgctgctttcggtccaggaagtcgggaggggaggcgcgggcgcataggggccattagttggcgccaccccatcctcccacttgaactgctgctgccgacagtacaccgttgctgccgatttgtgttgccgccactcgtctctgcagggacatgtccggtcttgatgatgcggtggaggccggggcgcgcgtttgctgccgcggctacagtcgggcggccggggaacgaaggggcctgtggtggagatggaggtgcgagcacggaaccgctggagccacctactgctatgtagaaggaaggggctccgcaacgcgcgacgatggtgcctctaaggaggagcttcggcggttcagcccgtattggagtgtacagcggcgtcgttggtgagtactccggtgaaggtgacggtgatatgatgtggcgagcgtggtttgtccagccgtggtgaggacagtatgacgtcaccatgtctggcacctcctgcggtagcccgtcgggctgtagccgcacccttgccatccatcgatgggacttgcagtggcgcggcgactccaccagaatgtgttatggcgtggtgcaggtgtcaggcatcactggaggcccatagcgagtcgcgagggtgctggagttagggctatcagctctggtggttctgcaggcagttggtccatcgtcgcggcgtttcctccatgtctggcgaagccagagggaggagaccgggggccacggccggcaaagccagcaccacagcccctgtcacgtcgagaacggcgcacaagagcccgaagaagcttgtcgagttgttgatgcatgaggcaacgtagatggcgagcacgaaggttgcgatgaagaggagatccagcgtcaagaggaatgggaaaatggcgagcaatcttaccctttgagttaccggtgagttcttcacctttgttgctcagtatcttagagctgctgacaacgtgttagaaaactaaaagtagaaacagtgattcatgaatttgcccatattctcgttgatcttaaggtctctttataaatagggagattacaaacctagttaattctaggcattagtgtaatacatcaattcttattctaaaggtagcaataaggttgattcatttccttgcaataaggttgattaatggttttaaccatggctattacaatggatttaaaaccatgatggctgcattgactaggtcaaataatgtccttttgtaacaatactgatagtgtttagtggtaggacaagtgagaatattcagatttgagagttaatagaactgtgggccgtgcaaaattagtcgttgagaatttagatgtttctacggttcgcaatggtgcgcaccctatcgggtaacaataagcatgttgtagcagacaaaagaatttatattttcacttgttgacaaaattagaatgaactataggaaaaaaatcattgcttacatggggcattgtactcgatgcagaacaacattaaggagagcgagtgccattgggggcagaagaacatgttgtatgaagactgatttccctgaaaaatactgggaatgacagattggttcttatacatggcatttgggctttttctgtgtttcgacttaattaattagggcttgttcaattttctaccattttcaaacttactaacattgggtaataccaaattttggtagtattagatgcgtttagtttaaaatcttacttttatgttggtagagtttttgagagtggaagtttctggatttttcaaattttggtatggtagcaatggtaaggatgtgtttggtttgttgctctaataaaatttgacgatgataaaatttggtagggttgaaaatagcaataaagaaaagtgagcagggtactcctaatgatgttgtactgttctattactgttctattaactcaatgttggtgattgttgtcatcatttaccttgcatgaacaggttgtacaaactggaccattaattaatattatatatgtagtatcatttagatgcagtaaatattcattcagtatgaactagccactttgtcacgcattgcgtgactttgatggccccctatgatatgtaaaagttctatgatgaatgtctgctagatatatgtgcggaatttcaatttttatatgaagaacttgataaagaattgctatggattttatttcattatataattttttttatttttttgtttaactagaaaaattgcccgtgcgttgcaacgggcgaaggttattttaatcttattattgttatacggtttagttaaggtgaaattcagtatgggaattcgcttgaatatataatttttttagaaaatcatgagctgcagttaggagtatgatcatctcaagttagcatgtgagtttttttaaaaagatttattatacgacttcttttgtatttaaaaaacaaacgaccttaaaaaccaactcaaatacggatatatatttcaaaagcgaataaaattaaaaaccgactcatacacagatggcgtaccaaagtaccgacaaaaacatctttattttcatttttataatagtagagatgtacctctggttagcttgcttccgtcagcggcgcaatgccgaaactctagatcatataggtttcatatgttgactcgaaatcaacctgccatgttaccaaaccaccgctgagaaagagtcgattagtacctgtttttaattattggaggagacgtacattgtatcaggttttacgttttgagaccttattaagagaaaagcaatatgtgagggaggcaaaatagacttactgttagttggacctgtgagtagaggcccagcccatttagctcctcctctcttcctcgcagtgcccgtgcccgccgccctcgcaacaacatctgtgagggtttcgactcggcagcaatggcgagggatgagatccaagccggcatccccaagctcaactcgacaactcccccgagaagaatggatcatccaagaagaagaagaagaagaagaagaagaagaaggcacaagcacaagcacaagcccgacgaggtgaaagaggagatggtggtggacgccttacccaaggaggaagaggaggaggagcgcgggaagaggaggaagaagaagaggaagaagctggtgacggtgaagctgagcgacgagctgatgggatacctgcggaccaaggaggttatggcctacctcgcgcgcgagacgcctcgcccgctcccgatcgatcccagcatcgcgcagcacatgttcgtcggccaagaactcaggcaggaaatcgctgcccaagttcacgagaacagagaattcgacgccttcgtcctctaccagtaccgcaccaagggctacgccgagatccagcaggaggtcaccgatgacgacgacgacgacggctagaatctgtatggtatgtttttgcagggatcgataagggactacctatatatttgtcgacaaattttctagtaaaaatttgacagatgtaattatagtacaatcatagtgtaattacactgtaacttgtatgtaattacactgtaacttgcatgtaactatagtgtaacttgtatgtaagtttcacgtaattttgaatcgttagatctattacaagatttgttctggtgaagaagaaaaaaatcatagcacacacatatgtgaaaggatttgttcccacgatctctattttactgaaataacatgttaccgagagattcttgaaagttacatacaagttacattatagttacagtgtaattacatgcaagttacagtgtaattacactacgattgtactgtaattacatctgacaaatattagggggagaaatttgatgacaaatatctagcaaaatcgtgtcttcatctattcatttgattaatcttcaaacaactcacaagtgtgaatcttctgcggtattgttcttttgttcatgtgccaatgcagtgtgatttggtgcgctctttttttcatattttagtagatagcactctcccttggttatacaatcaagggctttttagtggatggaaagaataaagaattccatgcttttgtacatttgtttagagaaacaatatacatgtgtttgcaaaactgtgagctttatgcatcgtactgctgactaaaagattatcttctcactctgttgagttggtttcacaaccctatcgaaccactttgaaaaaagtctgaaacaacggattgggtttgcaccagccaattcacctgcatctgttgcttaaacagaaataaaataaaataaattctcatgcatcttcatgacgattattggccagagctaatcatagatctttttcagtgatctcagtgacagaaaagatagcagggatttgtatgcccgtggttcgagggaggggtccatatatttattgggccgtaactgaattctgacctacgtgcagcccatattagttcggcctgaaaggacattccgatttattgcagcccattttgttgtcgggctggaacggcggtatcaccctagttgggctggacgtgaggcccaataactgatgcttaccagttgggccgacccgagatggatgaccccgttattgggcctcgtatcgccgccggcccatcccatcgctagtgctcgcggaggccggagcggaggaggagacggacgcggcggcggcgccaccggcgacggcctctccttcgtctcgttctccgctctgcttgacgggaggcggctcctccgcgcgtccccctctccgccgcggtgaccggccgaggggtgctccgccctccgcttctcccaaccccggacggggcgccgccgagccagtgctccccgacggcggcggcggcggcgaggaacccgtccccgacagccgaaactcggatcccaactaggaggagctgcagaaagccggcgtctcctacctccaacggtgggaaatctcaaatctctcaagtctcatctactgatttagttttgttcattctctatttctgctatttctgttgttattagttctcaaatgcctagatggatagattgaagaaattacagactaattgaaaatcatcaaaactttagctactgaatgagatgggtgatgaaatggctcaaccatcacatggtgagccaaagacatgtgcaacagccaacagtgcaagcattgaaaaaaagggaagatattttttcttctaacatgtaagaacccgaaagatgaagcttcctctcactattttaatttctcgttaagatgcgattttgtgattcatttatatccgtaggatcaagatggtgacagtgaagaagaagaaatctttgcctgctctggctcacaatacttattttcgtactgaagcttgttcattattgttaaattgagcaatcatttcctgactctcattcaggcttcgacttgactgcaaaatatggatctttctcctttcaagttggatattgatgagctactagcggattataccgaggtaattttgactatcctgcaatctctctaggtgtgtcacatttatatcagcttgacgttgctgtttttcttattggtaggcaaattgcactgcattcgctgatttcaagagattgtggatggcaaagaaattttcttatatctatgaaggaagacctaagacaaactctggcgctttcatgcagtcgctctttttgcattgtattggtaggctggcttcctggaaatttgcactgacatacccacaaataatctttggagtcatttctgatcaattttcacttttttactattacaggtcatatgacatctcagagttgtatgcctcaaagattggctggactttactgcctttactgtctttacgaatcgcaaccatacaagccacatttcaagatctatttgtctcttggtaatgcacttgctttcggtcactaatttggtgcttctgatatcactagccaaatgcccatgcgttgcaacggattactgaaatagtaaaaattaaatccttgttgaaaaataatgatcttttatttggttgaaacaagatctttcatctttaaaaaagaaatgaaaaatgccatacttaggattgtggttctcaatgtgagacataaacataagtagtttccagtacttgaatataaatcggtgactccaaccattttaactaaatgtcttttttcatatgataatgaaatatatattttgattaaagttcgaaatatgtactcgttaataaatatgcaaagcaatata

SEQ ID NO: 66944 - DNA, 5123 bp, Oryza sativa
gagttaactgcatctcagaataagagagtgaaattcgcatgtgacaagtatgtgttaaactgattctcattagtatttgtgatccattccatttactattgtcctattcaaacaagaacacgtaataaattattgcatgctaatattttgttgttatcctccaggttgtttatgaatactcagatagacagttatatgcacatggatttggtaaggtttagcctgttgacttaaataacttctttttgtttctttcatgcctttttacattataacaaatgacaatacatcaacatgaccacaagcccatactagaaatcctttcatttagtttctcaaaatattacatacccttctgttactgacaaattgatctacgtctagggttcggagcttgaacttgataagatcaagaaatcatcgttggattatgccaaagccaaggaattggcatttgcaggtgctcttagttgtttccattgcattatatagctttcagtttctgtgtgtactcactgagaactttattatcagtaacgatgattttgatcctcctcctactggttttatcctttttctgcttcacagaggcaagcaatattatcgatgttgaagatgctaggcacattgttcagaatgacaaactgctgggcgacagggtagatgaaatcgtcaaagaatgggatgcacagaaggaggccttctacgagaagacgggagtacgtcgcgatgaactagcagtagttgaacatgacgaatcaggagtactccctcatgaaaacgatgaattcgatgagattagacagctgctgctagagtgaaagtagtgtacaacagcatcctcctaaaaaaacagatgaaatcattcattggcttactggagtctctcagtttttttttccttttgtcactcatatgctctttttgagtgttttactgccctgctgtacgttgcaaacaaaaacaacttgtacatagtagtgatatgttggatgaatgttactattaccatattgcgtagttgtacattgcaagattcatttataagacatggatttcataaaaattttgcagaaatctcaacagaaagagtttgaattcccgtgttccaaatgagcctgtgatatgtttgatatttttttctccattatttgtgcagcaagttgatatcactcgatgttctgattggttcctgaacttatcagctcgaaccaaaatttatattttaaatattaattttagagttgatttcgatttttaacatagtttattttcaagcaaatgacttggaagttggaacaaatatataaacattttactttcaattttttttctagtaaccgttgtgggttttgattagctcgaggtgattttttttggactgtcagtctcccagagtccagaagaggatagtggaaaaaaatgtgtgaaagagagacacgtggcgcgcgcaaaagatccacgtccctcgactcgcccgcacccccgccactccccctctcccctctcgccgccgtctctcgccgccgccgcggcgctcgtcgaacacctaccgcccgccgcccgcctcgtcgccggtgcggagcgcaccggcgagcgagatgtggcccgccgcagccgcgtccctccacgtgctcgtcctcccgccactccctcctcccggttgcaggacgcgccgagccgcccctgtcctcgcgcgccgcggccgtggcgtgcgacatgccgcgcgccgcgacacgccgcctaacccggtggacgcggtcgactgcgtcggcacgggcgccgacgtcgagtgctacgtcgacgaccgcccaggcgcggaagtggggcccatccgccgcgaggcgacgccgccgccctccccgcaggacgcggtcgactgcgtcggcacgggcacggacgtcgagtgcttcgtcgacggcccaggcgcaggcgcaggcgtaggcgcggagcccctcctcgcgcgggtctccgaggaggaggaggatggcgtctcggcctcggcggcggcgctcgtggggagggagtggtgggagtgggcgtcgctggtgtcgcccttcttcttctggggcacggccatggtggcgatgaagggggtcatacccaagacgggccccttcttcgtcgccgcgctccgcctcctccccgccggcgcgctgctcgtcgccttcgccgccgcgcgcggcaggaggcagccctccggctgggccgcctgggtcgccgtcgccgccttcggcctcgtcgacgccgcctgcttccaggtgctcccccccgccatagctgcaaggtgttcgcttcttagctctagcgtgtggctgtgctgttcctgagctaaaagcattcgtctcatctcgcagggatttctcgcggagggattgcagaagacatcggctgggctcggaagcgtaagctgaattctcactgctgttcttcacctcctcatacctcgagcaagccattgatactgcccccattttttgtcaattgaactgatggccatgttttcaactgaaatctccattgcaggttatcattgattctcagccattaacggtagctgtccttgcagcgctgctctttggagaatcgattggcgcgataggagttggagggctcgtgctgggtgtcgtcgggcttttgcttctcgaggtttgcctttgtatgcagcatacatgatatcagtattgaacctaggcagataatgttgattacggtaacaggttgtgttaatataatattttctcgacggccattgcatagttatagcatttcgaaggcataagttccttgtagaaatatttgaaccaaacccacttatttgatttgtcttaattcccatagcaattcttacaggttacaacaattgccttctgaattattctattactgatatgtggcaactaattattcagtacatacatgctgtgttatccataaaatggtgtaagtggcgatcttagcttttccaagttatgctgtattttatcgaaatcaaacatgtgctgtgtgaatttaatgccttcttgtattgtgtgcttactcattgattgtgtatatctgtgctaggttccagcactatcagttgaagggaatgacacagcgatctggggaagtggggaatggtggatgttcctctcggcccaaagcatggctgtcggaactatcatggtccgttgggtgtcaaagtattctgatccaatcatggcaacaggatgggtatgttattgcagatgaataaatagttttttttttagtataagaacaaagtgatgcatgctctagagcacaattgatattctttagttttcttgctacaaatgtacctttttaccatgatatgttttgtgcaaatgattctgtatgcatcttggaagtgctaatttggtcatttttattatgaggaactcaatgtgtatacctatgcttttctgcattgtggatcttaatgcatatttctgataaattgtgagaggaatcatgtattggaaatgcattcatagtgcaagtctgcaacatcaactggaatatgaatgctcagatcaacctataactttcaactctgtaatggttctatcagattatgtatgttgatgtgattacagctgattgtcattccccctgttctttggatagttttgtttgtttttgcaattctgaaaagcctggcattacaccatgtaaaatgctaatattcacataattacagcacatgataattggtggccttcctttgttggttatatctgttctcaatcatgatcctgcgctgaatgggcatcttcaagaacttacactgaatgatgtattagcacttctctatacatctatatttggcagtgctatcagctatggtgtgtacttctacaatgctacaagaggtaagatcacttcccactcatgtttagcatttactggtattgtccacaaatatattcttttaggattcccatatgattatgttctttgcaggtagcttgaccacacttagttctctcactttcttaactcctatgtttgcttccatttttgggtaagattctttccccaacatgtcaagctaaacatacatgacaattgacaaacatgtagcacttgttttctaattgctcttctgcctcacctttccttctcaggttcctctatctgggagagaccttctcgcctgtacagcttggtggcgcgcttctaacattggtcgccatctatatggttaactacaaaagcatcgtaggcgagaagtaaaaggccgttgcaagattcttctggagacactggcacagatgaatgctgtactgaagcacctgtaacatttcattggcgcaaaacagcaatgtgaagatttaaagtacatcccacggtcccaacatctcacacagcttgaactgtgaaagaagacagggatatggtggtataacctctgaacatagttagactggtaatttgggcatcagtgcatacttccgaggttcccaagttagtcatctacttcatttcggcttgcattctgaaatggataaaacttgagtgtcatcagatggttaaaacatagttgctatgaactgtgttgtggatatcaaattgagggaagttgcccctttgtacaagtagtttggagcataaaaaaatagttgatcgaaaggaagcagctgtatatgttgagcacaagcttcgtctatcgatctaagttcagacactttccctgataaatacgaagcatgtcccttttgtgagaaaaaagggaactgtgaaactgtagttgatggtgcatgtatatatacgtgtatatgttttccaactgtgatatattttacaattattttatattttaattttttttaaaataaacattttatattttgcattttgagaactagtaatattgtcgtttgaaacatagttttccaaataccaaaacggctaaaagcagtaccaccaccaaatcgagattatcaaaatctactgcaattccaaattcatcaactttaactacaaggcaggtaaaatacagtatgaatccaattccaaccacgacatatattggatatcaaaatagttccaaaactttctgtacacggtcggtttacatcttcagccaagaaaaacacaaaacctataagtcctga

SEQ ID NO: 66945 - DNA, 10086 bp, Oryza sativa
tgttcagatcacatggggtgagtgatgaagtagttgtagtcatggtgctggactccgagctgcttgagccaggaatccgcggcgccgaagagggagaccatcctgtcacggtcccctgttctcgggttggtccagagagaaccctgcagcttgtgcgccgcgagcccgaacggagcaagatgagtcttgctgaccttcttctccgtctcgtcgtttcgcttcccgttggccatgctctcgagcgcgtaatctgtggatgaggcggaaaatacaggtcagcacggttcaaaattagtgccaagaacatcattaccgcaacgcgttgcagttcaaaaacagaactaaggtgatcatcggtgaagtttaataaaggaaaacagtgcataatatttttcttcttaatatgcatatcactatcaagcacactgggatggctcagtttagactcaagtaccattacccactgattttttatatatttgaaatggacagctggggtgcctaagtgctgttgcactcattgcaatccaagcaaccttgcaccaatattttatataagtatacaaagagctcctaccactgtggtagaacatagatatttctagtttttaagaaacagctgcatgcctaagactaagcactaaaagtcatggcatgtggcaagacagtctccttcctccgctttatcgggcaaccaaacttctgccacttatcctcttttttaagtgacatccttatatatgcacttaaaagctaaggcatgagaccttttgaagctgaagttggaagcttggatgcaaaatagaaagctgtacaatcccttgaagaaaacttacaaactcttgcaagctaagcctgtgttttaagctaacatagcatgctaatgtgcagtaaaaaacatatcttgacattaacacaaaataataagagtaaatatattttctaaatttagcatctaaaatgaagaggataaaagcatcaatgtgcttggtctgaactctgaactgtaaagaccaatcaatcgatcagtcgcaagcaaggcgactgttttctagctacataagtccacagtctgaacactaaagaccactcatctgaccagtctcaagcaaagcaactattttctatatatatagttcattttctgaacattaaagaccacttgatcaaacagtcccaagcaacactactgcgaaagctacactgctacagttttgagtgtcttagtcctgggatagcatgttgccatttaagcatagtttaaacatatactgatcctgaggtttttttccccacaggaactgattattcttgtgtaatgtatatcatcatgagatgtaacaaagaaaaaacatatagtaagctataatatttttgaattgatatgcctgcctatggcaacactgtaagcacacaaaggggcaatatcatatccattattttcatccagtaatagaatagtaccctagaatatatatatttttcgactctatcacaagattcaatcaaactagtacttgttaatgtccctaatgcaacaaatagcataccttgaaatgaagaggaaatggtatgataagttaggaagcatgcagataagtccttcacattgcgctggtagggaatatggtagatgggatacctaaatatagcaatataagttaatgataatgtttagcgtaattgtctctgggaacagaattaacaaccaataatggattcaagctcctggagacatcagctactatttagaaacaaaagaattataaagtgccaaaattaacagaaatgcttcaatcaactaccaaaccaagcaacaaggcgattagaacaaccatgaatgcagaaacaccagatttactatagctgtttataagccagattttatgctaattgccaaaaaaacagcattaatagaggtaagcttgatcaataccaggcaactgacatccaactagcaggcgaaaggtcaacacttctcagggatgtcaacccaggatagctctgggatagttcatacacctgtagaaaaacgatataagcataggaaaaagaaacagctggtctaaactactatcacataggacataaaaatttaccttgtcaatgagtggaatccttccataaggagagcaaacctcgaagaactcaaaatacatgtgcccgtggcgttttctattgccacttattgcatcacagttaaataatgagtcttcagatgttgaactccaagatcttgacatcttctcattgtcctcatcatcgctccaatagtccatgccattatcttcaccaaaactcctacagaaaaaaaaaacagagagagaaccgattcacaatgcatccagaaatcggcacagactcaaaattcacgcacaagaacggatcttttgtgcagacctggatgcagtctgggctttgttggtatatagctgtatccctgacaagtagggaacatagtattggactactctttcccctccatacagctgcaccgtagttccagccccgtacgcgctccactcatagtactgctcccataggtccgcgaggttgaagtactcgacgctgtccatctcggcgtggtgccaagaatcgctcgaaaaccggccattcgcctggatcaaaacgagcaacatctcactttcagtcttaagttgacaaaataagcacagctagtggtagcccagcttagctaacccagatcgaaaaggcactcatatacagcagctgatcaacatgcggaaatagaattgacaatagcaaccgggaatttaagatggcaaccgtatatcgccacaggccgcagctactttcgtcccaattaggcagcacggcagcaagcacagagcttgatggtacaattgtccttataatcgtaccaaggaaaagctatatacaagcatggacgcactatcaattaatcaatcaatctaccattacccacaccccccatccttttcacggatgcattttgcaatcaggaaacacgcagcagcatgatcaatctctgacagaaaaaaaaataaaaagaaataaacagagagcagtaactagaataatcgagtaatgggcaacagatcatgtcagccacatccacaccaaaaatctcgcaaagaacacgaagctttaatcaatcgatcaatgagagagagagagaggaggaggaggagggggtgaccttggggaggaggtgcgtgtcgacggcgggggtggtgcagtccaagaagcactgcaggttggacgacggcgacgacgaacgcccgtactcctccacccacctcccgcccgcgcccatggcggcctcctcctcctcaccactcacactcaccgccaccgccgccgctccaaacgccaacgcaaccaacaaacacacgaagaaaccgaaatccgcccgagagagagagacaaagaacccaccgcccctttgctgctgctgctgccaagattggagaggaggaggaggagggggaaggggaggagactttatgcggactgatgcgaggaggaagaggaggaggagagagaaactgggcttcggtttgctttggcttctgtgtttctctctctaggtgaggtgaggtgaggtgaggttagttttctctctctaggcgtcgggggaggggttgccttgtcgggcgcagcaacaacgcaatctcatccccacgtcacgcacccacgggggaggaaggagggaatgggggagaagagaaagctacgggtactgacccggtagcccgataaggcattgttcgcctgttcagttaatccctctggtaatggactgataatttgatttttaatctcaatatcttgtttggtagaggggatggaaattgatagggagtttagttagagattagatcattaataaaaacggatggttgagatttgattagacaaagtaaaggaggaattccctcccaattacctgcccctacccaggtattgaaaaagagggagttccttccttaattcctcatcccatcccactaaaattctcatatcttctaaccaaacaaaacacttaatagcatcatccctctaaactcccaatcccttctaaaaactccctccaaccaaacgggctgtaagaggatttgaaaggaatgtatttcatgtctattgtagtatgtactccctccctttcaggttataagccgttttgactttaagtttgaccaagtttgtaggaaaaaatagtagcatttttaaccaagacaaatttattatgaaaatatgttcaattattgatttgatgaaactaatttagtataataaatattactgtaaatttagttaaacttgaaacagtttgactataacctaaaacggagggagtaattattttttaaaaaacatctctattttttttcctactcggaattaatcgaataaggcctacgggagtagatcgcctgactcaccaaactaagatggtgttggtatgaaaattggaatgtgagtttgattttgtttttttttcctttagatttgttttgtagtttcttcattcatgaaattattctttgtatctgtgtaatcttcttcttaaatgaatgtatttttttcttcacttgttattgtttcaacattatattaggctgaaaacatatggttactactcgtatttacggttatttattctttcgatgctatatgatgtgcctacgatggtgagacatgtatgactttatatttactttatcaatctcaatatattttcttcaagatataggatagggcgtgcgtgcacgttttaagggtaactgctcgcacgtgcatacgtgtttatattgtttttaaaaagataaaacaaaagggacgcgccataggataccaacgtgcacacaagaaagactacttacgaaaaaactagttacttggttacactaactaacgaatttagagtgccacataataaaaacataattttacacataatctatgtgagctaaacactctgttctactcatattttttttacatgtaaagttctttttttccctaaaagataaagggggcagacattctctcactacactcctacaaactcaccaaacccgttaacccgcaaaaacagaattggatcagttaaatattgctttccatcttttggaagcctttgactctttttttccaccttgtcatgcagccgggcccactctcctgtatatccaaagccaagccacgaaagtgtaaagccacagcaatttttcttttctatgagccctttaaataaaaaggcaaaaatattttttgtggatccgatagcccggtagatggtgcacgccctcccatcatacgtttttatgcaaaaatctttgtcctgttttgtgagtcacactggccttcactttgtgccttccatgctcttggccctactgtgccacaccctctagcatgcaaccaatttaagccccatctggccattgcaaagttgcttggcttttcttgcaactaattttgtagccttttttttttgctattatatgttgcttcttatcttatcctttctctttttgatgtacatttcgtagggttatttcggttacactttatccttttgctttattggtcatactttggtgttatgtattgggtagaagttttctatcttttttttagttttcttcatggatgtgttttaaggtttagtaatgggcttcaggatccatgtgaaaaaaaaagtgaagcttgtggattagaattcgagacaatatcaatttgactgcttttacataaatattttgcatgggtacaatgtaattaatttatatgatactttgaagatatggatcttaattaaattgattgaacatctattttttgtggatctttcagatatagtttgttaataagtgattctcattcgcatatggctttatctaattattttgtcttgcaatcataaacagtgaacatatccagcttcttctatttcgggttataaagatcatgctccattcagacatgagtggtctctcctaaattcaaatactatagcgaattcaaatatggcacaaataggatacaagcataaccgtgcgaatttagacaatgttttgcttttatagatgacaatgagaagatgtggattttaattaaaacaataggacatccatttttgtgcatctttaagatagtaatttgttaataaccgattattccatttaaccatttcattgcgtgttcatgagcatctatttttattttatgaaatctgtacatcattctagcatgagttggctttcttaaatccaagtacttcagcaaaatcaggcacaaactagatacaaccgtaaccatgtgacatgagttggtcgatgtaagttgccacctaaccatggtccacataattagcttaaacatataaattttattactcttcatttaaagatccaaaactattagctgtctcaaccataattctgatagaattttttttaattaaataatttaaatataaaacatacatgagtccctcaattagttggcagtacactggccctattctaagcttacctagctggaacttgaatcttgtccaaaagaaagcacaagaaagtattgtcttgtgggtagaattggaattcttttttctgtggaagtcaagtggaacctggcccacccattaatttgatcattccaactatgagagatgatgtgatattggacaagggtatcttcattggggaacacttgtttcattttctttgagaaaggcatttgatcctgaattcctcctagcctacatttgcaaagtgtagcagagatgctgccatccacaataaatatagtggtggtagtgtattgtagcatctttgtttgcatgctctgcgtatttggttattgttttccgccgtgtttagttccaaagtttttcttcaaacttctaactttttcatcacatcaaaatttttctacacacacaaactttcaccttttccatcacattgttccgatttcaaccaaactttcaattttggtgtgaactaaacacagccttcatctcactgcctattttgtgtgtgcctttctggcattccttttctgtgagagcttgcttggagaatgatttaaatagtgtctgccattagtccaatatatagaacaataatccaatcaccaatgtgatgtgtgtacttagggttacacatataagccactaaagcagcatcttgataatactagctagtttctagttttgtagctgcatatatagcacgatggtgcaataaatatagtgcatatccatttttattatgatggaaagatataaaccataagggcatgtttggttcgacgtatcagcttgtcgtgggtcacgcagtccaatgacgtcctagacgaggcaatccaccaaaatcacatcatatgaagtgatggaaaaaaaaattgcgaggttttagcacgaacaacagacgatacaaacccatgacacaaatcaaacatgattgttaggggatcgaatgaacctagcatagaccggtttcatcaaaccagacaacatctaaatttctttcttgtaaaacatgcaagacatggataaccgtagttctcttttgtcaaataccgatgcctacaattgattatttgtatgggcttcattttcatattaattttataagcttcatggatttatttatgacatccctctattcgtcatatgttaaaagagtgtgttactgggtgtggtgtcactactgaagaactgatctttactcggatgcaaaaaaaaaatacatttatcctggttcgaataggaaccagaactaaagatcatttctagccacggttcaatagttgtcaagccccaacgatctttagtcctaattggtgttaccaatccagactaaatatactttcacggtcagatgtgtgcagtaggtgggatgataatgcatgtgagggccgaggtgagagatcttgagtccgaatcccacatcccacatatttttttacttggtatgcatctttagtcccgattatttcaaccggaaaatccctttctccagtaatgtgtgtgtgttaggtacatgtgcataggtgtgtagtgtaggtcttcctcataaccgaacaaactaacagttcgcaataatcggtttcatccaacggttaattactcaattttccaacatatccttacatttctatttcagttatgtacaaattaactcatgcaaatctgtggaatttgcattttttttccattgcaatcccctcccaattcagtttcaaatctgtggaattcacattgtgcctaactctgcttctagaactcttgctaagctcgagcttagctaccatccaattccaattactgtccagcatccacaacaattgacctgtcgtttgaatcatcttcgaattccgtgccacttgacagcgagcatccgatgctaagctagcttaaagataaattctactactactcctcgataaaaagaattagcttacacggctaatgcacctctggttaggcagctgattaagctaagctctgagagtgacatgttttacagtgacgtggcactgagtgatccccatcctaatccggattatgcgaagaatagaccatggccgccccccgtgatcctgtccatgtcatcacagctatgcactgacagtggatcactaattatttgcttttttaaaaaaaaattgtggggattggtttagtttaattttccgccattccacaggggttggtggaatatttaaaaaggatacttgtttgtgggaaatccgtatgaagtcgacttggatatatgtttggtacatagctttagatccaagatttttttagagctatgttatttaactcatgaaatatatggatctagatatatgattatattgatagcatttcaatgaaatattttgttcatattttataaaaacacagaattttaaactaatagtataatttaattttctagtaagaatataaaatatgtagagttgtgccaaataggtttgggccaggcgattttggttgagagagtgcgcgctttgtaattttagtggatttggattgtttccatgtagtaaggttgtggtttttaatgattgtgtgttttcttttcgtgtgtgaaatggttggtgtcttttttaaaaagtggcgaaaatttctagcgtacatacgaagagatgatgggattacaagaggaggggcaatggagaggccgaaagtgaccacactaagaaatctgagaagaaatgactaatgagactgatggctttagtcatttcattaatgaaacgtaggtgataattattgatatcttggcacgcaattgactgcccctcatcttggtaactactgtctccgtcccaaaataagtgcagctgtggatatccgtgcccaacatttgaccgtccgtcttatttaaaaattttgtaaaaaaattgaaaatatttagtcacacataaagtactattcatgttttatcatctaatagcaataaaaatactaatcataaaaaattttcaaataagacgaacgatcaaacgttgaacgtgaatagtgcaaaactgcacttattttgggacggagggagtagtccatttcttcacaatatcaattgttagagtttagttcatgagaatatgaagtataatctttttaattagatctaggtagtcgtctaaaattttaattattcctccttgtttgtgctctggtttgatctcatattgctaaatcttgcatcatatacgactaacatgaactgtcacttacacacaattaataacataggaattaaatcgattgttagcaatggacaagtaaggctgaaagtaacgtaacataaccatttgacacactccacgactcccatatataacaggacatctcttcccttttcatcgtcgtgttttctcgtaactacattaaatagaggataagaattatcgttgttgtacactgtgccaatattcaaaacgtacccaatggtcgaaagctccgaactccaaaacaaatataggaatcttagtcttaaaagaaaaacataaagatgcatggtgctgaagttataagtacatagctttcacccactaagaattaaaatcaaatcctag

SEQ ID NO: 66946 - DNA, 1433 bp, Oryza sativa
aattcctgcagccccaaatattacacatatacgagtatattttcaacaaaaattcaacaaagtcaatggtaaattgttgccttcgcccctttgagagtgcattaataacacatgtattcatgggatataagcgtaatgtgtttgtgtaccgatgtataaatctacgtgtgcgcgtctttcgtgtaataaaagaatacgacatcgcatgtttggaaccgcaactcgatgccgtgagagcatgcttcgatcggtgttaatattacaacgtcttcagacacgcgtagcacggctgcacattcgagccatatgtatcaccagtttagccatgcatccggccggcatccgaggccaatggaagcagaggaggaattgaagaaagggacagtgggcagtgtgcatcgctacttccctagctttagcatgctatgaattgtgatgtgtgtggccatcgttatcgttatcaggatctaattagctagctattccctctgtctcgtattataagggcacctgtagtcctggttcgattagtattgtcgagcaaaattttgattcgtcggcggcaatgtgtgacatcgatcgtgggacccacgtataaaaagaatctctaatcacatgcgtccatccctctcttatgcagccaaccaacggctacagatcatcttttcatcgctgagttcgactcttcttctttggtcgattttttgctctgaaacatctaaatcaagtcactgtgtagtgtgttgtattcaattttttcaaacatggttcggttttacttatacacgggagatgctctaagtcgttttgatttttttcctagtcaaatttctttaattttgaccaaatttatagaaaaataaagtagtattttcaacaccaaataaacatattatcaaaatatatttaatgttagatttaagtttaactaggaaaaaatcaaacgacttataatatgaaacggagggagtagcacacaagatgacttcactggactatttgaaacagattatttgtgtcacgctccaaacaatatatattttttacaaactttttcttagtaaattatttagacaactttttatgctatttattaagtttattttcaaaataattaatttatccataagtcaaatacataacctacgtacaacaacagtgcactcaataatttgtttcaaagctatttgttagatgaggcaggaacgaaggttaggttggtgtcatgtgtggattcggttagtgatgactgatgagagggatagtatttagtgccatgtcattagctttgccaactttgcacgtccctcggggacatggcaaggcacagtagaagtgtgatttctgtggatgcatggatttcaaggggttgcataaattttcttgtgtatttagtttttttttcctctcgtgggaagacgggctgcaggaat

SEQ ID NO: 66947 - DNA, 2024 bp, Oryza sativa
tttgcgcaaagcaagttttgtaattcttttcacaagcctaagacctagcattgactgatcaaattttagtaccagagtttgtatttacacaacgacggttctgtccaccatccattgtgatcccaaggatagcttcccgccattgattcgtcatggttttctgaggacgtccaccttcccgcctctcaggaagtggctccaacagcataagattcatcatgcaatatcccctcccacacaagttaagaatttagagtctagccaagtgtaatacatgtcccggtgctcaataaccgcgagcacggctattcgaatagatttggtttactcaaactgcagtggatgtacactttacccgcactccgcgactgcccaacacatgagcctcgtcccaacacatgagacgcgtcacggcaaagctttttgataacctcgcattggcagtacccgctccatgaacttttcatcctcatgcactctaggcgtacacggtttctagcagtgagaggagttctggcgcacccgggaagggaagactcacacatgcattaagttataattatgttttagattctcacatggtagtcctaccgatggcgacaccactgtagacacccgcctcgcggtcctaccaatggctgccccaccgtagagcccctgcctcacacatcaagaaaccactatgcatggatactgcctccgctcagctatctactccgctaggtctatacccatacgagaagtgcggttgtacgggggtcgtttcatgcttaacttcatggctcggtccttaattgaccagggacggcactagccttttccggacaccacccaagtcctccagccaccccagtcgaaaacagttgttttactttattttcctttcacaaattatgtcatcaatatcatggcaatgtggcgcttatgtcttcacatgtcgcatctcaattaccttcccaaaggtaattgcccaagcatataacatttgataaatatgagtatgcatgaatctaaaatagcatttctaagcaagtgtcatagttgactagggactcgtacgtatctatggttacaaagatttaaaggtgaacaataatcaaggcatggtataatcacaagtaggatgttcatgattgcatgcaattttatttgtaaacaaaacaatttcgcaattgggatcaacatgttcaaagaatagcgatgacttgccttgctcaaagtcttgcgggtcttggccttcacttggatccgcaactccctcgggctctatagttacgtgcaaaaattgatttgaatttggttagaattcaaataaaaatccaaataaatccaaatgaaagtcgaacgcgaaagttgattctttttattaactttactatctgcgaactacggcaaacccaatttcgatttaaactattttgcgggtataattatttcgttgtcaataatttagtctccccgagcattgtatataataggttagaaatttctaccacgagctaaatattggacgaaatcctagaaatattatacaatttaatttagtctatgactaaacgattaaatataatatacgtctaaaattcctagcgattaaatccgaatttttaccgtgaatcgattacttatagggattacccaaaaataatctataataatctataagaattcatttatttgtttagttattaattacatctaaattactaccgcgaattgatttcttatagaaattaccaagaataatccataatttatattaaattttgcaattctacgactataattaatctataattaaattctaattattttaaattttctaaacttccccaaactccctctaatttcctatttatttccttttcctttttctccctttcctttttcttttcttttctcttttcccttttctttttctcttttttctctcttttccttttcttttctttctctcctctctttctttttccctttcttctctccctcccggctcctttctctcttcctcggcttctccctcc

SEQ ID NO: 66948 - DNA, 2446 bp, Oryza sativa
  unsure (1)..(2446): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaagtcggtcgccggcgtcgacctgccagtgcagccgctgcacacgctcatctgctactggaaggcccgccccggccgcgagcatgagctcacgccggagtccggcttcccgacgttcgccagctacggtgacacctgcatctactccacgccgtccatggagttcccaggcctgatcaaggtgtgcgcgcacggcggtgcgccgtgcgacccggataggcgggactggtgcgctggcggcgacgccctggcggacccggtggcgcggtggatcgacgagctcatgcccggccacgtcgacaccgccggtgggccggtcatccggcagtcgtgcatgtactccatgacccctgatgaggatttcatcatcgacttcgttggtggggagtttggaaaggatgtggttgtcggcgccgggttctccggccatggcttcaagatgggacctgcagtcgggaggatcctcgccgagatggccatggacggcgaggccaagacggcggcggaggccggagtggagcttgggtatttcaggattggacgtttcgagggtaacccggagggaaatcgtgctgaaaataaggtgaaaatttgagtcctcgcgtaggcatggccacctgtaagagctagatctgtaaggtgatgtcggtgtgcgattgtgagatgtttgctagtactgtaatatgtcaaacattgcatttctgaacttatactccctccgtttcgaaatgtttgacaccattgactttttagcacatgttttaccgttcgttttattcaaaaacttttgtaaaatatataaaattatatacctacataaaaatatatttaacaatgaatcaaatgataggaaaagaattaataattacttaaattttttgaataagacgaacgatcaaacatatttaaaaaagtcaacggcgtcaaacatttcgaaacggagggagtatatgtgtgcgcttcagaattatatgtttgcttcggaatcttggacttcggtagattggaatgattctcattacgatttttgctgcgctattcctattccagagtcatcatcttcatgttagatgtgcatgttaattgaaagaaactagtgtgttggtcattgtcaggaatatcactggttatccagttatgtcaggaatatacagtaccacaaaactccacatccgtacaaccttataagtaccggttcacttagacatgcttattacgctaatccagaccgcaccattcacaaaactcaaaagtgtgggacctcgctagcattgttggtcagatctccaaatagagatatgaaagaaccatctaaagaacatgatatcttacacgtcatcaattatgttatagaagtaccctatatgatcttagggtctgcgggtagaactccaactcctaaatttagctttagaagttttgtctggagtggagttgtagataattaaacataaacccagctctgcctctgtgatttattttgtaagaacactccacccagtttcactcctgttttaggtggagctgaaactgtttggctggagctgtgtcaaacaagcacttaaagtctataacttcgcttctattttaagtgtagctgaaactgtttggctagagctataactgtattaaacagacacttaaagtttataacgattttatgaccttcatgaacaaaagatagtagaatcagaattacatggaaacattatagttacctaaatagttggcggagacagaaactaccacagaagcatggggtcggctagtcaatcagggaataaacacctaaggatccaacaggactaaatggcatgtttggcctattgaggtatcatattataagctattgtgttaatgtgttattgaaattatgccaacaagttggatatgagctagcttataggaaatggatacttaagcttctaggccccataaatcaatacctgctttgttgcttcagtttttctttggaggtagagataaatttgaagagcaagaataatctgaagatgagaagtgttagcttttttggccttatgtaccctatgaatgctctttacaagttcaagaacaggagtatacagctaatcaagtattatagtttaggtttaggtttattggtttagacttttaagtcagcttattgactt

SEQ ID NO: 66949 - DNA, 2088 bp, Oryza sativa
aattgacacacgaactaaacacggccttagtcactggatacaaaaattgagctgatctgacgtctcaagtcaatttgtcaaaatgaatttccttttcaactagctacaatttttatgatacttcttatctgcctttcacagggttgggctaaacatccaaatgtgtcgttcatgaaattttaatctaatgaaaaatatgagatagatagttgctctatctcggggttgtcgatctgctggtgaaaaataaaagaggtaaagtttgctcctcgggtagtatgttgtttattctctctctttttaccctggaactattatttgattgtttctgttcacacttttgggcaagaatagcacatgggtgatgggtctatcctgcttgtactgccgctgtagtatatagcaacacatcaatggcaccaggtacacaacattgtaatattctgctggatctatcttaacttccctgttggatggcatcaatggcatgtttggctgtatcaatggcaactgggctctgatctatcttaacttccctattgaatcacatgttaccttgatctggtcaatccaccaaaacaatgcccgccgcgttgggaggtgcgtgcactagacgagtatggtatttactcctataaagtaagacatgcaagaagccacatcagcaataattttaagccattagatcatattagtacaaagataacaaccgtttgatcaagaagctacttaattattcatccaattcaatcgttgttttatttagtatttttgttgcaatagaaaataagatattgccaaaaaccattacgcttgcaaaaaaacatgttctatcatcacaattttaatttttttttggcattttgcatagtacatggctgtggtatgttacttttcactattttctgttaccacgatcaacaaattcgttgcaatgaaaaaaatgtcatcttataatttaacttaattttttcatatggacatggattgggacaaaatttatatgaaagttatagctctcgataagatcaacaattttataggtgataactttttcatttgaaatcttttagatatttaaatccgtgatttaaatctcagttagatatgctcaaatgaaacgatacacttttctaacagaattgatgagtaggtgagttggtaaatgagagcacacctaaaggataggtcttgtgttcgaatctagcgaagacaaggtatcaaataataaatagttaggatgtagaacaaaattagttattaatatttaaacttttaatttggtatgtaaaactaatgtcacatatggagtggtggcaataattatttattgcaatgatgtgaagtgttgcaatatgattttttgccacatccattctatggcaacatcaaaatttattaccaccgaataaaaaatgttgaaataacctattaccacgctatttattatcacggctagcaatgattttaaaattgtggcaatatgtatctatcgtcacaattttagtattgatgccatgatttttttcgtgatgacaaattatttttctagcagtacaccacagggacgtacccagagggtagtccaggtaggcccagaattgccctaggatttggcccagaaaggagcatgtatttttttttcatggcccataaacaaatcctggcccaacaaaaaaaaactctaactttcctactagcctcctcccggcctcccagttagggatggcaacggggcgcggcggggccgggttggacaggaacggccccgtcctcgacccctgactttatcccccggccccggcccctactggtccccgacccagaccggggccctgcaaagctgtagagaaagagggcaaaccaggactgtagcagccaagacgcggtggctcatcgaggaggccagcgtcgcggagatttggcggaggtgcagaagccggcgacgcgcgatgaaaacaaaggcgaagcagccggcgacgtgcgacgaaggcacaacagccggcgacacgcggcaaagttgcagcagccggagacgcagcgaaagtgcagcggccggcgacccgcggcctagacggaagcgcagca

SEQ ID NO: 66950 - DNA, 5843 bp, Oryza sativa
tgcacgcgccgtcgctccgacgcccgatgcagccgccaccgctcccgcatcccgtgaggccgcgacggcgcgacggcgctctgcccctcgtgccggtggcaggcctgcccccttcccgagtcccgacagcgccgccacggctctcttcccctcacaccagcggccggcctgcccgccttcccgagtcccgactcacgccgttgcggttgcaccgcctccggcctccccgacgcgcgtcggcgcgcgcgtcccgccccggcggccggcggccgccgcccggccggcatcccgcatctggcggccctccccctccggtgagcattgcgccactgcttctccggctgtccggctctcctctccctcagtccctctgctctcccccttccaatagtcagcaggtagtactacctccgtcaataagttctttatatccatgattccccaattggagatatagtaatttgtatagattaccacaaaattgtgcgccacaatgaacctcatatgacatttttgcatggtgtgatggttgtcaggagattgaggaatgaagaagtcaagcattgtatttctttttcagaagcatgaagaaaaaaagttgcatcttgtgatctaccaatcccacctgtggatgaagggtcatctgttcctgctgtagatgatgctccaattctagttgatgaaggggcatgtgaagaacaagaaccacctacacctacagatcttgttgatgaaggggcaatttacattgtcatttaggtaagttttaaacttttttgttattatccacttgtattgaaccatttagagttatatacttgtatcatttactaggttttatatcgaatcatgatgtattgcatttagatttttttcgctaggcctaccctgggttcaaatcctaggtccgccacttgtacaccatgtacaaaagaagtacacgcatttctgaatcctgatatcaagtgattttgtattcaatgaacattcgacgcacattcaacatattagcaatgaagggtgagcatagatatatatatgtgaactgatagacctttcccttgcaaagcatagttcaccgcgtaattaaccggtagccaatggccaaatgcaagttcacaattattagactagcaaaatttacctaaagttcttttgggtgcaatataggatagcttgttgagatgaccgaatgatctatggtattctcctaatctctacaatagaagtgaaaggcatcgggaagactagtaaaacaatcatcagagttgcatctgaaattgttcgactaagaggatcctcgatcgccgcgtcctgactgtggagactaattaaactgggccatgcacgaccccatggagatgttttacgaataacttcctgtcgactacaaattactcattaactttatataagacagatagaaagacaaggcgcctaattcagatatgaggataaatttggcaactcacacttctggcaagaaatcttggaggtgaaagagagcttttacaaattttgtaataaaattgtaggtgatggtaggaacactttattctgggaagatggttgggggtagacccctgaatgaccgatttcctgagttatataatgtggcagtgacaaagaaggtaactattgcaactttgaaacagaaggggattgattccgtaaagttcaggagatgtttgtattgtgagaaactcagagactggaacaaaattaaaaatagatgggtgatctgcagctgaatgaaaatgatagggataagatttggtggaacttgacaaaagaaggcagattcactgtgaagtccttttatagtgctatgaaaatggaacaagtaaactttccacagaaaaaaaaacattgaagatcaaagtttttatttggctgtttgttggaggaaagggggtacgaattgtcaattttgtgatagagaggaaacaattcaacacctgttctttgattgtcctatggttagattactttggaacattggtaccaaattaattacagaatccgtcaataaatagcgagacaaatttattaagcctaattaatccatcattagtaaaagtttactgtagcaccacattgtcaaatcatggagcaattaggcttaaaagattcgttacgcaaattagttgcaatctatgaaattagttatttttagcctatatttaatacttcatgcagttattcaaacgttccatgtgacatggtgaaaaatgttatggtgggatctaaacagggcctagggcctcagagttatacccattttgtactcaatgaacattccaagcacattcaacatattaattagagacaaatagacgatgggtgagcatagatatatatatatgtgaactgatggacctttaccttgcaaagcatacatagctcaccgcttaactggtagccaagttcgaaattcttagactaaggaaaatttacctaaagttcttttgggtgcaatataggataggatgatgagatgaccgaatgatcgatggtgttctcctaatctctactgaagaaatggaaggcatcgggaaaatgagtaaaaccgtcatgagagttgcatctgaaattgtttaactaataggatcctcgttcgttcagtccagactgtggagactaatcaaactgggccatggccccatcgagatgttttacaaataactctttatagactacaaattactcattaacttgagttaagacagatagaaagacaaggcgcctatttcagatatgttttggcacgatcgacgacctcaagactctcactgtggcacccaacaaactaaaacttcaaatctgcacatttgatcaaatttcaatgtattttgacggaaaaaaacagttactgaatttccttatatgtcattttgttctgagattttgacatatgcaattaaagcttttgagtagtgttgtttttgctagtattcaattacggataagtaggtttccaaaaaaaaaaaatacggataagtacggcaatacaaatgtccttgaattgcttcagcagctagctactgtgccgagattttgacatatacagcatctttaagtagtgtagtttttgctagcattcaattatgcataagcactatagatataaatatgctttcctaagagcatgcccaacagtcactcaatatttgattcccaaaaaatctgaattaggaattccaaaataagaattaggcccaacaatcaccccctcctccaagagaggcccaaaaattaattccctatcatttgttagtttgccacataagcaaggtgggcctagttcggtaccgatcaatcgtctccctcctcgcaccagcgccgagacttctccctcccagcaccttctccctcccacaccagcgccgccatctgagtaaatcgcatcatcaccagccaaccagtgtcctgagtgctgcggtttctacaaaaacggaataccaaggatatgccatagctattcgtgtcatcaaggaggtaatccctagcaaatcctattgatctcttgtgccctagtcaatatctgtctctatttggttatgtggatatctattgttggaaaatattaagtttgatctaataattaattttatagattgattattgttgtattcctgccatcggttctctccattgcacttcatccctgtggtaaacgctccaaccctgtggcaataaaaaagagaagatgagtcgtcgaagtaccctcctccaaatgctattggatgaggagtctttattggatggctacgaagaatttatttcttcggcggttgatatagtgtacgatgagttcgacgatgatgaagttccaaagcgtggtggatctgttataggtcatgcagtaattaatcgggaaagattggctggacatcggagattatataatgattatttttctgaagaacctacgtacctcgatgttcagtttagacgcaggtttttagcagtgctttgttttgacaatatttgtttgcaaaattgatattaaagataattaatatcgttaattactatgcaggtttagaatgagacgacctctgtttttacgcataatgaatgctatagaagcacatgatgaatattttgtgcttggactgtcatgtttgcaaaaggtaatagcagtgtcacgtatgttaagttatggaatagcggcagatgcagttgatgagtatgttcgtattggaggtagtaccgttattgagagttttaacaggtttgtggtggctattgatgaagtttttgggagaggagtatttgagaacaccaaacgagaacgacatagctagattacttgctcagggggaagaaagagggttcccaggaatgttgggttctttagattgtattcattggcagtggaagaactgcccgactgcatggcaaggccagtataaagggaaagagggagttcctactatagttttagaagctgttgcctcacgtgaccgacggttttggcatgcgttcttcggttcacctggatctcacaatgatattaatgtccttcaacgctcaccgctgtttgcaaagctagctgaagggaaggctcctaaagttaattatagtattaacgggcacgactacactatggggtactatcttgcagatggtatttatccttcatgggcaacacttgtgaagagcattaagctgccacaaggaaataagagaaaatattttagcaaagcacaagaagctgctaggaaggatgttgaacaagcatttggagtgcttcaagctcgcttttctatagtccgtggaccagctcgtttttggaaagcacttactctgaatcagataatgagagcttgtataatcatgaataacatgattgtggaggacgagcgcgatggtgattttgatttagtttatgatgagatgggagaacaggtgggtggttcccatgaacgtacgaccaactttaatgattttattagtcagtacgaaaaaattcaagacaaggaagttcacaaccaactaagggaagacctcatcgaacatttgtggaatcatcatgcagaccgatattaattttacattatatattcttatagataatgtcatagattgtaataattggagattcacagcttgtttttaaattagtacatattgagcttatagtaattatttattgacaatgtgatttattgttgaattcgatacagtacaatagactgaaaaggacagcagtgcatatcctttttcaggactggatatatatacaggatatacaccacaagggtgtacatcagaatatgcactgctacatatgcaagccgatgataaattctggcatttttgctacatatgcaagtccatgaactgaaggttttacatgccaatcatcatcgaacattgctactagttctgacagttactttaatggactgaaacttatttcaacccttgtaaaattgatgcctgaatggctctgtaacaaccgggttatttcagcactagtggacaacatgaactgaaaatgcacactatcagtaacagggccatttgagatgaagaagcaattccatcaacaacaatttccagcaattttcaacaaaaaaacaatttccagcaattttgtagtagtagcaaatgctccggctacataaaacagtaccaaaacaagatagtacaatttactagtccattaagtaggctctatagctaaagatctaacaaattttgaatgctaattgatgagtaataagactaatttatgcttgagctgaacgatgacttagaatttgattcttcacatttttatagtactcctgctcctcgatgctcattgcactagtatcagtcctcaaaagctt

SEQ ID NO: 66951 - DNA, 1625 bp, Oryza sativa
aaaacagagccgtgtcaaaagagcatcgcgaagaggcaaattcaagattttgtattgaggccttagcaaatggaggccaccggctttggtgcttcgctaggatgtggcatgtagacctacacatataggactgggaaacaccaggaaccaaaggggtgcactataggtaggcaaaccaagcctactcaagaatatgtgttgaggtagccaacataaaacttgtatggtttcactctaacacagccatgtgagtatggctcccgcacctgcaacgtcgagttcggcagccgaatctggtgccgcccctccgcaacgatgctcggtggtggccggatccagtgccacccttcccacccggtgcttgggggctaccggatctggtgccattccccccgaccggtgctctggagcggctggatacggcgctaccccccaccagcgtcgcacctcctctccgcctcttcccaccagtgcaacccctcctttcggccccttcccaccgccgctcgggggtggccagttccggcgcctccttttttggcgccaccccctctttggcacagcacggcatgcaaagaggtttctccacgatggtggctgaattaccagggcatgtggactaacttctattttttttctgatttcttcatcttgttctttatgtttgatgcatgcaaatatttcctgtaatgaattttcattggagtgatgaatttttgtgcgaaaaatttgtggttcaatttcttcgattttgctctagatggatgtgggatggatggatggtgatatgcggatgtgggatgaggagctactcaatgcattggctattatcaagcaaatgcattgatccgacttttgttttgcaatgcattggctgtctgctagatgcagattaggaaatctggcacccatgagggttttccaaccggcacacattgttgtttctgcagtatgtggttgtcttggctaaccagtgagttcgacctacatgagtgcattccttgaagagatggcgcctattatcacattatagtagcacacagtagacaaaagtggttattcggccatcctctaatctgcaactgatatgccttccaaactatgttatgaaagagtactattattcatgtaacagcatggtattcccgtttagttttgttactgaacataatagtatttttaaatactcacagcagtatattgaaggtcttaattaattaccaaatgcaacaaggccaaggtccgagctacatactcgcttcgtattttaatgtatgacgccgttgacttttcgattaacatttgactattcgttttattcaaaattttcgtgcaaatatgaaaatatttatatatcatgcttaaataacatttgatgatgaatctagtcacaataaaataaatgataattgcataaatttttttaaataagacgaatggtcaaacgttggataaaaagtcaacggcgtcatacattaaaatatggaggtagtattattcatgcctaaacacatgaggccccatataacctactccctccgtttcaaaatgtttgacaccgttgactttttagtacgtgtttgaccattcgttttattcaaaaaatttaagtaattatttattat

SEQ ID NO: 66952 - DNA, 7661 bp, Oryza sativa
  unsure (1)..(7661): unsure at all n locations
ataggaaattagagggagtttggggaagtttagaaaatttaaaataattagaatttaattatagattaattatagtcgtagaattgcaaaatttaatataaattatggattattcttggtaatttctatgagaaatcaattcgcggtagtaatttagatgtgattaataactagacaaatagatgaattcttatagattattatagattatttttgggtaatccctataagtaatcgattcacggtagaaattcggatttagttactagggattttagccgtgtattatatttaatcatttagtcatagactaaattaaatcatataatatttctaggatttcgttcgatatttagctccaatttgagtgaaacttgaacctaaattcatctaaattcataagctttccaatgatatataattcactatttgataaaatatagttataaatattaaataattaatatcaagatgatgcataatagtcaacttaaaaatatgctaataaataaaattagtattgtacagtagagtggatgtaataatatttgtctctaacatgtcttgccactgtaacaaccacacaaactaattttatgtgatgtctcaaatgaatggatgtataggaaaatactagtacttatttaatattcgatggccatggcttataggttatttaaatcaagtgtagccttatgattatgcaactaaaatataaacacacatagatgaatctttaacctgcttaggagaataataatagagctagatgtggaggaatcactaagtaaattaatcgacgcaataccatatagaatagcttatatatgcctaaattgattaccacttattagtaacccaatagaaccagtgcttaaacttatcgcatcacatatacaatatcactcatagaaactagctaatgtataattaaactacaatatattcaggaatcacttggagcattgggtagtacactttctaaataagctcatgtagagtaggcgaccaaaaccttatacgttgttgcacacatatattgtacatcccattatagttacacaattaatttatctttttcatatattaaactgggagtatataacaaacatgaatagtagataagtactaattataaatcttgacctcatatgttcatagttcaattgtaactccggattgttcattaagagataatatgtaactataatattataaacttcccgaatttaacatatagagcatggataattattaaccttttataatttattgtgacaagtaaaatatgttcataatcaaggtaaagcttccatcaataaaataaataatacaaatgattcactgtaattatttgattgatcctaaatccatctaacaacataacctctagtatatgactgtcctatttagatggatgcatgcttagccataatccttccataagccatttgatagactaaaccaccgattagccaaatatatatgtatcccataaatgctatgatggttaactcctaaataggccacgttgacaatagaaagattaagaaaccttagcccctagcgtggttgggatccattagcaaacacgaatagtacattttgttgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaaggcaagtcatcactattccttgaacatgttgatcctaattgcgaaattgttttgtttacaaataaaattgcatgcaatgatgaacatcctacttgtgattatgccatgccttgattattgtttacccttaaaatccttgtacccatgattacgtatgagtccctagtcaattatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtagggccgagaggcgtgccctacatcggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgcgctcgcggttattgagcaccgggacatgtattacacttggctagactctaaattcttaacttgtggggaatgggatattgcatgatgaattttatgctgatggagccacatcccgagaggagggaaggtggacatcctcagaaaaccatgacgattcaatggcgggaagctatccttgagatcacaatggatggtggacagaaccgtcattgtttaaagtgaacactggtactaaaatttgatcagtctatgctaggttttaggcttgtgaaaagaattgtaaaattagctttatgcaaaaggacctgaagccattccttgaaataccctctatcatatgcattgttattatggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatgttattttgtcttccgctgttgttctctgatagttgttggcctacctggccctaatgtaagtatttaactcctttagcctaaattcattcgtgatatgttgtgatccaactatgtatgtgtgtaccaactactgatccagggattggtacggataaacacagaagatttccgattgccaaaatcgggggtctacagggttggtatcagagcctatcgactgtaggtcgagaccctagatagaatggccgttagttgcaggaccttatattttacaaatatatttttaaaatgctaaaaaaaagaggttatgaaaacattcaaatattgtttctcatcttacctctcttcaaaaatatctgattccgatacgccaaaaagaaaaaaatatttttgataccttacatctcaacccttcctttgacaaggcgattttatcacttgatttgtgattgaaaaatattggttctacattctcatccacatttcaaaattttagaataagaaccgaaagcaattaagacgctatagggatattattgattgtgccgaaacctcatcctcgaaagtagacgattgcatcatgattatatgaaaaacaaagtaaagaaaaacaaaagaaaagaacagaaattaactcatcaatcatgataactcatgattgttagtactagtttgctctagtcacacactcgtatagtagaagtgaagtctcgactaagccgttagtgaccatagaagctcgacctgcgacatggaagttcataaagaacaataaagagaaaagaaacagactacgtatttatgagaaagcccagcaagaatactaaacatacaaggatctaaagattatggatcaagaaggaacataagatgctacgtagatatggaaattcaataaaaggaacccttatttggataagagtacatggacgaatgatgaaagagatttgaatttattggatattagcttgagggttgcttcaaaattccaaggacaagtcgaactcatatggcttaaatcctctgaactttattttataaaatgtctttagcaaaatatcgcgaagcaaattaatttttgcattttgaaatatagccttacaaaaaaaaattacttcaaaaaggaagaaaatgtttgtttcaaactatgtaattgcaaaattgtccccagagccgcactgaacttatattaaattttgggaatggtcgaaattagccttgaaaagaaaattttctctgaaaattatttgtgaaattttgattccaaataatgtattgcaaagttttccaaaataaaacttcattcaaaaccaatttttcagtgcatgtcttcgaaagcctcctttcaaaaggttttccaagctgaattccaataattatttgcctaaagctttgtttaaaaataataataataataataataataataataataataataataataataataataataatagtaaaaaaataaatttctttcatgagttttcctttgaggtgttcaaaattattgttgtttcaactttgaaccatgcatacaatctatatggtattttggccctattggcaagagtgctcttttgcgaaataaaatcaaatgttgtttaaaaaaaaaaatttgattacaaaagtttttagttgccatgttgctttttgttaaacatatgtatgattatacaaaatcttgcttgaaaaatctattttcaaattatatttggtgagaaactgcatctcttgaatattttaaatgttttgcaaacatcacttccaaaggatatttctgcaaaatcattttgaaaaaaaaaaatcttctttgtgaacgcaaaagcatatctccttttaaattgctttcaaaatttcttattttaaggggggtagcctatgatggagaaacctcgaggaaatcaataacttgtgggaaaatatggacaaggaatactatatatcaaggtatatttgcccttgtacagggaatttgaagtatcattggatagtaaaactgcaaagggtgtgaccttaactctcgtcggcaagattcataataaatattaaggaacgaaggattgaacaaatgaagaagaaaaacaacaattcagcattgtcatgctactattgatgactagtatagtagtttactaactttcaacctactaacttctaacaagagaaacctaccacaggacgtgaagacatggacccaatcgacatcgaaaaacaagaattcctccaatctacaagaccccaaaatatgggaataaaccagcccatgctactctttgaagatcctccccaagcttccaggaacaaaggacgagtccaagcctcactaaagcctgaagactacaccatcaatctgaatcacctaaagcaatattcttcgaatgaaaggtgccacctgactccagcaaaacgaaggataaatgtcacgtgttatagatgtggcgaggaaggacattgtgccttggattgccctaagaaaaagctaggaaatggacaagtaaggaatatacctcgacacccaaaaaggaaaatgagggcaggaataccaccaaaaccgatgccacattcactctatccaaaacctatgtatcagcaatttcgtagacaaggaactacaccacattggtggaagggaaaacggaaaagaaaagcgtcatcacgaataacatatgctgaacttaacctcagtaaaatgggaatagaaatcggtgatttgcctgaagatgttgaagaactacaactatggcaacgaaagagagatggctgttgtttttcttgtggacaatttggacattatgcgataggttgtactcaagacaccaatgaagaacaagaaacactgccctcacagatcggcccggaaaaggatagagttccagacccatccaaagaagtttcgaagattaaggcatgtagtcgttgcggagagataggacactacggtagtaattgcattactcaatgcccctactgtgacgaagaccatccaaacggagaatgcccaacaacgaagatcacgtgcttcctctgcgaaaagacggatcatgtgccccaagattgtcaactaagtccgttgctgaccaagacggcggaagtacaaagagtgtcgcttcgcttcgcccatcgactcatgacatccagaagccacgaagacccgggatttcctacttttgatttgcatgtttgtttgtcgaacaatatttaagccaaaatagtttaatgtctccgtagtcccactaaatctcggggacgagatttctttaaggggggtagatgtgtaacatcctaaaaattcccaacaataaaaatcactaaaatttcgaactttttaaaacttttgcatcatgctggttgttatgattcctattgcttgccaaaccataaatgatcaccaagaaggtaaagaaaagaactacatttaagcaatagatatgatttacgagaatatatttaatcctacaaataattatgcacaagatagttaagtcaaatattaatttctattacaaattacaaattaggtattaaatattcgaaccatgattgatagcttgatgtcacaattagctaaagaaatagtaagattaaatctaattcatttgaatcgaatctcccatgaaatataagaacacatgaaatgatgatcaccactatagtgatcgtgtttataaataagtaattcaccggaatatatagattgatacttgcaacatgtcgccgagttactcatgacatgaaaatcactcatataaaataatggtcatataaataaattaatccttatatataaacaagaatatgtgagtgtttaaaattagattaatgttgtaccgagtcttaatatactatttatagaataaatagattcaacctatccgtgtaaaatatattgctataagttcattcaatgtgctattgtaataataagggccacactaggatattttagaaccctcaaagcctccaaaattatctaggctaattttagaattagacctcatttaaataatacaatagaaatatatatataagaataaaatatgggtaatattaaaatttggtaaactttcatctaaattaaaacatatattgggcaaaccttatttatgtaaaaattaggatttatagaatgaaatttatacaagggataaactaaaatcgggttaaatagaaaatggcactgttcattgcactctaggtgctcgatgtggtccctggctctatttccccctcctcagcctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 66953 - DNA, 2186 bp, Oryza sativa
cagatgtagcattgcctaactaggagttctcccaacaacgtgtttatatttcactctaatatcgtagtgagatggataaaacacattgagaaacaagtacaattttaataggcattcaagaactacctcccaccgaagatcatgagcaaggtgtggctgtgatgatgaatcatcttgacatggtgatcctatgttgttatcagcctcctggtgctggttccatgatatataatccatgtaaaaccatatataaattgcattgcaccatatgaatgaaaacaacaaatcctaacctttttgccacaaagatccagaatattgtcatggtgcatattttgctgttcctcacatcttcttttgttctatagtggaatggacaataaaaatttactatagatgccagtatgtgtattgagtgttcaaataaaatttatcaattagaaacgacaaaataccattgatatatttctttgattactcattgagtcgtcttgatcaggtctactgcatcgaaccctctgtatgtgcacatatttaaatattgttgcacaaaatatggtgagaaacatagaatgcattactttgacattacctttctattagtccgtactactccctcttcaataccatcatcaaaagttctctgagatgttgcctacaacaatgaaatcaggaaggggtaagattttagtgtgaatcacataaattttttattttacaagcatctacaaaaatgaaatcagaagtagctaaaaattcaatgttaaggacaaaggtatttataacgtttaccatagttggttcactattcccattgcttgttcctttgttttccaactcctcaatacgctgacccagtgttttgactaatttttttaattcccccacttcccctctaacatgtgtctcttcattcgatgatgagtcattcactgtagtgatgtttatgttcttgagatgatgtgatgtacgaccataaacctgcttaggaacaggaagtaatcccattccgtgcacttggccaggtttttctttgcccaatactttatttagcgcatcaccttcccatgcaactcttccttggtcattttgtgccaactctggttgttcatcgatgaggttctccaatgtgacctgcaagtgaaaaaatatatgcccactgtacaaggtagataacatacatattagatatttatggaaggattatgtgtatatggcataccacgtgttgatttttatctttatccttttttttgtgagttgctaagtaaaccattgctctatgtggctgcttcttatttggatcatcttgtctctgaaaatgaaaggtaatgtaagaaagtaaagtgaacatgtatagatgaattttgaacaaaacaaattggctcaccaagtcctcagaccaacgagcataactctttgtccctgctgagtgagggttctgtaacattgaacgacttcttttgttctttgcactgagggcctattacagaagcaatgtagtctcattgagttcacacttccaatgttgtttacggtaggaacaacagtacaatatatgtcaatgagacaatagtacagattgtggagcagattttttacctttcctttttttgacttccaatatttgataagtggaatccattggtctttttctacatcgtctggacaaagcttatacagagcagaacgcttcttctttgggttaaaatatttatcttttagtgcagccttgtatcgcctccaatctcttccaattgatttcagtatccattgaacgcatgatggagggtacaggaaatttgtctgaaatacataggaataatgagagtagaagtatttgaatttgcatgattacgtcaatggttaggcaagggataacagcaagtaagaaaactcagcattgaatatctgtaaaatacatataaacattgaatcgaaaacattcagttgccatggatatgaacagatgcatcaatctgagagtaggaaaaaagtaatgactagtaatacaaacagagcattatacttatgctattttagcgtttgaggtacctggacaaattgtagtattgttaaatctccttcatctgctttgatctttctccaggtcatcttatctaatggacagtaagctccatttcttgctaatgtgcccaaaaactgtcctagcaatccaccttcat

SEQ ID NO: 66954 - DNA, 1749 bp, Oryza sativa
gcatacattttgattcggtacttagcattatcaagatatctaaacaggaatattttgcacacaactaattacatagatctggcaacataaatccaattaattcatttcacaataatgtagtcaatgtcactgaacatatgtcattaacctgttcagattgtctagcagatgctaccacggtttatcaaataactgcatgtttgatcagaacttcaataatcatcagtgggaactaattttgtttcttgtacagaaataaacatggaatttagatggtggtaccggtgcttttcatcgaacacatggtgtatatagctctaacagagagcaagccatccagttttatttaaccctagttgatctaactctcagaaataagcatcaggaattttagagagaaggtacacaaactgtagagaggaatcctttggttgaaatgtcgattcctgtgacctgccctcaccaagcgcaggcgaaaaggatggggtggtttggatcttcgagtctgcagattccacaactcaagaaataggggagagagtctagagagatggccagatgagggggagagccatggccggaggccctgcgcggctgagcagttgagaatgcgatcttggaggaggcgatggaggagtgctctggtgagagatagtggggagcagaagactgactaactgattccaggttgaatggggattatatagggagcttattcgttgagagagatgtggagagagattagcaggtttgttactctaatgttgcggtactacttggagggaaaattgagtttggcgggaagtatttggaggcaaactacgcatgaaaaaactcaaggaatttccttattgaaaaaaaaagatacatctcaatttttttacaaaattggttaattactacattagtaattttgtaccttactgataaaaattaaggaaattccttatgtgattaacgtgatcccctaatgactgtgtccctctgctagctctcccttcatttttattcagcagaataatattattttaaaagggtatctatatcatataatatgaaactaatggttcttttttttcctattctttttacccgattgttttttttcatatcatataatacaaaactaaggggagccatgcattgtacggacaaatatgcttttagtttatcacatttcttaataacaccgagcctctaattagtaggtacggtccaacgtttattattggtcaaacttgatttatagggtccgatgctaggagaatttgtagtgttaacgtgtcgagtgcggctttctaaagatagaactaacagcgacgcgtcgctctcgggctctctactgttggtgttgccggcggctggctttctaaagacaaagactaatggtgatgcgttgttctcgggctctcagctgttggtgttgccgtcgcagccgccggggagggcagcagcatagatctccttgtggagcttcacgcacaacatcccttacaaatagacgaattttaatgctcatgtcctaaaatataagtatttttgtactccgacaaagtcttcgagatgcatgctattttcacattatatttataaaaataaaatattttaaataaaaaagttacatattaagatagtttgattaatgataaatctagtaacctcaattttacatgattatattattatttttttctattaatagtcaaagttaaaaatggtgactgtacattaggctaaaaatgtctatat

SEQ ID NO: 66955 - DNA, 1661 bp, Oryza sativa
cctaaggcagtcaagtgcatatgacggcaggttagcaaattgttaagcactaagtttttctatgcacaccaagtgtttgtcatttttcttgtacgcagatggcatcttaaaactttaccctgcatcttattgtttcaatttttaatctagctcacagaaactcttatattaaccatataatttaatctgtacaaccaaaaatattggctcatagtgcagtttaattcctcaattatcatgtaaagtccttaattctttattctgattgcttttgtcaatcccatctgcagcaatgtctgatccactcatgtactgctttgctatttttctgatctagccagtagataagatggtcgttttcgtttggttcaattaaacaagcatcagggctgcatcgacgctgtatctactggatcctaatcctaagcttccaggtacagttaacctcacctacacatgttcggtagacaaatttcttttggcttgaaggcataattatagaatcaaaaatatttagtggttgttgtcaaattaggaacactcatgtattaactatatttcttattttaacacagaaaattgatggatttgaataatattaagaagttattgcttttccctagaccaagtgatgagtaccttgctggaatagatggttttcttctgtttgcatatagggaaaagagtcttgaagataagatccgatgtccatgtaaggagtgtgtcaacaagtggttattaacgcgggatgaagtgtatgatcatttagtatgtcatggaatgttacttgggtatagtccatggggttgtcatggtgagaaccacatcattcatctctgccaacagtaggggaacatgagtcagcaaagtacgaggaatggatggtacacatgcgccaactagtgcaagatgcttttgggaacacaaacaatgaccctccagtgaatgaatatgatgtacaaaattttttaaacagtgggccagaccatgaaacaaaagcattctatgacttgctccgagatgctcatgaccctttgtgggaagggtgtgaacttacaaggctgtcatttctagttctcttgtttcacataaaatcagttaacaagtggagtaataaatcattaaatgatttgctagcaatcttgcaacaagcaattccaaatggtaagaatttacctggaacatttgctgaagctaagaagataataggaaagcttggacttaattatgtcaaaattcatgtttgtccaaataactgccagctttataggaaagctaaggcaaacgatgacttttgttcaaaatgtggtacttcaaggtggaaaaacaaagaagataaaactactttaacaaagaaggaaaggagaagggcaaccccaaggaaagtgttaaggtacttcccaattaagccaaggcttaagaggttatttatgcacaaggaaacagctatagcattaagatggcatgatgagggtcgtacaaaggatggtgtgttgcgtcatccagctgactcagaggcttggaagtccattgactctaggaatccccagtttgcatcggattctcgaaacattaggtttgcaatggctagtgatggatttaatccttttgggacattgagttcaacttatagttgttggccagttgtcttgtattccata

SEQ ID NO: 66956 - DNA, 3755 bp, Oryza sativa
tctggattcctgcaagcagacgcttcagccaaacgacgacgaaaaggaaaaaaataaaataaaaatttgaaaatccctaaaccctaaccctagaatccataagccgtcgccgctgtccttgtcattgctgtcgtcgtcgttgtcgcttgaatctaccgctggcatcctggtcatcgtcatcgctcgaagccgccgacggatccacacgtgtggggacggaggggcggcaggatccgcgttggaggggaaggaggcgtcgggcatccacccctccaattgatgccggcagcggacatccttctcaccacggcccccgctcgccgtcgcttcgtcaggggaggaggttggccgtggctgatctgcaccccatgccagagccctcacccgctgtcgagccctcctcccccgccactggatccgccaccgccttgctcaacactgccgtatccgccacaaccgctctcacccgagcccggcaccttcgctcgccatcgcttcttcgagagtgggagagttggaggagtttgagagaactgttagacttactgggagtgtcgagttggacttagtgggaaaagcgagaggaggggaggaaaaaacatgtggacagagggaggggtattttcggatgcaagccacttaagaggcccgcctacgaaaattgattttcgcatgtagttgttgaaccgtgattgggggagtgattttgcaggcgagagcagttatagcccgtctgcaacttaaagagcatatcgtcctgaaaaatcatttcatatcgtagtgcataaactctaacatgtgcctttgtttaacaatcatatttagttcgatggtcaccgaccaattcagtattgctgcatctatgctgcttaagtacaacgatatgccgatatccgagctgcaagcctgcaacatgtcttacacggatatcgcgccaacatgtcttcatcaatttgtcatttttattttcaccttctaatgttgccctgtttgccgttcttgttttggttgtctcccttacttagcagttccatcaatttgagctttccttcacgcttttttcactgcagaatatacaactacgtgaatatactcttacaccatgtgcaatgttcatttatatccggagaagggcagtatatatatttgttttgcagaaaacaatcaatgctttgttgataaattggaaaagaaaggtgagcgtatgtgaagagatgcattccctgaggatgaggatggtgttgtaatgttattgcaagcaaaaacatatcaccggtgaataagatttgtgttttctgtagacagacaatatagagtagtagaagtgggaggtattgggaaaactaatagtactcctactaactaatatgtggcagagatggttcaaggtgatcacaagcattttggcagagtccgtgaagatcttgatcaagaccaggtagttcccagtatgagaacatcaactacatgtacagtgcacagtctaaacatagccaagctattgtggaggcaaacagtctgtatgagattatggttcaaaaccgaagttcatgtgatttctttttctagactacagatatattttgaggtacataaacacgaagaaaaaaaaagggcaaaacattatgccatacagaaattacagacaaacaatttattccatttcatattacacaggcattcggttttaatttgacagggggcattattacccagtaattgaagcaatcttaataagaaaataattaatgtgtgcaaatatgcctatctgcagcgatagtatcccaattgcaaagcattatcgtcaactcgtcttaccaggtgtgtgttgggctgactgaaggagtgagagcacgaacaaaaacggagctagctgaccagacgaaaaacatacctctggtccaactaatatgggcttataagtacccttctcaaggcctcatgggcataagcatgtgtgaggcaatgtatatatatgcccatggaagatgttgtaacattggttaagatgtagtgccttttgtaagcattcatggtttagaaaatagaagtggaagacatcaggaaagtgcataaaaccgctgctctttgatttattggagtccagaaatgttcagctcctcctcccaacccggaagcacggtcttgcttggttattgagttcactacatcgtaccctagatgaactcatcgtgatgggccctctaaacgatatataaaattttatgatatatagacgctaattttatttacaaaatgaaaacaaatacatgtctggtaattattgagaaataaagtcgaccaaaatatcaatatatttgtaccttggaactaatatcactaccttaatgaagatacttctttggatatttcttgatgcaaaatcatcaagagcgttattaagatcaatagtgtctaagatatccttctcgatagagcatgtagccaaatcatttaacatttcttgcaacatagttgatctcaaatagttattcaacaacttcaattttgagaaacttctttcagttgaagctaccatcacaggtatagttaagagaattctttcagctggatgcctggacggctagtcttgcactcttgccgagttgctgtcttgcgtgattgcgtccagggctccaggcgggaggctgctgccgattggcagccggcgggctgacgccatgcaggcaggcggctaagtgttgacttgtgctgtgcgatgcgatgccgagttgctgtgttgcagacgagtcgacgatgttgtgcgcctgtgcggctataccctgtgtgatgcgatgccgtctgccgagttgccgacgacgttgcaactcctctcgtctttcgcgcgtttcttcttctaggtaggccataggcagttactagactactagtattaggtgttggacccactcaccatcatggccccctggtgattgcctcgtctgcataggcctagggccggccctgcatacaacaacacgtagaacacgacgtatatatcatagtaggtgacacgactataggccttcctatatagatgccggttttctaaccggtacaaatttgaggccacctttgcctagttgcccacccacaccagaaccggcactacaatctttgaaataagaaaaatctaggcagaagaagttttgaatctgtgatacccgtggagctcggggaggagccgccaccatctagtagcaagaacacaccatcccccgaggccactgtcgagccaatgcctccttgaacgagcagcgagattgcccaatctgaagcgatgaggcaacagcagccactggcttccttacctcgccatagggctccaccaccaaggcccctccaccgagctcatttgcccccgccgcccgatccatgccgtcgcacgcttcactacgctgtcatcgaatgcagcttcaccacggtgccaccggatctgaagcgccgacctcctcgcttccaccatggccttggcctcctcgctctccgccggagagtgaaacaaggtttggggagataggagaggtgccgtgggctctccccctcccgtgcggatcctgtcgcctaccctcctcgtgcatgcatccggctggccgggatcctgccgccttttttacaagctcccttgtgcaccgatcagccggcggcggcgatgggaggggccgatccgccagcggcaacgatgggaggccggggatgacatcgatgatgacgatggcagcggttgctagatagggagcatgatgatgacgaac

SEQ ID NO: 66957 - DNA, 2549 bp, Oryza sativa
agagctgcgacagacatagccgtggagacataaaacttgaggacctacagtatcaattatcaaatcggcatcgaggacatgagcaggtaacggttttggatacatggctgaggcgagaaattccatgctactccctcgttccctaaatgttgacttttttaaatatgtttgaccgttcgttttattcaaaaacttttatgaaatatgtaaaactatatgtatatataaaaatatatttaacaatgaatcaaatgataggaaaagaattaataattatttaaatttttttaataagacgaacagacaaacatgtttaaaaaagttaatggcgttaaatattttgggatggagggagtagtagcttatatcgtttcagcatccgtttggctttgctatgtacgaaaatgaaaaaaactggggaagcttgaataagcagtgtcagaacattgttatgacagatgaaccagatcaattaatctggaaacatacaatgaatgggatttttacagttaaatctttctattgaactctgatcgtacagaacactggttttagatttcaaaagagatatggaagtttaagatcccaccgagagttaaagtttttatttggttgatattaaaaaaatagcattctaaccgaagacaatcttttaaaaagtggacggataggaaaaacatagtattctgatagaaatataagtgtaaaacagagaattttaaaacacatgaaaaacataagaatgatcatttgattgggccatagaaaagacacaggaatttaaggagagataaagactcaaaaagattttttccatgaggatatacctcatgttaaatttccttcaaaacttgcatgtgaagagacatttcttataaactaggaaggtagcccgcgcatttgcgcgggcatgtttttatttcgtttcgaaaacatgtctaacaaaataagtttaaattaaagtgaggtgtttcccttcttaattgaatgttcattgtattttttctttaaaaatcttgagaaactttaattgctcataaatatatattttttactaacctgctatcacctttttaaattgaccaaatatacatatgtaagatagtgattcttatgcgtaggatcctacagtatttttaagaaaaataccaagttaatatgagtcttaaaataaaaattagtaggaaatttctaatcatatcgttatacgaaatgcttattgattttgtattgacaccttagaggcatttacatgcaggtcgtggaatttagtgtattcgtttaattatcattgaccttcatctcctgatgtgtcaaagtgaaatatgacttgtatgtagagaagaaaaaaagtttaaaagaataaaatatcgttaggatgtaaaatgaacttttttttcctctgtaaccaatggaatagattgattcaatactacttttgcgggttaagtgctccactaaaatagttcactgtgtaaaagcttcgactctaccttctgggttaagtactccactaaagtagttatatgtaaacacattacaaaagttatttctaaaggtagcccatgagtccgaggcaaaaggctcatcacataggaggctgcacatttgaggaacatgagaacaatattctcgcggaaatcatttgtttagaatgtgatgaacataattgtatattcaattaaaaacgttagaaaagtggcttaaagttgtcatttcacattgattggttatgaaaataatggtatatataaatctttgtgccgatatcattgtttgccaacaatcaacgaacttgatagttacttttggtgttccttttggtatgtagcaaattggctacatattttacaacttactgtatcctttgctgagatgcacttgcttttttttctctgtatacttgattgtctcattgtttattaatggatgccttcggtccatgtgacacaatatatatttcaaataaaaagccttctcgagtctaaattgattttgcagcgtaggagatagtttattgtttcgtgtagagtgtgtgagactccatgtagcttagcaggaacataattttcattgcgaaaaataactccgcatgtgtgattattatgtagtgtggtatgattgttgtcatgatttaaatatttttactctaaaatttatgattaaacattaggattttacataatgcaaacaatcactttgtgattttatcttagctaacatgcattaggcctttagtgattatgtttatattgcataatcctaaatatgaagcctacaatgcttatcctattttatctttgttgtttgaaagaattagccatttatacaaccattgtagtttaaatactaaatagtttttaacttttaagtttctaaaataattggtagataaagcttttagctcggtcatgcatgatacatacatgtagtcccaagctaatttgccccctcacgctgacagtgtcctgagtaatgtcgatgggggcaaaattgtgaccgatcaaagtcttaatttttttcagttcaagaaaaaaaaatgaatctca

SEQ ID NO: 66958 - DNA, 3806 bp, Oryza sativa
gttgagacaatttgcatattgttttccccttgccaatcagtgggtgaaactgcgcaactgtagccatagtattccaatagtgtttagcatgaactttcgacaaaattaaaaagttgagtactttttgagagtaaggaactccatgaatgtatctttaatgcttggtatgtataagttttaaaggattggaagcaatcaggattgagactatgacatgatctaatatgaattccctggaatctcgacgacagtgccatgtgtgtttgtattttagctcctatttgtgggttgcagataaatgcttgggctttcctcaattgtcagttagtcctgaaacataagaactgtacttggagcatctaaaatcgtgttgcttgtagtgcaacatccaatacaaattacttgtaggatctgtaagatcaatgtgtgttttgattcttattccgtgataaacaattagcatctgtgattattggttttgatatttggagattatcgtcaaagtggttttggagatgatcggatttactgttattttatgtgaccggtccgaccgggttgtgtatgccggtcagaccggcggtgatcgagcggtcagaccggccggcccgcagtctgaccggccgacgctgtgtcggcttcggtttcgggttgtttctttggatatccgtgattgtttcatggttatggcttctagatggatattatacgtatgtaatactgttgtttgctactaatgagtcaagttggtgatagcttggtctcggaatatagtttctttgtttgtttcatccataggtgactcgatgcctcgggagagtatttacggtgatggaccggaagtcggcttggtggtaagacgacgtccgtggtagtcagatatcatgtgggatactaaggctagagttgatgcatgtggttgatggagattccatatggcatacgatggaggtattgtgtgcgtatgggatgcggagtcaaatttggaaggagtccaaatttagtatgattggaaggagtctaaggtgtataggactcttagtatgagtttggtttgtggctttaggctgcctacctcatgtataaatagagggggagcgtgagtcttcccggtatcgcttttgtatcgcttttgagagcaattgagttgctagtttagctagggtttcgagtttagtcgagatttttataaggagtgctgtcggtgcactttttaaacacagagagaagcaataaatttgtcatctactttaagagttcttcgatttgtgtttcaccgggttttggcggtctaaccggcatctcaccggcggtcagacctattggtggtcagaccggcggcggcgacaggagctggcgattgatctcggcggttcgaccggtgttacaacctcggttagaccgacgatatccaggcggtcagaccggcgctactacttcggtcagaccgtgatccatcgatttcgagggtaacttttatttccgctaaaagtttttggtttttgggtataccaaccattcacccccctctggttggcttagttcttgtgattcgaccctacaagtggtatgagagccacgtttgctcttttcgatctttatcaatcttgagtttttgccatggctacttctaataagttttcaactaagcctcatgttatcgatggaacggatttttctcattggtgtagtaggatgcaatcttacattatagcttagaattatgatatttttggctcctcctcccatccaagccctactctttttcttggtagctaatctcgctaaaccattattgtgctcctcgtttaggaattaattaccaactactacaaaacatggtactttgtttctacactgcggaaacacgtgatctagctcattgtgtgacaaggcatagaagattgaaatgaaacaagtgaaataataataaaagaagtcatgcatgcataattcgctggaattttcaaaagcaaaggaagtcgaaattaaacgatgtatttttttatcaagtgaacagagcagttgaaaacagggtagtgagtcttggcaattgcattagtatgagaatacgacagcaacaaagaaaacccggtactttctctgtttgctgaccttgctaacaaaataattaattcagaacatactttcattgatatctcatcccttttttgctaaatctttcagacagcagtaattgtaaaataaaataccagatatcatgagctactaatgttagtcagattatgatcaaatattaatttaagagagtctagctatacttgaattattattaatatatattttgcagtacagttcacaattttcagttgtgggatagcattttccagaatttggagacattaaacttttgtatgtttttacctttacaattacaaaattgctctggttccagtagaattcgagcagaactcaatttctgctttaagtattttgttacaatgtgattgcttcttctgattgtgagaaatccaactgatcatttaactcacatagttgaggaagtcacatactgtactgcatgttgttgcaaaagctcaacaagtgtatcaatattccttctgtattcgatctgccccaaatgagagcggtttttacatatttatacaggagtatacaaggggaaatggctttaatgcccctagtcctatgaggaatctgagtggctggccagtgggccaccctcggacctattggtaatcttacaggtgagagggaggaagcgcccataggggaggcagcgctggttcccgagggaacctgttattacacggataaaggcatgccccgggtaatagcgtgctccgcttggtcgtcattaatggtgtcagaggcagttggggcgcgtagtgcgcatttattccagcccactcgcgcctggttcctgactttagccagtggaagcacatcaagtgcttgaatcgctccgggcggcctcttgaactctgggggcctcccaagctccgaagcctctggcagcctccggagctcccttgccgggctccaaaagcccttcacgctctggagctcgagatgccttctggggctctagggcccatgggtgctatggcctcctggagcaatcccggagcccttccgccgatctccgaagcccttccaggctctatcgcactcgccgtccgcgggatccgattctctaggatccctggaggccttcggagcggccacctcggccagggaccgacatggccttgacctgtaaaatcaaaggtgttttgattattattctgtgatgaacaattgggcattggagattattggttttattatttcgaatttactcacgaagtggttttggagaggattggatttacaggtgaatcgcaggatctatcattttatgtgaccagtcagaccgggctctggtagccggtcaaaccggcgtgtattgcgcggtcagaccggcgcagcccgcggtctgaccggccgatgctatgtcagtttcggtttcgggttgtttatttggatatccgtaattattacatgattatgacttctagatggatactatacgtatgtaatactgttgtttgctactaatgagtcaagttggagattgcttggtctcggaatatggtttctttgtttatttcatgtgtaggtgacttgatgcctcgggagagtatttgcggtgatggaccgggagtcggcttggtggtaagacgacgaccgtggtggtcaaagatcatgcaggatacttaggctagagttgatgcacgtggttgatggagattccatatggtatacgatggagttattgtgtg

SEQ ID NO: 66959 - DNA, 12462 bp, Oryza sativa
ttttgtaaggagtgctgttggtgcactttgtaaacacagagagaagtaataaagtcgtcatctactttaagagttcttcgatttgtgtttcaccgggtttcggcggtccaaccggctacataccggcggttagacaggcggcatcgcggcggtcaaaccggcgggaatacggcggtcagaccggcgtcgacaggagtctgcggcaggcgatctcggtggttcgaccggagttagatcttggtcagaccgacgttcatcaagcggtcagaccggcgcattcacttcggtcataccgcgatctgtcgaattcgagggtaacttttatttccgctaaaagtttttgggtataccaatcattcacccccctctggttggcttagttcttgctattcgatcctacacgacccacagtcatctccttgggaggatggttctccggagtgccgcagcccttcggaggctggcttccctcgatccggagacactccccaaacaatgcacataataagcatcttagttcactatgtacctttagaggagctagctactcatatatactcagctctgaagatgcagttgagacaatttgcatattgttttccccttgccattcagtgtgtgaaactgcgcaactgcagccatagtattccaatagtgtttagcatgaaacattcgacaaaattaaaaagttgagtactgattgagagtaaggaactccatgaatgtatctttaatgattggtatgtataagttttataggattggaactaatcaggacatgatctaatgcgaattccctggaatctcgacgacagtgccatatgtttatattttagctcctattttgtgggttgcagataaatgctggggctttcctcaactgtcagttagtcctgaaacataagaatagtacttgggacatctaaaatcgtgttgcttgtagtgcaacatccaatacaattactcagctccattaacaatgaactccgaacagagcctttggatgttaagccatgcaggaatgtcctagctaggaaaagttaccaccaatctgtaaaatcaaagtgtgtttgatttttattctgtgatgaacaattggcaaatgagattattggttttgatatttggagattattggcgaagtggttttggagatgattggatttacaggtgatgaacaaggactgctgattgtcgggtccggtcagaccgggcagtagttgccggtcagaccgacgtgctttgagtggtcagactggtcagcccacggtctgaccggccgactctatatcagtttcggtatcaggttgtttcattggatatctgttgataatttgtgtttatgactttgttaacagtgaaatttgtgtatgtaatactgttgtttgctaatgaaggagtcaagttggagatagcttgtgctcggaatatgttttattggttgatgcatgtgtaggttgtcttgttgcctcgggagagtgttgccagtgatggatcgagagtcaacttgaggataagatgacgtccggatggttacatattatgcgggatacttacactaaagatcaatgcatgtggttggtgaagattccatatggcatatgatggaggtattatgtgcgtataggatgcggagttgaatttggaagaattccaaatttggtacaattggagtttgtaaagttagtttcttggacgggaaggtttcctagggtattaggacttcttgtacaagtttagttcgtggctttaggctgcctacctcaggtatatagagagagggaaggtgtggcctcccggtaccgctttagagagcattgagttgagagaatagttaggatttcgagtttagtcgagattttcgtgaggagtgttgttgttgtactttataaacccagagagaagtaataaagttgtcatctactttgagagatcttcgatttgtgtttgctcgagttcggcagttcaaccaacgggataccagcgttcagaccggcggcaacgcaccggtcagatcagcgggagagcggcagttagaccgatggcagatcaggcgactacgacttctttagggaggttagaccgggtggtctactcctgtcagaccgacgacatcggcttggtcagaccagcggatcaacttcggttagactgattgacatcgattcgaggataacttttaattctggtaaaagttttgattttggggtattacaaccattcacctcctctggttggcttagttcttcctgttcgatcctacacaatcagctaatccattctgctccttaagaagtgcaattataatttgttaacatatatatgcttaagatttatatatggttcgatggtcttaccaatgcaacagccaagcaatttggcatgctactaagctcaactcagcggtacgaatgccaattccacaactgcaaaatcgtaacaatctcgcctactgtcttattcgttgttttttcttacacttatcttcatatatttcatctccacttcaggctttaattatgcatcatctcctcttgattaacgagctttggtagatctatatattaatttggactcaaaagtaatattttattttcatattgcactgacttaattccgaagaaacattgaacgcctagtcttaacattttctgacatgactaaacgaagtatattttatttttttactagtatttatatattttaatcaagtactataatggtactcttcacaacgtacaccatgtgcaattaaacgtcacagcaacattgatatttatatatttttgttacgatgcatattcattgtctggctaacatatgttcacatcaaggcctcgagggtgaggacactacatacgtaaggagatatgtgcctggcaaagggggatgatgttgtaatgttgttaccagcagtaatgtgttgcactttgacacagtttcaaatgaaattcaaaattaaattttctgggcacagacagtgtagagatggaagtgggaggcgtcaggataattacttgtactactcctgcccttgaccatattggagtgcacgaatagttttggctcctccacccagccaagccgtgttgtttgtgttggtaatgatggtcaatgtactgtagtgtttctcatgcatccgaggctgcagggagatgatcgccaagagagacagaacacttttaggaagctgctttggtgataggtgcatagggtagagaatgccacagcagaagatggtgacttgtaccctcaagaacaatgagctgaatgagtatggctgggctaaaaagaaccagcggtgatatgggacaagaggcagaggagatcagaatgaaactagtgaaacaacaaaaagtcatgcaaaatttgtagcttattcagaagcaatggaagcgatgttttctttttccaaagttaacagagtagtttagaacagggcagcgagtcattcgaattgtattagtacttgatagtgacatctcaatacaggaaaaaaaacttgtacacttcctcatttgtaccttatcacttttcgctaatttcattatatatacggttatgctacacgacatgtagcgtgctaggaatccaatggcgtgcctccaagctccttctcctctagttttcccttttttaaatcactaagatgatgccccgcaatttgctgtgagatatacgttagatagttgagaaatgatgaaatgatttggattgaaatattatgaaaatgatttgagaatgatgatttagcatatagatgtttagtttttgaatgaaataaattgtgatataattagtatatgtttgcatgttgagttttgatgtggcatgtttacatgtaggttttacgagtgctaataaatattatgtttatatgtttagctttaggtgtttagtggcattaactttatagaaagaagagatctgtggtcctatccccaccttttacgtgttttcttgttcttttcaccaccttttccatagcgcaaccaagctggatcgcctccctccctactgccgaaattacttccttttactaactcccaccatctatatccagtaaaagaattactatcagtggtagccgaacaaaaaagttactaacggtggttgtttccactttgttagggtctatgcaaatataaatattgctccaataaaataattactcatcattctttccagtaatatagttacttttcgttcttagtaaaaatattactgtcaattggtttataacttcgtaatgtatttactccgttttggcagtacagtattggtaggagcgtatgcatttagtatttcttttactataaaaaaacatgcaatctcacacaatcctgtgcaaataaaaagatgacatgtatcacacaacattaattaatggtgcgggcaatctagcttgtgcatgattataggtaccttgggatactaatgtaaatagaatctagcttgtgcatgattataagttcagtacaccgatctcatgtgcaaaaactgtagctattgcgatatagagtgatacaaatatttcttttgcaaatgccaagctgatagaactttatttaattaaggttgagcgtatgtgtgaagtgcctcgtggagattgctggcgcgcgacgcatagataaaataggagtggaagacatcagggaaaacaataatagtgcacaaagtacaggatgacattttaacgagttcgatctgccattttgttaagtttactggctgcattggtctgagctagctacaagagttcccttcagactagtatactgctaagccatagcttcatctttttgttctacttcttctcgtgcagttccatctaattatgcccatgctgaattgaaatgcaacaatcgagccttctttttttttaaaaaaaaataaatagccatctatgttcaggtataaacaatttaaaataacaacattctggacatgttcaattcgttgctaaaataaaacttaccatttgttggtaggcaacacatcaggtgaatacaaagcaaatcgtgcacacatgcacaaactccatctcaaatcgtccacctgatatgttgccttgttggtaaagctaaatttttgcttggccaataacatcgttgacaccttaccaaatttttatttcgatgtggttctgcgagtggatgttttggaattataaatgtatatacaatgatgaaagtaatatgttttatttataaaactaacaaattttggcaatgcaaatacaaagacctagaacaaaaaaaaacacacacacattttgactgaatttgaataaaatttgttggcttaaaaagtgaaaattttcaggtgaactagttttgtgaggggtttatgaaatttcgaacccttccacctcgatcctgtagcacgtccacacacgtgatttcagttgaaattctgagcctacaatggaatggcacacatgttttctctttgattctatttacatttttttttgcactaaacacttctaggcaccattgatcaagctcgagtactaaacttccagacgttgatttctcgaataaaattaatacttatgggtatgtttgcctaatgaatgccagtagtgctttttaactcgatttgtttttcttacactcagattcacatttttggccaaattattttctactgtttttttttcttttcagcaaatatagaggaagtactgttcagtacactggccattctaataaatgaacatcaaggttgagcatataaatgtgtgaactcactcatggcagagaatgaagttttttttttttgaatgcgcaaaaactttgtatgccaatatatttatatgtgtgtgaattttataggagtgaaagacatggaagaactgtagtactagtcaaaacatgcaggtgagaactattgcagagcaaatccctcagtgtgggagtcgtttcttgaaaagctgtgttactgtcttactggtaggctgcacaaggaagaagtcgtcacaatagatcagatatcatgaacatatatgatatatgaagtgatagttgcacggggaagaaggtagtgttgtactattatagttacaaccgcagttcaccagtagagattcaatattttttagagtcatatatattatagaaatagaagtggaaagcattgggtaaactaatactcctgcaaggtaacatctgttagaggtggtttgagggaaccacgagggcgtcagtcactaagaacatgtacaacgccttcagttagcagttgatgaccgatatggattgaacgcaccggcaaccaagtttggtgctccttagacaaggaaatttttttccatacagtagcatggtgagattggatgatcaacacaattcacagaggttgaagcaaagaataaacatggtgatttctttgacaagaaaatgcttgtacaacctttttagctgctgccgaagaaaaactaagtcaaataagcattggtatgaattctagcttgaggatagatggtcaaaattgttggtcaaggatgacaaaggagcacaagaatcattccattccgatcgaggctatctcatctagtcgtcttaccagtagggatgaaattttggtcaattttggtaattttgaacccccagccataaactatcttatccacaatttttgtatttttcaaaattttaatttggtcaaaatttattcaaattcagtcataactttattagattttcattatcttaaaaaaattgttaaataattttgtaccgaaattttctaaaatccctgaaattgtactcgtcattctgatatcaatattttttttcttttcattgtgcaattttcttttcggtatgcaatcaaatggtccgttagtaaattggatgttgtaaaactcgtccgaaatcaccattgaaaccaaacgcgaaataaacgtcatagaagatccaaacacggtgatgataccgagacacgatacttaataacagatttcagccgtagcctatatatacataacactgattacggatactcctccttggtccatcataattacaatgtattagatttacaacgaccctcagccagtcattgccggcagacgctccctcgcgcctataccaagtcatcacgagtttacaatagatgtgcctctctatttaagagagagcataggataaagtccaaacctaactctatcatatacatgtttcaacttcaagtcctaaactataaccgactatatacatacacatatttgacataaactttaacattgaaagtgttgcccgactatgagaatggtgttgtataaatagttgctataagtatagcactgaacagacctcatgctcctgtcttttacctgaaaaatagacataatagggatggaaggcatccaggaaaacccatactagttgtgaaacaatccaggagagttccaccatcagggctttggtgatcttggaagcagcttaagttagcttaggcaagttggaaccatcgtgctctttgaggattgatgctagtactaaatttgtccaagccttatagactaagaagcgatgacgaaaacaattacgaaatctgtgtcatagtattgtgatataataaaattgtgttagctacaacagcatatcatttaaacttctggtttttcatgtccacttcagccttaataagctagccgttgtggggctattttgactcaaattaaagtcatgttcctattcaccattttgcccagggttttcactttcgatttcaccgaaaatttaggccatttcagtagaaccaaaattcctgcaatttcatgattttttggtacttttggacctttttttttaatttttaacccaatttaactgaatatgactaaataattcaacaaaaatttatgaaaacccgaaaatttcgactgagataatgacttgctttggtggagggggtggttggggtgttccgaaattactgaaatttcaaaccagaattgcattcactcatttcggtacagcttctctgtttgttttactttcaccaagtacaattgtacacttgattaaattgcaccatgtgcaagagttacagtgatgtggggagtgatatattttcttttcaccttttgcaatgcccaactcataaattgggcacatcatatatgaagctagctagtgttgcgctgatgcttctcgaggatgtggtactgttgtagtgttgttgctgctgatgcatggcaccagtcaggccatctagtgaagtttaaggcatatcacatagaatgatagacaaatgcaaatagggttggaagttattgggaaaaccaatagcactgcgaagtaggcgcccaaatgggacatgaaaggacagcgcgacgggagggggactagtcttttgctctaggggcagaagaggttaggtcatgatgccgacgatgggaaaatgtatgacagggtcggccaaaacattctggagattggatgagatagaatttttgtggtgatgttaactattattagaaaactatatatcattagttgtcatcttaaatataaattctagattttaatttgggcttcagacttttcttgtgcacatacttgccggctttgtttcattcaaaggatttttgggcttcatatctttttttggtttttccattcggcaagtacaaacggtactctttactactacctccgtttcaggttataagtctttttagcattgcccatatttatatagatgctaatgaatctaggcacacatatatatctagattcattaacatatatatgaatgtgggcaatgctagaaagtcttataatatgaaacagaggaagtaattgctatatgtataccatgtgcaggaattactacatctaaagtgatgttattttttttaatgtgtgtacatttagtcttggctaataatttggttattaatggtgaaactgctatatatgtcaagtagtggatgcccatgcatagaagaggacggatatttttgcaagcaatggacaacaccatcaaagttcaagaggtttttattttcaagtatgcgcgataagaaatagaagtggaaggcattgggaatactgatactcctcccacccacaatgagtcagagatggtacaaggtgatcttcgatatcctgttactgcccgtacgtgaagatctctaataggacagaacgttataccgcttttgcttatgatcttcaaagcagaggcgtgtgctattgaaggcgattagcatgacatgtagcgtgtgcatctaaaacaacaatgccaaattagtgccaacacaaatgggcagaacagcgggcaacgctgtgcttctgactgcacagctaattgtaagagcaattctacggtccttgaggaggtaccatgaggtaccaaaaatttagtgtaaaattctggtacctcatggtacctcgtagtacctaggtaccacgaggtatcaatttacaatagaaaaagtggtatctcatagtacctcctcaaggaccgtaaaatggctctaattgtaattactacctgcacatttgctcaaattttatgtatcttggtataaacagaataaaagtatttatcatactttttttataccgaatgctgatattctgacgtatagataggtattatgtgttgtttgcaaataataaaccagtcagaatcagtatgattgcagccgtgcggtggagatagattgggagacggccagtggcctggtccagttcaacaatctttaggtaattcacccctgtaggttcccctacccccatctactattcctgtacgagtatccccattggcagaggaggtgccttccatctggtgcacgctcgttgctaggggtgggcattaaaaccgataaccgaagaccggacccgaaaaaaccgaaaccaaacccgaaaagaccgaactctcgggcatcggtcatttgttcgggtgtgacatctgaaagaccgaacaaacttcgaaagattcggtcatcgtgcaatactacccgaagaaaccgaggaccgaagaaaccgaggaccgaagaaaccaaatcaataccaatcactaaacagacaacgtgaccatcccatggaccaaaacagcccaacaacaaggtgaggcccaaatccacgtcaatgacccaatccctatgaccccaccattcgattgaccgaagcactcctaaccctagttagcccacgcgcatgtctccttccttccgcgccgctgtcttctgcagtactgccgcatgctgctactcgccggcgtcgccgcagtgtcgcatgcaatcgtgtggtcacgtggaagccataacaaggccacaggctgctggcttgctgatcctgctgcacagccgcatgccggccgctgtgccatcgcgtgccgtctgcgtcgcgcggctgatttctgccgcgtcgtcgccttccgtcccgccagcacttgtcaccatgcaatccatgctagtggatatccgtcccatgtgactgaggtggagccatggaggttttcaggagcaagaagacgagaagattgaagaggacgcacgttctggttcgagcacctcggtttagaccgaagaccgaaccaaattttcggttaaccgaagtagcggttagtaatttttgcttaacaacttcggtttcctgtttccaaagaccgaatttttaaaaaaccgaactaaccggaccgaaacttcggtctagtccgaatgcccacccctactcgttgcactgcctaggaacatcgtcaataatcttccttctcgccattgattggtgtgtgctatcttattttcgtaaaattcgtctaggaaagaacacagtcaatgttatctatcatgtgcatgcccggcatggcgtgtgtcatcggcgcgttgaagagtgcggtactggcacatgttggcagggtggtggtcgcggcgaggggaggatcacagcagcatagggagagccaagccggttggcgaccgggcttagagggaggcgacggtacatggagttatggacgaaggcaacttgatcaaacatattattttttaataggaatattggttaaaatccagcctctgtatatacccaaaagatgtgtacagccaaaactaatataagagtatttagactaaaaacttataaacctaatatcttgcgggactactatatgttgcacgtccttcatatcatgtttaggtccatttaatacataatacatgctgcataatgttgcagcccttttcctatacatctaaaatgggctaggagtcggatgtaagcttgagggtctatctggtatggggattctccctactactttgatcccacatgttgcatttatataaaaatacagtatttttttcatcgtgtatgtctattatctctgaatatgaaagaagagcagagaggtgaagacaagacaaggggaacctacagcacgtccatggaaaatttacatacaaatgagaggtttcactacacacagaacaggttgggaacccacaatagatgccggttttctgactcaaaccaatttggggtacctttgtccatccgtataggtgtagtgtaggtacatacgtaggattaggaagcatcgtgaagtaaagaatgtcacagctagtttgctgatcgtcaaaccttcagaatgaatccatcatagggtaggtctagttcacaagctatcctgagacctcgccgcacataatcacgtccaggtctctccacatgttgtttcttttctataagacgtctccaccataaagatgtcgtccgtcccattgaatttttatttttgttctgcgtgacattgtgtgctcacactgttgcatttgaacaaagagaacccacgtgcgggagtaattttcaaaatactccctccgtttcaaaatatttgacaccattgactttttagcacatgtttgaccgttcgtcttattcaaaaaaaattgttaaatatgtaaaactatatgtgtacataaaagtatatttaacaatgaatcaaatgatatgaaaagaataaataattacttaaattttttaaataagacgaatggtcaaacacgtattaaaaagttaacggtgttaaacattttgaaatggagggagtaatagcctgctatgcgttgttggccttcttatttgggagcccacgattgacacaacctgcttttcttcatagaccttttttaattcacatattttttcccactgaacaatgttctggcctagaaaaagaaattgataggttgaaactttacacatagcaattttcacataaactatatgcaacgaaacacgatgcatgaaaactttgtatatagaaacttcatatgtgtaaagttttggtatataattttttgcaagtgaattaaaaaaaataaataaaacagatgaggccccatatagcctagttactacttagtgggtcattgctttgttttttgcataggtgggccagtaggaaaaaaaacctaacgcaataaaaaattgc

SEQ ID NO: 66960 - DNA, 1904 bp, Oryza sativa
ttttttaaataagacgaacggtcaaacatatgctaaaaagtcaacggtgtcaaacattttgaaacggagggagtagttactacttagtgggccattgctttgtttttttgcatacgtgggctagtagaaaacaaaaacctaacgcaataaaaaaaagttgcacaaaggcccagaagcctgaccaaagaatacctctaacaccactcgtgttgaaaacatgagcccaaaagcaactacgcattcgctggtagctgaaagaacgaaaggggtgtccctttcttttttcttttttttttcatctgggccaaaaagggcattcagagcaatcaccgatgagccatttcatccacagagtgttattgaaacctaatgatatatagcctccatttttttcactataacacaactagtgggccctttgtgtggtagtcaaatcccaaaatcccagtccagcaagcagaggatctaatcaccaaacctaactaaccagcgtggcgaagatctataaaaatagagtgatgcccactgtcaggatgtatgccaagactgtaggggtgtgtgcacatacgattgggaagatacgtaaaacgaggtggcctattaagttgtgtttgggagtgagggttcccagcacgtaaaacgaagcagcctttagcgtgtgattaattaagttttagcaattttttttaaaaaaattgatcaatatgaattttttaagcaactttcgtatataaactttttaaaaaaaacgcaccatttagcagtttgaaaagcgtgtgagcggaaaacgatgagaaggggttgggaacctagacaaacgaaatgagccttagtgcatgattaattgagtattaattattttaaattttaaaaatagattaatatgatttttaaagcaattttctgatagaaattttttgcaacaaacacacaacgagagaaatattctctatcacctgctgccgaatgcagttagactcatacgattcagcatgtaccagacaatatcattatttctgaaaaaaatcctgcctttggaatcgtgatgattctgttccgacaaggtcgccatgtctatgaactgcactgctgtcgaggaaagacatctatatcttgtttgaattgcctgaatctcaggtgataattaagctagctgattccgtacttcgcggctacatgggtccattccttgaaggggtgattagccgtttccaggattctgtattacagcaggcaaagtagttatttgctcatcatctaatctacaagtgatccgccatccaaaccctgttctaaaacagtactattattatgacaaaagtaccatgcaatatcatctgtcatgtaacttcgtcgtgtcctcatttagttttgtcaaaactattgttatcgcatcctatatgaagtgtgcacattcttgagctagctacccattagtccatatcgaggtcaagaataatcatatacccattgggcgggtgctattggcgagatgaagaacgcgatggtggcacacaaagacgggggtggtcgcaccgaggagaggatctcgacatggaagagggagcccaaagagatgccacagagtacaacagggacatgggcgtgagtcaacaaccacgctatggaggaagccgacttagcgaaacctgatatctggcgagccaagtatacgtgctgcgtgtccttcataatatgtttaggccaatttaatataggcaacataatgttgcgatcctgtcctcatccatctgaaatggcatagatgcctattgtaacctgttgcgacttatctagtatgggcaccatttatcttaacacatatgctttattgactcaattttaaaatttatagcagatgaaaaccatatgcggacccacatatttatacttattaatacaaa

SEQ ID NO: 66961 - DNA, 3238 bp, Oryza sativa
actagggggagtaaagcgttatggaagcacatatatcagtgctagtctactctccagatcagtcggctaaaatgccaccggacagaaataaagtaaagatgcacgatgatggctgcaaactctaccatgaggaagagagacaacgggtcccacagaaggatcacatgtgcaaattcagttatggtagaaatgtgagctactgcagcattgtttcgtccatgtttagttttcaaatttgcaatttcccagtttagttaatttcatctctgtgtcgctgtctagtctatattttctggctgcattctcccaaactgccaaacatgttacatgaatttcgttgtataaagaaaataaaaagccttgtactattttcatttcctccgttctaagatttttttttccgctaggttacgtcgtacaatattaacagctcagatgttagtgttgcttaattcacaatttgcagagctacgctagttgaaaaaaatgtttttgcacgaacatatatatataacaaattgtaactaatgccactgctaataggttcatccagatgacacacatccaactttgctttctgtggagatgatacatctaactcaaatatggttaaactctgcatatctgctcacatacggttataaataaaacatagccgtgccaacatgcatgagcatcatgaagagggaaactcatgattttgcattgagaccatagcaacggaaaccatgggaaatgtggcatgtagacctacacatataggactgggaaacaccaggaatcaaaggagtgcactgtgattaggccaaccaagcctacccaagaatctgtgttgaggtagccaacataaaacttctctggttttactctaacacagccaaatgagtaggccatccaagctatgctgagagccccgcagcagtgtctgcatctttcgatcgatgagtatcaattgaacaagcgagtatttggtttgaatagcagattaggacagcaaaacgatcaccaaccaacggagcaacctgtactaaaggagatgtaacaaaatagaacagtgcccactgccgggattaagggaaatgcctgacaggattctctgacttaactacacatgcaattgagtcacagtcatatgaatatgaatcccactttgctataatccacatgtcagtgactcaactgcacaatagctaagtcagataatcccttttcgaggcactcatatgattatgttatcatatatgaatcacttattagtgttgttagttcgaaagattcaatttttttttgaacataatactatatctttatatataccagtcagcagtagcttgatggttgtcttaattgcaagtaacaaagcccaggccgaagcaacacatttatgtgtaacagaccctggtctgcagtagcttggtcaatttggtcagtaaacctataatgtattttagggctgtgaacctgtgatgcaattgcatgtacttgtttggttagtgacctataattaatttatggtcagttattctattatttggatatgtgactgggtttgtccatatgtatttacactgtattagatctccactgggttttgttggatattacctgtgcaataacctctgtgctatatggccatatgggttgttactgggtataatatttagacctatgtagtattttgaaatggacttaggctgcgttagcttgtgtgatatagggtgagaaaggacctcgttttctgcacgcatgcttcccaaactattaaacggtgtattttttaaaaaaatcttctataggaaagttgctttaaaaaatcatattaatccatttttgaaatttaaaatagttaatattcaattaatcatgcgctaatggctcacttcgttttgcgtatcttcccaatctccccaatctccttctcctcaaacacacccttagtccacttgttatttaccacttcaaatgaattaacaagttgggtgaacatattatgtaaattgctacatcttaactagatttatatctaactaggtttgcaattatatcgagctcataaacaggttgctcattttatggaccttcacatgccaataatgcgtaaatccctactctttagatgggtaggccaaaatttaaccgggattataattgggcttagcacataaacaacttgacaatagcatggctcttgacatggcacaagataatgtgtgacgtttcctaggttcgacaatgagaaaactaagagacataaactaaatgacatcgtcactagcttcataatggaaaaaaaagtgttttcatcacagaacatgattaaaaacacatgataggtgacgaaagaatttttgtcatgtcaacatcataggttttggaacgtggcatgtttttttagttttttgtgatgtaaatggagcatcacctatcataaaatttattgtgttgtgatatagctataaattgaatggttgttttggtctattgctcttaaaggaggtgactatattgattatccacatgacttgatgtgcatattgcatttgtcttcaacattaatgccctcaaaatatgggattactacacctaacctttaaaaaatctgagatttcaaaaacttggccggcgagagattattgacgctgtcaacgaggaagatcaacggtcttggcacgggcgacatgatcatgcataagaggcgagtacagtgatagagccggcggcaccgttaaaccctgacgagtaatagtgttttttgatgatcgactaattttaataggtgttaataaatatccgtagtgcaaacaacaatggtgaaacccccgtgcggccgctcaacctgcccgagaggtagctctgccatttgaggtgaccaaaccaacctcgcaacattgaacatccggtgtgagcaaaccaagtggcctgatgtgctccactacagtcccaatcccgcccatgcaagccgacatttatttgtatggccaaagcctcacagaatatcagtaggtcccaagattcttcatatcgtacctcaaatatcctgtccaatatgggccacatgttcatcgtaccaccattccggcccaacctatgccacacagtattagagaactgatcttttgacatggtacctaaaatcataaatatctcggttagattaaaaaccaatactagagatgctttagtaccggttctaaaattttcaaatcgtctctacatcctgtttcttgtgcatttaaag

SEQ ID NO: 66962 - DNA, 4727 bp, Oryza sativa
tcctgtacctgttgcatttaaagtccaagcccctggaaatatatttagttccggttagtattatcaaccgatattaaaaatgcatatttagtatcggttgatgttaccaaccgagactaaagatagaagatcaaaaagtctgggttggtgttaccaactggtattaaagattcatttttagtactgatgtgtgttatcaaccggtgttaaagatgccttcaaggtaagttcaaaaggaaagtatctctgttcaagttagatgtgtgtagtaggtgtgatggttacgtgtgagggctgaggtgagagatcttgacctcgaatcccacatcccacatattttttcacttgctatatatttttagtaccagctctgttgctacaactggtagaaaatgggggttgtaaatcaggactaaatatcagttctctagtagttgttacaacttgtggtttgcacattccggttcaacctaagccaacccatgcatgcatttattggccttgcaaataaactgatgatcaggagttgctacaatttctggtttgcgcattccggcccaacctaagccaacctatgcatgcattcacattggccttgcaaataaactgatgatcaggagcaagcaaatatttaaagtgatgaccgatgaagaaaatgttgctgcgaaaaagttctgaagttaagaacttctgaatatgtactcatgagacgagacagagaaatggaaggcatttggaaagccaatactgaccagagtttgagaaaaagctcgatcaaagggcctccaccaacttctctaggtttcctgggacttgcatgtgttctatttgtcatttgaatccaagaaacggagacatgcaactacgctcgtcatcaaatagtgttccttaattgatcaaggtttacgaaaagtgaagtgatcaaaattcgtttgagctcaatatgctaacaagcagggatctgtctcaaacttaattggattaattatacgtgattactgatcattgtggtttagctttgaacaaagatgacaaactgatttggcaggccatttcgctgcagccggcctaaaccaagcaagtaatttttttgagcggtccgagatcaattatgcaagcatataaccaagcaaatcaaagaaactattatctcattggaacacatgatttccaaacttgtttgtaacaaggatttttgacagatcatgctggttaattaggaagattctactaagtgtcaaattttccaaataatattgctatctcctcggctggctgtatttgcctgaactgccaaacatgcatttttaaaggtataagcaaaagaaaaatcatttccacaaataaaagcttagatgagttatgtctgactaaaatgttggggaatcaatccatttcaaacatttttttccttgaacttaaataaacaagattgtgattaacaacattgctactgctatatgcatatagcgaggtatttgaaaaattggcgctgctataaagggaaatgtcccctagctagctaaagtacgtattaatagatataaacatgcttattattagataaagaaacaaggaaatagaaaaagggaaactgagaagatcatatatgggcagcaggtaagctagctgtaacttttatttttagtcggaaaatcaaagtgtgtctaatgaattaccgataaccatttacggtaaaatacgaatgaaaagccattacccattttttcataagtagttcaaatgtacttgagctattaattcctcaatcatttttcatccaactattccacacgctttgtcagcatgccccttgctcagattcaaaaacattaaggacttagaattatggaatttataaccagggtctatgacggtacatcactgtagcattgttgcaatccttcttcaacagaatataaaatgagggtagataaacgaccaagaatatgcactactggagaaaccatctttgatcggtcgaacaaattccacaatagtcccggttgcaataaaaatagggactaaagttcaattggttagagctactttttaatctttagtcctgtcctggttggtaacaccaaccgggactaaagatcatttttacccccggttcaaaaaaaaacggcaggtgatgtcagacccctctattaattatttttagtcccggttgatattactaatcgagaaaaaaagatcggcatgcgcagagaagacgaggcgagcgcgcgagatcgaggaggaggaggcgcacgacataagttctatctcctcatccctcacctttatctcttcctcatctcctcactcaccccatcttcctcttcctcctccggatccgccccctcccctctccttcccattctcaggaggccgggtggcggcggcggtggcctcgcgcagcggcgaaggcggcctcgtgcggcggcggccggcacggaggccggtgtggcggcagccggtggaggtcggcgcgcctatcgggattttttttcttttttttcttttttccttaatgtgtaatttgatctgtattattgttgtgaatgattttgagaatgaactatgttgttgtcaatgatttgggatgaactatatacgttgctttgaatgatttaagataatgggcgtgagatatacaaaatagcaaaaaaagaaaaaaaaactttaatcccggttggtaacgatcttactcccggttgaaaaaccgggactataggaggttaccaaccaggagtaaaaatcatttctccaccagtgacgacagctgagaacttctttatatatgagattttcatagcaacaacagtttcggtggcataaccaaacttatatgattgggaggcaccaggaagcgaaggagcgcagtatcacttggcgaatcatccaagcccaaataagtagcagcattgtgtttgccaacacgaggtgcgataaaatctctatgattaacaactgcatctttctttgccactcgaacgaggagaccatacctcatggagggcaattgagagcagacgacacacaccaaactggactagccagcttgtgcagtttgtatcaaaacataatgatgcacactgccagggtgaagggaaggctggggttatggtcagcttggatttccggtgatatcgatggacactccgactccaaggacctttcttaggaccaaaaggttttgtaggtagagtgtagtaccgtgtaccacgcaatactttttcttcgcaatattgaacaatttgttgattttgtattagtaggagcagaaaacgtttataagtttgtttacaacatcccgtcgcaccaagatatataatgatccatagccatcgcgaaaactctgttccaatgagccgtatgtgtctatgaacaagtcatgcaatgatgtggagggaagccatgtatcttatttcaattgcccacatcctaggcgatcagcttaccaattccatactttggctatcaggcattttcaggttcctgtagcacagcaaacaaaagtaattattcggctaccctctcttcttcaagagatctaatatccaaaccatgttctaaaagaggacaattattttgacaaaagtaacatgcaatacgattagtcctgtaacatcatggtatcctgatttagttttgttaaaatccatcacaatcatgacctatgttactagaacgggatcggttatctctaacgggcttaaacatcatctctttcgggcatgacccccgtgactaagcaaaggtcagtgacgtgagaaaatatctcaatcgggcaaccggtcatcacggatgacacacatctcaatcgtgccaacacaaaagcttgtcacggatgactctcatctctaacgggcctaaattatagcccatcacggatgactctcatctctaacgggtctaaattatagctcgtcacggatgagtataatcaaaaaaaataaattttgtttttttgttcgcctcaagcctttgacctcactcgtgtgcacccgggaagaacttctatgtcagtcacccatcccaaaattgctctagaacaagcacgtttaacctcatagttctttgaagattggcttccggaaaatatattgtaacttgttggcatgagtattatattaatcctataaagccctgggccagtatgacacaccctagcatcccatctattcataaacatttattcacatacacaaccatcaatatatttaacacaatcgcattcacataatatctattttgatcacatatttcactagtaaaactgagttaattggatcaaatatatattttgcaagtattatcatgaggaggaggcaaatcagacttctagacaaaaacgaattttgaattgaattttacaatactaaatgaacttatataaaaaagatgtcaaaaataaatttgtagaactcattgagatctaccaattttatttttgtcatttctccatccggtcttgatttaactatataaaatttgaatttcaaaatataagaaatttaaatattttttcgggtagtaaatgatttcaaatggaaaaattatcaacaacaaagttgtataactcatcaagttctataacttttactttggtcttgtttctatataaaatttgttgaacaatttgaatttgaatttgaaaatacgacaacctcaaaaaatattttcaaatactaaatgatttcaactgaaaaagtcatcaacaaaaaagttgtataact

SEQ ID NO: 66963 - DNA, 1735 bp, Oryza sativa
gcgcaatgaacagtgacttttcttatttatcccgattttagtgtattttccatctaaatttgattccacaattcctaattttacatatatgcattttactcaatattcgtgttatcttaactaatgaattcaccctagattaatattactcatattttatttttatataatttatttgagttttaattagggttaattcttattccatcgcaatgaaatttaattgatccaaatatggtcgcgataatattttatttattactatccacacctaatctttatttttaatttatatttattttaccaatttgtttttaaggtttatttctaattaactattctttactcacgattaataatcttcgagatcaactccagataaaatagacgaataagatcggcatgatgcaattagtttaaaaagtttttgaaaatccgtatttttagagttttggttttgtcggtcgaattttcagggtgttacaatattttaatgataataacttgataaatataattattttctagttaatcacactaataaaagagtagaaaataattaaaataaatatattgtgctaaaacatgctaatttgttgtgtaaatagatactaatatatatatttatctattagtttattatatcaataaggtgaacatgtaatataaactatacacaatcaagctcggtcaagctcggtagaagctcgagctcggctcagtaaagctcgtgagcttttgctcaggcttgggttcggtttgtttggagctcgagccgagctcgaatcgagcctaagacaagccaagctcgagctcctcgcgagcctcgagcttttttgacagccctacatcgaggggaggatatggagaaagcagaagtggccttgcgggctgggatgctgccgagtctagcatagacaggggacatgagtcaccaactaggctcagaggaggcagcatatggacaaagccgacttggcaaaacttgacatctggtgaaaaaatgctacactagtacagatccttctatctgtggggcctctaatatgcctacaaatagcgggccatcacaaggaagtcatttcaatcgggccgaaaagtgcccgattgagatatggtcacacagacatgttagatgggtataatacttaagcccgtcacggatgacacctatcagtgactggccatagtttaggcccgattgagataacattccatatctcaaacgggcctaaatttacggcccgtcacaaatgaccatcatctgtggcgggcaccaactttaggcccgattgagataacatttcatatctcaaacgggcctcaagttggggcccgtcatagatgaccatcatccgtgacgtgtaccaacttgaggcccgtttgagataacaactaggcccgtcacagatgactcatcagtgacgggctatatactaatgcccgattgagatgacttaatctctatcgggcaataactaaagcccgtcaacgatgagtatttttccatttttcatatgaaatatttatatttgtaagttgaactatagctaaataattaagtgcaatataataattcattttatgagtcaaaataattttacgggtagtaaatgatttcaaatggaaaaaatgtcaacaacaaagttgtataacttatcaagatttacaacatttagtttggttatttttctatataacattttttgaatagtttgaaattgaatttgaaaat

SEQ ID NO: 66964 - DNA, 1696 bp, Oryza sativa
taagctatatatatatgtgtgtgtgaagtgatgtatgctagagttagtgtaatattactgcagcaggtgcctatatatattgctccagtgaagatttagttttttttttccatacatgaacaatttagaaatggaagtgaaaggcattgggaaaactaatgctcctacgacatggatgggtcgagatgttctttgacagtacttcgacgttgatagtagggatttgacatgagccacaaagctggccatatatgccttctaagcgtatgagtgtgtcatcgaatttagagtgacctgtttagaatatgggagaaaaactgcaatgacaaatgatgggaaaatggccatatagtgctgtgctggtgctgagatgaaattccattcatttatcttgagggtataaacagaagaaaatagtagtatatttctatatgctttgtgctgagattttgatgaaaagtaaggagtacatgttgtttgctaataatatatcaatcacgagtcagtacagttacacaaatgcttcgctaagaaagaactattattaggtaaatctagtacattcatgtcacttcgtattcgtaatatctttgatccgagctacaagatagtaaattaagttcgtataaatatgcgaaacacagtgctgttgctaagaatacttttcccaagatattattttccttttctgcataacacatttatctttgcagctgtctaaatcctgcactacaccatgccattgtgacacgaattaagcttgcaaagttctttttctgcggaattctcagctaacatggcgtttccgaaccagcctggcagtgacttttttttttttttgaaagaactacggtaggggaagcccccaccgttaagattttatattaataaaggggaaaaaattacaacaaatttaaccactgtaataatgtatctctctcagaatttttgactctatgaactaaaagggagagatcattcctaaagagaactctccaagagggaacagagggaacaatgttttcaaaaattaaactattcctctgcttccaaatgttccaagcagcataaagcaccttctcaacaaaatgggtagagttatatgaatttctggccgtgatcaacatttcaccaaagcttaaagaaagattccaaaccacaccaaattgcacccaacattgagtgctaaaaggacactggaaaaataagtggagagttgtttcccttgatcctgttgaacaaagtacacagagcaaggaagcattttgaggggagcaacgccttctgtctaacatgtcataagtatttaaccgatcaatcaagaggagccaaccaaacaccttgactttcatagtacaactgctcttccaaatccatttaatataaacaggcacatagacatgagaaaaattcatggcataaattttctgtgaagaaaaaataccgttgccccaaacatatgtccaacgatcactctcatcattaagatgctccaaggtatctgcagctgacattgccaaatattcctgaaaagcttgctctgaaagtggcaaggcaaagagctgaggtagatcagaagtagagaacatcaaaactgagagatttgaattcctagcaaaagaatatattctatgataaaccaagtccctgactttattgttccacaaatcttcccaaaacaaacaagattttccat

SEQ ID NO: 66965 - DNA, 2849 bp, Oryza sativa
cactcgcgtgcttgctttactctgtttggggctgagtttaggtttgatatgaatgcctaagtttggattgaatatggtgaaaatagataaactataataataaaaggtttcttgaccgggttcctgggcaccccctctctttaatgtagctccgcccctgcccagattcaaaacaacttaagttttgcatcttataagaagggtatcaatggtgtatcatatatagtagaacattatttttgcatctatattgcatctactagttgaacacagataaaaagagggggaggggaggagcaagagtaggacaaccgaagacttctgtatgatattttcataatattcgtaggttcagtgttttcgctaggatgataaatacatatttagggcgctttgattcaaaggaaatttataggaattttagaggatttcatttctataggaatttttcctataaaaccctttgaatcaaagaaatgaaccctatggaattctatgaaattcctatggaatgcctcttcccgtacaagttttggaggaattttaacaagaggtagaacctcatggaagaaatcctttgagtctttatctttcctcaaattcctgtgtttttcctgtggtccaatcaaacggtcattcctatgtttttcctgtgttttagaatcctctgttttacacttgcattcctgtcagaatcctatgttttttctattcctccgttttttcattcctataattcaaaggggtccttaggattgggaggcacaggaagcaaatgagcgcattatgtcttgacgaatcaaccaagcgtgaacaagtagcagcatcctgttattgaattctggatgcagtaaaaactctcgggttttactctaacagtacaactgcctcttggaatgggcgttgaacaagggatgattgcacaacatggaggacagttgacagcaacacaaaagcagcaacggaacccgaataaggcttcagtagtgtaaaatggaaggttcatgctactgggacaaaggaaaggcgactttctccaggttggctggatgcatggtgagacacacttcgactccaaggatttttttccaaggattacatggacggacatgtggcagctagatgcattcgtccaaatatttgatgtgacaggtaaaatatttttttttaattcattcatattgtacttactgcagcagcagcttgacatgtctgtacagtctgacattcagtataatttcgcaggactgaccggttctttgactccggaggcgaattagagacaaatgaacaatttaagtgtctttatgagtgggtaaatcatcctttctttttataaaaaatcatcctattaattatgtacataactttctttttaatgtatactagttgtacaaccacgcattgttgtgggatattttttttataggttactttattttattcactacataaagtacatcccatgtagtcgcgtgtgacacttgttgagttgttatccaaaattatttgcacttaataaaaggccagcttctgccgtagtggagcggaggcccgtcgccgggaggcttgggctggagcgtagcggatcgtcatcccttttagggttccaccatatatatacctcttgtaagccgccgtgcggcgttgtaacctcaccccagatatagtgaagatattttgctggctggcgcccgtggatttttctctcatgttttgggagggtttttcacgttaaatctcgtgtcttctgtgattgatctattgttttttatcgtttgttcgcttatcgtttcctaacaacactgtggttaaaggatatatatatatagtaaaaatattgaattttctaccctaaataacttaattagggtagtaaaatagtttaccccaaactaccaagattcctcctcccatgtgatgtgccttgactagtacaaacatctgcatcctagaaataacacacaaggttagggaattaagtcaactggtattgatagttttggggttaaataagccaaaaaataacttaggatgtaaactggactaccaaaatagttcgggtagggaatggaacctttttcttctgtgggatatatcaacctttttgcattattcttttcttagctctttttccctttcagctaattactacatcatgtgcaaataaaagtcatatacaaagttatatttattctgcatttaattcagtagtgctttgctagctactccctccgtctcaaaatataagtatttttaaacttcaacacagtattcgagatattactttgaccaacaatatctataaaagtaaaatattttaaataaaaagagttgaatattatgatagtttgtttaatcataaatctagtaatatcaattttatataattgatctttttttaattaatagtcaaagttaaaaatgtttgactttacactatgctaaaatgcttatattttgggacagatggagtaataaattgcatatgacaggatatgcatataggagtatgtgaagtgatcatgcatccaagaggaaggaaaagggtttgtaacatttatggaaccgatatgatatgcatagcaccagtagagatttagaaatggaagtggaaggcatcgggaaaactaatgctcctaccaacatatgatggagatgggttgagatgattttccacagtttgagtttgccattgaggatcttacctaaaccagaaagccggccatgccttccatgcgtaacattagtggagaatgccccatctctcccggttcgcaacaccgggaggaggaatccgggactaaagatcgtcatttttactgccgtttaatacccaggagtagaga

SEQ ID NO: 66966 - DNA, 2599 bp, Oryza sativa
taagagggaaaaaaggaaaaaaaaaaagaaaaacgtccacgccgccgcctgccgcccggcggccaccgcggcccctccgtgtccgcgccgccgcttgccgcccggtggccaccacggcccctttgcgtccgtgccgccgcctgccgaccaacggccgccgcggcccctcctcgtccgcaccgccgcctgctgcccggtggatgccgcgccccttcacgtccgcgccactgcctgccacccgacggctgctgcggcccctctgcgtccgcgccgccgccgcccgccactaagcgctagttcaccactcctcagccgctcactcgcttgccactagaagaagaacacgacttagtagctaggataaagaaaagaaaatagagaggacaagaaaagagaggagaagggaagagtagttgctagagaataagtgcaaaggattatatactatgcgccaatttttagtcccggttggtgtttccaaccgggaataaaaagagtaggggacgaccactttttcatccaggactaaaaagatctttagccgcggttggtgttaccaaccgagactaaagattataaaagggcttgtaagatcaaacagaaaaaactaagccaaccagagggggtgaatgattggagtacccaaaaaccaaaacttttagcgaaattaaaagttatcctcaattcgattcagatcggtctgaccgaggttgatctaccggtctgaccgcgcctttgccatcggaatgaccaatatagattgcccggtctaatcgtcccgaagtcgccttgcctcctaacgccaccgccggtctgaccgccggtatctcgccggttagaccgccaagcccgagcaaatacaatttaaagaactctcagagtagatgacaacattattacttctctatgtgtttagaaagtgcaacaacagcacaccacatggaaactcgactaaactcaaaaccgtaactaaactcacaactcaatgctctaaaaaatgatacagggaggccacaccttccctctctatttatacatgaggtaggcagcctaaagccacgaatcaaactcgtacaagaagtcctaatccacctaggaaaccttcccgtacaagaaaccaactttacatactccaatcataccaaatttggactccttccaaattcgactccgcatcccatacgcacacacaatatctccatcatatgccatatggaatcttcaccaaccacgtgcattgatctttagccaatgtatcccgcatgctatctgatcgtctggacgtcgtcttatctccaagtcgactcccgatcattcaccggcaatactctcccgaggcatcaagacacctacacatgaatcaaacaaagaaatcatattctaagactaagatatctccaacttgactcatttttagcaaacaacaagtattagcatagcaaaagcatgccacgggagtatgccaaagccaagagcagagccgcggaaaggcccaagagagctggagcaccagaggtccgagaccgagaccagcactgtgggcctggccagagtactgaccgctcgatgcgcacaggtctgaccggaccaaaactccagcagtaccttttcatcacctataaaatccaatcatctccaaaaccactccgccgataatctccaaatatcaaaaccaataatcacatatgccaattgttcatcacagaataagaatcaaacatactttgattttacaaccggggctaaagatgatttttagtcccaattctctttagaaccggggctattaaggttttaggtcgacccagcaaagatcagctctcagtagtgtaagagaaacagaaaggagtgtgtcatggaaattagcacaaattgtagcatgagcagctgaaactgcaacgacacatagtaccacggggaatacctctgatcctgctatgatgttgaattgaatttactttgtgttttgtgctgagatttgacctaaattaaggagtatatgttgtttaatttggtaatggcatatatcaaccatgactgatcaatacagttacacagatgctattctaagaatgaacttttaggtaaaacctagtatgttcatatcatttcctagtgtattgattggatcaaaaacaaaaatcctttgagttggtcgaccgatggagaaaaaaataagcgggcgctctcctgaccaatcatcctctatccccctctgcattcttatccattcccttcctcccctcttgctctctttctctcccactctgtattctctccggcgcaggagggtatgcggagggcacagctggcggtggctttgctggcgtggcgggggacggtgcggatggggtggcaggtggcggtgctgagggagtgatcgacgtcgtgggcatcagcgacagaggcacgtcgatggggtggcaggaggcggggttgtgttgtttgcagcgggtgctaccggcagcgaggtcagcgccggtgtggtggtcttcggcgatatctcgcgacttcttccggagtagacaccgtcatggggaggggatgcggagagcacaaccggcggtgccttcactagcgcgggcgggggacggttgtc

SEQ ID NO: 66967 - DNA, 4643 bp, Oryza sativa
catatatgggacattgttaggactggaaggcaaatcaaaggataatttacaagcacgcttggacctacaagaaatgaatataaggccagatttgcatcccataagaaaagctaataataagtattatttgcctcctgctttctatacaatgtctaaacgggagaaacatcaattttgcaaagttctccatgatattaaggttccagatggctatgcaggaaacatctcaaaatgtataaatgttagtcaagggaaaatttcaggtcttaaaagtcatgactgtcatattctaatgcaagaacttctcccagttgctttgcggggtgtgcttccttacaatgtcacttctgtcttatttgatctatgtggatattttagagaactgagttcaaaagtcctgtacattgatgtgcttgacaagttagaggaacaaattaaaatgacattatgtcgtttggagatgatatttccaccagttttttttaccattatggtgcacttggttgttcatttagccactgaagcaaaattaggaggtcctgtgtgttaccgatgtatgtattttgtggaaaggtacatttctctcacaaatataatttcatttgttatctagtatagaaattttaacatttttaatctttctctttatttatgtaggtatttgagtgtattaaagtcatatgtgcgtaataaggcacatcctgaaggatgtattgcagaagcatatttggcagatgagtgtatgacattttgttcaagatatcttgaaggttttgagacaaagcataaccagcctacacgaaatgatgataatgatgagtcagttgcatgttcagatgatgaatgcacaccatatctttttcctcatgttggaaaaccacttggcaagccgagaagttatgttattaggggcttgactaaaatgcaagcacatagatatgtgctcttcaactgtccagatgtcaacccataccttcggtattagctcaagatcatacacttcatcactaatcattttcttcaaagcatacttcatgacactttttccttttacagaactcatgttgatgagattagaagaacatatcggcaaggccgcatcaccccaaagattatcgagcgtatccaaaatgaaaaattccatgaatggttcagagctcatgtaagtttcgtgttattatcatttagatcaacaaataaaatcatgactaagtaatcctatgtacacagataatggatctagagaggaaaaatggcatatgcagtgtcaagaatgatcatagatggctggctcgtggtccgattggtccagcaaaaagatatcgtgctttcaatacccgtggcttccggtttaggcctaaacatttggatggagtgacacagaatagcggagttgtcctaagtgcaaaaacatccagttatactaaatcaagtgacacaaatccaatattgggtgatctaacatactatggtagagtcatcgatattattgagctaaattactctggacaattttcagtagtactgtttaaatgtgaatgggttgatgttgtttctggaaaaggagttaaaaaagataagtatggttacacactagttaacttctcacatctcatacatactggagaaaaagttgagcatgagccttttattttccccaatcaagcagatcaagtttattatgtcgatgatccaatgaatcctgggtggtctgtggtaaggaagaacaaacctagagatatatatgacattggtgaggatgaatgggcaggtgacatagaaattgagccattccatgtttcacaccttggtggaatgtccagtaatgcaaacaattacaagcaatgggttagaacagatgttgaaggaacaacagtagatgttgataataatgctttgaataatgaaggataacagaggaaaatagttactctttcatgatttatttcattacttcaaggtatatgcaattccctgatctaaaaccttctgatggattaattcttgttagcaaaggtgcttccagttttagaactatcgaaaactctatccaactgaatgcatctaaatccaacaatatttatggtcttttaatttaacttttctgcctttttggtgtacggtacaactattaggtccactggttaagtatgatcttacattatgttcttgtgagaaatatgattacaagcgtagtggatgaataatttgtggttaccttggctattctttctattaaaagatagcaataatcgttgtgtttatatttatttctgattgattaaaacctgttcatgcatgttcatgtccattctttgctctatattgtttagtttcaggtccattattttgatgcagacgcagttacattggcaaggtatctgtctttctagattctattgatcagctcgctatctccatgtcttctttaacaacaaaagaaatgtcatgtctttgctgatgaacttggtttcttttcctacatggccaggtggcatcagggtgttactgtttctttcggcaagcgaaagtgaacaagcagctgtcactaaccaacatatggcagttctagtccaagcaaacatgagtttaggccagtcttcagtagtcaataataattcccaatgtagtctatatgtatagattattttaaatttgttcgtgtgagcttttccttttctactgctatattgattagtcctgtaatcatgtctgggttatgtgatctctctagcatcttgttttttaccatattactgaaatgattattctttcatattgccgaaatgattattcttccatttttttttctaagttcatgatgtaagacaaaaagattctgtgcaaatacctcagctacattgtagcaattttgtgattaaatatttttatacacatgtcatggatcagactcactcgctaaattaaaaaataaatccaaggagttatgaaccaagcccacagcctcatctataaattctgcatgctttctcactgtgcttgtggtacttttataacttgagtccagccatcctttttttatatataaaatgggcattggtcaacccaatgaatgcttggttcattgatcaaaccacaattcctaaaaataaagtgtacgcatgtgtgtataaaattaaatttcttaaaatttgattaatgcaaaaaaaaacaagtacaataatttacaactaatgacacaaatgtttgcttgcccagttggctagtctggtgcgattcttgtgtatttacacaggaggttaggagttcaactcctctgttaggcacgttagttgttttagaaagcaacccaagtactttttatgcgattagataatgttacatcactatgttaaataaacccatggcaccaatatattatccaaccctagtactttttatgtgattagataatgttacatcactatgttaaataaacctataataaaccaaggcaccaatatattatcccaaactaaatctgttttaattacatagcgcaacacagagttactataggtggtagtaacaatgaattggtgttactatatgtataccaactgtaacatattggaaatatgttacaacctttttttcaacacataaggtttcgttgctatagcattcgccagtaacacatctccgaatgtgttacaaaatagtgttacagaatgtcagttctgacgtagtgtcatcccttgtctccatttaattttatcagatggtgattgatagcacactaaaataataacaccacaattggtaaactttttccccctctctcaggtgtgataatactgttgtaagtactgattgaaaagagagaaactaaatgttgtaagaaatagttgaaactcaagggaaagaaattctgaattagttctaatcaggccggatcgagatctagtgactaaggctgttggtttcttcaccacgttggcttcatcgccacccgttatcgcagccgcgccaccagctgcagccacgaatctcgtcgcccactggcgtcccacccacctctctccagggctcacttctccctatcataggagcaaacatatatagtgcgcatgaagtgaaggatttggcatgaattcagtggatgtcactgatctaattgcacatacacattattaagaatgcacatattgcattgagtaaatttcacaaaatctcagagtttgcaatggatatctaaggtcgcactttactaattgataatgtaattcctatgtaacattttgatcctaattaagaaaggtccttttgtagaagtccgagtacgtgtctcaccacctagccaacttgagaacgctggccacgtcgctggctgagccatctttagtcccggttggactaaaaagagggtagcggcaatccctcgaggtccccttttctttttttttcattgttaatttgctattggctagagttaatccttgtattttctcccaaattgagtaggatgcgtatccccaaatcaaaccccaaatcattaacatcacaaatcctaagttatacacacaaatcaaatacatcacaaatcctataagtaattatacacaaatcaaatacatcacagattatacatctcagatccatacaatgaatgacaaattctagaaattatacattcagtgaat

SEQ ID NO: 66968 - DNA, 1244 bp, Oryza sativa
cccggttggtaactccaaccggaactaaagataaatctttactcccggttggtactatcaaccgggactaaagatcctcggccgctgacaggcttctgacagggatgaaccaggactaaagatgatttttagtcccggttggtaactccaaccaggactaaagatgattttttttttaactgggacaaaaatattctctagtcccggttctaaagaaccaggactattatggaaatcgttcgactctccaaagatcacttattctccagtagtgtgccttccactgcattttctaatttttagggtccaaactgccccccttcgttgttcatctcctcatcttctcaccaatctctctcgtattcatcgatctccctgtacactgcccccttctgtgtggcctccggcagcggccactcggcggcgccagcgacgtcgccacacgacggtcagcctctatgccaagaacggattggagaccgttggcatgccatgtaggacggcaaggatgggagctcatggaagccagaaaggagtcatgtcccgccggcagttgtattagagtttttagtccatctgaagatctctaccataagggtgctatttcattaggattggatggttggccaacacatagtggacgcctttgcttcctggtgcctctctatcctacttcgggaagcacggagcctgttaatgctatgaaaatatcacagagaacgaagttcccggttcaccgttcatattcttcctcctctcatcttccacctgcttttcacgtatgttgaagtggaagatgcaataaagtcaaaaataatgtacaaatatatggtgtactccctccgtactcgtaaaggaagtcgtttaggacaacgacacatacggtctccaaaacacaactttgacttcttgtttctataaaaatatttatttaaaagtgatatatgtatacttttatgaaagtatttttcaagacaaatctattcatataatttttacctttttaaactcaataacttgggagttatttatgatttatattcccaaggtttgacttaaacattgtcctaaacgactttttttacgagtatggagggagtacatctttgtgtttttaatatgacagtaataacatcaccgcatggccggttaagaaggccatatctgtgctagtgttatagcttctaaattagtagagtacactacagaaaagaaacttttgcatgcttcatgtcacaaatagt

SEQ ID NO: 66969 - DNA, 842 bp, Oryza sativa
gccatccgggcctatctgatcccatcagccgcagattttccaaacatcgatcccattccacaacagcaattatacaaagtagtagtcaaacaaaactacgctagggatcacctcacatccgcccatgaccgtgggcacggctgttctaacagtttaataacctctgcagagggggtacactttacccacacgacattactaacccggatcacccagctcatgcagaacagccacgtctggagaccttgaggcattcatgacaaggcatttcgaaagccgacacaggttcaccatatgccaacgagaggggtcccagactgacatcaggttaggtcccagaccatactatgccaggaagcccgggggttctcctcggcaccaccccgttgaatccacatgtctcttggcatcatggctccctcggtctgtggttttggaaattcatttagttcgcaagcaccgacccaggtgtcgggtattccaagtcttttgtaaaaccccaagttttacccatcgttggatattttaaattagaggggaggtgttccgatgcccgtgcccgaaggccagtgcatcgaagcacaacagttgacaaaggaggtttaagtgttcaataattcacagagggtaattgcagcaattaggattcgggccggcaggctatctaacaagccgcggccgaattactgtgtttaacctattcatgcaacatttgtggaaaagaaatacttagatttaaattataggtgcaagatgatcaaaggtgacttgccttgctcgagatcttgagctcgatcctcgaaatcctcgcactgcgggtctgcgggctctgaaactacacg

SEQ ID NO: 66970 - DNA, 5565 bp, Oryza sativa
gagccgacgccgagccgagcgctctccccctctctcgttctctctgcccgctccatccccggcaagctccccgccgcgttttcgagttccccgcgcaccgttgcctcgcacgcgcgccctcgcggtcgccgcccttgccacgcctgcgccgcctagccgctgctctgccgcgccctgccccgcgagccagcgcgcgtgcccgagccacgccgcctgcatctgtccaaaaaccggaggcagcgcctcccgctcccatctctctccctccccaaaccggcatggcgcgagctccctttctccccctccgtttctccctttcccctctcggcccagcccctgcttcctccgttctgttcccgctccaaggacgcagaggagcagccgcgccagccgtcgcccctgccgtttgaccacgcccgtgaacccatcccttcccctcgaagctccctcaccccagtgccgctcgaggtcggtttcctctcctcccgaaccgacatagccaccacttaaaaggcgcccctcgtccgtgccctgttcgccgtcgcctttcgccgttgcgtgtgccggagtagccggtgcgcgctaggaacagaaggggactccaggcgtacgtcttccttctcttccccggcccgaggccgtagcgatcacgccccgcgccgtcagccatcgtcatagcgccctcctctgcagtggtagtgcatcttctccgttctccttcctcgctccatctcctccccttagactcgggtagtagctcgagtagaccccccgtagctagctggcgccgccccaagccttgcggccacccgctgtgtgctcgccgccgttgccacccgagctcagtagcgcctctcgtcgccggccatgctcggcgtagctccgcccaatccgacgcaagaaacagactctggtggccgagtagatgctctggtctggaggaatcgaactcccatcgcgccgtcgccgtttcccccttttctcgccgccggatgccgccgccgcaatccgccaccgtcgagcatcccccagcaaatccgagccgttggcccgtcccctctcaacccgtgctacctcccagtgtgctcacttttgcctgtaccgccgtagttcgccccgccgtttgcagccgccgtccgccatccgttccggccgacgccttcttcaacctcccgccggcccgcgtggcagccacgtaggtgccacgtcggcgccacctcggctaggaccgggtcaacccgacctcggcccgccgctcccttccgccccgcttgcgcgcgcggtccaccgcgagccgtgaggctacgcgtgggcccgccgcatccgcgtcctccgcgagccgcgcgcgtgcaccgcgcccccctccgaaccctagcgccgcgctacctgctccccgctcacggtgagctgagccgccgacaagcgggtcccactcggggccacgcaaggtggacccggcccaccggttccccctccctctctcacctcgcgtgcccttgggctgccttctcgggccggccggcccatttagctcggccgagccgcccttttctctcgggccgcgccctagccgcccgagggaagtctatttcccctccctctttcttttctttttccaaaagggtttaattaaatcctttttcctttagatcaaaaatccaataatcttagaaattcaatatcttctcaaccgtacatccgattcactccgttcaacttccaaaattcctcaaatctcgagatctatctaatggcacacttagaggtcaataatagggctttgttttcgccgtttgttgagttgtcccgtttcacgtgtagtttcgaagcccgaagacccgcagtgtgaggatttcgacgatcgagctcaagatctcgagcaaggcaagtcacctttgatcatattgcacctataattaaaatctaagtatttattttccgcaaatgttgcatgaatatgttaaacacaagtaattcggccgcggcttgtgagatagcctgccggccccaatcgtaattgctgcaattaccctccgtgaattattgaacacttaaacgtttcttcgactgaggagccgactacaggaggcagccaggcaggcgaggagtagaggaggccgtctttagcagttttccgtgtgttaggccccttttgtgccgccgccaactcttttggagtcgtggcgaggtagtgcgtgcgtgtgtttgatgtggatgttgtatggtagtctggattctcctaggaggtgtgcgtatagtcaagctcggcgtagctctgtgacttgtccacacccgttgtatcaggtgtctttatgatttgagaaatccagtttatgcctagtatgtgctatctgagttgttatttattttgcttcttgtcttccttaagtgcttatctgttgcttatctcgcccttttctgggagtttagatggctagccgccccaccgcgctgctcgtgcaccagcccgcttcggttttgaggaaggtagagttgagccagaagcagatcatgagtcagctaatgagcagtctcaccacagcaaccgttcgcaccgtactgcttcccgcaatgcagaagttgagcaatcccaccgcagcaaccgctcgcatcgcatagtttcccgtaatgcagaagtggaatagtctcaccgctctcaccgctctgtcggtcacaattctggtgaagaacgcattccttcaccaccccatgttgagaataacatgcagcacttgatggcagttcagactcaaatcttgcaaggtttagccacagctatagccggtattcagcacaacgcgcatggaaatggccaccctcacatgggcaacaatagatccaagctgacagactttctgaggtctcgtccgccagagttctctcagaccgtcaagcccgttgaggctggcgattggctaaaggatgttgagagaaaactcaacttagtgcagtgtattcctattgagaagacggtctacgcctctcaccagctaagaggacctgctgcagattggtgggagaattactgcaatgcacaccccgaacccactaacattccatggaatgagttcgctgcagcttttcgtgtagctcatgtgcctaaaagcactattgacatgaagaaggaagaatttatcaggctcaagcaaggcaatagcagtgtcaatgagtatctgagtcagttcaacaagttggctcgatacgctcctgaagaagtggacacagacaagaagaagatcaggaagttcttgaaaggagtcacagttggaatgagactccagttgcttgctcatgacttccccacctttcagcacatgatcaacaaggcacttccacttgaggatgccagaaaagaggctactgaagaatataagaaacgcaagtctacccatcaagggaattcttcccgaggtgcaccccaccctcgctttggtcagcctaagcagtatcaccagtcggtcactcaggctaaccgccagccaggctatgcccctcgccctcagatgaaccgtccagcacctccgccgcagcagcgtgccccaagtggcaatattgcgccaaacagtgttacctctttcaagtcaccaccaggactgtcaaccgtacagtgtttccggtgggacaagatgggtcactctgctagacagtgccctcagaatcctaccaacaccaactcagggcatgctaatggcagcaccgccagaactcctactctagcagcagctcagtctcgtcctagctcttaggcaagtggacaaggttcccatgcttccaacaacttcggtcgaggtcgggtgaaccacattcaagctgagaccgctcaggatgctccagacgttgtgatgggtatgttctctgtcaactccatacccgcaataattctgtttgattcaggagcttcctattctttcatatcgcaagcctttgtgaaaagaaatggttggaaaacctaaaatttacgagtaccaatgatagtacattccactggaagggatataagggcaactaaaatatgcccggaagttaaccttagaattgaggaagttgacttcctagccaaactgatagtcctggactcgcaaagcttggacatcatcctagggatggattggttggctaagcacaaaggacagatagattgtgccgaaaggtccatcaccttgcaaggacctggtggaaagcaagttcactttacccccaacactcttaccgcaagtcggtcaatcctaaccaatttgcaagccactcccttggaatcggtgcccatagtctgtgaatatcccgacgtgtttccagaagagttatcgagtatgcccccagatcgagagatcgagttctccatagaactggcaccaggtaccgcaccgattgcgaaaagaccctaccgaatggcagctaacgagttagcagaagtcaaaaggcagatcgaagaactggagagtaaaggttatgtgcgacctagctcatccccttggggagccccagtgctcctggttaagaaaaaggatggctttgagagaatggtaattgactatagagccctgaatgaagtaactataaagaacaagtacccgttgccacggattgacgatctgtttgatcaattggaaggagtgaaggttttctctaagattgacctaagatcaggataccactagttgaaaatcagatctgaagatatccgtaagaccgctttctcaacgcgctatggtctgtatgagttcacagtgatgtctttcggacttaccaatgctccagcattctttatgaacttgatgaacaaaatcttcatggaatacctggacaagtttgttgtggtattcatcgatgacatcttgatatgctccaagaatgaggaagaacatgctgaacagctgaggctgataatagagaagctaaggggtcatcaattgttcgctaagttctcaaaatgcgaattctggttggaccgagtagcattccttggacacgtgatctcctctaacggtatcgaagtggatccaagcaaggttgaagctgtacttgcttggaatccgcccaagaacgtgtcagagatccgcagtttccttggcctagctggatattatcgaagattcatcgaagggttctcaaagctagctagacctatgaccgagctgttaaagaaggaaaagatgtttgaatggtcagcagcctgtgaggacagctttcaagaaataaagaaaaggttgaccactgccctagttcttaccttgccagatatacgaaaggatttcgaaatcttctgtgatgcatcaagacaaggcttaggatgtgtcctaatgcaagagcgaaaggttgtggcctatgcatccaggcagcttaggcctcatgaagtcaactatcccacccgtgatctcgagttggcagccgtggttcatgcttttaagatctggcggcactatttaatcgggaacaaatgtgaagcatacaccgatcataaaagacttaagtatatcttcactcagaccgagttaaatatgaggcagagaagatggttggaactaatcaaggattacgatcttggaattcattaccatcccggta

SEQ ID NO: 66971 - DNA, 1735 bp, Oryza sativa
ctccatccatccgggaagtatgaagatgtaccaggatatcaaggcatacttttggtgggctggaatgaagcgagatgtcgcagaaaacgtggccctttgtgacatttgccaaagagtcaaagaagagcatcaaaggccagctggtctactgcaacccctaccgattcccgagtggaaatgggaagagatcgggatggatttcatcaccggtttgccaagaacccctagcggatacgactccatctgggtaatcgtggatcgactcacgaatcggctcatttcgtgccagtgaaaactacctttgatggaaagaaactggcagaactctacatgacccatgtcgtatgtcgatttggttgttccaagaagattgtgtcagatcgaggcactcagttcacctcaaggttctggaagcaattgcatgaagctctcggaaccgatctaaatttcagtacagcttaccatccgcagaccgatggtcagacataaagagtaaataagatcctagaagacatgcttcgtgcgtgtgccctggatttcgaaggcacttgggaccgttgcctgccatatgctgcattctcctacaacaacagttatcaggccagcattcagatgtcgccgaatgaggcaatgttcagaagaaagtgccgcacccccttgtgctggaatgaggtcgacgaagcactagtgtttggccccgacatactcaaggcagtagaagagcaagttaagctgatccgagaacgtttgaagacagctcagaaccgtcagaaaagttatgccgacaatcggagacgtgatctcgagtttgaaaaaggagttcatgtgtacctgcgggtatcacccctccgtggtatgaggaggtttgggatgtccgacaagttagcaccccgctacatcggcccctacatcataaccgccagacgtggcgaagtggcttatcagcttgagttacctgaaggtcttgcagatgtgcacaacgtgtttcgcgtgtctcagttgaagaaatgtcttcgtgttccagaagaacaagttcccctgggcaataccgagctggaaaagaatctaacctacaaagaaaggccgatcaaagttcttgaagaggcagaacgtcagactcaacgaaagaccatcaagttctacaaggttcagtggagcaaccattcagaagatgaagcaacctgggaacgagaagatcatctccgcgccgagtttccggagctgctcccttaggtgctgaatctcggggtcgagattcttgttaggggggttggtctgtagcgcccgttccgtcgtggcacctagagggaaaatttaaatcttaaaaaccctaattgcgaaatctatttctttgcttgttgtcagtctccgtgccaatctctgatctagaattccctatccatcgtcgaattcaaattccgaatccaactctctccaaattcaaattcctccgcaaaagtctagtttgcctccctcaggttcggtgggccaattcccctctcggcccatctctctctctctctcccttacccttcctctcgctctaccagtgcgccgcacacgcgtgagcgtgcgtgtacgcgtgagccgacgccgagccgagcactatccccctctctcgttctctctccccgctccatccccggcaagctccccgccgcgtttttgagttccatgcgcgatcgccgccgcggtcgccacccgtgccgcgctgagccgccttgccgctgctctg

SEQ ID NO: 66972 - DNA, 3387 bp, Oryza sativa
  unsure (1)..(3387): unsure at all n locations
ttaggatgttacaggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagtccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtgacgtcgggcatggccatcccaacagacccttcaggtacttaccactgcaggccgattccagcaggatactcgaaggtcgaagttgagttggtcgaaggcgcgtacgaggacctcgagctggattaccctggaggagacggtgagacgcatctacgagacacatgacatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaagatcctgcaccgactcctcctcgtgctcctacacctactcccccgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccaaaaaagaagattcctatagaccccactgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtaaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcaacattacaagacgttcatactgttgccatacaacacagagttagtttaattttactgtcttcctacataccaaatttcattcccgtacgaacttgctaagtgtttcatatgtaatgcatcccacgcacattgcagattccactaggtgcttttattcatcgacctggaggcctgcaccgtcaacgtatatgactcaatggataaaaaagagtctacatttgacaaggttttcgaacttatagacaggtaccgtcataagttcctttgttaattaagaaaatcttgttatgttaattgctactatgaattatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtaagtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacaaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatatctatatacatatgcatttgcataacatatatatgtataaatacatatatattatgcatgtatatacatataatataatataatatatatatatatatacatatatatatgtatgcatatatatgtattgaaacatatacatgcatggtttatatatatatatatatatatatataaaccatgcagcaacagggccatgcaaaaaaaaaaaaaggtcagctcgatctttagtcccggttggtgttaccaaccgggactaaagatcgatctttactcccggttatttcaccgctatctttagtcccggattggtactcccggtttggaaaccgggactaaagggaggttacgaaccgggactacaaagggtttctccaccagtgctaatagaatgatcaacaagctgcaaactagagtgagccattggaagcaaacatgagctcgacaccaccaagtaacgagcttctggtaggctcgagcttggctctgtcaaagctggattatagcacaatcgcagcagaaagaatgaaaaggttgtatttctcactaacagtgctgacaagaagctgtnnnnnnnnnnnnnnnnnnnnnnnnnnnnnnnnnnnnnn

SEQ ID NO: 66973 - DNA, 15941 bp, Oryza sativa
tgagatggcacggacactagacaacaatcaaagaaacaaatttcgcaattagggtttttcggagataattttcccgctaggcgccacgacggaacgggcgctacaccaagttaacaggtctttattttgcgaatatagaaaagaaaaggataggagaaattgtgttaaagtatctcttagggggaaattgcttaatacttgaagaattgagacgtacagttcgctctccattaatatgtaaaaatttaatgattttcagtgatgtttgacgtaatagtaaggctttgtttaaggaagtttaagattataagaaacatttgatgactatttagtctttgagaatttggaaaaccgaagttccgaaccttttgtttctaattcattttctatattttatagctacatatttatagaatttagatgaaaacctgaattgtttggtactaggagattttagaataaacagcgtgtgtcatatcagagagtggttggtttcactgtcatatatatccgtcgttacatgcactggttgaagctattgtcagcgcgtagaccctatcgttttcacagtggcaaaagtaaaacattcaagaaactacgagcgggttcgtttcaacagttggagagtagaatttggaggccatcctactgcttcgagaaaattataggtttggaacatctgatgtttattgatagttcactactcctaatacacatgttgctctataccagtctactaggagaagacaagcaatgcttttccgatcgtgatacttgcttctcgacatgcctgctttcctgactatgaagatagcaatatctagagttctgttaagaaaaaagatcagtaatatctagagccaatacgtagttacgtactctgctccatatctgatcatggattatgtctcagatctgtatgtttcttcttattattattatcgatgtgttctggtattctccggcatcacaattcagaagctagtctgtactcatttactagtcatctctatagtctgtagaattcgctgttatattccttagcagaattctttgattattaattatctaccaattcgtagttttcttcgcgttgtgaagcatagagaatacagagtaaaacatgttctacacttctacatgatctgtattcctgcatgtttcttcagtataacgtgtctacatgcatcaccacatgataaaaaacgggatcatttatgatcggtttctatctcaaataatttctgaaagaacggcattcattcaggatcgattggaacctcacaatatctacctcacttatttacatcctcattattcaagcttgattcgtctaaataatgttttgcttcacgtgaatgaagctttaattctgaaaagcgaaatatgtggggaagggtgatgagaacaacagagcaaatcggagcatttaatcctccaaatccagccacttccaaattaacctggactgagctgagttctagaccatatatatatcgcgctctcgtcattagtcacgaaactactgttcgtggagtcatcttagaccaactgaacgtttcttgcaaactcgaccaactgaacaagctagtttaatcaagaagcctaccatggaaagagtaaaatatagatagatcaagatcaatctcgggacccaattaagcttggctaatagtgctcccttttctccggaaagctcagtgcacagcacctgcgatttcgacgtgtcatggccgtgagatctgccgtgccggccgcctcacgctgacgacaccagctctagagctcgatgtggctctttcgtgccattacgcaagtactgatcgtccctgtagcgagataattaccatggcgccttgatttgtctcccgcttcgtcctgggccagtggttccacggccggtcgctgtcgcgtagatccgctcgccgctcggtcggacagtttgaggttgctctagaaccggccgtgcctgctcgatcgcgagctccgtgcgtcacggtgttaattgcggattgcgcggggcctctgcattggcgggctcccgaccacacgtcgcgggaccgcgcgcgcgcgcgcggtggtgaacgcgaagacgccctggtcgtcatgccatggcactatggcaggcagacgttgcgggtgatcgggcaaccgcgatcgaaccaggtgaggcggcgagcgcgcgtatcacatggacgcgatcgcgaccacacgggaagccgtcgccatcagccgctgcatggagcgcgcgcgcgcagcgttatccccagcgcaacttgcagctagcgtacgtggcggccggggcgagccgggaacaagtggtggccgcgggcgaagcggtgcaccgaccgagccgcgcgggttcgcgtcgtgcgcgtcacgtacgctgcgcgcgacactacgggatggacccacgggagagcggcgccaatatgatgtcggtggctggacagccggatgatgggcatcttccccggccccgtcgccgtccgcgtgtttccctctgagcgccggccgtcgctgtcaaggaggagcagagctaggcgtcgtacaagatggctccgaaatttctcttttcgcgcacgcgggcttgtggctccgcaggtgatgcccgatgcaagttgccaatggcgatcgagcgtgatggggattgatcggtttaggatcaggggctccgcatcaatcatccgcaccgacttttgtgcaagttggtacgatcgaactacttccgcctgtcgtgtttagggagagaaggtccaggtgaaaatagttggaactgtttcgtgcaggtagcctcttgtgcgtgtacgtacttgcttattagcttgccaatcgtatggactacggatcaagttaagttgtgtgacgtacagctcattcaaactttgcccacattttatacacatggatgaaaaattatattcatggtttagttcaactcttcttagaacactttgacctggtcaggcaataagctacggtctgtgttggagacatgtcatgagtgccttcgcccgaacccgccgaaaccattgggaacctgaaaaaacgaccggaagccaagtcgatggaaggcgaagcccatggtgaagcttgaaggcaaggcgcatggtgaagcttggaggcaaagcccgtggcatagcatgaaggcaaagcccacggcgaagcataagggtgaagcctgctggcagagggggatgtagcctcccttggattcggcccaagaaggctgttcatcacctttgtgggccgggccgaggaggctgttagaaggcccacgacttaatagacatcggttacccctgtagttgtcaccatcataagggcatctatctatctatctatctatctatctatctatctatctatctatctatctatctatctatctatctatctatctatctatctattatattattaagatagctcgaaaaggagacaccacgttcgctgtggaggctagaaattcccacattaatcggagaaaaagaaaaaaaaagaaaaggagagtccaagtagaaatacaatctaaaatagctgaaatttggaattaaaaatcagcaatattgaaagaaatttccatataagaacccaatacgagattaatcaaaattcaaaataaaaatgaaataaaatccaaaattagaaaaggaaagaagagtccaagtaggaatacaatttaaaaatagctgaaattcgaaattaaaaataagcaatattgaaagaagtttccatataagagcccaatacgagattaatcaaaattcgaaataaaaataaaaaaaatccaaaattagaaaaggaaatgagagtccaagtaggaatacaatttaaaaataactgaaattcggaattaaaaataagcaatattgaaagaagtttccatataagaagcgccaatacgagattaattaaaatttgaaataaaaataaaataaaatccaaaattagaaaaggaaaagagagtccatataggaatacaatttaaaaatagcctaaattcggaattaaaaataaagaatattaaaagaagagttgaacccaatacgagattaattaaaatttgaaataaaaataaaaataaattcgaaattagcaaaagaaaataaaagaagagttaagtaggaatacaatttaattaaaaataagcaatattgaaagaacaatccatataagaacccaatacgagattaattaaaatttcgaataaaaaataaaataatatccaaaattagaaaaattaaaagagagttcagataggaatacaattttgaaacgactgaaattgaaaataaaaaatacaaatattaaaagaaatacggtattaactaaatttttttaaatagagtaaatttcacaaaactgcagatactataaccaaattattacaaaactacagatttaactcggtgtatcacaaaactacacatttaataccaaatttatcagaaaactacacatttaagatgaagtgtcacaaaactacatatttagtaactaaattatcacaaaactacaggtttagaatcaatttaatcacaaagtattgatgtttatagctccaccataaaaatggtgctagggatttaaactccaaaagttatagttttgtgataagttcaatattaaatatgcatttttatgatacttaatctaaaatctgtagtttttgtgataaatttggtgctaaatatgtagttttgtgatacaactccttaaatctgtagttttgtgataacttggtcaaaatacctatagttttgtgaaattcactcaaaaaataaattctgaaattagaaaaagaaaaataatacttcaattaggaatacaatttataaataactaaaatttgtggtaaaaataaagactattagaagaaaagaccatctaaaacattatgacgagataaattaagtaacaggtctataaaggagtagagtggtggcggttgatatgacatataaaaaatattaataaaacaccaaatagaatcctaacgacgattaaaaggagggacgtcaggcaggccgtgaagcaaacaagtaaggcagttgctgggacttctagaaagtaaaaaaaataaccccattgataatcatattcgatttttaaaatcttaatgacaataaaaaggagaagcagagccgccgacggctgacgggacttctagaaaataaaaaatgaattccaacgatagttatgttagatttttagaatcacaatgacaataaagagtatgcgacggacgggtcgtagaggggtatagtggcatcgtttgatgggacttctaaaaattataaaaaatgaaactgcaagtccaatttttaaaggttcggaacttccaaaaagtaaaaaacccaatgataatcatgttcgatttcaaaatctcaatgacaataaaaaagggaggcagcgggcgagccgtagagaagtataatggcaaagccgctgatggtttagccggacttctagaaagtaaaaatgaacccaaacgataattatgttcgatttttaaaatctaaatgacaataaagagaagaaacagtggacgagccgtagaggagtataatggcaacgtttgacgggacatctagaaattataaaaacgaaacccatcgtgacaataaactctaaaaactataaaatccaatttttaaaggttccaagaagaatgaatagaaatagtggtagatcgagcaagcaaataaaaaaaagatgatgtaaggagtagcaactggtgtgaatttttaaaactatatagttagaaacacgaggatgataaggtttggtcttttaaagtcttaagacaatgagatagctatttaataaattttaagtaaaatcgtacttaaaaaaatatatgattttgtttgggtgctagccgcgcaattgcgcggaccatctagccggttcatgtaaaattccctgcaaacaataaactctagagagtaacatgttgtataaatagccccctagagccatataatggggatgtcgaaaactttattaagtcaatactactttattgttcaaacacacccaactcaatctctcgtcctgcgtgatatgacgcagttgtcctttgacaacagtctgcatgcgtgcagacttggtaatctgccacatcacacccaacacgccggtcgggtcaaggaaaaacgtggtgaggatcctctgcactgcagtattgcccttatcagtgacgatccatgccaagtaagaacggtcatcggtattaaacatgatgtgactacggtgaaatcgaaactgctggcacgcacatgactacaggccccgatgatgcaccaggagtgagaaacgctcaggggtctttcggctagctccacaagatggtgggctagacgatctgggttcgaagcctcatcctttctaattatttgatattaggtcattctctaatttttgcgtcttttatggtgcaccacgagtgatcccatagcgcactggtggagataagaatcttctacttttaaagtcacattattttatcactgatatgtaagcttgatgaatcctatacccacatgtaaataggcacgatgattttgataatagatcatcgtaatcctcagtgaagtgtcaatgtgtcattggcatcgtacgatgtgtttgtggtagtattgttggtgcttggctcaattttgcttgagggacttggtagttcactttagtgagttgagagagctgatataagttaaagtccataagttgaacactcataatttcctgagagatgggatgtttgtgaaataagtaaatactagtattgacaagataccatacacatgtttataagcttagtccactagtattgacaagataccatacacatgtttataagcttagtccctgtcacatcagatttttgacactaatttagagtattaacatagactacttacaaaactaattgcataaatgagagctaatctgcgagacaaattttttaagcctaattaatctgtaattagagaatgtttactgtagcatcacataggctaatcgtggattagttaggctcaatagattcatctcatgaattaatccagggttatgaaatgggttttgtctttagtctacgtttaatacttctaatagtgtccaaacatccgatgtgacatgtactaaaattttttagccccatctaaactccccttaggatggtctgtttgattgtccgacctagccaatagtccaggagatttttgttgatcgactgaacttgctaattgaaaaaaaaaaggatcggttaagacatttacaatatcatgtcatggcgaccgacctcgcgtgttcacatcagagccaaagccgccaccttgactgggagagatgtcttgcgggggcacgtgtgctcggtaaaaggcatttgagtctcaatgtaggagatgctctgtagttgtatagccattgcccgagaaaactttctctggacatattcaacctactgtgcattgagaaagggtgtcctcgatggcggttccaacctatgtgacattttctctttatatcacacaataatatttttatagtgtaaatatccttataggcacggacaatcttactcatgatcttgtccaaaaccaaacaagaaaagcttcacatcttctctttttccattaacctttatattccactatgccaagtgagcaagtcatataacatgccctgaagaggaggaatcaaaggtaccagtttaggaactggcataggctcgattcaagcgatgcaccgagcacatccacctcgagtcgtccacaaaatcaatccacaacaatcacagaatcgacatctcatatactcaacatataagatgtggatatcatacagaatcgtcatcgtccaaaaacatccatgaacaaaaccgacaaaaaaaaacatatacaggttaaaaataaaagggtatagaggaggacgcagaaggagagaaggttgacgccgctgcagctcaccatcgccgtctacccgcccgcctaccaccgtcgaggccggatttggctgcccttaagctcgtggcaaatagatccggtagcttccgaactcatggcgtcctactagcccatggagatgtcgaggaggggtgtccggtcaggaattccatgcgacgagtagggtggtggcacccagccgtccaccaacgtcgaggcctggtctaggccgtcgctcgccagctaggaagagagaagaggcgagggctgcactgctcgctggttggggagagagtagacaacaaccgcaggtgataggggagagaggagacagcggcgaggatgctcgatggggaggagaagaaaggagaagagatcgaggacgtggagattgaattaatgaataagatcgaggggtgggaataaaaaccaaaggtgctccatgcggttcgtctctgctcggctcataataagtggtgttgggttatttaaaaaaccagcacatataaccttttataggtaccggtttattataaaatccggtacaaatatttaatgtgccggatttttaaataaattgacaactatgaaatgttataagtgttagattttaattttagacttatgtgagagaggttaggaggatgggaaaatgcatataaccgggtttagagtttttggcatctataaagcctagtcgttccgtattatgttttacagtactgtaagaaagatggttcaagataacctaggatatattacattattaaaacaactttgaaaggaggcaccatgttcgctgtgggggctagaaattcccacattaatcgggaaaaaagaaaaaaaaagaagagtccaagtagaaatacaatttaaaaatagcggaaattcggaatttaaaataagcaatattgaaaagaagtttccatataagaacctgacacgagattaatgaaattcaaaataaaaataaaatacaatccaaaattagaaaaaaaggagagtccaagtagaaatacaatttaaaaattgctgaaatttggaattaaaaataagcgatattgaaagaagtttccattaagaacccaatacgagattaatcaaaattcaaaataaaaataaaataaaatccaaaattacaaaagaaaaggatagtccaagtaggaatacaatttaaaaatagctgaaattcggaattaaaaataaagaatattaaaaaaagagtccatataagaatccaatgcaagattaattaaaactcgaaataaaaataaaaattaaatctgaaattagcaaaaacgaaataaaagaagagttcaggtaggaatacaatttaaaattagctgaaattcggaattaaaaataatcaatattgaagaagaatccatataagaacccaatacgagagtaattaaaattcagaataaaaaaataatatccaaaattataaaaattaaaagagagttcaagtaggaatacaattttgaaacaactaaaatttaaaataaaaaataaaatatattaaaagaacacaatacgatattaattaaattttgaaaaaaaaattctgaaattagaaaaagaaaaataagatttcaattaggaatacaatttataaataattaaaatttttgataaaaataaagactagtgaaagaaaagaccatctaaaacacttgaggagataaattaagtaatatgctgtcacaccccgaagttctttcccaagcctaaattgaatttataattcacctgagaaaataccggtgtaaaagcaagagaaaaccctaataaattaatgcaaataataatcggatttggcatgtggaatttttcttgagttctacatgtcgaaatacactaacaagatttttagtggaattttcaaagctctcgaaataattttaatcaattaaaattgagcacaggcaatatttaaatcctggaaattcctttcttcctttttcttttttctttttccttttcccttagtgggccgccggcccattccccctcatctctccccgcgccttgctgggccggccggaggccacggcctggctcagcctgcgccccttcctctctctcggggtcaccgacaggtggggcccacctgtcgggtcctcccccaacctccagccgctcgccgccgcgcccgcaaccgccgccgcgcccacgtccccgcctcctccgggccacgtcggccacgcccgcgcatgcgccgcgtctcccgcacccacttccccctctctcccgctcgcgcccgcgcccgagatggccgggattcgaatttcgaatcccgcctctctttccacctccacctcccccatgtcggccggcgaatcccgcccctaccggccacgtccgagttccccctcctctatttaagctctgccgccaccccctctctctttttccccatctcgccgaactctcccgagctctccatcgctcccgtgccgtgcacccatccgccgccgccgctcccgctactccggccgccgctaggcgccgctagactcgccgccgcaccgcgccgtcgctgccgttgggttcgtgtgatcgaggtccatcccgtccgcacctcctccatcgaggtccgtcgccggaacccgcatcccctcgcactccagtgagcaccacctacaccgccgccttcggccatggtttccgatcgccgtggtccacccctctccctctaatctctctcttttcctctcttatggcatctcggagctcgtccgtccgtcgccaccgttgtcctcccgtggctcgtcgtcgctgttcgccgtcgtcctcctccgcgccggccactctcggtgaggcatccctcctcctctattcccctccctctccttcctagccgcgccgggtcgagccgccgccccggtcatgcgccgccgcctttgcgccaccgtctcccgccgccggttgccgtcaccggcaacgcgcgcgcgccgccgcccttgccatggccggccggccggctttgtgccgagccgagccgagccaggacgccgccgcaccgtccgatcggccccgggccgatccgggtcgtcgatcccgtggaccacccgcgtggtcccagtccatggtagactgaccacccgtgcgccgctgccatgtggggcccgcttgtcggcgccaccccctctctctctccgggatttatttattgcgcaataaatcaattaaggatttttccgtttatagtaaaaacatagtgaatcttctaaaattcataactaattcatctgtgctccgtttaagcccattcaagtctgagtaaatcaagaaaaatgtgtagaatccattaaaaatggttttgttatctgtttcagtagtcttatagcctgtttgtattgtttgccttgtatgtcgcttagattttggttcttccgacactccggtgtacttcgagatagtcgccgaggttcctccagcagcagagcaaggcaagtcatgcctgtcacttgaacatgttgatcctatattgcaaatgctctattgtttttcttcaaatactgcattgttttataatgttactatgggatgtttacctatcgttacagccatgctatttcgtaccatgttcctttgttagcttgggatataacatgactagagattggacttggaattgcttagccatgcttagttcaactagcacacaatgagggagatcctattaatgtttagactgtaggttctaatggtaatgttggattagtgccaccgttctggtgctgtttaattaaaatatattaaatggtgggctgtgggtgcatggtgttgctagtcgcgcccatggcacttaaggaccggttcgcgggaaaccctagaagaattcctcgtacttaccacaagccagcgtggtcaacggctgggcttgtagtgtagctttcctctagctgacgcatccaggcaagggtgggcgtgatggagcggggcgggccttgcgacggcctctgtcgcttccagattcacctaggcacgagaggggactgcccgtcgaccgctggggacgggggtgaaacctgaggtgtggtgtgcttggttagagggggtcatgcgaagggtcctgtcacggcctctttccggtatgtcgtggtggcatgtcggcgcacggaaacgtgtcgtggggctgtgtcttgtgggtacagttgtacgcctctgatcagagtaaaactattcgaatagccgtgcccgcggttatgggcggtcaaccagattcaccgtgattagtctcaccctagtgtagtctaatgaaattggatagtttaggtggatggttgggcctgttgcaacgtgggatagcgttggacagtggatgattaatattaattaattactacaactgtttacttctttcaacttctgtttataaatgctcgctttatgcaaatgaaccactctagttctcctttgataattctctgcatcatatccctattccggtatgacttgctgagtacagtgggtagtactcagtcttgctctattttccccaaccctagagtacgagtatgtgtcagatggtggtttctctgaggagtaggcttcatccgtgccgtcgaggatgcctgtggagtggtgttcccgctgcagatcgagtcaaggcttagctccagttatcttttgttttccgctgcatttatgtatgactctttatgatgtttgtaagacgtggatctgaatgtcaacattgtcgtttgtgtaccccggctggtcctggacggggattttaatgcacattctgcttgggattccattcgggaatttctgggcgtgacatatgcctataaagtagtaaagtggtggcgattgatacgacttataaaaactgttaataaaacaccatatagaatcctaatgacgattaaaaggagggatgacaggccgcccgtgaagcaaacgggtaaggtgattgccgggacttctagaaagtaaaaaaaataaaccccatcgataatcatattcgatttttaaaatctcaatgacaataaacaggagaagcagcgggcgggtgtataggactatagttgcagagccgccgccggttgacgggacttctagaaaataaaaaatgaattccaacgacagttatgttcgatttttagaatcacaatgacaataaaaagtaggcggcggacaggccgtagaggagcatagtggcatcatttgacggaacttctaaaaattataaaaaataaaacccaacaagacaataaactctaaaactacaaggtccaatttttaaaggttcggaacttctaaaaagtaaaaaaacaatgataatcatattcgattttaaaatcttaatgacaataaagaagagaggcagcgggcaagctgtagagaagtacaatggcaaagccgctgacgatttggtgggacttccagaaagtaaaaatgaacccaatcgataattatgttcaatttttaaaatctcaatgacaatagagaaaagagacagtggacgggccgtagaagtgtataatggcaacatttgacgagacatctggaaattataaaaacgaaacccaacatgacaataaactctaaaaactataagatccaatttttaaaggtcccaagaagaatgaatagaaatagtggtagatcgagcaagcaaataaagaataaagaaggagatgacataagggataacaactggtgtgacttttaaaaacatataattagaaacacagggaggataaggtttggtatttcatcaaagtcttaagacaatgagatagctatttaataatttttaagtaaaatcatactaaaaaatatatgattttgttggggtgctagccgcgtaattgcgcgggccacccagctagttaaacatatatatccatgatgatcgttgctgcggcagtgctaatttagctgtctcttgcaaacgccattcattttttttctgttttgtccatgttgatgcatcttaagcacgatatcaaaagatcgtactagctgcttagttattttggtaggttcattccgattacacgttggacatcaaaaggtagcaccgtcatcatcccatacgtacgcgcaccaggttgtccggttcatgccatttgttcatgtccgttgctaagaatgtgcaatcttcagaaatagcaccaaacgcgctcagtttgaacgcatatcttggtagatatacatgcatacagctagcacacgaatggcctaagttcgtacacgacgcaccgtgccgctcgtgtggagacggcgccgcgaccaaatccccatccacccatcgaatccacgtacgacttccattcgcatcgcccgtcaagaaaggaggatgcgtgtatctcccgcttccacagtgcacacacgaccgaaagccgtgcatatccatctcgatcgatctccctttcaccgcggcgcggccggccggcgcggtagctagccgccgaatcaagaggagcccgttcgtcgcgtccggcgagctaagcacgccatcgcagtgccgccacgtacgcgctcacggagagagaaaaaaaacggctgcaatgccgatggcaacgctgatatttccgctctcgattcggtcaagccaaattgccaaatacagacatggccaacctccccacaactctaaaaacatcaccgtaaaaggaggagcatagacaccggcccgatggataggcctgcccctaagtgacagggaataaactaaaaatccagagacttttcgacagcttcgtgacttgtctgtgtggtctagctgagctgggagatgtgatctggttttgggcctaattaacgacgatatgtgctatggctgcctaggcatatgctacgtcgaccacgtcccagtcggtcggcgctcggtggccggctcccattggcgccctcccgagattgccggagcttgtgccccggccggccgtggatgttaccggccgttcggcgcacgacgcgacgtgtggaactgaatcttgcgtgcctgcgaggacccggctcgcccggccagaccggcggcgagggcgccaccacataggtggtcgctgaatgctggtaagaactaaaagtgatcgagagcgacgtcggtcgcgtgcagaatcacggcgatcagggttcgtcttggcttcgtctacgtacagctgccgtaaatcctagatgcaaggatatcatccgatcgatcaacgaaactgcggccgatcaattgaaagccatgcatacatttaatttcgttgtttgcgtgcataggaacatgcagcgttgtatggatggagtagttgcatggctagctctctctgacatcctacatgattgggcagattcgatcgatcgagatgatctatgtcactgttacacagtgcagtaccaaagatcacgtaaatatcaccgcacgcgatcgatcgatggcgccaaatgaacagttaattaattgcagatgagatgatataatgtggccaccaaaccttggcggatttaatattcatcgtatcacgccgcctggataacgatatcctcattggcatggtctgaaaattctgaatttgacagccaaaatgcatatagccaagaacgcaaaagctgtgaggtatgggggaggagaagaaaagcagtgatggacagcacgtcagataagtagataaccactccgaccgaagaatccaacaaaacaaaaaccgggtcgaatccggaaaaggacactgttctgatcgatcgaatccttgttgccggcggcgttgcgcagcacaggatcaggcgatcagcggcgttttctagaaatccatctgcgtggctacactatacagctcagtttagctattgctccctttctcaccaaagttcaatttcttcttcttttctgtttacggtccacagtgccccagaatttttccacggtccagaaaattgctgcacgtacaggagtagagtagtaggtgagttgttgctctgtcgcgaccacatttccatggcattgctactttgctatagctgcatcgtaagcttgcacta

SEQ ID NO: 66974 - DNA, 7975 bp, Oryza sativa
ggaacttgtgctcgttttgatccggacgtggagtcgccatcgcagaggatcccgaggaggatgccgcgaagatccgcgtgcgtctgacacagattgtcccggcctcgccgtggcgccccgtgttcgttcaatcattctgacgctcttggtggccgacgcaccactgcttcaacctgctccgttgctgcaggcagtgccctgtgaaggaggccagaataccggttgctgatgcgtgaaatgatttgcgaggtttttgtgtgtttgcattttgcagggaaaaggattagggcatttggtggtgactggtgtgatccaatgagtacgttggggggaatcagatgacggatcggttgtgtgttcctgcttttgacggccaaagtggttggtatagaaaggacgggggtgatagggaatcagggatccagcacttaccaagtagctagcgatggcatgcagtaagaacatgccatttggttatctacggtcaggagcgaggtatggcttgcgccaccctcgccctacgagtcctccatcactgacatatttggactgaaattaactgagtgaaatgcaattttcattcattgatactgctcgtctaaaccgatatgacgctagataagcaaggataaaacaactaatatgtttagactgtaaggagtgaaaagtaattttcattctttacctctagtctaaactgatatgtgccgtctactcttatgagaaaacgttgaataactaaggaaacttgatatctttttttatgctggacaaacaaagagaggtttggattgaaaggactgaaaatgcttttttttttacctctttacctctagagtaaattgatgtgccctcttcctttctaagaaaatgttgggcaataaagaaaaaaacttgatattattttcttcatgctggacaaccaaggagaaacttggtatcatcctaatgacaaaattggtgtcatgcactctcaagtaattaagaaaaaaaatgagtgtcgaaagccaaacattgcaccatgaagttataaggtcacacaaccctactaggggtggataatgatatcatctagtttggatcgttatctttgcaagatatcttggcttgtttcgttaaccttaacaagctaaatgtctagctcggcttaaatcacaggctgactcattaaactcgttaggctagcttgtttacgagctttatctaatttaataaatccatgccaccctgctagtataggtgtttagcctcggtccagttatgatataagaccattcattcacacattcatattgttttgagcacctgcactattgcatcgaacaaggagtagttgaatcgtcagccctattaagcgcctatcgagcgaatggatatcctctattgtaatgcacatgcagtatatgtcattgacatgtgggcccgaagcatgtgagacccacatgtcagtgacatctactggaggtgcactacagcagatgatttgcgctgctaccgagccgctagtaagttcatctcaattatagtttaaaaaacttaaccagaccgatggttcaatcgtgaaatttaaaccaaaatcagtgcttgccttggtccagttgtgctctactaccgttcatgcattcattgagcgcctatacggctataccattgtgtcgtacctaatacaattgaaccatctgcactatttatcatagtatgagcgtctgtactattggcgttgtacctagagcgattgaaccatttgcactattgaatgggccagtaggaaagcacaacatgcatccaacatatttttaaggctagttgtgtccatgctagaaggttgtaatagttagtgaaccccagtccaaccaattagttcaccgattgaaccactagaacaatgaaccaatatatcgactggatcactcatcagtcggtttaaacttttattttccagaggcaatccggtttgaacttatcctcttcttggttgtgttcttctctcaactttcccaaactactaaatggtgtgttttcaaaaaatttctatataaaagttgtatttaaaaattatattaatcaatttttaaatctttttagtaatacttaaattaattatacgctaattcttagtttgatttttcgtgtcagaggtaaggttgggaactcagccttagccttattctagatgcggattctctttattgaggcggacgggaaaggaagcccactaccgaaacaacgcaacttttgatctgggcctaattccagaacatatctgggcctaactcccgtcagaagcggtgatcaaattaggatctgcggctcattttttagctcaatacaactagcacaatttcccatgagtaacgaattctacagataaggtacatttcatgggcctgcgggcctagctacgtacgtctaagttgcaccctcagggctgtcgagaaatacagtgccacacgtcgagcaataacttaatttgtttttttgtttgttttttttccccggagagcaataactttgtgtaaatccggttatatcgaattcaagtcctcgatcagaaacatgacgccacttatattcggataagagccaacgagtctgttggtaattttttgtgacaagtcgacaagcacgatcgcaacacctaaacgccttgcggtgatatgtagtcgccaaccacctcgatctagccaaagggccaatgaaccggccttgtcccttaaataggggttggtcttgccctctacagacccttctccacgtccaattcaggatagaaaccaaaggagacacgaaacatgtcttcccgagcaaggaaacccgtcactttccaaactttggcaattttccactattttgttcataggtgtcaaatttgggtgtaaacagagtcatcacaaacgggtagacgccagccgtgtagaaacgaaacagctgggtatacgtaacatagagctaattctgagctcgatcgacccatgcatcgccgtttgatctacccgcgtacgattcacggccgttcgattggatgcacccacccccatatagccgaccctatcatagtttctgtagccggtcagagcaaggaagcatgcagaagctcgaccatgcatccgcgaactaggacaagcattacgtgtcggctggatctgtacatggatcagatgctattgaatggcaacggtatatatgatgtgcatcacattggaacgaagggagaaacctgcattgtttttttatcaagcacggctgcacatatattgacaacgaaggagtagataaacctgacgacggtcaatggatcggatggacttgcgcagcaggcccaaggccgatataagagacggcttaatttgctttcgttttggatgagaccaagcagtttcatgctggagaagcccagctccaatggggcaatccggaactctttatccagtccgctcttcgtcatctccaacatacgagctaggtacaatgcaaactgcctaatgttctattcattttctgatctgagcgatctatatatatgacaagtctgaaaatccacatacgtacgtacgcgcgcgtggacgatcgatggacttatccacgcaaaaatgagattgaggtttgcaattttgcatgcatgcatgcacgcgtcgttacgtcggtactactactacatattgcccagatctttccaacgtacgtgcggcagccttcgttgactcctattatttgtttcattgtttggtgtacgtgtctgtgttgcaatgcattatatacggatttgcatgcagttgatcgccggcgggcggcggcgagatcaggctgaatggtgaacccaaccgccccaacgacaggccgccaccgtagtatatatgtccgtattgtttgattactccctccatactcaataaagaaagtcatttaggagaacgatacggtctccaaaacataactttacttcttatttctataaaaatatttattaaaaagtgatatatgtatatttttataaaagtatttttcaagacaaatctatacatatactttttatatttttaaactcaataatttgagatttatttatgatttatatttttaaggtttaatttaaatattgttttaaacgattttctttacgagtatggagggagtatacgatacgtaggtgcgggcgaaacattgagggagagggcaagctgtgcctgtgcgtacgtcctcagcatgtaggcagactactgtgtacgtgttctcgttgtccgcgtggctagctagacgtccgccattcaccgcttctcgacctcgatccccacctgcatttactccgaatgattcagggatcggtacacgcagctagctagtctagtacacaagcctggaaagaacacagtagctagctagccgcttgggtaccatggtgtaaatcagaatgaattattagcatataattaattaagtattagtttaaaaaatttaaaaatatatgttaatacgatttttcgaagtagcttttctataaaaactttttgcaaaaaatacaccgtttaatagtttccaaacatgcgtacggaaaacgagcaggtaaagttggaaaagtgtttcaaagaacacacaaacttaaggccttgtttagttcccacacaaagaaatttactgtcacgccatgaactagccccgagcggaactagcccgtgacgctccaaattaacctgttaatcgataccagtcccaggaaacagtgctggtatcacaggaagacagtatatcacagcaacagaggtctctttattatagagtaggagtacagtcatgttgggctgcggacagatcccgagctcacaactacattacaaaagggaaagcggaagccaagacttggaccaaacatcacaggcgcgacttgggaactaggcagaaaccctaaaactcatcgtagccgacttgctcctggaagaactcctcgtcagcgggatccgcttcatcttcttcagcaactgggggggggaattatttatatagagcaagggtgagtacgggagtactcagcaagccatggggattaagtgtttaatgcaggcttcaaggaaaggctgttgtttttgcaattgattttatttaaactcttttctgaaacaactaagtgagtgcttctcaaacgacacggataagacagtgcgtctcgtccgatcggagtatgtgcaaggtatcagtcttttgaattgatcaaggttggcatccggccaacagctttcaaacggccacccgggcctggctgatcccatcagccgcagattttccaaacatcgaacccaatccacaacagcaaatttcacaaagcagtagtcaaacaaaactacgctaggaatcacctcacatccgcccatgaccgtgggcacgactgttcgaacagtttaataacctctgcagagggggtacactttacccacacaacattactgacccgaatcacccagcccgtgcagaacggccacgtctggtgacctaaaggttttcatgacaaggcatttcgaaagccgacacagggttgccatatgccgacgagaggggttccagaccaacaacaggttaggtcccagaccatactgtgccaggaagcccgggggttctccccgacaccaccctgttgaatccacatgtctctcggcatcaaggctcccccgcttagcaatttactcagccaggggtgtcccattccatccatgtggtcgcacttgtcttatgttcggatgaaattccaaggaaacggtccttaagtgcaagagcgggaaaccgtacacccggtacgttccccggtccgcgattttagaaattcatttagttcgcgagcaccgacctagatgtcgggttttccaagtcttttgtaaaacccaagttttacccaagatgtttctcagattttaagtttgaaggcgaccgtcgatactcgtgcagagtgcacgattaccgaggcgcaactaggtggttacaagggaacatggtataacaattaacaaaggaataatcagatgcaataagttaggtaggcccaccggtctgccttgcagacggagcaaacagattaagtgcaatcctatcaatgcataatattttgcaagcaatataattaagttcaaatataggctcaatattttcaaaggtggcttgccttgctcgagatcttgagcttgatcctcgaaatcctcgcactgcgagtcttcgggctccgaaactacacgtgaaacgggacaactcaacaaacggcgaaaataaagccctattattgacctctaagtgggccattagatagatctcgagatttgaggaattttggaagttgaatggagtcaaacggtcttacggttgggaagatattgaatttctaagatttttggatttttggtctaaaggaaaagggatttatttaaatcctttttgaaaagaaaagaaaagaaaagaaggagggaggggaattagacttccctcgggaggctatggcgcggcccgagggaaaggggcggctcgggcgagcttaatgggccggccagcccagcaaggcggcccaaggcgcgcgcgggcggggaggagagagagagagagccggtgggccaggtccatcccgcgtggtcccaagtgggacccgcttgtcaacgactcggctcaccgtgagcgaggtgcacgcggggcgtgctagggtttggggaggggggcgtggcgcacgcacgcggctcgcgggggacgcgggtgcggcgggcccacgcgcagcctcgcggctcaccgtggaccacgcacacggggagggcagaggggagcggcggaccggggtcggctcgacccggtcgcggccgaggtggcaccgaaatggcgtgttcgtggcagccacgtgggccggcgagaggaagacgaaggcgccagccgcgaatggacggtgggcggcggcggtttctccgggacgccgtgcgacgacgaggggcgacggggtgtacaccggaatgacaaggggggacgagagggagcgggccaacggcttggattcgtcggaggatgctcaacggcggcgaattgcggtggcggcaaccggcggcgtgaaaagggggaaacggcgacgaggtcacgaggggctgattcccggcggtgagagcatctacacggctacagaaatccatcccttgagccggattaggggggaaacgcaccgagggaggctggcgacgagaggcgcttcagagctcgggcggcgacggtggcgagcacacggcgagcgacggcagcagtcggggcggcgcgagctagctactggggtactacacacactactaactgagtctaatgggaggagatggatcgaggagggagaacgggggaatgcactaccgagacgaggcggggcgctgtgacgagaggccgacggcacgggagtgatctctccggcctcgggccggggaagaggagaagagggcgcgcccgaagtccccttccgcgtcctcgttcgtgccggctcctctgacacgcgcgacgacaaacggcgacggcgaacagagcacgggaggcggcgacaatggagtggaggcgatgggacaacgagaggagaagagagggagggcgcctgggctttataggatggcaatgtcagtttgggaaccgacctagggcggtcaaaggagagggctagcgctcggcggtcgcggccaaaacgccgacagggagggatgacaccggcaggagagaaaagggaaaaaggaggagagaaagggggcttgcccccttgccactttggggaaaaggaggagggagagagggcgacgcggcagagggaggaggagctctgcctctgtcccttggaggctagcgcgcggagtggcggggtcgggttgatgacgacggcgatgacggccgggcggtgtggagcggagcagcgacacgggcggcaggcgcggcagaggctgacggcggcggcgaccaggcggtcggccaccacggcgtgcgcgcgcgggaagca

SEQ ID NO: 66975 - DNA, 4273 bp, Oryza sativa
gattcgggattgatcttgacgatgatcggggattgagatccggaaaggcacggagactgacagcaagcgaagaaacaattttcgcaattagggtttttaggaaatacaatttcccgctaggcgccacgacggaacgggcgctacatttacactatatcacatcgaacatttgaacacctgcatgaagttaaatatagactaaaaatataactaattgcatagattgcgactaatttgcgagacgaatattttaagcccaattgcttcatgatttgacaatgtggtgctacattaacttttgctaatgacggattagttaggattaataaattcgtctcgttgtttactgacggattctgtaattagttttcttattagtacccgaacacaccatgcgacaccctatataacacccgatgtgacacgtcaaaactttacacccctgtatctaaacacccgctaatttagtagccccaacatcttcagcttttctaggttctcgctagctagttactcaccgactatttgttagaatccttccctagctacgatctctgtgtgacacttgcctagcagttgatatatgttttctgggatttgaaaaatgtcaaccgcgcaaaatgtcaagcactgttgaagcaggaatatacatgcctagggggaaaaaggagaaattttagaaaattcatgcaaaagtcccgaagctttttttttctaaaagaatgtataattttgggggaacgaaaattgaaatcttcaaaattttgtgaagcgccaacaatgtggtggttagggtgggacattcggtcagaccaactatccaatctttgttctcaatcttttgagaaatttcggtaatctaaaaagtaaaagatcgaattaactaattcgttatcggtatccaatatgaccgaaatttcaaaagagatccaaaaccgcacaaatccagaaattcacgcaaatccaaaaaaatcacacaaattgccattggagtagatgatccgaggaggtagacagagagtacgtaggctgtcagcgcagcgaccattggcggcggcggcggcggtgcccatgacccaaccctcaccgtgcgccgcttagcattggccagtgtggtggcgtaacatggaggaggagctgtaggcggctcggcacgctggtcatggccatgggcggcgaagtgggagatcgatcatttcaagtaagaatctatagcaaggcaaggatatactcacttgaaatgatatgtgagttaggtttgcatatatacatcctataggatcgaacacaagcaaccaacccaaaaacttttagcggaaataaaagttacccttaaattgatggaaatctcgacgtagttttatcgccgccggtcggaccgctcggacgccgccggttagaccgccggtatgtcgtcggttagaccaccgaacccgataaaacataaatcgaagaactctcaaaatagatgacaactttattgcttctctgtgtttacaaagtgcaacaacagcactccttacaaaaatctcgactaaactcgaaaccctaactaaactatcaactccatgctctgaaaagcgatacagggaagtcacacgctccctctctatttataccaaaaaacctcctacttaaagtaggagtagaactcctagttccaaaacctgcagccacaccggccacagacaagtcggactctcctcgccgtcacagcagcgacacgtcctcctgttctcctgagccgactcggcttgccatagccccgagccaacctatcagatcaacacaaatgcatgcagccacatgcacgtgtacatgcatccacatacacgcatacacgccactgtgtacacatatatgcacaatacagtaacaccgctacagtacctcgagtactgtagcaaccatataatactccacaattttcctccgcgaacaccgacgcttgcacgcacacctcgtgaagcccgctgcgaagatctcttccacacgatgtccatccatcatgtaccatctcatatccaacttcgtcacccggtatccttaaccgtctggaccttaactcctccctgagtctagtcccgatccccaccgttgaccgaagttgaccttcaagaatcctgactttagtcaccttctcacatggtatcccgaccacactagacatctgttcctccctgaacatagtctcggtcctcaccattaaccaaggctgacctcaagtcacctgcacacaatcagacaaaacaaccgtttctgagcacaaatatcacaacctgacccacattagtcacacgcacacacaccaacatccacacatcttttcaaaccaattcatcgaataaatcatttgtaaagccaattgttcatcacaaatattaatcatgacaatgatttcacaattggtatcagagccaggctaggttaacatctctggcccgatggacatgtgtgaaggcctgatgaaccgtgggtgcctgcggggcccgtatacctgatggaccgtgggccggtgggggcccggatacagtgaaagggcggtgaagggctgagggacactaatgtgtgaaggaggagattgttgaatagtcccacattggttgtagaagggcaaatgacctaagatataagtggggagcccctcatctcaatggctagtttctgaggtgggaaaggccctttacgacttctgtataaccgtgaaagaaaatctcaggattttaagaattctgttccgaaattctgagtcgttggtctccatctgtgtttgagtggatatgtgaatgaggtttgcatacatcctgtgttagcttctgtataaccgtgaaagaaaatctcaggattttaagaattatgttccgaaattctgaaccatgcatgctgacaggtttggcatgcccctatggcggcgaaattaagacagtgttgcgcgcccttatccgtttgattcgagccaatccagaaaaccaggagcatcccggccgtctatccccgcactactataaatacttgcccggagacgatttcttctccacgcagcaagagccgatcgatcattgtccaagtctccaagcgatcagctagctgacttgacgacgctgcgagcagcggcagcaagagagcagcagcacaaagggttcccctttcacaagtgtccggccggctgcacgtaggccatggggaagcaaatggccgccctgtgtggctttctcctcgtggcgttgctctggctcacgcccgacgtcgcgcacgcgcagacgcagatcctcttccaggtgctttattcatttcacccataaacgggcaagggggttcacctgtgtaaaattatcgacagcaagtcagaacggctaatataattcacgtacaaccgaatacgtgtctgtaacatttttgtgcagggttttaactgggactcgtggaagaagcagggtggttggtacaacatgctcaaggaccaggtgggcgacatcgccagcgccggcgtcacgcacgtctggctcccacctcccacgcactccgtctcgcctcaaggccagcaagccatgcatctccttcatctcgttacgcttctctttgtagcatgtccgtttctaaatatttgacaccattgactttttagcatatgtttaaccgtttactttatttaaatttttttgtgaaatatgtaacactatatgtatacatataagtatatttaacaataaattaaatgataggaaaagaattaataattatttaaattttttaaataagatgaacggtcgaacatatttaaaaatataacggtatgaaatatttagaaagggagggagtatattacgtgacgtaaagtgtgttacggccagtgtcttactgcaattatcagctgatctagctcatcaggcaattgacatgtatgcatgcatgtgtttaaatcgatttttcccgtgcatgcacgcaggctacatgccgggacggctctacgacctgaacgcgtccaagtacggcaccaaggcggagctcaagtcgctcatcgccgccttccacgccaagggcatcaagtgcgtcgcggacatcgtcgtcaaccaccgctgcgccgacgacaaggacggccgcggcgtctactgcatcttcaagggcggcggcccgcgcggctgcctggactggggcccctccatgatctgctgcgacgacacgcagtactccgacggcacgggccaccgcgacaccggcgccgacttcgccgcggcgcccgatatcgaccacctcaacccgctcgtccagcggg

SEQ ID NO: 66976 - DNA, 7957 bp, Oryza sativa
acggcgacgggaagccggcggccaaccaggacggccagcggcaggagctcgtgaactgggtgaagcaggttggcggcccggcgacggcgttcgacttcacgaccaagggcatcctgcagtcggcggtgcagggcgagctgtggcggatgcgggacaaggacggcaaggcgccgggcatgataggctggtatcccgagaaggccgtcaccttcgtcgacaaccacgacaccggctcgacgcagcggatgtggccattcccgtctgacaaggtcattctgggctacgcctacatcctcacccacccaggagtaccatgcatcgtacgcaattaacttctcaaagcttgttataacatccatggatcgatgcttcatcattcataggtgacaattttgttttgtgttgtttagttctacgaccacgtgttcgactggaacctcaagcaagagatcaacgcgctggcggcgacgaggaagcgcaacgggataaacgccgggagcaagctgcgcgtcctggcggcggagagcgacatgtacgtggcgatggtcgacgagagggtcatcaccaagatcgggccgagaatagacgtgggcaacataatcccgtcggacttccacatcgtggctcatggcaatgactactgcgtctgggagaagagcggccttagagtcccagaaccagaaggtcggcgctagaaacggctcgcaagctagctacacagttcttaataacttggtcgcaaaaaaaaagttcttaataatttgtacgagaaatgttcgtttctgtttgcatatatagcttatgaaatcttaccaatatatactgctctgttttctatagttcatcccggaaatttgaacttgcaagcccaaattttgaatatatcttttgctagaaaactttcttactccaaatttttaacatacaagtaaaaaatacaatagaatattctctatgattacttaaattggaccttattgatggtaagatacttaattagttgcgttcgtttgggcttatcggacgagctacttcatcgttcatcattagcactctttcaaatgttaaatagtatatttttgaaaaaatatacataattatttgaaatatataataaatccatttttaagtttacaatagctaatacttaattaattatatactaatgatatttcttattttacgtacggcttataagctcacttaagacttactccctccgtttcataatgttaagtcattctagcattgctagaatatatatgtctagattcatcaacatctatatgaatgtgggcaatactagaatgacttacattataaaacaaaggaagtagttcaaacgaatccttagtccatgttcttttcagctccttcactaagttatttctatgcattatttgttcctctaaaagtacgatttctcgttaaaaaaatctatctaccgtatatttattaagtttatttaccacaatattcaagttatatctataaccatgcagataatccaatacaataacttttttgaaactaggctatagtgaaggctgcatcactgcatgggctagcttctcataaaaaaggaaaagaaaaaggaagaaggctacatgagcccagtcaagagcaggaactatatggacttatcgtcagggataagggctgcataactaatgggccacggcccttccagaaggaataagttcattttgatttccctaactagtggttgaatttgattcgaattcctaaaccacaataccgaatatcttaacccacaattattaaaaccggtacaatttgattcccttagtggttttggtgggttgtttcgctgatgttgcgctgacgtgacagtgttgacgtggtgttgatatggcgcttatgtggcattagaattaaaaaaatggaatccatttatcattcacataaaaaaatattttggacccactaacataagggcccacatccacatgtcatcctctcacttttccttctttctccctttctctcactggcgtgccacatcaaatttttttagatggcaatgtatttaatgctatggacacctaatttttttttcttattctcattgccatttatctatttcttataatattccttaaaaaaatgtgaaatttgaaacctctaagttgaagcctgcatgaatttatgtagaaattagaacccgtgggttggctcatgaaaagccatatggacggaaatagagagagaaagtgacatggacaaggaagagaaagagtggggaagaaggatgctttgatattagagaatgcttcgatactataggataggtgcactttcgctctataatctagaagccatggtccctctaaatataagttcttcacgtggttggtactgcaaaataggctttggaaaaccgaccaagtacaacggtgaggataacccaaccaaagaatttgcccactatgttgaacttgcaacgagacagctatatacctcatagcacactgccaagtcacaaagagaatctcgggagccatagcaaggtgggcacagatcaacctacaaatggagcaatgaaacaccatagatatggtggaaaacttggtgggcaaccttagcccacactaccggaatattgaagaacacgctccggtcactcattctcctagtcagttgggaaatatggaaaaagaggaatgcttatgcatgtgttccaggcttccaacgcatcacattaacgcctactatcattatagcaaaaataaagtaggaggccagagacatacacccggacctactctcataacattgttatctctctaagtttttttttttgcccccaacagtcctaccaagcaaatcctgctaacacctataggtaaactcatttctcctcctttattaatgaaaagaggccatcctcatgtcctcttattcgaaaaaaaggttgataggtgctataatcacaggaagggtctaaggaggtgaaaatgctaacgggcgatcgaccatgcacgtgcaatccgtgtgatagggtcggtccgtacctttttttttttggctcacatggttttcagcttttcattttctaacaaatctttttatgggcttatgatcatctagttttccctttttaagctggcataggcaacttgttttttaatttgtttgaagtgtatatacaaaatcgtatatgtatacaattctattatatatatatatatatataaagtttatgtgtatataatgtttctatgcataatttttttataggggtagacaaacacactacttcaacttgtttgaaacttgtatatacaaaattttgtatgtttgaacaaagtctttatgtacaaagctttgtttgtcggtggcgtcgggtgtgggttggacttggcaatgctctcgagatccgagtgtgacgaggcggacgagtacattggcgtcggcaccaggatggtggtctccgtcgcagccaacgcgcctcggacaatcgggaatacagacaagcctagactgcttgctgcgcgcgccgacacggacatggaccaccctgacgtggattgcgaaagagaaagaggagatgatgacgtacgtggtcacctgacgtatggggcctacgtgggtcccacgctgagtcaactgccacgtcagacaaaactggagtcaaaaccgccgagggacgtagtttgcattggttttgtaagttgatggatgcattgtatctggctttgcggttgggggacgattttgtaactcgatgacaagttgagggaccttcggtgtactttttcctaatttttttcaatcgggctaacatgttactgggcctaaaaagctgctcgttgggccgttcaaagagaaatatatatgggccgacgctgcttggactcttgtggaaacggaaaaacggatgctaaagagcgcatgtgacatcttatcgtcattttcaagggttaattggatcataccactgctgcaaatgtggactattcacgatatcggccggatgtcactagaattttgagaaattaaatccataccaccccgtcatgttttccatccttcccgtcacactttccgtccttcccgtcgctctttccaggaggctgagggcacggaggctggcgttgtgggcggcagacggcggagccgccgggtcaaggaggcggagcggcggagttgccggcggacggagacgacgggtcgaggaggcggagcggtggagttgccggccggcgtcgtcctccgctcctcgctgccgacccgctcctcacccgctacggcgccgtcgtggtggacgacgcgcacgacgggatggctctcaccggcgtcattctcagttagtcggcccattcatcttgaagaaacagcaaccagtcatatccaatttccatcccagtccgtcgtcccctagctgccggcatgccagccacaagcaaccctcgtcatgctgcatcaaatagcaacctcgtcgtcgatctgcatcatcaagcaacaacagccgtttcggcatctagtggttgacattcacccagcagaagcccggccggatttggcgctggatgcggtgctcgttgaagccgcccgtcacgtacggcgcctcttcccgtccccatcgcatcgctcatcctcaccgtctcctcgtcctcatcgtcaattgcggtaacctcatccaagtcatcgcccgtcgtggcccatcgtctacaagcagcaacaagccagcttcattccggcggtggcggcgggctgaaccacggtggccgtggctttgtgctgctgatgctgcgccgcaagctgctctcaaccacgcgtcccctcccatggaactcgtcgacagactgcaggcacttggccgtgtcctcctcggcagacggcagaccaggcacttggtcgaggtcctcgagtccgcaaaaacgcgcgtgccggtcttgacggcggcgccgcggcggagtgggccggcgcgggacgagttgaggaggccgaagtcgaggccagagaccatcccccgagaggcgctggtcgtcgagttcggcggtgctttcaacggcgaagtagaaagacggcacgtagttaggaaattaacgggggaaggacggaacatgcgacggggtggtatggatccaatttaccaaaattttagtggcacctagccgatatcacgaatagtaatagcgttttattaatttgccacatttgcagtggcatggatgcaattaaccccattttcaatcgcgcgtccctcaagcggtaaaacaggactccgtaggtagtcaaacggcctggaaactaaccagtgcagaatcgcaggataccataacctgaataaatcatacacacaaaccggaaaaaagaataaagaaagaaagaggataaatggtagccaatttgtgttagggcgcagcagccagagccgaaagcttctgaagctgatgcgatcaaacctcaaaagaccatgggcagccagcacggaagttacaaaccgaagccgcgcggcgcgcatacgcatcagaaaggcgcgcaataacggaccacccatacggcggccgcgctctgttcgcggcgtccctgcgcctgcatcgcacgccatccaaggctgcatagcacgacgcatacatatctcacgcgccctttttatctgcttataaatgagatagcccacatagcagcgctgccgtttctcctcttctctcgttgggggcaaccgaacttatccaacaacgatccatccattggccaagtggctgccgtgctgcacctataaattcacatgcaccggcatgccactccacacaactcagctactcgaaagaagcagcaatggcaaagcgcatagcctcaatgagcagcctcctccttatcgccttgctctgtctgagctctcactggcccaagcccaggtcctcttccaggtaagcatcctgtagtacaatgtcacattacataaaaaaaaatgacttgcgtttgacatgactgttcttggtgtaggggttcaactgggagtcgtggaagaagcagggcgggtggtacaacttcctccatggccacgtcgacgacatcgccgcgaccggtgtcacgcacgtctggctcccaccgccgtcgcactccgtcgccccgcagggatacatgccgggccggctctacgacctggacgcttccaagtacggcacgggggcagagctcaggtcgctgatcgccgccttccacagcaaaggcatcaagtgcgtcgccgacatcgtcatcaaccaccggtgcgcggattacaaggatagccgtggcatctactgcattttcgagggtggcacgccggacagccgcctcgactggggccccgacatgatctgcagcgacgacacgcagtactccaacggccgcggtcaccgcgacaccggcgcagacttcggcgcggcgcccgacatcgaccacctcaacacgcgtgtgcagacagagctgtccgactggctcaattggctcaagtccgacgtcggcttcgacggctggcgcctcgacttcgccaagggatactcggcggccgtcgccaagacgtacgtcgacaacaccgacccgtccttcgtcgtcgccgagatatggagcaacatgcgttacgacggcaacggtgagccgtcgtggaaccaggacggtgaccggcaggagctggtgaactgggcgcaggccgtcggtggccctgcgtcagcgttcgacttcacgaccaagggcgagctgcaggcggcggtgcaaggtgagctgtggcggatgaaggacggcaacggcaaggcgccggggatgattggctggctgccagagaaggccgtcaccttcatcgacaaccatgacactggctccacacagaactcatggccgttcccctccgacaaggtcatgcagggctacgcctacatcctcacacaccctggagtaccctgcattgtgagtcctcagctgcatgaatacgaatgccataaagaaaaatctaattttctcaaccagtttctccgactaaattctgtttattgactatgtgtgcagttctacgaccatgtatttgactggaacctgaagcaggagatcagcacattagctgcagtgagatcaagaaatgagattcatcccgggagcaagctgaaaatccttgctgctgagggagacgtctatgtcgccatgatcgatgataaggtcataacaaagattgggacacggtatgacgtgggcaacttaatcccgtcagacttccatgtcgttgctcacggcaacaattactgcatttgggaaaagagcggtctcagagttcctgcagggcggcaccactattaggcgaagaaaatttttcaggactatttggtgcctggaataagatttgaattatatcctaaataaccagattatgattgtatgagatttcttaatctgagcaaagcgttgagcattgctccgatatttctatgtattctacctgcctggggatatgatatttgtatcctctagaagtaaagatgattttaactcagaagtccattgactttactgctacattttaatcagttgcagcactgtgttgatcaaatgcaaacgttcctgacagcagactcatcactaaactttagggaaattaattaacctgcatactagtccagtgcattgtactccccccgtccaaaaaaaagacaaaccctgagtttccgtgtccaactttgactgtccgtcttatatgaaattttttttataattcgtattttcattgttattagatgataaaacatgataaatattttatacatgacttgttttttttaatttttttcataatttttttaaataagacgaacggttaaacattggacaaaaaacagggtttgtctttttttgacggagagagtataccttacgaagcacctgagcactactactgctgatgctgcttgcattgacctaggaccgacggcctgctgctgtgcgtgcactactacttgct

SEQ ID NO: 66977 - DNA, 2238 bp, Oryza sativa
atagaaatacaatttagaagtaactgaaattcgaaattaaaaattaaaaaatattgaaagatgagtttagagttcacatagaaatacaattagaaataataaaaaattcagaaataaaaataaataatattggaagaagagcatagagtctatatagaaatacaatttacagaaaattcagaattaaaaaaaataaatattaaaatacgagtctagagtacatatagtaatatatataattacaaataactaaaatttggtattaaaaataattaataactaacacgtatataaaatataatatgaatattacatattagtagttttgtaaagttattgcaaaatttaaaattatgttgccattttaatatttttgaataatataatgagaaaacatatatgctattatatgagagaaaatataataatgctagccgcgcaatatgcgcggggcaccatgctagttttagtaaatacataagaaatcctgtcaaaattttggcaatattgtcatcttgccatattgccaaaatttaataaggtttattttggctacatctgaacaagcccttaattttcagtgttagtaattttcattaactaattctagcgaggactcttgttttaatcagaattgccatccttgatttatttacttttttatttaattaacatggaatgtacgagccccatcaactggccaagagctgatttgatgccaaaacatggctcattagcgataaaaaataatttataaatgaaaattttatatatgtgtttttaattagtaacttaaaagctaatgctacaaaagaaatacattagaaatattctaaaatcaactacagaattatgttttgaatcagattttagcagcggttgattttatataggacaaacaatgaggctctaattccaatcagtaaagctagccgaatggcattcccttgaaaaagaaaacaatgaggctctaattctaggaagtgtccggcaaaagtacgtgtacaacaaggataattaaattcatgatggatggatgaattgtataatgtaatttggataccaaagaagaaaactagcaaacataggaaataaagaaaaaacattaattgcgaaacaaaattcgaattggttttagctagctgcccttaggtggatgtgcgccaacagagacgatcgcatgaaggaaggctgcagcctggaacagcctcgcctcctccagggaacgggaacgggaagaacaaaaggaagctttacctggagcccacaacgctatccaaggctttatctaacttcctattggcctcctttttatcctcttttaaatgagcgcaactcgtcgccgccgtgccgttgcgtttctcgttaggagcaactgaacttatccaacgaattgaacaatcaattcacccggagaggtacgtctgcatgccgggctgcacctataaattcccatgcaccagcattccccatccacacaactcagcttgtatctgagacacgcaatggcaaagcattccaccacaatgagctgcctcctattcttcgtcttgctctgtttgggctctcacttagcccaggctcaggttctctttcaggtgagtctcattgatcatttgatctgctgtacttcccgttagtatgtcacatgacaataggaaatagttcctagctatgaacaaatttgacgtacctgcacgttgacatgatgttggtgcagggattcaactgggagtcatggaagaagcagggtgggtggtacaacttcctccatagccacgtcgacgacatcgccgcgaccggagtcacacacgtctggctcccgccgccgtcgcactccgtcgcgccacagggatacatgccgggacggctctacgacctggacgcgtccaagtacgggacgggggcagagctcaggtcgctgatcgccgccttccacagcaagagcatcaagtgcgtcgccgacatcgtcatcaaccaccggtgcgcggattacaaggatagccgtggcatctactgcatcttcgagggtggcacgccggacagccgcctcgactggggtcccgacatgatctgcagcgacgacacgcagtactccaacggccgcggtcaccgcgatactggcgcagacttcggcgcggcgcccgacatcgaccacctcaacacgcgtgtgcagacagagctctccgactggctcaactggctcaagtcccaccgtcgcttcgacggctggcgcct

SEQ ID NO: 66978 - DNA, 4546 bp, Oryza sativa
agccgtcgtggaaccaggacggtgaccggcaggagttggtgaactgggcgcaggccgtcggtggccctgcatcggcgttcgacttcacgaccaagggcgagctgcaggcagcggtgcaaggtgagctgtggcggatgaaggatggcaacggcaaggcgccggggatgattggctggctgccggagaaggctgtcaccttcatcgacaatcatgacactggctccacacagaactcatggccgttcccctccgacaaggtcatgcagggctacgcctacatcctcacacaccctggagtaccctgcattgtgagtgctcagcttgataatctccatcgctatcagaaatcgatatttgttaaccataatctcgaactaacattccgtctgtctgtacagttctacgaccatgtgtttgactggaacttgaagcaggagatcagcacattggccgcggtgaggtcaagaaatggaattcatcctgggagcaagctgaacatccttgctgctgacggagatgtctacgtcgccatgatcgatgacaaggtgatcacaaagattgggactcggtatgatgtgggcaacttgatcccgtcagacttccatgtcgttgctcacggcaacaattactgcgtctgggaaaagagtggtcttagagttccagcagggcggcgccactaggccaaatatttctttcaggactattttgtgcctgaaataagaagtttaaatgatgtcttaaataacaagaaagtgattgattgattgtatgacagacaaatatttttgtcaggactattttatgcttggaaaagaaatttaaatgatatcctaaatacctggaatatgatagtatgccatttcattcaaacaaattattaaaatttgctctgaccgtctgacgtgtcaagggttcaatgtggagtattattcttgcctcagccctcaggacttttgccccactagctgtgaagtgattttttttttgtttaaattcgcttggtgttagtagttaccacaacaatctggaaattaccttacctcagcgcagtatgaaaatgtttgtcttctatctatactcttctaaatgaaggcaattgtggtggtggtggtgaaaactcaaaaatattagcagaaaacaacatgttcatcatactgcagatggagcaattgaataatgggtgcgttttctactctaattccatggatcacagtgaaaatagttgggattgactgcacatagcaaaaccgacaaaaatcgcttatcagatcgagagggaaatctgtccaagcgagttgcaaattccttaccgaaccgaaggaagaatcccgaatcggcccggatggagatctccgctccgcgccgccgccgaaccagtagaggggagaggacggaggagaggagaggacttcgacgcggcgtgcttcggcgccgccggagaagatcgacggtatggcacctagcggcggcggcgccgcggaaaggggattcgtcgccgcggccgaggagagggcaatctggtaattagcgcgagttgacatctccaagagtccagaaacgccgcttcggccttcggataagccacgtcatcaaacaacctgacccggtttgaccttttccggtagactattctacccttggtttgctgccgctgcctctgctggctgctggcgcctccccgctgacctcacgccttaagtcagcatccacacgtcacctcggccccacggcacagcacacactgcccaaatcccctcgacaccacacgttttccacagggctaagcctgaaagaggaaagatcaacgacgacgtggagcatgtcctggcgccgttctgtcgccgtgttactttcgatgttggtctccccctatataagtgcacccgctctcccggcttcagctaacgacctcaagcacactactagctccggctcacttagctccctactgatcactggaacactcatgaccaagaaggtgataccggccatggcggcggcgaggcaggattcttgcaagaccaagcttgatgagcgtgggggtagtcatcaggctccgagctccgcgcggtggatctcgtccgagcaggagcacagcatcatcgtcgcggctctgcggtacgtggtgtccgggtgcaccacgccgccgccggagatcgtcacggtggcgtgcggggaggcgtgtgctctgtgcggcatcgacggctgtctcgggtgcgacttctttggggccgaggcggcggggaacgaggaggcggtaatggcgacggattatgctgctgctgctgctgcggccgcggtggcaggaggatcaggcgggaagagggttaggcggaggaggaagaagaacgtgtaccgcggcgtgcggcatcggccgtgggggaagtgggcagcggagatacgcgacccgcgccgcgcggtgcgcaagtggctcgggacgttcgacaccgccgaggaggccgccagggcgtacgaccgcgccgccctcgagttccgcggcgcgcgcgcgaagctcaacttcccgtgctccgagcctttgcccatgcccagccaaagaaacggcaatggcggcgatgctgtcacggcggcgacgacaacggcagagcagatgactccgactctgtcgccgtgcagcgcggatgccgaggagacgacgacgccggtggattggcagatgggcgcggacgaagccggcagcaaccagctctgggatggcttgcaggacctgatgaagctggatgaagcggacacctggttcccgccattttccggtgcagcgtctagtttttgagctagtgttattagatctcaaccgttggattagattactggaaggccattcatttattcgtttcattgtatagctaattagctatgcttcgttgtttgtgcagagcacgttttttaggagtaccgtcttatgcatatttttttgtacagagtagaaagtaccaagaattttgtatattgatggaatagattatttccaattcatatttgcgcaaaatgtctgcgatgacttgaagctgagttaatttgcaaacgatgcctcggtggaagcagttccacatgcgttccagtgagtctccacgcgagttaataacttaggcgtgtacgtattttgtccagtcgtgactcgggagggtgaatccgcttttcacctgactagtcaacgtcacatcgagaggtggtggaactcagctagttttcgctcgtggaacagcaccgtacgagggaaatcacccgtggcgacggcgatgtggaaaacagcaggcgagcaagcacccagcacactgcacacgggtacacgacggtcaactcgtttccgaggaccaagcgagagcgggagaagagaagcagcttgatagtttacagaagcagcttgattagtttactcgccacggccaagtggcccaactgcctttcccactgtgatcgcaacgtgccaccagccgcccaccacgcagcgtcgcgagccgtctagggatggcaaaccggccgcggtcaccgtcgcggctaagccgtagcgcgcgagacgggtgggtttccgcgacgccgcgcggtggattctggagagaagcgcccgcgatgccgtgatagccacggaggcgcggacggtgaaccgcggctccagctgagtgttttgatgggactcgtttcgtaagccaaaactgggagcggggcgctgctttctcgctcgctgcgcgccgcctggtggcctggggaccaccagccccatccgtatccgtgggcaaaagacgtttttgtctcattgtgtgccctaaaattgatcttttatcacaatccgtctttaggccactggagtttcattcgggctcattcggaatgaagcaaatgtgaaggaaaacaatggaggattgatgatttctttgaattagctaccgtagttgcattcgttttaaaagattggctacccgattgtcacaggaatactattcgctacctatgcacgaagaataagaaattcttatgttattcaatcatgtgtttcacacatacaatcctatcatatttctgtgatttctatttctacatttttttctatcctgcattccaaataagcattaaataaggtgtcatgtcagtgtttctgataatgttgcaacaaattaataaagtgagagatgaaatgggttttaactagacgaaatcttgtctacactgtttttaatatactccagtttgtatcttgcatatactacccatgaaacaacaaacatgaaactatgcattatgtgagctatttcaatcatcaattaaataccttattacttatgtggtatcttggaaacataaaaatgatatctctaattaggaatagccttagatccgatcttatttgcttccattccatcttgattccttaatgaccacccctatatgcccatagtttcatgtcatctagattccctaaggcataggctaggaaaagggatcgaatgcaatgttctttgactcaggaacgtcgtccccatcccagcaacaaggagacattttcatccgtaaaatcttgcaatacgttcat

SEQ ID NO: 66979 - DNA, 6586 bp, Oryza sativa
  unsure (1)..(6586): unsure at all n locations
tgtttgctattgggcatgtgttgtttgtttggtgctatggcttttgtaaacacaaggttaaaattaggccaaacaagtccctgcttttgcggaatagcactactccgcgtcctaattatagttatagtttttatctttggtggacttggtggtctccctgcatatggacgtcgtattgcgttcctaccgttcccccccccccaatctcttctcgtaactttgatctctcttattgatgaactcttgaagggaacggaaatcgaaaatccaagaggtattgtaactttatatgtggctattttctacaacttgttagccaatttctttgctagttgtagtatgtttttacgcctatcatgtatttgatttgcatagaagctgtttatgtctatctgtgtaggtatatcacaaacgaaaactacattttcttcaattaagtggagtcattttttatcttcatgagaagtacaaaagtgaccaaggatcacgtgaaattaattatcttaatatgaataggaagtgcaaggaagattgcgacatggtagaggcctattattcatgtgctaaccttagcatagttgcatgttatatacttttcctgataaaacatatctctcaaccaaataaagattcatggaatgcttttactctattcggtaactatcttcgtctatattacaatgtgttgtgttgttctgtaaagatttctatagatgctttatatttatccatgttattaattattatgtacatgcaaaaactacattgcacaaatttagaccataatcttcatatgttttactagcatgctaatttgtatgactccaatatttagaaaaaaatcatgacctacatttgttttatccatggagatgagaataggttatgtcatacttcgataatttgatcaatatggtgattaaatttcccttcctgctatattgtaagtcatttgaaaagggttaatcaatcttatgtgatatatgtgtgtcacgatttttccttcttactagcatataataaccttttcaggtgccccttactaattctatccatcataatcatttgaataattatttggtattctcctgcatcctaggagatggagggcttgaatattgaagggattcccccagtgcctattgatccaaactctgttgatgtattgtcaagctcaaatattgatccaaactctgnttggacatatttggtcaaagncttncaaatattttgatccaaactctattngatgtattgtcaagctcaaatgaatcaaagcctactatttcatttgatttgccatcaagtttctcggttggtcatactagacattcaagtgaagatttaagttcccttacaattaataatttacgcataaatcatagagaggacaattaccaaagccagtttgaagagaagcggatacatagccatggtcacacaagacgttttagtgaagatttaagttctttgaagattaatgatctatgtgcaaataaggaagaggagaattatgacaaccagcttgagaggaaggaaatatatcgccataactcagctggaaacattttcagggctgcagagattgctgaacgcttcattcaaaccattgataagagagtcctggtcgacacagcagcaccaattgaatccgttaaagatgctgttagcaaatttggagggatacttgattggaaagaggtagttttttaatccttctttatccatcttactgtcttgttttgatgaagggaatgcataaattcgattataactattctttcgtagagacggaaacatgtccaagttgagcttgacaagatgcaggaagatgctcctgagtacaagagaagagtggaagtcacagaagttgagaaaagcaaagttcttgaggagctatattgtactagacgaactatagaacgactaaaaatagacctagacaaatcccatactgagacaattcaagcacaacaagacttagagcttgctgagattcggtttgaagagatgcaacaaggcattgcccgcaaagagagatctataacaaaggcaaagattgaggttgccaatgaacgacgtgcaacggccttagaagacttgcagtcagtgaagatggagctagatcaacttcaaaaagaatacacatctctaatttctcaaagggataacactgaaacaaaagcacgtaaggccattgttgcatcacaagaaattgaaaaggttgttcaggatctcaccattaaggttatcacaatgaaagatttgataaccacctcacaagctaaccatgttatagctgaggggaaaaaaataaatgcagctttggcttatcaacaggacatggtgaattggcagaatgagctaaaacagattgatgacgaggttcaaaagctcaatgatgacctatcactcaataaagaccttgagtcaaagctacaaactgcttcaatgtggctgatgaatctaagggacgagtttaaggctcacgtggatggtacattgcctaaagtgccatctgaggctagagaggaagagcggccaatgataattgtttgtgcgaagctagcacgaactaggaaggagcttgaaaatatgaggatagacattgataaggccaaggatgatgtgaagtctttgtggaatgctgctgctacattacaagctaatgtagagatggagaaaacaaacattgcatcattaaggcaaaaagagaatcttgcatttgaatctgctttagctcttcaagaagaattgagcaagattgcttttgagctcagcatggtggaagagagaacaaaagcagcaaaaatgcctttagaactacagcaagcaactaaaaagttggaacatgcaaagttgaatgctgtatttgctaggaatgagatggaaaaagctagagaagaggcagatcaagcccaggcagaggtaaatgttgttcaattgagaatagaagcaacattgagggagatacttgcagttaatgcatcaagagaaattgcagtggcatcagcaaatgcactacaagactataaacaggaaatagaactagaaccactagctaatcgaaaaaacaacaatgtcacattgtcacttgaagagtacaatgtattgtgcaagaaagtgcaagatgccgaggactctgctaagaagcaagttattagagctatagagaagatcaagaaagcaaaggatgcagaggtgaggagtttggataggttagatcaactgatcaagcaaattgatgataggagggttgcactgagagaggctcatgagaaagccaatgtagcatgtgatggaaaattagcaatggagaatgaactaagaaaaaggagagcccatcatgagaaacaacgaaatactggtgaggtatctcttcctattgctcaaatctccaatgtaaagaacacatcaacctcttttgacgcagtaggatcatctaactccaatccttataagtatcgaatgttgctacctagagctgacactatagcaactacaatagctgagtcaaggccacggaagtctttcttcccacggtccttagtggcaatgttcatgtttaggagaaagacacatttgaagtgataactcttctccttgctagcttgcctatttatttttgtttgtttttgtacatgtaccttcaaagtgtcgacgtttagggtgggttgtaattacttatcgaaaatatataaaattaagccagaggtatttgttgttcttgtaccactttcaatctattatatactaaaagtttattaaacttcctataaacgctcctaaatcgaccgtgacactctaagaaaatcctaaaaaatctgataaaaacaaaaatatctagccattgatttacacttaaatcggtggaacaattattttaaccattagatttgatactaaaaataaataattcaacaaccggtggacccattatatctattaaaagaataactctgctcccctctttctgtaccgtgattacggcggtgtatggagtacaatgatcttgttcgccatatgaggaaccgatcgtgtagctctcgatagagtgttaatttggttgcctgcgattggtttcgatttgtcgtcttgacgattggatgctgatgacgctatgcatcgaaacgctcgagcagcaatcggagaagaattagccgctttgagaagaatggcaaatataatacaagatcaattagcaaaacaataacagataatgctgcctatgcttacggtctatgttgacaatattctaatcagcaacaaaattcacgactgcgcatcatcaacagattaatacactaccacaatcaaggactgcatgattgagagattattactagctcccacctttttatattacaagacgctttgatttattttttgaatggagatagagtagattatcacaccaacaaaattaaggattgtgcatgatccacagattaatacacagataaattaatgttggaatcaaaacaaaaatcttaaaaaggagtcaaacaccacatcacagatttatttaattcactcctctattttctaactaataacaatcttagaaattttgaggaaaaaacatctggccgtagatttatgcctaaatcagtgggtatattattttaaccattagggcaatgtctgacacagctctagattctaaatacaatgtttgaagtttatatgttaaattatagtggtttaaaattttaaatttcatctaaaatagaaacaaaatgaattatccaaatgttatcaatgtaaacacatagatctatggatctatggacctagaaatacaaaactttaataaatcttagatccggagctgtgtcaaaaacaaacaactcaattggtgatcccattggatctatgtaaagaaaacaaaccgtcttccactctccctccccctccagctgtacatttgtatgtctccctccgcactactcacccctcgtctcctcctcatctcctcccatttaattcacccctcttattttgaactaacgacataataataaagtaatttatagttacatagctaaaatataagttatggctgatttttaatttgtttgaactcttttacaattggatagctaaataactcaacatttaaattacttatagaaaaattcaaataagttggttgaacatagacccctattcttttgcatggtaaccaaacaacattctatttttaatttgtttgtagtattgttttatttataatcatataaataattgaaaatccatattatttcattttattatataaaaattaaaatgtcatttgaacatagcccctatcttttgcacgataaccaaataacaataaagcattgaaaataatgatagtaagtattatgacatcttaaattattctacttaataaagaaccattaaatgtcctctagagttcttttaagccttggcgtgtcaatgtttaaaaactagaaaaaatcttcgaaattcaatgaaaaaaaagtaaaatatttgatcattggtttgtgcaggcaatgcgagagattagtaattttacggaccgattgctcagcatgtgtggaaggactttctactccatgtatggatcagtcttgcagttatggccaagtcatgctaaagaccgtataagtcttgcatttacactattttaaaccactaaatctacttttaggaaaacctcaagcagtcgcatgccactttttaaaagttagcaacatcttagaaatcttggaaaaaaaacatccgatcatcatcagtttcaccgaaattgtttagaaaagaacaattttacggttcttgaggaggtaccatgaggtaccactttttctattataaatttggtacctcttggtacctaggtaccatgaggtaccaaattttacactaaatttttgatacctcatggtatctactcaagtaccgtagaattactctttagaaaaactagaaaatcaaaagattttccacggtctttcaataattttatgaaatacaacgtaattatgacaattgaattggcattgcaggctttaaataataaatatataatatacatgtacttaattcatgacaactgcaggctagcttaaaaaatgtaaagtgtttggttatgagtacataatttctagcattaaactataaaatgtatagaaagatattaaaattatggaagcaactataatacatcacataataaaaaaatgatgaagaaatcatactttttcagatgcaaccaataatgcatatgcccgcgtgaatgcgcgggctacctttctagttaatttaattgcattttgccaattctctaacttaaactctgagagtgagagccatgttgtggaacttcttgaggtgttgtgtcatcattaaattgacaaatttccatctttaagtgggcatacgttgtttcacttattgtttgccaaaagacagggctttggtaccttcttgaagacaaccaattgcatggagtggtctagtgctgacaggatgcaaatcatttgaaacattccccatctcaaatcacatgacatctttcaactggaaggccatattacatttgcctccatctaagtca

SEQ ID NO: 66980 - DNA, 1434 bp, Oryza sativa
gttcaccttcgccagcacggtctggtcgtcgtcgcagaagaagagctggtccgactgctggtagtcgtgctccagatggacgtacgcgtacgacggcagcgactcggaccgcacgccggcggggtcgtcggtcttgatcttcttagcaccgagcaggttcgcgtagctgtgctcgctgccgcggccgagctgcgtcaggttgtggacgaggaaacccgcggggagctcccacgatgcggccgggaagggctcgcagaagagtccggccatgtcgtcggtgacgtgcaccacgaacacgcggtgggtgaggagcgcgtagaggaaggcggacgccatggagagcatgcggtcgccgaggtggctgccgccgcacggcgtccagacgaggtaggtgcactcgacgaggcccatgctgtaggcggaggtgagctgcatcagggacttcttgtagaagagcgtgccgggcccgcacttgcggtggagcgcctcgtacttgcgcagccgggagacgaggtacggcgacggcgagtgcggcgacggcttgcggtggagcgacgacttgtaccggctcaggcacgcgctctcgccgatgtccggcgagagcagcccgccgaggagcctgtcccggttcgccggggaggattccggcggcgtccctgctggatcctctgcattgaccaagaaaccagtgaactaatcgcgtagtgacgtcacaggaagatcaacgttgagtgctgctgctcaccgtcgtggacggtcaccgtgacgcccatctgcgacacgtcggacaaggtcggccgcgctcgtgacagcgcgaggaagagcgggagagcggcgaagcagaggacgacgagcagcgcgacgggccacacgccgctcgtcttggacggcaaaggcggcggccggcggtgcggccgcgtcggcttactgtccattttaatcaaccctccacttcgtctccgccgtgaaagattttgcagcttcggtgcacgagctgggcagagatcagattgactccaatgcagatgcagccgatctgctactgctggggtttgcacttggcgagttgaccacttgggctctcacctttttgccgctcgaagtaatggccttgcgtaagatgcaaacttccattgttgactcgcctaattgatctcggtccaaagacggtgaataatctaacccaactaagcaacaagaacagcccaggtaagttcacttacggcccataactcaaattcgtttgacttaggtgactcgcttaatggatctcggcccaacgcatttcagcctttctgttcaggactgcatagcctgaaggaaatccaggcccttcatagtaggtacaagtacaactcggcctcttaatttcaggcctaatatcgcaaattcgcaatatttatgttctaccagcaaaaatgtctttgcattcta

SEQ ID NO: 66981 - DNA, 2174 bp, Oryza sativa
gctgagctaatttgttaggcaaattaatcttgattcgcttctggactgccggaagaggaagaagaagctagctaggcagactccaatcggtctgtacactgtagtcgacctaaagcgtagaaaaggaggtttcttgtcgtgttacacgatcataaactgaatatctgaactgacctttgaggcaaaaatggacaacagggttagatacgtgtgtcagggagtgtgcgccattcggaagtcaattgatctctccacttcgttttagttttccacgcaaagcatgcttatcggttttaaacgacggattcaacctgccttaagaaagataattgggggcagaaagagacaatagaatgatagaaacgattgaaaagagagatgcacctactgctagctgacgtgttcatcatctttttttttccatttctcccttttgacaaaaacctcacgtctgttgtgtagtcaattcgtcagaagttaattccactttactgatgatcttgcatcagaaaacaagaagatcacatagctataaaccacaactctgaaattataaatagcaggtggaaccacaaatctgaaacggcagaggtcatcttcttccattgaaaaaaaaaaggaaaaaaaaagatgaagtgcgatgaagacaaccatgtacgtaagcaagtgtactccattgctgaatgcttcaaagaggaaactctagcatcatgcatatgcatctgagcatctcgaagatgaccatttccaattactattagctagctcgttgtgaaagggcatatagtctagtggttgcggtgacctaaatagcaccctaaggtattgagttcaaatctctataggagtgaatttcagattgggttatttgagggctagcaccccaaagttctgagttcaaatctcgatagtagcgaatttcagattgggttatttgagggctagcacaccaaggttctgagttcaaatctccatagaagcgaatttcagattagattatttgaggactaggtttctatatttgataggctaagttcctaattaaaaatatatttgataggctaagtttctaattaaaaagaggctgtatatatctggttgaatatagagggctggtaaaaaaatacctcgtctactagaagggtgttcatatctgaactggcaaaaggaaaggacacgtcgcgactagcaaattgcgacgggagcaaagtagcaaacagttccatgaaagcaaagttaattaggtaactgatatatagtagcttgcagatcaggcataattcaggccggccgtcgattgacacgccaagtgtactagtggcgacaaagcatgatttctggtgcatctctatgattatatacgggacaggaatcttggtggaaatttctgggatggattgacttttccgggctcttcgtctatgatcgtctagaaatgttggcacttgttgtaccgtactcaacctgcacatgcaaagcatccagcgcagctaatctttgtttgcctttactcgtgttcgtgcttaatttgtggggtagaaagtttcttcagcgaacatgtcgtgtgtggtttctcctgtgcttgatcacaacatcacaggatcttggacctttggtgcatgaatactgacatgcatgttcatcagtactatagttatagttgtcaaagcgtcacgctaataacaacaagctatttatatcttcaaaagaaaaaaaaaacaagatcagctatctagctcagttctcagtactggttcttcaattgctgcaactggagtagatgagaatactccaaagtgtgaacgtctaatagtattgattagcagcgacgtctgacagagatgtataacaagtatcctgacgtctggtatattgaattcaatggaacagttgagttactctttccgttgtgattgattctgcacatcttgtggtgttgttcgaatttgacttctagtagaaatttgatcttaggatctgtcagtgagacagtgatatatccatcatgttttttttagatgacatccttcttgttttagcacccaacattcatgatatttgcttccctttgatatactgttcttcaagcgttaatccttgaatatactccctccgtttcatattataaatcgtttaacttttttctaatcaaactttattaagtttgacctagt

SEQ ID NO: 66982 - DNA, 3975 bp, Oryza sativa
aaattgttaaataactatctcgttgtcttaggactttaaaagaccgaaccttaaaatctccatgtttctaattttgtagttttaaaaagtcacaccactcactacctcttacctctttgtcaccccctttatttgtttgcttatctactacagcttctatttatcctccttggaactttaaaattgaaccttataaattttagagttaattaaatcgttggttttcattttttaattctcgtcaaatgccgctactctactcctctacggcccgtccaccgcttcctctctttattgttattgagattttaacaatcgaacacaattatcgccagtgttcatttttaactttctaaaagtcccgccaaactgtcagcagcattgccattatactcttgtacggcccgtcctatgcctttccttttaattatcattgagattttaaaaattgaacgtgattatcattgtggtttatttttttactttctagaagtcccgccgatcactctgattgtgcttcttaacgggttgcccgccatctctcctcttaatcgccattggaattttatttggggttttgtttatactttttacgcccattgccttccctcttttttattattgagattttacaaatcaaatatgattttcattggagtttattttttactttctagaagtcccaccaacccccgtgatcatgctattacaatggcctgtccattgtccctcgtcttaattgtcattggattctattttaggttttgtttatagtttttagatgtcccatcaaccactgccaccctactcctttacagtctcgttgcttctccgctctttattttcatttgccatcgttgtgtttttagatggattgtgttttatttccatattttttattcagatattatgttgtttataaattttattcctacttgaacgcctttaattgtttttaaatttttagaatttaatttattttttattccaaaatttaattaaactcgtgctctagatgatctcttctttcagtattgcttattttttattccgaattttagttattttaaattgtatgcccatatgaactcttatttttattttctaactttagaatttagtttggtgatgggttgctctttcaatattcctttttgttaatttcgaatttgagttatttctaaattgtaatcctacttataatatctttttttgtaatttcagaatttattttattttatttttcattccaacatttaattaatcttgtgttgtgttttgaatggcctattctttcaatatcctaacttattattccaaattgataattctaggcttatagagttctgaactgcatgttttcaaagtatggttcatggatggattgttgatttggttaggacatggtatttcttagtactctcagttttttttaactaaccaatatcatataaaaaaatataggagtatttttttataaaaatattgacatatataggctttctagcatttatgattagaaacttgagaggaaagagaacccatctatatatgtgtatttgaaaattagcatgtggtagtcaataaaaacttattgtaattatattagagaataggattactgctaaaagttttagcttttcatttgaatccgatggaggacttgtcctgtcctgtttttcctgtcctgttgctagaccttcatagctatgattccaaaaaaaacgtgtcatgttgttgtgtggctttgctcggttgggagtccgactgcaaacatgactatgagaaggacatgtatactgcgtagtattttttttctttatttatatacctatacaatcaatcttaaccgttataatatagatccactatgagaatatatttttctttttatttcaaattttaattaatctcgtattggatttatagatggactcttattttaattttacttatttttaattccgaatttcaattattcttagattgtacttctatttggactcttcttttctttttcttcgattaacgtggtaatttctaggcctctacggtgaacgtggtgcctctttttcgaactgttttaataatataatagataggtagatagatagattcttggcccccagatatagatgggccggattaaactgttttgcacgtagttgtctatgaacaaagaatatcccaaatctaagcatttatgccaaattttcattgttgattgtacatttgtacttgtgcattcaccgaattaacgatgtgtgataacaaacacgttcttagtgtctttctgccaaaaacatgtccttattgtcttgtgttgattaggacagaaacatgttacgattgcccctcaatacgttcacacgatctgaccggggctaacgagagatggcgactattcatgcagggtttccggaaggtggtgcccgatcggtgggagttcgccaacggcaacttccggcgaggagagcaaggcctcctctccggcatccgccgccgcaaggcgacgacgcctcagtcctccaaatcctgcggcagcggcgtcaacgtcgcgttccctccgccgctgccccctctgcccccggagccgtcggcgaccacgtccagcggcaacgaccgcagctcctcctccgcgtcctcgccgccgcgggcggacatcaccagcgagaacgagcagctcaggaaggacaaccaaacgctgacgatggagctggcgcgggctcggcggcactgcgaggagcttctgggcttcctgtcgcgcttcctcgacgtccggcagctcgatctccggctgctcatgcaggaagacatgcgagcggcggccggcggcgtcggcggcgagcagcgcgtgcaagagcacgcccgggaggagaagtgcgtgaagctgttcggcgtgctcctcgacgacacccatggcgccgccacgaggaagagggcgcggtgcgaggaggcggctgccagcgagcggccgatcaagatgatcaggatcggcgagccgtgggtcagcgttccatcgtcggggccggcgcggtgtggcggcgacaactgaagtccaaacttgtgcatgccacggccatgacctgatcgaccaggcgaacggcaagcagaaggcatgcatggtgaggttggtggcaagaatggtccgatcaaccaagtcattaggtaaaacgagacgaattaagcacgccaaatacgtgcggccctgtgttaatcacgggttgctaccatgctagtagtaaggtaggaacagtacgaggagtcaaggctgaccgaagcgaagcagccggctcttgtgtctggacgttgtttcagttaacactgaaagcttcaccttactatggattatacattttttagataatggaatataatatcccggtctttacttaaaagagctacaaccaattattacatagtagtttttatgaacatagtataaatctaaatgaatagaacacaccgaagagaaaaacaaagaaaccaacataacgtaaggagatcacaattattaaagtctatttgtaaatctccaaccataattggcaaatagttgcataaccgtggtctccaactttcggcatgcaactttcagaaactcttcatcttcatcacacctttgtagttgtgcccaaaaccggagccaatgagttgccctgaaaatgacctgcatataggaaaatgatggtgatttgtcaaaaaccatatcattcctactcagccatattgcccaacaaatggtagaagctccaacaagtatcagtttacccattttcttatcaactcccaaaagccacccattaaaaatatgagatatgctaactggaagattaaaaccaaaagagaactgaactgctctccatagaaacttcgcaaaatggcaatccataaagagatgttgaatagactcattcttcaaacaaaaagaacgtctcaagctgccattccagttacgccttgccaaattatcct

SEQ ID NO: 66983 - DNA, 2178 bp, Oryza sativa
taagtggcaacttaagcttccaaatacactggtttatactcgatatagccattattaattaaagctaggtacatagacctcaccgagaacaagccattctgatggaaattccatctaaatctatcagacgaatcattcaactgaatatgtactatagaggcacacaactcatgccaacaaacaagattctgaccaactaaagctttcctgaaagaaacattaagcggaaccgatcccataacagtggcaatagaagatgttttcctccgaacaattgcgtacaaagatggatatttatccttaaaagccaagttaccaatccatctatcttccccaaatctaatttgttccccattattgacaatccaagaacccatatttaagaaagtacttttgacattcataagaccagaccaaaaataggaatcaccttgtttcctgtcaacttgggttatagatttattataaagatattttctcttcaataaatcatgccaaaccccttcctcattaattaacttaaacaaccatttacttaaaatacatttattttgtatctccaaattatgaatcccaagaccccctggtccttgggttgacaaacaacatcccacctagtgagcctgtattttttcttatggtcatccccttgccaaaaaaaccgcgatctataataatcaattttatgaaaaacccctttcggcacctaaaaaaagatatcataaacatggctaaacttaaaagaacagaattaatcaacaccagtctaccaccaacagataaatgcttgcctttccaactactaagctttttctcaattctctcttcaataagtttccaatctttattagaaagcttcctaaaatgcatcggaattccaaggtatttaaaaggaaaggtacctaacttacaaccaaaaatatcaaaatattgttcataacattcctttgcctgaccaaagcaaaataatttactcttgtgaaaatttatttttaggccagataacttttcaaataccgataaaatcagtttcaaattatttgcctgttgcaagtcatgctccaaaaagatgatagtatcatctgcgtattgcaagatagacaaaccatcatcaacaagatgaggaataaccccattcaagagtcccgcctctttagccctcttaatgaatagagtaagcatgacatctactatattaaaaagaataggagataaaggatccccttgcctaagacctttgtaagtttgaaaacaattaccaatttgatcgttaacttttataccaacatgaccaccttgaacaaaagaagctatccattcacaccatctaggagaaaagcctttcattctcaaagtttgttgtacaaaacgccatttaactttatcataagctttctcaaaatcaatcttaaaaattacaccacttttatctttgcgatgtaattcatgtaaagtctcatgtaaaataaccaccccttccataatatttctcccaggaatgaacgctgtttgagtaggactaattaccttttgagcgacatccattattctatttgtagcaactttggtaaaaaaaacttaaagctaacattaagtaggcatataggtatatactgttgaatctttaaagcctcggcacacttaggcaaaagaatgatagtaccaaagttaagcaaatataaaggcaaactcccagaatgaaagtccttaaatagttctaaaaggtcaaatttaatgacattccagaaaacttgtaaaactcagcaggaaatccatctggacccggagctttgttatgttccatttggaaaatagcatccttaacctcattttcagaaaattccttagttaaggcttcattctctaaatatgaaacttgaggaatgtcagcaacataattctcatcaaactgaaggtcagactcatcaggagggccaaaaagacctttataataagtggtaatatgcgactttaaattggcatcaccacttattaaatgatcaccctcctgtagttgataaattctagttttcctatgttttccatttgccactaaatgaaaatactttgtattagagtcaccctccgaaatatccttagtcttagcccgctgataccatttaatttcttcttcccttagaatgacagataacctactcctgaaaaaccatctaatat

SEQ ID NO: 66984 - DNA, 3190 bp, Oryza sativa
ccatccctaagatgttgtcttaggcggtgaattttcgcttgccaacgctccataggagtattgccctcatcaaccccagaccaaacttcttttaccatatcaacaaatccatcacgtaacagccaactaagttcaactatgttgatcgttactaaaagaggaagattttgtatttaggagcaaaggagtatggtctgaaatatctctattgagagcaacaacagaggataaagggtatttttgctcccattccgtcgacactaaaactctatccagtttctcataggttgggtgtgccagattatttgcccaagtaaaattcctaccagtcatttgtatctccctaaggcacaacccatcaataatagcattaaacaagaagggccatctatcatcataattattattatttttttcattaggactacgaataatgttaaaatcaccaccaataagaattggtaaggtctcatgactgcacatgttaactaattctgcaaggaattgttccttaaactcattttgtgcaggtccatacaccaacactaaggcccacttaaaattatcagctttatttcgcaaatgaaacttaatataaatatccccctcatcaatcaaaccaatgtcagaatttaataaattaatacccaatagaagaccaccagatctgcctctaggaggtttacaatgccacaaaaaatctttaccagcacaaagattattaagagcagctatagaaaattctttgttaacagtctcagataaagcaataaaatcaagttgatgttctttggttaaatcagaaacaaacttatgttttttcgggtccttgaacccatcacaattccaaaagattcctttcatttaaaattaatttttttattattcttcttttttttacccttcttaccattagaaatactattagtagaaggtaccatggaatccaaagtggactgaatattatcactactaggacttggggcgcgcgttgcggtgcctcaccgtctgaagaggagtgtgaactttgcataatttgaaccgaacatccagtagcacttaaaagcgaaagagattgtactgataaaatagacgaaaaggtagcctatatggtccacctgattgaattacatattaggaataacaaaaccacactgttctttgatattgctgcaaaatatagtcgcgcaggagcaggagaagcagctagttagataagtagtcattttttctggttcctatcaggatatataaaaggaaccttgttgttatgcaggttgattagattagtggtgcctaccaagctcagtaggcagacgacgtggtggcattgctggcgatccaccctcaagaggtccagtatcagtgtctatctggcgagatacccactggaatgtctttacaattggcaagcgagggttgtttctctcatattgttttagaatctctccatcggtctcactttcactgtcttcatcagtgtagtcaaagtgtttctcaatgtgaattaatatggttgataaatctgcattgtgtttccaagcatactccgatgattgctgatccttctcaactgcctcaatattccaatccattagcttggggataagattgcaatctgttgtccatgcagccaatttgaaaacagaaagatcttctatatggtgctctgcatatagctcctcaaccatacaactgccatcgagtaattctttcatagctgatttgttccatgattctggtggtactccttccaatgcaagtatgactctttgacgcagtgggtttggaacactatgtagattcatcttgaaaggttcaaatgctagccgagttgtttggaatgtgaagcttttctggctaaatgccttttgagatctttcgtactgtttatcagagtccatgaatatgacgatgtacattctatgtctgaatggcagtaacgcaaaatcatcgacttggcagtcacagacgaagcctaccatagctgataccttggttgtgttcggattgccagccccaagcaccttgacaactacagcatcttggtaaatgacatcggcaagcagctgtgaaatctcttcacggcttgagaactttgtcgctaacaacagacgtttagttccataggatgatggctctggctgtgttctgttagggcgtctaccttgctgggcttccattcttttctaaaaaacaaataagatagatggaagtgaatatctacagatttccagatgtaataggtgtgttgtttttttgttctagtaagttcatagttgccctgttcagtaatgtgggatctcgtctatttctatctatgaagagtagcgagacaacagatagaaggaaatcggtgaagaaaatatgccgtggttgttacctggagagggagacgaagaaggctgtagaacttgttcttgctcacaggaagaggaggaggggaatatgagttggggagaaatagaagtaaggcgttgttctccacgacgtctaagccaaagcctgtcttgtctcttcaaaggcagcaggtaaggctatgggttgatgtcagtatatggagtaaaacaacgtgtacgatgtggttccagtatggagtagttaggtgtgtgaattttgttggtctttaattcaatagcatattttggtgatggatagtataaaaccctggactatcgtgtacatacatgctgtgctattgtggttaagcgccggtgttgactaaatacagaagctgctgaagaggtagtagtaacgttcagtttttttttttaggattcgtgacgcctggtaagcaaaacagataacgtatatgcgttctaccttgagggacggtgattaaactggatgtatgaatgcgactgataattcggaggtaaattaatcgccgtgaaataacaaccagtattcaggattatcatagtataactatgataatgcagaatcctagttacatgatcagtgccagttcacattaagtctttttgcaaaagaataagtctagtggaaacggtgtcaaacacaggacaccagtataataataggacagtttgcaaaggcactacagaacggctgattttcttctcctctcactgaagagctgtctggtgtaggcagcaactgtggcatccaaaagtaagcttgtttggtccataacatatcaggcttggttgatggcactgcaacgatg

SEQ ID NO: 66985 - DNA, 2146 bp, Oryza sativa
atttcctcttcatcctgaacctctgtagtggtctttgaagcagactctatttccaggtctttgtgttttgatatagcagtggatgggctagctggtccagtctgtgcatcactaagcccaactgatggagttggtgatagagccatggaagctgggagagaagatgcttgagatgcagatggggattgtaacagggcaagggtgtgattgttagcacctccaagaatcctattcatctggaatgcaacagtaccagtagaagcagtgttctcagtgatgctgacattctaggtaaattctttctcaagtaggtcagtgatctcctttggtatgcaaccagtgttacttggattctgctgcaacagtgtctcaactgaacgaccaatgaggcgttgtgccaaacgcccaaagataatgaatgaagaatcagctgtgtcatcgcctgctatcacattgagcttgaatctggaaaatgcattataatggtaattttagtatagctacatgtattcattagcttgaacagtggagtttatgtcaactgacctaggcgaagccaaaacaactggtgggcatgttggatctgcacacctgtatccatttccaaaacgttttgctgttttgttgcatgtgtcacaagcagtgtaccaccaggagctatccacgttaaccttttttatgacgacagtaactaagaactgatgcttctgttcataaaaataggatcctaattagcactgtgtataacataaattgaaatgttagaatgagcatttatagtaccgaggatttaccttgaacttaaaagggtgtaggtctttaatctcaatgaccgtcttctgttctgcattgtttgcagcctgagatggggcgggtagatcagtatattttattggctcatagtttccttggatgctgcatagaacaaaaaagttcatgtctcaattggaaatagaaaagaaagatcagaggatatgatttgctaagacagtatatgtaacaaacctgtttttcaaggcagtcacctatggtttgtcaaggtttatgtaccatttgcaggcagagttacctgacaaagaaacattccctgcatccagagcatatgtaagcaccctagaacattttccaagagccattatagaacacatgtatggtgtttaatggacttactaccaaagcccctcacaagcgtgccaacaaagatcactatctgtggatttttttttgccagcttcaatcacctcatctgcagggaatgttgtggctcgatctccccatagcgcaacatttattgtcacattgctatgcagcagacatagtatcattacataaagagtttatggcatcgtgagcggttgttgggtgatgttagcaaaaaaataaatgtggaaagcatgtatattgaaagggggagtaatatttggtggtagttagttggtgttgctgatacactgttaatagaaatgttagagaactgaagtaaatatctttttgcatattaaaaaacagagaagaagggctaactcggcatcgcgaatgtagatgctcctcttcagactttcaccatccttggtgcgcgtttggataggtgtcactgatgttatctcagtaatgattccaatggcatctattatttaagagatcataataaaacacacattaagaatgcaataaaaagaatggtaatctatgaggatatgactgaatcacagtacctgtgaaagagtccttcctgttcactcgtccccttagctggtcatatggcgttagagagtaaacatagttagggaaattctctggcacatcagtacactcttccagtgtagaccactttgtgagggcaatcgactgcatattgccaactggcctatactggctggtacactgccttacacgatagaacgtgaggtcatacactttgccttcagtgattgcaggggcaaagagctcatccaatggaggcataatctgagctgcaatgctggccccctgtttagaaaatggtactgagtaagaaagcgaaatgtgatgacagattacaaagcaaggattctaaagaactaaccgtgccatcaaccagaaccaggccaagatgatacagaatattttcatcattttggtcgcggaattcccagagccttgatac

SEQ ID NO: 66986 - DNA, 21634 bp, Oryza sativa
tagtacagcaaacgggaaaaaggatagtatacaacagcacggcaaaaaatagtgctatagttggtacttaggtgccaaggtcctgcaattagaacagagaacatattagggtttgtcctaatatatctttcggtctgtagtatgatgcacataaagccaaattgtttaataataccatcaatctagctgcatccaacacttcttgataaaccatattcctagtctttgaactacagacctcatcctcatcctctataaggattctaaggcctgctcttgaagttgatctagaagcagcaacatatagttgcccatgtgtggagacaggttttttcaaataaaccccaacacgcgaaagagtttgtccctggcttttgttaattgtcattgcatagcatatacggacaggaaattgtcttctctgaagtgtaaaaggccacttagaactcgtggttgtaagcgcaatccgaggtatgaaagctgtctcaccaatattagatccagttaatatcacacattgtaacaatcgatggccaagagaaacaatcaatagccgtgtgccattgcaaagacccatagattgattcaaatttcgcaacaacataacggtgacaccttttttcaaaataagtttatgtgacgggaaattgttgacattaatagagtttaagaattcagttgggtatagtatatcaaagtcaggcatatggtcacatgatcttgaaattgtatcacaactaagatattcttttggcttagtgggtatcatacgaatgacagaatcatttatttcatcaaccgttcagttgttggggcaaacaatagcacggcatgctagataggaatggtctgtgtacttgttgggaaatctaggaaaacctcatctattattgcctttattttgtcgccggatgtttttattagtaaatcttcaggaatatcgacccatgttgcttcagtttcatcaattttttttgttgcaggtaccttaccatcaccaagacataggatccaattagcaaaagtttcaaggtcttgtcggttctgttcacaaaggtcactttgaaggagtctcatattaatgttcagcttcagaagagtaacatggtgccagagaggcaaatttgttatggacgcatcaactatggaagcacgcgagccttttcttatcactggtagtatttggcgaaaatcacctccaagtacaaccaccttaccaccgaatggtagtctgctgttagaaggtgtgtgctcggaaagcagatcacgcaaacttcgatctaaagcctcaaaacattttctatgagtcattggagcctcgtcccatataataagtgatgtcttttgaatgagctcagcaagcatggtacctcttttaatagtgcaaatactgttctcatcaatgtcaattggtattttaaacctcgaatgagcagtgcgtccccgaggaaggagaagggaagcaacccccgaggaggcaatagcaagaacaatctttttttcagaccttatttttgaaatcaatgcattccacaaaaatgttttccctgtgccaccatgcccatagacaaagaaaaaaccaggttttgagctatcacatgcttcataactgtatcgaaaatagttctctgatcagcgttcaattttggaattattgaattagcttcagtggccagtatggcgctgtcaagagcaagctcttcctcaatcattctattccgtactatgtcatctgagtaaatcgctgggcgcggtaaatcatagtcatctatgttaccgccgctatttgaaaaagtggtttgcatttctttcatcaatagcgacagtagcctatcatgaggaaccaaataagaagggtttgacaaagctgttctaagacgtcgctggatatcattagtgaaatacacccaatatttgtcaaagagggatcgaacgtttccaacagagcaaaacattacaacagtaacaaatagttgtcttagctaggtggatgatgcggatattatggcctcatcaaagagcaaataccactcgttatcactctcgagtaaacctcttaattcacacgcttctctaaatgtcgcataaacaatgccttcgtatgtcctaacatcaacatatgactgagcacctttcacaatcatcaacagcattcgtaaatagtaaagctctccactgattgggctcacatagtacattctacctatcttttcacatggtgttctaggacgccaactacgtgagctggtgtcccatgtccattcctttgggaaatcacagtatgtcagtgttcgtgcgttgctatgttttttattagcttcaaactattccgttaacattgttttttgggccgcagggcttgttaggagtgaattgagttcagcaccctttttgtatcgaacaaagttttgatttggaagatgcacagttagtcgctctactgaaggaactctatagtggatatcgaattcaaaagcacgccaaagagactcgcaggtagatagaaaccgtgcatcaatgtactcctgtatttcatttcgaggtgtgtgattagaattagttgttttgtttaacgtatcatctttggctgcaccattactatcagataattgaccagttggcttattattgacctcaaagtatgctttagatctatcagctccttttgtgacatacttgaaaaggtatttaatcatgttagacttgttgcaccatttgacattaatatgggcttggtattttttaaggagttccatattataaggcacaacccatcgattatcaagtttcactccatttttaagaacatatcgaccattgtttctgcgtttgtagatagtaaaaccaaaatcatccattattgtctcatcctgaaaagacttagggaaatgtttagaacactcccctttcttcatgcacgggcatgatttgttctggttgccacaagggccatggatcataaactcatcgaccaaagcataacccaatggatcagtaaaaacatcaggtatttcagcggatataaagccatcaacaataggagcgctaaattcagtgctgcctgcagcaagccagataaggcaatgtatatgagggagtccacgcttctgaaattctactgtgtagagcactacatggcaagtataaaatgttagaactaactaactgaatgtacaacaaactaaacacaggaagaaagtatcccaccagcaaggactgggccaaatgtttttccttccctaatgtctgagataaactcatttactttcatgttaaaaaccctcacaatcatatcagagcggtcacttggtacttggcctagttcaaacagcaaagcatcgtatatttcttgccactttgaattgcaagtgaaagtcacaaacaaatcaggcactccaaacacacgacatattgccatcgcatcttggtaattttgtaccatgtatcgcctgcctccagtaaaactggtaggcaagacatacttcttccctacagaatcccagtttcaagaccatgatcaatggcatcagatatcgcttggacagactctgagcgaagttcaggctggttgtcagcaatatacttcaaccttgacccttcaacagtcgagtatgagtcaacacatatggaatcactaagacgtccacaacaggtaaagggatttggtttattcaatcgataatggagacggtaacggtagtattcgagcattgtaacatagcgtcgtgaattaccagaaatgctagggaagtcagtgtacttgatacctaaatggaatccggcctccccatatgggaaaagcagcggatactgaagagccatataggatggatgtagagctgagacacgtcgtaacctggcatcagaagattagaccattacatcgtacgtatactcaccgtttgaatagtcacctacaactattcctgcgatctcaccactcgttggaagattgtactgaatttcatcccttgcatcacaccccagcaatctaagggaaattttctcatcaccatggtcttttaaccgatctctagcaaagcgaaatgctttgaccagatcattatggctgtcaagcatagaagtcagctcgataacaatttctgggtctggatcatccacggcattagaatctctctcaaatatattcattctatttgatgtctcattttcagggtcatatatatacaactgagcaaatttaggtgcagcaccatgtcgtggcaagaggctgccaatacggtggtgtacaaccccattgattttaaacacacaaggtgcagacctattatttatcgtcttatcaacattagctcctagcgaagtaaaagcaaacatagagttgtatgatcggatctgccttataaatcgcttcgatcgtgcatcaccatcaaattttaatagtctggctaggaaatcaggtggttttttcagctctggaaggctaatcttaccacttctacaacacaggttgtaaatgatctttcgctgtgacagcacggtcccttttttgaccctctcttggaacgaaaatacagctccacagtatgggcattcatgggatggcccgccatagtaggatcgttcagggtatagcgctgtagaattaaagcataagggaagactggaatatagattaaaggaacgctggctaaaggatgaacaaaaacaaaccttttaaggatgcaatataatccttaggcaaaggtaagatgtcctcaagagtaggttttgggcctatacaacgaatagaaatgaggctataagcagtaggaaacaaattttttctttgtattttttttggatctgaaaataccatcaagaacattcatcagagagtagtctgttcggtgggcagatctcttcatatgtcgtctctccctattgctcgtagcagcacttcgcggtatgtctagtaatgtcctcttccctaagggaaagtagttatactaagaaatgaatcgaaacaatggttcgttcttttctcgaatgaagcaaccaagtcagcttataggctatattagtgatgtacttacttttcacattgcctattgggtttccactgattgtgttgatttcaatgggcagttgcctattggcattagaacgatgggatgtggcttgctgggaaggacctgatggaacgcttccttgcgcgacatctgcatgtatgctacttggtccagtgtgcacagcatctgagctgaggcgcaaaggaacagaacctactgaaccaaataccggagcttgcagaaatcctaaggaagccaatttgctgtcttagttagctgagctaaataataaaaacaacatgtacaaatgtgtggcgcgaataacacaccctggcctaatgaagcatgacgccttaatcgactctcacgcgcccgttggacacacgattttgctttaccagacattgcaaagaaaatggggacacatacagggagccactctgcacagcgcatcacaaaatagaacacaattgaacatgcacagtgagtaacatagataatagcaggttttaaaaaaggcgaaaacagtaagcagctgcaaagatgggaacaaaagctgaacaaaaccaaatcaatagatcaagttggcagtttacatataggaccagaaacagagggcaataattaaagtacgaaaaaacaacgatcaccattaagaatactctttaactaccccgatactacagaggaacaatcctacgacctatgcgcaccgcagaaaaaatggtcctccctaacaaaggtgaaccatagagagttacactgctttagtacattctcacaaggcagatctgtaggaccatagcgcgcctctaacctagcaaggtgtgcagccgctgttatagctacgtcaaccgcagacgcggctatctttctgtatgaaagcaacatgtggaagttataattgtgcacagcgaaaccatacttgacttggagaaacctaacagcctgctgtgcaaccatttcatgggaaacggccgacggctgtactgcagcaacccaaaagaacttgcttactgtaccgcagcctaactgctcgtcaggaagactaagttcaacacctgctaacagcactccgtcaccatctacctcccaaaggtatgacacccaaggtaaacggcaatgggaagcaacagcgttcaacaaagaaacgtaggatacgccaaccgccaccatcccgccgagagcactgcgaatcgtagagacagctttcaaatagggggaaaagagggcttaaaatgttgaggagacaggggctgagggaaggtaagatatatactaagatagcaagaacaggaagatgctataaagtagctacactgtcgcgtggggccaaacacagatatatattctggaaccaacgttcacatgtcctgtacagagcacctcacactcgagaatcctctatgaaaaagggaaaaaaaacaaaggttgacatataaaacattgaccagacagcaacggtcccctcccaaacaaaccaaacgcaataaaggtggcaataaaagcacaaagaacaacacacagcaatctaggcgatataaagagaagaacactaccttggtggtaccggagacccaacaccgaaagaagctacgcatccgtcaagaaccagggaccaagcacgaagagagagagcagcagaccaacgtgcggtggccgttctcctacagaatggaacaaaattagagccggcatgaaacctcaccgatgaacagaagcagccaacggggctgtacctcctccgcaacagccgatccggagctggcgtcaaactctactatccctagatggagatgcccctggatcctgaaagggatttgctggaaagaacacaccgaatatgaggaacaccgccaatcctagaaaaacaatgcaacaccatgctgagcaagggcaatcaccttgccatcgccatcagagcggaaggtcgcaaccagccactgggcagactgaaggaaagggaagaaccgaggagaggggaaaacgggatggaaggtaaaaaggaggacatcacggggaaacttgtgagccgctgtcgatttcctattggccatgcagaacacacatggtaaacccacccaccagccaaaggcacgcaccaactgatatgtgggaccataaaggcgtcgacgcccacgcctgaacagcaacgacccctacgtcaacaaaagggccctcgatcagatccatcagaggagcaagcagcagcatggaccaagcccataggcaacacgtggcaacaagtatgtatgttctctccttccctacccatagaccatagaccaagcccatccaaacaattcaaacaaagcaacaatccctcggttagatcgatcagtgcaccaagcagcaccatgaacctagcccacgcgcaacatacatgtacgttctctgcttctccaaaggcagaccaaggaccaagcccattggaacaaaccaacactgcacgcactacctttttgactttttggacaagagatgacggggcggcataacagccattcttcacacgccgtcgcctctgtctatcggacccaccggtcagctacagcggtaaaaccgcagcacggcacagtaaaaaaaagcccgcttccgtgctctcccgtgccccaccgagacaggctaaacccacgatacaaaaaccgacgacgtggatagtggcgggagcgaacacatcacccctaaagccgcgtaaaacgctctggtgcgagcacattgcccctctctttaactaccctgattcccacttaaatccatcacctcctccataatttcaccacataaatgttgtagtagagtattatcatcgaactgatcgtctagctcaccttcaacaattacatcaggaaacaattacatggtaacttgaaaatttatcgtgaaaaatacaaactggattttcccaattttttttagttaagtgcacccccttccccaaagaaaatcatgacaccttttcttttcacattctctgttccacatgttacatgtcaaatgaaatcagtcggccaggttagtaagggcaagtactataatatctcatatgttgcctctaagaatgccacattggattgggtgatgaggtggaggagagaaatggagagagaagatgaaccacccctaaatcaagaggcaacctccacataaatttcaagaaatgtgtgggagtattagagatattggtatttgtgtgttagaggtaatacattgtatggattgcctcttagttcatgagtgaataaaatagataaatttggaggtggtagtcacatctaccatagcacttgccctaagttctaatcttgagatctgcgtggagattgatgattttagaatttatggacaaattaagtcgcaatcacttgttctcattcaaacatgagttcattcaaaggtatgacgtggtgtattggcgttggtgtggaatgtaacagtcacaaaaagtcagctccatcgtcagcgtagtgttcaaacaggtgttggtggcgttggtctagagtcatgtttggttggctgctaaagtttatgacgtcaaatattagatatgacatactccctccgtttcaaaatgtttgataccgttaactttttagtacgtatatgaccattcgtcttattcaaaaaatttaagtaattatttattatttttatatcatttgattcattgttaaatataatttcatgtacacatatagttttacatatttcataaattttttttgaataagacgaacggtcaaacgtatgctaaaaagtcaacggtgtcaaacattttgaaatggagggagtaatttgttagccaagctctatagttaacgctagatcgctagccacagtttcttactttattactccctttgaattaataatacttgttgttttgaaaaaaaaataaacaactttaaccattgtcttctgtcttctgctagaggtgtgaaagcatagttggttagggtgtggtctcaactctcaacaatcaattgttgccggtttgattcccatggatctttcgctttgtctttcctttttcttccaatatttttattttcgaaacacatccattatctttagcaaatatgataattatatgcaagcggcattccctaaaggcgttttagttctctgacaacattatttccaaaaagtcttgaatactcatactgaaaatcttgcgtccaccagccactgcctgtctgagttggcactctagttggtactaggtgacttaaggcctgttaggcatacctccagctctagctccacctcttctaaagctggagcccaacaaaaaaatttcagctctatctagaatgaaagcgaaattcggtggagcgctctcacaaaatgaacttcagttagatggccagtggtcttcgtgaggggcggcgccatgccctgttagaaacccgtttggcactgtgaccgatcacccacatgcatatctctactaaggtaaaagcacacagtcgttctccttccatctccatctctcacgcatgtacactctacgcgattaaacaccagattctattgctttatccttaatcacctttttagtccatgtttaattatataggcttggtccgttataacgtacgagcatgttattagtatgcaacaaatgcggaagtgctaatgggcgatcgatcgcccggcgacaagggtagcgatcgatcccccttccccctccctccctccacctggtttctttttttggcaccgcattactttcctattttagtaaatttatacacctaaagtttatacaccttaagtttacacatctaaagtttatacacctcaaatttacacatctaaagtttagagactaaaagtttataagtcaaaagtttatatatccgattcaaatttgaatttgaattcaaatattttatatatatatagtatttctataaatctaaagttcataaacctgaagtttatagacccaaagtttataagtcaaaagtttacatacccgattcaaatttgaatttgaattcaaatattttcaatatatagtatttttatgcatctaaagtctatacacctaaagtttatagacccaaagtttataagtcagaagtttacatatccgattcaaatttgaatttgaattatatccgttcaaatttgaatttgaattcaaatattttctatatatagtatttctatacatctaaagtgtttatacacctaaagtttatagacacaaagtttataagtcaaaagtttatatactcgattcaaatttgaatttaaattcaaatttgtatggtgtagtagtaagagaagaaggggaggtaaggtagtaaggggaggggcgggcgatcgaccgcccgttaggagtatcccaacaaatgcaccaacaaagaaaaaaccgtgtccttgccagtcgcatcttacccggcatcagagccttaaaggccagctaattctcaatgggccatgcacccatgccacgcaggcccgtcgatggctatgtgccaagtaggcgaccgcacagggcctctgtttttttggcccccatataaacaatgaaggttcacttccaattgcccagctatagcatgcaacaaccaaatagactaataggcaaatcaatcaataagaccaagccaggatggggcgctgcaagtctgcaaggctctgctattacctaccttttgcatggctgtcgtgcgatcctaattctgtgctgcgccaactgccgggatgtcgtaacgtgatctcaattccacgcgcaacgactaacgaggcggcgacacaacttgatgctttcaacttcgaggctccaagcagcatcgacgatcgcgacgaccttgcagctctgccttcggctgggctcctgggtccagccttcttcctccttgtttgctcgtcgtcctcgactcaaccctcgatggttcgactcggactggtaaggttagcctggatgatagatcgtaaatatgtaatatgcatcaaattgtcgtgagttcatgactgtaatctatctatctatctattaagacagctcgaaacgaaggcaccacgttcgtcgtgggggctagaaattcccacattaatcggagaaaaagaaaagaatagtcaaagtaaaaatacaattaaaaatagctaaaattcggaattaaaaatgtgcaatatggaaagaggagtccatataggaacctagtacgtgattaatcaaaattcaaaataaaaataaaataaaatccaaaattagaaaaggaaaggagaatagaaatacaatttaaaaatagctgaaattcggaattaaaaataagaaatattgaaagaagtttccatataagtacccaatacgagattaatcaaaattcaaaataaaaataaaataaaattcaaaattagaaaaggaaataagagtccaagtaggaatacaatttaaaaatagctgaaattcggaattaaaaataaggaatattaaaagaagagtccatataagaacccaatacgagattaagtaaaattcggaataaaaataaataaatctaaaattagaaaaagaaaataaaagaaaagtttaagtaggaatacaatttaaaattagctgaaattcggaattaaaaataagcacactgaaaaaagaatccatataagaacccaatacgagattaattaaaatttagaataaaaaataaaataatatccaaagttagaaaacaataaaagagagttcaagtaggaatacaatttcgaaacaactgaaattgaaaataaaaaataaaaacattaaaataacacaatacggtattaaataattttttaaaaaaattctaaaattagaacaagaaaaataagatttcaattaggaatacaatttataaataacaaaaaattttgataaaaataaatattattaaaataaaagaccatctaaaacacatgacgagatatattaagtaacatgcctataaagagtggtggtggttgatatgacatataaaaattgttaataaaacaccaaatagaatcctaatgacgattaaaaggagagacgtcagggaggccgtgaagcaaacaagtaaggcagttgccgggacttctagaaagtaaaaaaaaaacaatttttagaatcacaatgacaataaagagtaggtggcggacgggctgtagatcagggacatagtgacatcgtttgatggcacttctaaaaattattaaaaataaaactacaagtccaatttttaaaggttcggaacttctgaaaagtaaaaaaaccaatgataatcatgttcgattttaaaatcaaaatgaaataaagaagggaggcagcgggcgagccgtagagaattacaatggcaaagccgctaatggtttggcgggacttctaaaaagtaaaaatgaacttaaacgataattatgttcgatttttaaattctcaatgacaataaagagataagatagtggacgtgttgtagagaagtataatagcaacatttgacgggacatctagaaattataaaaatgaaacccaacatgacaataaactctaaaaactataaaatccaatttttaaaggttccaataagaatgaatagaaatagtggtaaatcgagcaagcaaataaagaaggagatgagacataaggggtagcaactggtgtgacttttaaagcctatataattagaaacacgatgatgataagatttagtctttcaaagtcttaagacaatgagatagctatttaataaatttgaagtaaaatcatacttaaaaaaatatatgattttgtttgggtgctagccgcgtaattgcgcgggccacccagctagtttataattgaaatgatcgattatatcaaattatcgttttgattaaaattactgctcctatttgtttgtgaaacataaaggcatatatttcgaaatatcatacattataacacatattacatatatataattgagtgaaaatatattttatttattttatatatgatttttttaaaaaattatatgatctcaatttgcattttaccctgggcccaaatttaattcctggagacggccctgatgccacgaaaccgatgccctctctaagccaggcacacgtgagcaaacgaagccgcccgtgcatgcgcaacgaaacaacgaaacatcatatcatgccaccaccgtctctacgtgtcggcctccgcgcgcggcgtgcccccacactcggacgtgacgaggcacggttcgcccggcgcccccatgtgcgtgggagagagctagctcagccggccggttatgcacgcggaccaccatggcaccatcgcgcggcgaggagtaaggagacagccagctcgatcgatctccgcgagtacgcctactacgtactactgtactagctagcgtggtactagtagtaggccaacgagcgacgtcgcgtcgtacggggtcgtctgccggtgcgacgacgtgcgcgggacggggacggacgggggaatgtggctgaaagggggaagccgaaccacctcgcgctcgctgcctgccgtgccgggcccgtgcgggcgtccgacgtgtgcggccgatggtatgatacttcgatcggaacaggtagtgcgtacagagccgtacaatctcggtcggtcacgcgctcacgcgtcgtgagctggactccaacggccggcttgtgtggccttgtgccgggcgccaactcactcgacagcagtggcaagcagcgtcgtaataaacgtacgtgtacgtaccgtccgaactggggccgggcctgtggggatcggtgatcttttggttggtggcggatcgcgcgttccgcggggcgcgtggcgcgtgggcgctgatcgatcgagcgcgagccaggctgccaccgtcagcgtcttgggctcgatcgtggcgttggtgggggacgcgacgcgagggagttgggaaccagccaacggacggacgggctcgttcgatccccttcgcctgttaatccgttgcatctcgtgcgctgcgcgtctctgcgccttgcgcgcggtgcgtgcgacggtgcgagctgctttgtctgaccgatcgggaggattatggcaagaactcattgtgtgagcctactatatatgagttcaggccggctctcgcatcagttttttttttaagcccggcctgaaaccggggccaacccgggggtctgcacccaggtgtaccgtgtacggggaaaacgcatatggcaacacgcgttggtgccttggtgtaatgaaagggagccgaaatgcagcagcattaactgctgaagccatttaatttgggtcaatgtcaatgatattacacattatcatttgtttttcctccgagaacccattctcatcatcattaccttcttatgatcaagttaaaaaagaagaaaactccattttttctccccggacttcccttgaggaaatagaagggcaatgaaagaaagaaaaatatctccctagctagcttatctacattaaacgcctaatcaaaccattgctacgccattgtcgtcattatcaccgttctggcaaccatctgtttccacactgacactatcatccctccataatttcgcgagaaggccatgcttgggcacagggaatgggctgtactcaacctcgtcgctggaaccaacaatctcccacctgcaaatcaagaacgcagacgtcaatcagcacaccgttccacaacgaaatttgaggaaccaactcgtctccaatgacatgcatgtgactgctcatatgtggtactaggatgctgagtaggcgctgtgcgatctgagcagtgaatgaccccacaggttggagcatgcgtgtactagcagctgtggtatgtgtatgcggaatctggcagctgggaggaaggggccaatggagtggcagcagccatggcacggtgtggtccacaacgacaaggggagaatatatggcgaatctgtgtggaggggcacgcacctgtagccagtgaccaggtggtggatgaggacgagcatctcgagcttggccagctcgttcccggggcacgcgtgcacgccgttcccaaatggcatgaaggtgttcggcctcggcgacacctgcatagacattgttccacacacaaccagaaaaaaagagaaggttcagaaaaaagaagtttcactcgtggtacttcagttttgaggctctatctatctgcagattggtagcaccactagtatttgctgcggctgctatgcaaagataaattaagtcatttacaaatgttctagataagggtttgactcagcagcaagttgattaatggttggttggatttccatggtatacatctgatccgagtgtgaattctggcctatttgtgggcttgtcgaatggccgaaaaccctgacatattctgacgagaaaaggtacaaattatttctgaaactgaatatacctattcgcacctgacgtattacaactatgtcttattataatttcattccacgaacagtatcacaaagagctgccgttgactagagaagagggaatttaatgctatcgaaaggaacagtgttcagtttgttcagagatgcatgcatcgacatcaaaagcactgcggcgaggatcgatcgatcgatcgaggcccataccttgaatctagaagggtcgaacttctgtggatcctggaagtagtctgggttgtgatggatgttcctgaagagcggcatcaccttccatcccttggggataaggaaccctacacgccaaggaaaaatacacggtcccgtcagcaaaactaaaaaaaaaaaatctacactgtttttttcacacgatgcatggagtaacggacgtggctcccctacggccacgttgtagcgtagggctgcgcacgtgcgtacctttgtactccacgtcagccacggcctccctgaacgtgaacgagatgatgctggccatccttaagctctccaaaatcacctgaaccgaaggatgggagggagatggcaacaaaggaattagcagatggcgccgtcagtaatttaaccgcaaaaatacacgggaatcgaatgaaaactcgggaaatgggtgtatttttcgcgcatacgtaccttgtgggttagggccatgctccgcgtctgcgcccacgtcagcggcagccggccgccgtcgttggcggcgcggatcgccgcctgctccgccctgacggcctcgagcagcttgggatggtcgtggaggtacttgacgatccaggtgagcacgctggccgtcgtgtcctgcgccgcgaacagcacgccgatgatgttgtcggcgacctgctcgtcggtgaggagcgcgccgtcgtcgcccgcccgcgactgcatgaggcagccgaggaggtcgctgccgggctccccccgcgcccgccgctcccgcatgatgtcgctcagcacgccgtgcagccgccgcctcgcctgcagatttagtaagatgcagaaaggaactcgatcggttatcacctactgttgctgcaaacaggacgtacaagaacgacgtgaggaaggcactagaatatgctacagctcgtgccatctagtgcctggcttctgctgcgtacctggatcgccttgtagtacagcgtcccggggaagctgttggggaaggagttgtagcccttctccacgatggcgtagttctgcctcagctccgctttccgccgctcgtccagccgcccgccgaagatggtcacgatgccgacatcgaacgagagctgaaaggaacaaaaaaacaaacacgttacatgcatcctcgtggcgagcagcactgcttttccggcacattcctcttcatgctctggctggcaattcttaccctcttcatggcgtggaaggtgctggagacgttgccgtcccaggaggcgagcgtggagcggacggcggcctcgacgtccggcacgagcgcgcgcagggcgtcggggccgagagggccctggacgagcttgcgaaggcggaggtggtagtcgccctggtggaagaagagcgccgacgggccgatcatccgctccttgctccgcgggtacgtcggcttgaacaggtgcgcctgcgtcaccagcacgaaccgcgccgcctccgggctcgccagcatcacgcacgggcaacccagaatgtgcgtcttgaagatctcgccgtacctgcacgcacacacaagccatacatcagcaataacgccgaaagctacaagcccacaactatggcatgcagtatttgtgttggcagcttggcattatcttgccatccatgtccttcaaaagcatgcgtccatgctttcaggttgcagagattagcagcatgtttgggtttttaattaattggcaactaacctcttctgtttggaggcgaagaagacgttggggtcttgggagtagagctgaagggtctcgccgatgtaaggccaacccatggagcccggcggcagcctgacggctttctcatggccgtagccatggagtttcctcctctgccggctcgtgtagtggacatagcacataaaagcaagagaaatgaagaaggagatgacgatgacgatgacgaaggaggctgccatccaaatgaccctggagaattaaggatcacttggacaccacagctgttttgagagttctgaaccagctgtcttcttcttgctagctagtcgtgtgttattgtctttgcgctatatatgctgttgctaggagagagggagagagctgtgaggagagggagagagggaggagaaaaatcttcgagggatctttcgaatggtggtgggcgtgggaaggccttgcgtggtatttatagaggcagagcgcgagagagaaagtgagaggccagtttggaagctcatatggtgtccgcgagctagggagggagggagtaaggcctgtttttcccagcttaggattattataatctagattattgagtcagattaccataagctagattgttataatctgtagtagaataaacggttagttgtttctttcctagattattacatcctaaattattgggtttacaagtctaaagagaaagtggtgtggtatgacgggtaattttttacccaataatctggaaaaagctcacctaaatgagcttatcatattataataagccctctttgtttaggcttataagccaacttataagtcgaaaagtctgagcctaaacaagcaagcagcttttccgtttggtttttttgaagccataagccactctaacactattaagccaaaagctaggttggagaagcttttttggcttatgtgagttagatgtatgactcaactactaaacttaggacattaaatccaccggcttataaatcatataagctgacttaaaagtctaggctaataaacctaagcctaaataaagagggcctaagctaggctccagattataataagctacttcaataagttgtttgtttctttcagtttactcctaataatttggattataataatcctaagctgaaagaagcagcgcctaaatgtacatacatcaaggaagtttcaacttatcctgtggatttctaatgatagcatatatatatcgtggtatttatttcttatcaagattttcttaagagggtgaaacgtacatgcagcaagataagttcagtataccactataccctgttgatttgctaccctgtgctgattagtttcaatcgtgtattggccaatctggtcgtaagaatagcattgcattgcatttattatgttcttatcatgtgttttttggggatgaaacgtacatgcagcaagataagttcaacttatccagttttatcgtcgttctgtacatattaaaatgtagtttaatacagtatagtttactcctacttatactttaagtatgtgccacatcatctaaaagtatacatagagataggacatactaggactactagaatacagtggcggagccaggataaaaatatagcggggctaaaccaaaatgaccaacagcaactaagagagatttaggattaggttaggaatttttgggccttcttaacgttttgggccttctaacaacctcaaacaaagtttatattagcccctcatttataaatatatggattagaattttagggggggtattatgagggctctaatggtctattagagggtacgggggtctaaaaacacctccacccccacgctgtctccgcctctgctagaatacaataatacaatagtagttacattcttccattccctcagccatggacgaagctacaagtatccagggatgcctagggaaccgatacataatttttttttagttatagtttacctattttcatcatatatacgtctcctcaattcaaacttagacatccgtatcaagctaaaatcgattcaaagtagagtaaaatatgtgagtggaacccctctattttgttttagctttgtcaccgttttcagtgtacgtaggtaaccaccgtatctaatgctttgtcccataatcacatttatgtagcacatccctacttatataggtccgacacgttacaaataaggctccgttattggtactttgaaaggggagtcttccgtccaccccctcccagtccttcacatcatgcacagtgtgcaaccatcacactcgcaagaaaacaaaccaataatgttcctaacccgttcccaatcacacctcatttccaattacatggtccaaaaaaaattaatctccattgaaagagacaagtatattattatccattgcaacacacagacgtgttactactattaaaacaaataaattggtagtaaagatatgcacacgtgtgtatcccaccaagtaaaatagaattgtccatcgaatgtagataaaaggatgcacacactctttcttatgcataatttgttaactcactacaagaaaacagaatgtccttggcggccatataatttctttagcggtatttacttagcgatcggccgatggaataattaagaccgccaagtacattccgttttcttgtagtgacttgggaataatgtttacaatatacccaagtgtcatgccccgaactagtcccgaccgagactagcccgtgacgctccaatttaacctgttaatcgataccagtcccaggaaacagtgctggtatcacagggagacagaatatcacagcaacagaggtctctttattatagagtaggagtacagtcatgttgagctgcggacagatcccgagctcacaactgcattacaaaaggaaaacggaagccaggacttggaccattcatcacaggcgcgacttgggaactaggccgaaaccctaaaactcatcgtagccggcttgctcctggaagaactcctcatcagcaggatccgcttcatcttcttcagcaactggggggggatatttatatagagcaagggtgagtacgggagtactcagcaagccaggggaaataagtgtttaatgcaggcttcaagggaaggctgttgtttttgcaattggttttatttgaactatttttctaaaacaactaggtgagtgcttctcaaacgacacggatgggacagtgcgtctcgtccggtcggagtatgtgcaatgtatcagtctttgggattgcaacaaggttggcacccggccaacagcttttcaaacggccacccgggccaacaacttttcaaacggccacccgggcctagctgatcccatcagctacagatttttcaaacatcgaaccccttttcacaacagcaatttcacaagcagtagtcaaacaaaactacgctaggaatcacctcacatccgcccttgaccgtgggcacggctgttcgaacagttcaatgacctctgcagagggggtacactttacccacacgacattactaacccgggtcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccgtgtggtcgtacttgtcttatgttcggatgaaattccaaggaaacggtccttaggtgcaagagcgggaaaccgtacacccggtacgttccccggtccgcggttttggaaattcatttagttcgcaagcaccgacccaggtgtcgggtttttccaagtcttttgtaaaactccagttttacccaagttgttactcagattttaaatttgaaggcgaccgtcgatactcgcacagagtgcgcgagtatcgaggcgcaactgggtggttacaaggggacatggtatagcaattaacaaaggaaggatcaaatgcgacaaattaggtaggtccgccaatctgccttgcagacgggacaaacagattaagtgtgatcctatcaatgcataatattttgcaagcaacataattaaatttcaaatataggctcaagatgttcaaaggtggcttgccttgctcgagatctggagcttgatcctcgaaatcctcgcactgcgggtcttcgggctctgaaactacacgcgaaacgggacaactcaacaaacggcaaaaataaag

SEQ ID NO: 66987 - DNA, 1031 bp, Oryza sativa
tgagctggcgccgacgtggcgcctacgtggctgccacgcgggccggcgggaggtagacgacgacccggcctcgaatggacggcgggcggcggcggcaagcggcggagcgaaccacggcgatacgggcaacagcgagcacaccgggcggttgcacgtgacaagggaaggcgagccatcggctcggattcgccggaggttgctcgacggcggcggattgcggcggcggcaaccggcggcgggagaagagggaaacggcgacgaggtcgcgagaggtcgattcccggcggtgagaacatctacgcggcttcgggaactcgacgctagcgtcggattgggaggaactacgccgagcgaggccggcgacgagcgggtgctacggagctcgggcggcgacggcggcgagcacacggcgagcgatggcaacggtcggggcggcgccggctaactacggggagtctactcaagctactaccgaaagctagggggaggagatggagcgaggaggaagaacggagagagactaccgtgtgggacggggcgcagtgacgagaggccgacggcgcgggagtgatctctccggcctcgggccgaggaagaggaagaagagggcgcgcccggagtccccttccgcgtccacgaacgcaccggctctcccggcgcttggcgatggacggcggaggcgaggcagagcacgggagcggcggcaacggtgaggaggcgaatgggagaggaaaggaaaggagggggaagacgggtttaaatgggcggcaatgtcggtttgagagaggggaaccgacatgggcggtcaagccggcgagctggcgctccggctagcgtccaaagcggcgacaggaggtgacgccggcgagaggggaaaaaggggagaaaaataggaaaaggagggagagaaagggggctcgcccctttgccgattcgggaaaaggaggagggagtggggcaactcggcagagggagaggggctctctgcctccgtcccttggaggctagcgcgcggagtggcgggggccggg

SEQ ID NO: 66988 - DNA, 8958 bp, Oryza sativa
  unsure (1)..(8958): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagcacctgcatcacctcctcggcgctgatccttccgtcgccgtcctggtcgaacacgaagaacgcccggcgcatgtcccccagcggcacgccgctcttgtgcacctccatgaactcttcgaagtccatgtagccgttcttcttgaagtcggcgacgcagatcatccgcctcgcctcggccgcggcgtcggctttcccgaacttctccaggagccccttcagatccttcctggtgatccggtcgtgctcgccggcgatcttgttgaacactttcttcatctcgtcgtcgtcaggcttgtagatcctcgtcaagtcggagaactgccggtccccgccggacagcagccggccggttggccggcctgcggccttggacttgagcttctcaagattgtacttgaaggtcaaaaggctcagatgagacattttggatttgatttgctgcagctacggatgattgatacgcctaaatgagctcctgattgcccgtcatggaagttcataggttccttgtcctaaacatggctaaggtgcatatatagaatatatgcctgacagctgcagaaagtttcagaatatgtgattcctccagaacttgcagaataggctacctcaaaccagaaagaagggcaaaagatgggccagacaacatgcaaagtaagaatctagtatagccgcttgggataaggaaagagaaagagatgtagaagtgtagaacagaaccaaagctgacttgaaataatttctttccttttctttatcaactataatgataagaacaaaggagtacaattattagcagataatggtttacaacacttaaaaatggcacctcatcatgtaccgtgcctgactgtaacagaaagaatcactggttaaatcgtccaagttgtgaacacaatctatccagcagcagttaataaatgacagctgccaagcgaacagggccatcaaactatggtggttttccattgtctaactcatccatgttttcaatgtcctggcgaaatgtgattttccgaacataacctacagaataagtagaacacccatccaagtgtcataacagcaaatcaacaggtaaaagtttgccaggagtaatgaagagttaaggcagtagtaataggaatcaaaataaattagcatggtatttagaaagatctcagttatcaacaaaagttaatctcacgagctcgattggaatatctaattgtctcaagctacttactttactatggcagaaatccnnnnnnnnnnnnnnnnnnnnnnnnatctaaatctatttacttttccatgtcaaaagtcctggaaattttggcagcagctaactatctaaatatctagttctcatctgttggacaaaggaataacgttaagtgcccaacacacacgtacctgcacatgctatgccaatttctatcaggggtattatctatcaggtcagattgaagaactagcgttgcttgttattagattttttcagggattattttgttcgatgatagtatcatatctttactgttgacttcggtagcatatcatggcaattttagtcatattagatcagttccaatgtacttagaaaagctcaggtaactgaactcagtagcatagaggaaaacattccaacagtaaacaacactctttttcagctattcctgaacatttctaaagcattgaattctaggttccgttatcccattattcatctgcagcatttcaggagctacataactgaggcactgtatacaattttatcagtagttcattccacacaagatatttgatttactatccttgattgttaaaataaactttcatcattgttgctagcatctgcaattagcatgcttaatttggattcagctgtcaaggcattcctaatgctagacatctatgccacttcatgccatatggacactgctataaaatactatttgtccaatgcatagtttctatgtgtgagatcaatgcaaatagtaaattactctcatcgtctctccctcttatttgttgatttgcctctcgttttgtgccacagacactacctcaacccctaatgctattttgtttgtttcttgatgtgttggtttatttgccttgggtagtgtctcatgcaagacatggattctctctcacacacttcgttaactctcttgccacattaggtttgatcctacatggcaggctattaattattataggcactacatgaggtggagcaggagtgctatcatgttcatgctttcacatcgatctgagcaccaactaatcactgaaagtcgctgataagtcgagctagtcatgcgactttatatttgtttgagttgtgggcttctggtcgtgtgggctgacaatcaccgactaatcgagactaattgctcaacttaacaacaataggaagagcaataaagagaaatggcatctctgagcaaaatctccttttctgtgcaaggttttagcaccaagggttatgtgcacaatatttactggatatttagtactatcagtggtatttgcagccttctttgaataaaagggggcaaaagctgcacttacaggttgacatgaaatgttcagtacatactaatgcaaatcattttataacatcctaactgcgaccaaggctgaatggtaaattatctgtctaaactaaagaactcatcaaaactacactgtatctaatgataaccaagtgccacccctaaactgaaggcaacctacaccctttccagttcacaatagcaattcctagcaagaagatctggatacatgtaatatccccattccctatttccgatcacctacaaatgagagcaattcgatcgatactgggaatgcgagcaagggatctcaccaatgccagcgcatggcacgcatttgcagatggtctccctccccttcttcctgaaatagctcaccagccctgtcccctggcaactccggcacttgcccgtccactcgtaggagacagtcttgcaatccttcaaacccaaatccacacaaacacatactccgaaatcgtcaccaaattttccctccgaatcaccaaagaagtgaaaaactcttaggatcccaccgcaaccgcacccacctcgatctccacgtcgcagctgaggcggcggtcgagctcctcgcgggacatcggctcggtgtccggaacggtcaacggcagcggcagcggctccacgtcgtcgacgaggtagctctccctgtccccggaccaccagtcccaccatctcctcctcccccttcccctccccttcttctcctcctccgcgccctccctggccctgacgcgcaccccgggatcccgggcggcgacgcggccgccggatgtcgacgggtccgcgtcgggcggcgccctaggccggaaccagtccggcgtggaggccgcgccggtggtgttggccgccggcggcgggtgggggcgccgggcgcggcgggggagggggagggaagggttggggcgtggggaggagaggagcggggtggggttcgcgggagtcatggagatgggagcggggtttgcgtccgggacgcggagatcatcgctcgctcgctcgccgccggcgacgagtgggaaatagtgggagtgacggggaagcaagcgatgtggcgacgagcgcgacgaaggatgtgccggaatctacagataataataaagaacaaaaaaaggaaattgggagatatcttgatattggaggcgttaatgggctgggctgtcagttggtgacttcgtgggctgcccaactgttcggggcgcggtttgtaggatccgcaatttaatgcatttttttgctacaaaggctagtgaggaactaaaatattcagttttcgaactcactgtttttccagatagagatacccatacattgcaacgaagattaaagtgtatagagattaaattttatttatagacctatgcgactgaaaatggaatagaatgtggactttttaatgggtccatgtgattgggtttggagcatggggtcgagcataaattttttctattacttagtttctataattttatcgggttggtggttgtgcacgtaaataaatgcagatcctctctggtattgttggtgcagtagcaggcattgacgtgtaaagaagaggatagaaagacaactctcattttcaaagtacttgtcgtttagacatcgacatcattttcgttacacatgtttcatcttttttttctaactacatgttttgctattaaaagaataattatatgaaatgattttcatgaaaaaatttaccaatatcattctgatggaaaattctgacatttcttcgttaattaatcatgcaaattttctgtctgactgggacggcatctatttgacaatgaaggtagtagtaattaaaaatatacatacaaataaattgaatcaggtaccacacagttgcagggttaaatacattcaggatcacctcatgtttgccaaaaagaaaggaaaggaggaacaaaaatacggatagaatcgaacggcaaaaagaaacaaaataaaagggaaaaaatggtgtttaattaatgtgttccagcgtgtcgtcaacggttaatgtctcttttcttcatctcatgaacaccggatgatctcaacctgaacaagcttatactcgttgaatttgtgttagctaaggttattcccaggtgcatatctgtcagagcaagattattttcatttcatcagtcactaaagaaaaataaggaatcacaagcttaaatacagcactcgtgatcactcactggaacatgaagcccgttttgttcttgaagctgatcggaatcgccccttgcagtgcattgttctgcacaaacctgtcaagcaaaaaactcaagcggtcataacaagtcgatgaactcaaatacttgactagtataaactacttgttgaagccacttacaattcacgaagccttggcatgctccctagagatggaggaatctgccctgtcagtcggttgttctccagatgccttcagttaagaaatttagccaggtgatcttcagtttactgaagcattctccaaaacaattattgagcagtatgtagctactgtgcttacagagaaaccaaatgatgtaggaggctcatatctggaattggtccggtcagattgtttcccacaagccaactgcaatcaccgtacccaaattaggcaatcaatatttactttaccactgcaatctttttccaatctgtcagcaggacaattaaagaatgggagtctggcattagcttgtttaaggaggcttacatgcttgagatcgctgtcaggttggcaatgccgtcagatattgatcccccaactttaaaattcgtgagattcctgccgtgtgattgccaccatttcggtttcagagatcaacaagagaacatactgccccttttgcaggcattgatgcatatagtacatatggcaatcagtaacttacagagaaaccactcgagcaagtggttcttgggtgcaggtgacaccagtccatgagttcccctgaggcaaacatggatcgccggcccagtcagccggtgggttgtcgaaacctctggctagcgcctgcatgccgatcactgcagcaacacgagacaatgagacatgaataaatttcgatgagcaaaccacgaattcggcatgatccatgagattttgtcaagttaccatctctgggatgtgtcctccctccgagtggcacaaccatcatcagctcggcggcgttgatcaccggcccgaccggcgagcctggcgcaggcgtcagcgtgatctttgtccgcccggagagcggccacttgtcgccgtagagcatcgacccggccgtcgacacgttcaggccggcgaagaacgtctcgccgttgacggcgacgtcgaacactctccagctgagcgggcccggcgcgcggttgtcctggaagtagagcgccaggtagtagctcgcggcggggagcggcgccggcggccactggagctccaggctctcgccgcggccgccggccgtcgtgacgcctcggcggaacacgtcctccggtggcttgttccagaacgccgcctgcgacacgctcgcctggctctccaccaccggcatcccgtcgctgtgcgcctcccagaaccggttgaaacgatcgcctggatagctagaaaaaaaaaatcacagattcgacgagcatcaagcggcaagcacgccatgaattcgtagcaaggaaatgggcggtggtgcgtgattgttcttacctgacggccgctgagccgtcgtggccgaagctgtggcgcgcaatggtgctgagagcgtaggactcgaagtcggtggagttgtacaccgagtcctccaatggcgacacctcaagcgcggagatgaaggggctggacttggtggcggcgttcctggcgaggcacacgctgacctccttctcggtggcgagcacgacggcctcatagtacgtggcgaggcccctggcgtagtcccccgccgtgtccacctcgctccaccgcgtgccctcgatgatctggtcgaacaccggcggcgcgctgccgccgtcgaacccgccgtagaagtacgtcgtacggacgaggtacttcctcttcctctccgcgggcaccacgtagcagtacttcctcgccgacgtgtcggggaagtaccggagcgaggagagcaccggcagcacccccggcgaccgcacgtcggagacgttgccgacgctgacgaaccggccgtcgggaacccatgtcacgtcgccgaccaccttctccgacgtcgcaccgcaacttatctggtaccctgtgtacaaacgcggacaatgttcatcaactgcccaagcacattgcacgttgtgaactcaccgagggcaaaagcgttcatcacctgaaaggccatcggcggcgccggcgatgccgaagacgaggacgacggcgaggagggagagggggatcattggaggaggaggaaggtgcaaccgcaatgagatggtcgttggctcgttgccggcttgagagttgagacttctgctttgttttgtttgggtggcagtttcttcagaagttcattatttttctctatgaattttctactactcatcagctcttggtggcacacatgtatagattacatatgcatgacctcttctaagacaagggagctgcattcgccaaatgttgggaggctttgcagtcacatgcacagcaattgatttaaccctattgaattttgagaattgaaaaacaaaagccattctctttataatagagcatttttcccatccttaaagaggtatcacgaggtaccaatctaatctaaccgttggtttaacaggggtatgatcgggctaacaaaaatgaggtctcctctcttccatctgccgccgtcgcccatcgaggccatcgcgccgccgtctcgcatcgaggttgttgccgccgtcgtgcatcgaggccgccgcgccgccgccaccgtcgcgcatcgaggccgccacgctgccgtcacgcatcgaggctgttgccgccgtcgtgcatcgagcctgctgatgccgtcgcgcatcgaggccgccgtgccgctgccatcgtgcatcgagcctgccttgctcggaggcacccaatttgagtttgctgctttaatctgaacagagaaataccaggaggagattcccaatttgagtttgtaactttaatatgaatagaggaaggattcaggaggaaaaaaacaatgcgtaactcaaagtacacgagactttctcatgaatcgatactatttacagcagatccaatttctgaaccttgttattttagttcatcaatacgaaacttgcaattcaagagtaagctggtaatcaaccatttagccatttacatttggttcagcaaatccaacaacaaaattcacagcagaaaggaggaagagacaggccgtcgttgccgccgccgtcaacaaaattcacagcagaaaggaggaaaagagaggccgccgctgccgccgccatcgcgcatcgaggccgccatgccgctgccgtcgcatatcgaggcgcatcgaggccgccgcgccgctgccgttgcacatcgaggccctcgccgtcgccgcaatctctcgctgcccctgcctcttgccgccatctctcgctgctcttccccaacgatttttttctctcgtgaaacagggaaggaagccgaacgcgaaagaaagagatgcccacgcgaaagtacagaagtaccctttcacccacggtaccgcttcaatgaggaggtgctgtaccaccgttggatgatgccagatcaacagtcaggatttggtactgcacaacctcaaggacagtaaaaaacctctttataataagacaaaatttgctacaggacatcaaaaaacgtataattagttggaggacaccgtaaaaacgtgaatttgctatagggcatcgtaaaaaactggtaattggctgctggacacccacaatattattttattattttttagaggaaaaggagagagaacagttgtgtaaatacggttctaccctttgaatttttttcttttgagcgggaggcgactggcgcggggcggtgcggcacgacagccgggcgcagtagcacaggcgtcgggcatgggttagcctagcgtggcggcagctgcaagccgacgtctggtacaccgcaccggcgccggatcagcgaggcctcacatcaccctccgacgccgccctacctccaactgcaacttccaactccatcgcagccctccacacgctctccctcctctccggcgcgctcctgcagcgggtgatgtcgcga

SEQ ID NO: 66989 - DNA, 25267 bp, Oryza sativa
  unsure (1)..(25267): unsure at all n locations
agaaaagatcagcaaggtatgtattgacatttcatcaggatatattgtaacatcctcttcgcctcttcgctcctagagctgctacctgcacttatattgtgatattattcttactatcttacacacggtgaactcatgacctttaccaggccgatcttgaggaagtcagtggtctgtacttggatgctaaatcgtcggcgcgtctccttcaggagcagcaggaaagatacatcacctaagatctcttgctgtacgacgatgtatttgtccttagtcattccgctggatctctgataacttggtactaaagtgcgaagacttctttagggcactggattgatttatgcggaaatgtagaatccgaactctgtactcccgccaacctctagaggaaaacttgatttcggcatattgcttgttcacattactccttgctgagtagattgcatatgaattatcgtgtattttggtttcccatgctaattagttccagattccgtttgtcatctgtcgatttttttcattaaccagctgcttatcatcttattctttgaaatgtggttggtattatactccctatttgattgggtttatccaaaatttttccgcggcgatgcgaaggcatctttgcgcctcatctgcgttgaggttttgaggacgtgttttatgcagaggggcacatcggtgcgtccgttccagcgtcgctgtttgctggcccctgctttttcttccgtataataatgacatttccatgtcgattcttgatcattcctacattcattgaatcgtagagcgaaatgccctgaaatttgtcaatagacgatatagatatattttgctaatttctgaccatcactataccgctagagattactaggcagcactcggctactggaggcttagcctcacgtattgccgtggttcagtcagatcacggcgaaaacaacgtcgtcgaagccccaagagggaaatgacgcacgccatgacaccaattcaccctgcaacgcgacaccctgcccgatcggcatcacacaggctgcacacgtacgccttgttgctcgcgcacggccctgccaaaattaacttttgtggtcatcaggtcaagtggttgctcatcaacgccaaaattccggcagaaacgtacctgcgacgttccaggtgcactgcacctcgctggcagtcgcagcattgcactcgagaccgcgaggcgcgcgtcttagctggtgaatccatcgagaacctgtgatccacatttgatcggtttttgcgagctgtgatgctcgccatcttccgttgtggatagggggagctcgaaatatctcacacagtaggtgacaagtcctctttgctctttagtcgccgtcgatatatatttttctcgccgcggcgacacattttatgtggcgttccgtcgagcatagtagatgggccatgctttgcatgatttggccatttgtagcttttcgtgtcacggattcgatgattattgcatctgcgcccggtgatcgaggaagctagggaggttggtctcttttgtctttagtttttctgatcgatggggaatcgaagagagaggtactatccaaattcattttttacctgtttcatataaccaatataaaaccaaaatattacaatacctctactttatcaaatctcaatacaattattcttcactttatttattcacaatacaattattttctactttcacaaactccgatgcaatgattactttaaaaataaatttattttgaaataaacgaaaggagttaattttactatggaacagaggaaatatttcgctattggtccgtttgatactccctccgtctcattttaagtgcaaccatcagtttttgcacccaacttttattgttcattttgtttaattttttataattaatatttttattattatgagatgataaaacataaatagtacttttctcgtgacttatatttttaattttttaaaaaaagtttcgaataagacggacgatcaaaattgggctcggaaaattatggctgaatcaagacagacaaaacgggtaccaatttgatcgcaccgtgccggtacactgtatcggtatgggcgtgggccgccggatggccggccgatcaattcgtactacgatgcaatttgggcagccaatggatggaggacacgtggctcacgatctcactgacaagctagatgaagactagcacgcacggctgacctggcgcactcccatattccgggagcagcttaaccttaaatctcggccacatttggcccaaattttccggagagttgtataatcaaatcgtggacaattaattatcaacagtgcgtgctacagtgtttatatgtgtgtgctcgatttgcacctcatatatactacatattactattatagatatcgatgcatagtggcatacgctacagtagtacagtgtatgatgtgatgagtatttgtgatttttatatagatttactgaatgttacggtattgccatcttcgacaggtgaatgattgcaatacttaccgtaattccggttttgttaggaaattcagcgaagcgcaaccaaattgtgcttattctattcctctttagtgggtaaacgatgaagaattttagtacgtagacagtatactcctacctgtaagttggtacgacatagctgtccccaaagctgttcatctacgttttctctcttgaaatggagactatcagcaggagttgtaccgggcttggtcacgtacggattagtagcaatgaagaagctatatgtttcctcaattttttaatacatgatgtcgttaactttttaagatacgtttgaccatttattttattaaaaaatataaaattatcatttattttttatgatttgatttatcgttaaatattctaaagcctaacttaaattattttatatttgcacaaaaaagtttgaataagacaaatggtcaaacgtttgtcaaaaaagtcacggtgtcatatattaaaaacaaagatattatatggttattgcgtaaatgctcaacgccgggcgaccggcgcggggggagccggatcgggcgcttccccctcctcacgcgcaatgtctcctcctggccccaccatgtatctccaccatatattccattgcaacaaatcatccacatattttggaaaccctctattaagggaatttggtttattttttgttccaccaaaaatgtttcatatagtgcactcacaatgtttcactatgtatagatctaatgttgcagtgaactaaaatactccattgcaacaaatcacccacatattttgggaaccctctattaagagaatttgttttataatttgttccacaaaaaatgttttacctagtgcactcataatgtttcactatgtatagatctaatgttgcagtgaactgaaacatacttttactatttgctgaaatattgtttttatataaggtgaaacaacatccgatttaaacaagtgaaatattttcgatctacttagtgaaacaattccgatatacctggtggaacatcgtgcaacatttaaaaataattcaataataagctaaatttttttcatcagaatacacatggtcttgttttgaagatttaattgcaacaaatttaatggtgcaatcgggtcatgatttggataaataatttaagagaaaaataaatttaaaatagttttgtacgcatgcgtgacgctgacgtcatggcccaattttaaccccctcccagtcccatcgggcgtccgaaccggagtcgcttcttgattattagtatatgcagcttgttaatttgatgctactaggtcactactattttggtactatctcatcctgcagtgtacacgttagctacatccactgtttgaaccggaagatacatcggtgatagtcatgcatgtctatgtacgtatgcctattgatcacggtgaattccaattccaatgtacttctggctagcaagtcaccatccacatgcatcggacggcctgaaattaacgagcgtgcataattaattacctcgcgaactgaccgtcagggagcgagatcaaaatcaggccacatagaaaagcaggggactgggtaaggtgagtgcggcgggtgggcccggcaaaatcccccgccaccgcctctccgcgaatggggaggcggcacccacgtgagcaagccccacatgctgacatgtccccactcgatcgtcgatccccccctatttctacctcctccaccccgctgcttgtcacgctctcgttggtcgatcactccatcgatccatcgatcgatcgctagctactcgccgtcgtcgaccggtcgatccgccattagcgagctgcaaggctctctcgcttataaatcttccgagtaggcaagcctcaatcgatccgagagtttggtcgttgatcgagctgatcgatcgaccggtgagtggtgcgtggtgtgcggccatggacgacggcggcggcggcggcggcggcgactcgtcgccggcttcgtacatcagattggtacgtctattgtggcgtctctattagtacggcgtacgtggtctgctagcttgatctggattgtggcctgcgagatgcatgtatgcctcattctgatgaatgtatagatgtatgctgattaatttgcacgcaggtgcagcatctgatcgagaagtgcatctgctacaacatgaacaaggaggaatgcatggagacgctggagaagcacgccaacatcaagcccgtcatcacctccaccggtaattcgctatttatagcttcacgccacatttgcataaatggctaaacatgtttagtacctttctttttaagtactatttacctaggagtttattacttgcattgcaactgtgcggtgcatatgcacatgcagaagctgtggctttcatcaattaatgcattacattgtgcacgctgcatgcgtttagttaatttgtttggccatcggagaaaaactcccatgtctctttttttccccttgaaatacgaatataagatgaatactccgtattctatatgacgatatctgctcattcgtcgagaatttttcaatattttttcttgattatgctgtctgtgagcagtgtggaaggagcttgagaaggagaacagcgagttcttcgccacgtacaagaagggccaaggagaggaaccagcggagagcaagagcagtagttcttcacaggaagctgctggttccaagagatcaggcggagacgacgactaggtgcatgcatggcacccacgagagagggggctacttgtacagtaggatatccatcaagtcgtagtacctcgtactgtcttacatctagctgttcatagtacatagcgtatagtagtaatgtagccgttattatgtacgttttgccccgaaaataattaagattcggattcgcagctagccatcgtctagttcagccggtggtgttgcatgcatccggaagatgacgtacgtgtgtacacatatattcacattcgagtgcctagctaccttgttgctgtcagtaaaaagatcgatggatctctctcggtcgattttttaagtaaatgacgccgttatttatttcacattcatcttattcaaaatatttatacatatacgtaggatatatcatgcttaagtatttttaaatgataaaataaattacaataaagtaagtaataattatcaaaattttctaaataaaagaaatagttaaacgtgtgttcaaaaattaagggagttatcaaggtacacaaagatcaatttggtactactccctccgtttcaggttataatatgtttttgattttggttaaagttaaactgcttcaagtttgactaagtttatagacaaatataataccaaattagttttattaaattaataattaaatatatttttataataaattttggcatggtttatatatattgtaggtaaaagatgcagtccatgtatgtataatttcctggacgaggagttgtgcttctcccaaaggccttgatgcaaacgtaaggtgaaattgtgcgcgtcgtcagagtacaggcgatctggctgggttttttttctctcctccggatcgtacacaccgcgcgcattattattggcgtacgtactcgatcgaccgcgagcgcgacacgcacgggcgagcgatcgtcgtcagccacttgggagttgtaccgagggggagcgagagcgagagcgagacgcgtgccgcgttggccacacaacacaggtatacgcaggtacattagtagcagactataaaacaactataaacatatttcgacaaagataaaatagtatagagaaaaacagcgggctacagaattactatagtacggacttcaaaatatatgtgtgtatgacaggtaggatcatgtattaattatgtagcatatttttataagtaactattgtatgaattgactatagatgatttaaagtcagtagatgggtatactattaaatttgctcttaatactactccctccgtctcataatataagagattttgtcattttgctagcactgtttgattactcgtcttaaagtactttggataataaagtaagtcacaaataaaataaataataattctaaaaattttaaaataaaatgaatgataaaacagtacaagtaaaatattaaaattctttattttaggagatagaaggagtagctagtagtactactatagctactggaccgcgcgtggagtcgccatggggtcgaggacacacgtgcgtcgagagagtggcgaagcagcgcaagctagcagtagctaggtcgtgtatagcgcgcgtgtgtggacgtacgtgcgcgcgcgcggtgatcgattggtggccgccggtttggtgtagacgtgcaagtctacgtacgtactgttgcgtgctagtgccgtcggctgcggtgcaccacacgtacgcgtatgcgtacgtacgcgctgtggtgtttgttttgtcaggccctaccgcgtatcggtaggaaggtaggtcgattggtcgatctgtcggccgcgcgcgacgttttgacgtgcgtgcttcacatgcttatacgtatttcctctgttttaaaatgtactccctctgtcccataatataagagattttgatattttgtttgtactatttgaccactcgttttattaaaaaaattgtataaatatagaaaacgaaaagttatgctctacaaatatagaaaacgaaaagttatgcttaaaatacattggataataaagtaagccaaaaaaataataattccaaaaatttttaaataagacgaatggtcaaacagtgcaagcaaaatatcaaaatcccttatattaggggacgaagggagtaagtattttttaggttgacacgagtataaagaaagtggatgggtatggttggagaaataaagtaaatgaaagataatgattgtgattggttgagaggaggaggtagacgaaaaaatagctttattttgggacaagatattgtgctagaaatagctatattttgagatggatcgatgtagtactaaaaaggacctaaggtaggagtactccgtacatttgcaacattttctgcttgattaagaccctgtttgggagcttagcaggcttctcctaaaatctacagctctccaagaaaaaatatccagattttaatctagattctaaaaatttgtagttgtagaatcatgaaagtgaacccaaatacaaatcggaaatcatagtttttcaaaattctcatcagctgcttcctgtcataatgttaggcttccaaatagaccttatttccactaggactgatctatcagcccatcagcgtacggactaatgatgtgagtgttttaacctggttgttaggattccaatccatatcatagtttacaagtggtcaagtgcttgtgcaaataagtctggagctacttaagcttctatgtgttcttgtgtatagcaatcgtgatcaaccttttgcccagtgtgccctaggcaacttatataccgcccaagcataattaaccgtgtcctaaaaaaaagcataattaatcgttttggggctagacatgcatcatcgtatgctctgtagctattgtcatgcactcatgccatttatcacaccgttattatttcttaccacactgtattatctcaggtttaactatgcctcccctcgacataatgcgtcagttgaagggaggtgtaactgcaatgtaattatatgtaactcgttatgaaacaaacatgaaaaggtaggtgactagtaggcttccatctccatgagatccctaggtctattcccacttcacgcatgtggtgtgaaattcttttatccatgccctagcacaaatcttaacactcatctgatgacccaccccgaaagtttctgtaaaaaaaattctggcgatagttttataacaaatccgtttatctttacggcgctcttcaaccatgcacggtttaaagatctgtggcggaaccatgcacagatgcattcgaccctgaaagtgaacaatccgattaatgatagattgcccccccccccccccccctcttttcaattaaaaaaagtagtaggactatacaggctttttaatgcaacacttaggtaggagtactgggctaagggcctaaggccaggccatctgatgtaagaaactggccatctattcattccggcccagcgtacgtgcttacgtttttcctactgttcttgcggaaatgcgtgtcttcaacgatatttgctgcaagataagtgcgttaatgatcaagaataagtccactacggattagagagatttattacagtaaacgcgatattattgatttattggtacaaggagaaagagacaatcgatgatatatatgaacatatataagggcgatatcggagtagatcaaggagtagatgtcaaggcggcggctgctgctgctgcctccctgttcgccgacttgggcttaggcggcggcacaaccgggaggcggtggccgtgaggcggcgaaggtgggaatggttccgtcgggacgggcatgaacggcagcttactcttgtccgtcgccgtggccgtggccgtcgttgccggagcagcagaagacgaagctacggcctgcagctgcagggaggagatgcttggcagcggcagcagcagcagcactgttgccgccacggccactgcaaggcctcgtccgaatccgtggccacggcaccctgccatctcgatcgaatccaacaaaatcaacaatatgagatcaagtaattcccctctcgttccatttataagcagaacagagtagcatcattaatgctggtgttatgatctgcttgcatagttcgggagtggagtaatgaactgctcattcttctagagtactagcaagtatgatacgtgtgataaatgtatttatgcatatgcatgttactcccgcctaacttgcatccatgcatggaaactgaaataatcaaccgattgctaagcagtagaacaaacaaacaaacaaacaccacactcgcacaagcacacatgcgtgcagattaatggattctacagtagagtagcatatatatagaccgagtaaacagatctcatgattcgtagccgaaggagcagaagaccgtatattaatgtaaagtggctgtgagcctgtaattaccaggcatatgtctctctagactttgagtataaattgtactacacgagatgatcgagatgacggatttaacagtcaagaatcctatagtctacaacaagtagttacaaatcacaatctacggctttggcactgtcacacccgccaatccagtatacagaattaaaatctcatacacccgcaggtttcctgacgagcaccagaaattctgaaactaattgctgctgctaaacttaataccagtggttgcgaacttgcaacctgcgtctggctatttttcatgggacagagcgtgctcgggccgatgggtgaactcgtagtcgaggtgcacgaacgctcgctcgatctcaggcaggcgttccagtttctcctgcagggcctcgccgatgtcgtgcgcctcttgcagcggcatgcttgacggcagcacgatgtccacctcgacgaagtaatgggagccaaacgtgtacgcccgcaccgtgtctatgtgcctcacggccttgtggtggttccagcataggtaggtcagcttctgaaggtattccggcgaggctgactgcccgaccagggagtggacgttctcgagcaccgtcatcgaccatgttctgatcgtgtagattgctagctgcaaacgagaaaacagaaagtagtctctgaaatacagcgtgtttttcttaacaaaaacctaaggaaacgtttggaatacaagattcttgagtaattctcatgtttgaaacgtttggacgttgcaaaggactacacacccaggacgatggaaaccactggaagctatttcatcagactttcagtagaggaatttagtcaggcagactagaaatattctctcttttaaaccaagtcactgtcaaggttatggacaccagttttgaaggaaaaaaaaatattggtccctttaagaaaccggtaactgccagttactggtttttaccggacaaaagagcaaaatcaaacactaattcaaaaacctgtaacatccataacaaatcgagccggttttttagttcaaaactttggattcaaacttttgatatagctaatgtgtagttgttcataaaacatatgaatatgactatgcatggttgtacaaaatgtgtattccaaattaaaatttaagttgttctggccagtacgaacaaaccagctcgtggataaatggcagtaactggtactgccaggatttgcatctctggttacaataaagtcatagctgatcttttcatcatggtatgttttccttttttgaaagaatatatcatgatacatggaaaattggcagaaactagttacttttcccagtcaattcccaatcaggatgatgtgcctagctccaaattaacgattagatcaaatatagcatttacttgaactctagttttacactactgcaatggaacaggagaaaactttttggtacttacgatgattgcaccaactgggtcgatccaaccttcgatataagtcgctagtagtgcagcaacaagaccaatcatatttgtgatgacatcaaaaaaatgatcctgtgcataagccttcactatttcatttgtgaatgtccggcaatataaaacaagggcaagtttcactaatgtcactgcaagcatgatgtccacaacccacttttcttgctcttttgtcaagctgaactcatccccctggagaacaagacaataagttcagcaatcagaaaggtatatggcaagctacaacagaatttcaaagccaacaaacatcaaagacacttatcgttctagaaaagaaatcctcaggcaaagtttctggtcaaaagcaaaatgagagtaggagttcaaggccaacaaaacatcagcagacttacatcagacaacaacgagcgtactgattctaggatgatctgaaggccaagtgtcgccataacagaggcaaagacaagtattccctgaagaagatattgtgatggaacagtcaacatattgaaatttggaacttaaaagtgtatgactgataatactaagtgaaaagagaagcgataaactcgatcatttagtgaaattagactgaaggacttatcataaatatttccatgcataaattgtctgctgccggagtagcaaagatattgatacagtagcattgacctaagagcaagagatatctgggggaaattgggaacgtgatttctagtaactatgaaaatcctcaaaacacaaaattccgcatgttactatggtccatctgccaggaatgtttgcaatagtttagtttcttttcattcctggagcatttccactttttcttttcattttgcggaaaaaagaacatcacagggagtaactggctatgcatcatgaatagccgagagttgagtcccttggaatcaattgcataaattacagtaagaagaataagcatggcaaacatgaaggtaatcttgtgataggactcaccagtggctgcatacgctttttaccaatagggtatctgtagggatttggtgtttgcatagagaaggcagtaaaccacaagataaatcctgacaacaagtcaagaagagaatccaaagtcgaagcaataatagcaagtgaaccacttctcacagaagcatacactttcgcagcaaaaagaaccatgtttgctatgttcgatagccggatggctaaagtctcactcctagcaaccttctcacgctcttcctacaggcaaataaatttatgttcagtgttgcaatgcagttgttaaacaatttgtcttccctactgttacaacagaaaagcttatcaaacataccttggacattcctggaagaaaaccacgatcagtaagtgtatccatttcattaaagccctctagcatttccacttgctgttggtagtattcagcaactacgtcctcaggaccttgagctgaagatagaatcgtacatcaatcacagaaaattatgtccagcatgaagaaagatagtgacattagtggagcaagcaggcatgtatgcttcacatgttctactgaattataccacttctcagtgaacctgataactctgatatctaattaattatatttcatctattgattatatcacatgtagaaccactgaataaaatgctacagctattgaaatgtacaggataaaaatgtcaattctgatttaaatagtactactagtactaggattgtggggccttgaattcaaccaccaatagaccacgactttaagcccacaaggactccctacttctatagccatgggaaagcagtgattgacaatacgggagagaaacgactactagatatccaaaccccaaatgttgagtgcggccaaatgacatgattgggttattaattcaactttttgtgcccaatgcaactttgttaaccagaacaaaacctctaaaattgcataaaagggtaaaataattgtgacaatacatgaacgctaagacacctggtgcccttctcacgctgtcagtcacccacacccagtgccccagtctttacaactcggctcagtgctaaccacccccgctgataaaaaaaaaagttttcttagaactctgttcacgtgcactccaagaacagagcagctcacgtgaggaccgtcctgccctgccccagatgagcacgatagtataggcaactaggcaatatcagaaagctagaaacaacaaattcctcattccaccaatataacattccccattcctattcttatctgccaaaggttgcacacgaagaatctagcctaccactaccgtcaacatcctaatccaatccccatctatactagcacagctgagctcttgctagttgctgaaacgaaaaataaaaggagttactgcctttttatattataaaggcctaaacggaactgcttttatagaaagcagataaaaataagttactttagtagatatctattgcaaaaggcaactaccgaaacaaatgaaccatgttgccaacacacgagaaaaggcaaacgaatgaaagcctagatcaagcaaccaagcatacgaacacaacaatatatccataagaccataaacatcacacggtacaagggtagcaagcgcgcgacggcgagttggagagagatcgtacataggacgccgaggcagtggtggtggagcccgcggggcggccgcctctcctgctgcacctccggcggtcggaagccgtcgaagttgaggcgccacgacttctccgccgctgcgcccgcgccgccaccgtcgccaccgccgccgaaggaaccggcctcgacggcggagagcaggagcagctcctccccctcctccccaccgcccgcgaccgccgccgccattattccacgaaccagggagccggaggcgacggcgcgcggcacgctggtgggcagtctccctcggtcagttgccctcccgccgtgcggcgcggcggcgccacggggagaggagaacggcgaggcggttggtagtttcggcgaagcggggaacgcgggcgctcgagcgacgcaaaaaaagagtgcgggtctcgtgattaaagaggagggtcaagagggcggcggggggagggaatgaaaggaaggggagggttaggccgcgtgcgccgagcccatacaccgcgggagattgattataatcactccatgtctcggtggctgtcgagcccgtttattacacatgtcaattaaattagntntacatttttttaaaataaaaatcaattgatatgaaatatatcattcgatatacatacgagtttaaattaacatctataaaaatttattaattaaagcttaattctttatgctttcataacttttcataacttatagagtcgagtttaaacttgtaaaatttaacttctacaaaagattaattaattagagcttaattttttatgctttcataacttatagagtcgagtttaaacttgtatatcggtggagtgacatattatatgtcaatttattttgattttttaaataaattcttttataactatttatgacatacaatatacatataagtgattaaaattgttttccacgtacatagtcgatcgccgcggtctttggtttgacaaggacggcggtgcacttggcctacggaggaggacggacaggtggagggtgcacaatttgagaggatacggatccccgcggttgcgtggcgcgaggtgataccgagaggatccggttcagcgcagtaggaaatgtggcccccttctccggtttaaaaacgcattcgcctgattgcctctctctgtcccccgtacacatatcaggaaaatggccgatgctgattgcgggggattttaactacttatttgccatcctttaccagatccatttaatccctctcacagtcacagcaacccctctcactgattttgctgtcttgccaagttgcactgatgaagcgacgaacagttgtaaacgtggacggggctcctggcttgatagctgatgacacggctggtgcgagcctatgtaggagaacatgattactcggttaagatgaactttcgagaaaaacaactatagagctcaagtgcatttggggtcaagaagagagtcgctagttatgactgatcggggcggcgcgtgcgcccacttgcaaacgtgaaacaagcgcgcggtgtggtcggagtcacctcccgcgtcgagatcgccgtagctttcgtctcccggggatagcggctaggtgcgtgtacttccaacaaaaagatgtgaaactggaaggaagtggaccatatcgtcctcgtgtttcttccacacaaacgacgcacgcacctggcaccagagagccacgtacgcatggggaggcagtggcagagcgaatgatgcaacagagagccacacggttgggacgggaaagcagatcgcatcatcgcatgacgctgcctcgcctcgccgctgggataagtgggcgggagcagccggagtcgtcctggccgtgccgatcaggccgtttttttcaccgcgcgagcacggtcttatcgccaccggggtgcatgagctaccacaatcctgtaatccacaggaggagtcgttgtccctgcttggcccacgaccgtctacaagcagcagcaaccaggcagccggagcagcgccttgctaccgatggataaacgtctcttcgtcggaatgtgcacgtttgccggtgtaatgatcctggctcattcgtcgcgggagacgtgaaccctccgaatggaaaggcaggaacctggcgaataacgttcatcacgatttagtatattccacatattgacgggggagctcagggagaaagggactcatcagggacacggaggcaaccaaataattgaagatcataagaaacaaaaaattgagggtctcgggtttggtgggagaatgggagtcacgtcaataaatcggtcaacaagagaaaaaagaacctacctcgctgaaagaacacatgcagtagtatatattagtacagggttgttggttcgaaacctgtgatcaaaaccgctgctcgccgtcttcaaacaaacgcgatctctgtaacatatgatgatcgaagcaaatacgactatacgagaatgccaggttcgaaacctgtgatcaaacctgctgctcgccgtcttcgaacgcgatctcatgtaacatgacgatggaagcgttggcgcccgttccgaagggttagtatatcataccttacagagttacaggctcttgtacaattgacccgctgctacagctttggaggcgatctttgggctgacgtcacgtagcccaatgagtaaaacatttaccagctgctcatccattcacagtaggaagcagcagctctccaaatccaccttcgatgagtaaaatctttcgcatgtccaaaacgagcctaaactaccagcattctggggttagtctatcttgcctatagaatgatttcatctttaatcaacaaaacaagccggactaattttgtttcactagtgttgacactcgatgttgataaattaccttcaacggtagtttcactcaattgcaaaaatgaaaacgataaattaaaaaaaatactcgtccttgcttaaatatagttgtaaaacattttccagcagatttcaaatactcagtttgtcaaagaagatattgtagcagccaataagatgttatcagaccaaataacagtctttttttttgccagaagataacttttgagtaatgagcctttatagaaagaagaaacaagcaatagatgaatacaatcatcacatcactaaagtttgataaaggaaatgacttttgtaagatattaagaacaagctcacctggcgcaaacgatagacacaggttgagtatagttttaagctcaaaacccacaaggatttatctaacaaacatctccaatccaagagcttggtggctgctagtaatatgggaaccagtaagattttaaagccagtactttacggtatattcaggtaaattagatatatatcagctgctatcaaggattctggactttagtcacagttgacaatatttcaaagttgagcacatcttgagatttagactactgtccacaatttcaaagttgtcgcaaacctttccaagccaagtgtcagactcaaaagctcagttaattaccaaacttttatccaacacccgagacttgttttaagaaatatgaccagtcacaagcaaaactcaccagggtgtaactttaacgtccggttagtttccagggctaatcatgcatttcaaggtaaaatagaatggacatgaaggtcaagtgaacaggccatcaccaattttcacgagaaatactgagatcctaaatgcacataaaattatattgataagcctatctccacaccaaacaggacatggtcagaatgcaatgctcaccttatatcaccagctcaccatcaaatacagtgtaccaatctttcatgagagccactggcattccctctatcctcaattgactccaccaagttgagatttctgcatgctacctgctagtactgggcagtcttgcaaaaattagtatgaagtaaaatgtgaggtttaaagacaggaacttgtaagaattgaaaaatatctcccagttaaaataaatcggcagtcgtagaactctgtctatatacaacagttaccttgcacatcatcgaacagaatgcgagttagcacatttcatttttgtggaacatcttcactttttttttgggtggttcttacacatcaaaatgaagaaatacagcattgagcattttaatctcagtatagtctcagtaaccacatcttctgtggcatcttgtaaagaacgggtgttgaagagcttcacgtgcctttaggcgcgcatcaggatcataccgaagaaggccttgaagaagatctataagatctccagcagaatgatcaacatgttgcattaccagattctgcatgagttagcacaattcgagtgtcaagaggataccacctatgagcgacacttggcaaagaggggaaaatgctaagaggaacatactgactacatcagataacaaagtacctgcagacgaggcaatttccagactgccttcaggctttcccgtgaggcagccccctctggccagtccaaccttaatccacgtctgaaatacttttcagcacggcgactgtaaaaaagaagtaacaagtacatgcaagtgattgataatttgaaagaacttcagatgaaactcagcagcaacctaagcctagatgtaaaccatcttatcttagattataataaatcatgaaactataacgaagaccttgtatacatactcagctctgacaatcatatgttttggaaggggacctagaactctctccatcatagccaaatgctccaaattttcatgtgtttgaaagagagcttcaccctagtagagaaaatcaaagaggcaacatatcaataggaagcactgcaaattcgcggagccggcactgggctatagagaaaatcaaggaactactcaggtatagatagtgtgaactaaccgagcagagttcaactaaaatgcatcccacactccacaaatcacatgaataattccacccaagacctgcaaatgaaaacagagaaaggaaataactaaacaaaggtaccataaacaaaacacagtaatataattatgtgttccactttataggggggaaatggaaaaggatatgatgttaataccaaggataacttcaggggcacgataatgccttgttgataccacataattgtggtcttggtgttcgaatgttgtacttccaaaatcaatcagcttgatagcactagattttggaagattcttaaaaaaggaaccatcctttgggggccgtattgtaacctttatggaaaacaatataaaaatcagtaaaaaataaatgtatgctcgtactaattgacataatgtaatggcaaccacaagtgttaacggataaaattgcaaaagattatagttcgaatgacaaaatttagtattgaagccaccttataatcaggcacccggatagattctgatgaaacaaggagaatgttctcaggtttcagatctgtgtgaataagtcgcaggtcatgcataactgcaaatattacaataaaataaacattagaataatactgttaggggcaagataaaacaaaacgttaatttgcataaccaacaaacagcagaaattaactgaatacccacatgcaacagactctaatatttgtctggcaaattcccgaacaaggtcgatcggaaatgcacgataactattctttcggaggaagtcatataagcttggtccgagcctctcaaatacctgacaaagttagtaattcaatattaaattctgaccatccaaaacatgaaaggaagccttcttgatgcacatgtacttactatacatatatgattacgatagtcaaaccaattccgtatttgcacacagctgcaggcatagaaccattcatgcaaatccatcaactcaataaagagtcaagacttagcaatgacgaaagtagtttgcttaccggctaccagtaaaatcatgcttcccaagcctctgaagcacatcaatttcaatcatagcagcctctcgatatttctgaagggagcgcacaattttgatagccactgtctcttggtgttccaagtcccagcactctaagacttgtccaaaagtccctgcaacacaaattaagaaaggtagttgttggtaacatgtacaaagggcaaaactnnnnagcataagcatttatcctgaactattccttataaaatgaaatgttgaaatttagaaaaggaggagcaactgaccttcacccatcttgctaagtattctatctgcaaagccatagacaagaacaaaggttaaacctcagaattatctcaaccaaaagaagcatcgccaacaaaacataagttcagtacagctggtagagatgcagggcagttgacaacacaacggcaatagatatcaagaatgcacgaccattacacaatgtcagaagttatttgggcaacgaacaaaggtatgcaaacattttaccctgatttaattgactgtaaataatgaatggttatttaatgaggcttgaaatgccattcaacccataattaggtggttgaaacacggtgttgcatttaaccagtaactgacaatcattaaacagctacataagtcccaaatatcaaacaaaatgaaagttctgtgtccagtatttcaacaattgtggcaagataaacttactccagaagaaaaacagtttaacagtctaaccaagcaagcgatcagaaatgcaaacaaaaacaataaccctatgcaataaataatactgagttgtggaaaaatacatcttggtgtaaggttctccccaactgcgaaaacatagtgtccatccttgtcatctggcctccagggaggcgaaagattgcgtggtggtcctgtataatagattggtggcggtggcagaaaagcggtcgcaaaatttccattgattagttcctgcccgcaatatagcataggaattgcctacaaaaataattagccacgtaaattactattaaccatatacatcaaaattggtaacaagcatataaattctaaatgaatagaaacaactgcatactgatctcctgtgttttcaaagttcaatgatatttacaccccacttagcaccattaaagttatctatctgttttgtttgatagtcctaaatagagaagtacaccgggtaacccatatgtttgacagcactgaatggacaaatacctcaagtaacggttgtgtcccaccaaaagagaacaatatcgattagcaaaaataatgacagaatatcaaactttattagcaagttccataaatttggcagcacttaggcacatggaggtcgtgagattgccccttttctccatattgttctttcgatcagcaactggctccgatcctatcccacaaattcacaatatcacatcgatgatcctctgcaacagcgcagcatatccccaattcccaaatatgcacacccagatcgaaccgccccgctctaaatctagcgaaaccacgactagatctagccaaaaactaccaccgcaacccacacgcccgagagagaccggatcgacgcagcacatagcgcatggattataccttggggggctggaacagcgggggcgcgacatcccaggcgaggcggggccgcttccgcggccgcttgtcggcgccctggtgcgggtactcggcgagccactgcgcctccattgcagagtcgaaatcgccaattaagccatcggcgaggccaatccggcgggggattttgggcgaggtcgccgcacgatccgcgggaggaatcgggatgcgaggttggggaattcggggaagaagcgacgcgagattggggaaatttggaaagagggggaggaggggaagctcgaggaggaggtggtctggtctggtggtgttcgcgtccgcgcaaccctggtttgttctgtggaaggcgaggttagctaactatggttagttcaattttttagcttttttgcgtacaagtccctcgaattaatgagtaattgtttacagtccagttccctttgctagttaaacacgtcttcgaattatgtgtgaatatttcggctgtgttgggttgttttgaaaaatactcgtgcaaatttccgtcggacccttgccgtgtttagattttttttttccaaaaacatcacatcgaatatttggacacatgtatggaacattaaatgtgaacgaaaaattaattgcacagtttatatgtaaattgcgagacgaaccttttgaacctaattacaccatgatttaacaatgtgatgctacaataaacatttgctaatgacaaattaattagatttaataaattcgtcccgcagtttacaggcggaatctataatttattttattattaatctacgtttaatatgtgttcatatacttaaaaaaaaattagccaatcaactaaacacaccctttttcctaaccgcagttggtgggaaacggtttgaacttccaactgtgccactgttgtccatcccattttgtcactgttgggctatgtagtgttgttatctttcccattttgtcctcacaagaaactcttgttttgttaactaaataaaacccatgatgctgaaattctgatactcctattgttgcttttgttgacttcagaaatagtattgttccctctcagaaaaaaatatttatgattgttccatgctagcatctttttaggtaaaggttatttaattttgaaggaaagctaaatatatcatgcctattagctgtttaccatgctttctatgtggaggttccatgctggcttaagcttttcatgaatatatgannnnnnagtaaccagtcaaaacaattggcaagctgggtttgagatagcggtagataaaaattgtgtgtagagctgtcaaaaaagctcgagactcgcaagctactcgagttcggctcgctttaggcttgattcaagctcggctcgttttattattaaactgagctcaagcctatcacgaagctnnnnnntttcgagccgagctcaaatagctcgacgagcttttgctgctgggcttacgtacaatttgccatcccttatgctaatctgttagggcttgtttagttcccaaaaacttttcgtgaaaacatcacatcaaattttcggacacatatatggagcattaaatatagataaaaagaaaaactaattgcacagtttgtatgtaaattgcgagacgaatcttttgagcctgattagtcaatgattagccataagtactacagtaacccacatgtgctaatgacggcttaattagactcaaaagttttgtctcgcagtttccaggcaagttatgaaattagttttttcattcgtgtccaaaaaccctttccgatatttgatcaaacatctgatgtgacacccaaaaatttttatttcactgactaaagaactaaacaggcccttagttgtctcatccaaattttcctccaagctttcccacaggagaatagctagcggccgctcctctcacatcaaacagcaaaatgctgcatggcacactaaatgccttcatctttctccatcactcatccctcccaacgaaagcttatgtccttcatttttcttccccgtgacttgcgaagctaacaacaggcaagctcgaggctcggtcgagccgaactcaagcctaccatgaaactcgaatgttagaacaggcttgactcgagccggctcgagtctgtgtcaagctcgagcctaagcatatgagcttgctcgagctcggctcgttgacagccctaattatgtgtgggcacatgaaacgaaaaaattattagcacatgattaattggttttaattattttaaattttaaaaatatatttatttaatattttaaagtaacttatatatagaaattttttgcgtgaaatgtattatttagcaacatgaaacgtattgtttagcaactacgcaagtgcacctttaaactttgtcgcacacttcaatatgtggattttatcatgatatagcataaaagagaaccaccgtatagatacatcccagttgtttcagacgaggagaaatcaggacgatgggggacaagttaaaggcaaaagggaagccggtaataaacataaaatgcaagctgagaattagtgttggaacacttatctctcataggctactttggatcgaaagaatttacaaaattttcacacgaacttattaaactcctaaaagttacttaaaaaaatcctccactccgaaaccatgacacatccttgccctaatggccaccacccagccaaaagaactaacaacatcctttcataaaagtttaagataactgacatatgcagccctatctttttgctcatgtttatacttaccagccaaattttgaattttcaattttttttatcaaagttcatttttcagcctttgctttttagatcgttaagaacatgtatataaaagttttcttcacaaattagttttcgtttgcaaatattcagcgaaacaatagggtcgatgctccctccattttatattataagtcgtttcaattttgattaaagtcaatttgctttcagtttaatcaagtttgtagaaaaaaagttataacatattcaacctaaaataattttattatgaaaacatattcaatattggtttaatgaagctaagttggtattgtaagtattactatatttatctataaacttattaaagtagtttaactttaaccaaacttaaaacaaattataatctaaaacagagggagtatcatggaacggtaatcatgttatgctacaaaatactatgtgtcaggggatcatcgccgaacaaaatgcaacaagtagcaacggtgatgcggttggcatctggcaacatctacgacctattttgacctgactaatcacgctccagtcatcaacacattcttccatgatcagcttttcctcctttccccgaaagaaagccccggaccggatcaggccggtgccgactctcccaagtcccaacaaacaaagggctgtgtttagtttcttttaaagttaaaaatttaggttgaaattgatacgatatgactgaaattatgtgtgtatgacagattgatgtgataaaaaaggttagaagtttagatccaaaagatctaaacactaacgtgtgccgaaattgaggaccccagacttccacggtgctgtagggctacagagaattccgacgcgtacagccgttcggaaactgcgacagcgctactgcgcgtagccgtcgacttgggaagctgggagttttgggcccgaacggcggtgggccgtgtgggcgtccgaacaaaacgggccgtcacggcagaaggccggcccactcgagcattgcacgagaggcgattctggatttttttttcactagcaaatatgcccgtgcgttgcaacgggtgaaaaaacgtaatgataatatacgtttttcatgcataaccatgtcgataacaatcagaaaattagaactacgaaattttattttctagcgcgttttcttttgtgcttttttctgacatttttccctcacgtgtttttttaaaccgtttttattttctcgcgcattttttccttttttaatattctgtagaaacttctcttttta

SEQ ID NO: 66990 - DNA, 9598 bp, Oryza sativa
atttggtattgagtcgatgctctttttatctcagtgccgaatctgcatgcctggtgtgatttcttcctccttatacattttctccctggtaatggatggccagttaattggtgttggatgtttgcttgttgttcttcctcacttgtcgctgcatatcagagcatggtacaaatcgttcagggtgcccgctcacaccactcaagatgctctgattgggccattgtggtgtatgccagtcgagtctcgtcgctgcgggaggatcccgccagtgcggccagtgtcaggtgcactcaccaccactcgtcgttcgagggcgggacggagagctcgagcatgcctggtcaatggcagccggtcgtcggggctgccaggtggttggtggtgtctgtgcgtgttccggcgagtggtcggtcccacggctatagccaatcatgctccgctgctgttcgggccccacgtagtcgtggtccatgccaattgcagttggccgctgtagtaggctccgccgatgtgccctttgtccggcgcagtgttactgctcggcgttcgaggcgaacacggagagctcgaggatggcctccgtcagagcactgatgtgttacgtcgtatgctgtggttgaccgatggccctgtcatctgtggggtcctattgacagcctctgagtatgttgttttttatgttacatatttttttgttttgtttaccagtataagtagctcattgcctgccaatcttctctttcccttctgctttttcaccatttcctttgcattgccttttggtgcccgttcgctgttcttcttgtcgtctgttctagcccattctccgctgttgtgctttcttcgtttgatcatggaccctggggggtgaacgcgtgtgctggtgggttttctgtatctggcctagctgccttcctttctgtctgtgccgtgtgtttcctttttatcctgtgattaggcttggtgcatctcaggtagccatgtactggcctgtttgttgcacgggatttactgtcacagagtttttaggttttaggcgattttccccgtgttcatgtttcccttttgacagtggatcattgcttatctttgttgttcttctttcagtatatacttctttcagtaaatagatggtggctattacatagatgaagcacacggtcgttagttaatgacaaatatcattgcttttttttcctggttctgattcattattggatcatgtttcgccattcagagtgtgtcccgtggtgttttcttttcgtgcagaaccatgtggttcatttgtatttttgagtctttccttaagtgcatctctgtacgtttacatgttttttttcccttcatatcgatttttttttggcgcaggtgcttattgtcgcggtcaggtccgtgcgatacgttcgttactgttgtgctgctgttccctttaccatcagctcctgttcaggtgagctttgtttctttgctatttctttggggctgacatcctttttgttttgtagtttatttgtgccttgtggtttggtgtatgttctttcttttatctgatatccagcttaaattacattcttattccctgcaggttgcggaccacatcttctgtgcccgtacatgtcggctaaggtataacaattggcctctgttgcttcagctatctatacattattcgagctgcgcttttccttgtgggttatatgttctatatgtgtgcacgacatttctgtttttctgtgcgtttagttcctatatggaagggggttgtgtggttaggcctgctcgtcgacgggatcgccgattgctagagcgtagcagcgcttctcttagatgtatggtttgttgcggtttgtttttttagacgctttagattttatatcttttcctgggtggaaagattaaatcgtctgttgcttgtttagcatcttcctctaattcagctgccagcgaatatgtttgggagactgttgctccaccccgtcagggtatgtgatttactgatctgtgtgcgactgttgttgtggcttgtttatatttatgtagtcgttgctcatatatttttctcgctttggtagacgatggatttttccctatctaccctgcatggtattcttcaaaaagacggcaaatgcgttcaaaaaaattggccatgaaacgattggtggctgcaggtttttccattggatctttggttttctgcatatgttcttgctgacatggcttacatggacgttatgtctccttccctataggcaaaaaaccttgccgtattgctcctgtctcttgcaacaagtttgacagtgattatgccaagtttttgagaggttgctttcatctctgattcgtttccattcccttgtttgcaatgccagcatgctgggtttaaacataaatttctttttttgaatgcttgcacagagacttcaaaggataggtgtgattatggccctcctgagtatcgctgccgtttgtgcgctgctcagttctggtaccaggaacggtgcaagaaagattctgctattaccaagcgccgtgtctgttacaacctttgttgcaaaggtgggaaaatttttgtccctccatttgcgcagccaccagaacctttgaattcacttcttaaatttgatggagatgctcgaagtaaacattttttgcagcatatacgtcagtacaattcgctgtttactttcacttcgatgggtgcagatattgacgatagtttaaaccagggtggtggtccttatgtctttaaaataaatggccaggtctatcaccgtataggttcgctcttgcctaatgaagataatccaccaaaatttgctcagctgtatatttatgatactcaaaatgaggtccaaaacagaatgcttgctgttcttggtgaagagaatggtagctgtgatctagatcctgagatagctgctgaattgctagacatgctagacaattgtaatcctttggttaagcagtttaggctcgcgagagatcggctggctgaacacggtgatgaacaattagcaattaagattgtaggaggaagggcctgttcagtatgaattaccaacagccgatgaactagctgggttaattgtaggtgatttttcattggaaaatgcaaaacgtgatataattgtgcagagcattcctggtccactccatcatgtatctagcttgcatcctgcttacatggccttacaatacccactgttattcccatatggtgaacgtggttttcagcttggtataaatttgaggggggttgatttaaatcgcactgatatacgtactaaggcttccatgcaagaacattattgttactgttgccactatcgtcgagaccagttcaacccatatttatgttgcggtcgtttgtcctcccaaagtcaagttgatggttttgcgtgtgttgacgagggtagattgacatttatagatgaacaccagggcgattttagatgcgaacacgttcaaggcattgcagatgcagtcgccaaaggttgtttagacggtaatagtgttggtaagcgacgaattctccctgcaagcttcactggcgggagaagatatatgtaccaaaattatcaggatgcggttgctatttgtcgtgtgtatggcgcccctgatgtgtttaccacttttacttgtaatccgaaatggcctgagattgaagaagcattgcgctttgagccagggcagcgttcgacagatcgttctgacattgtttgtagagtttttaaaatgaaacttgatgagatggtttctgatattatggctggtgttccatttggtcgtgtgcgtgctggttagtgctcttttttttgcccttaacttagctgtgctctttatggtctattgttttattgatttttatttggttgttttgcctatgatatgtttgtagtactttatagcgtggaatttcagaagaggggccttccccacgtgcatatactggtggcgtgatgcaccaagcacagacgccacaccatctgttgtggatacatacatcagcgctgaacttcctgatcctaatgaaaatgagcttgattacttacttgttgaagaatttatgatgcatggtccttgtggtgatgccaatagaaagtgtgcttgcatgaaaaatggggtttgttctaaaaaatatccaaaagattttgcttccgagacaactgtagatgataagggtttcattgtttatagacggcgtgacaatggtagatttgcatataaaaacaatgtgaaacttgataatcgttcagttgttccgtacaatatagcgctgctgcgtaagtttgaggctcatataaatgttgagtggtgcaacaaatctaaaatgatcaaatatctttttaaatatgtcacaaaagggtctgatcatgccaacataaagtttaccaaagtgagaaaaaggaagttagggcgtgttgcagttgacgatagtggtacaccaagctctagcaaaaagatgcgtggtgctgatttcactgttaagccgccaagggatgagatggctgagtttattgcgtgtcgatatttatgtgataagcaatctatgtggagattatatgcatatgatattcattttagaaacccttctgttgaacgtttagcatgccattaccgaacatgaacgtggtctcttttagatcagacacaaatttagcatctatggtttcaaatacatttttacaaaaaacaacattgactgagtggtttgtcgctaatgatctattcccgcaaggccgtcacctaacatattgcgaatatcctacgatgtttacttgggaagatgatttaaaaagttggaaaaaaaggcagcacgactataagattggtaggatgtattacatccatccttctgcaggcgaaggatattttatgaggatgttgctcatgtacgtaaaaggcgctagaagttatgaggatattagaacatatgacggcgttgtttatgatacgtttaaggaggcttgtgctgctagagggttgcttggtgatgatagagaatggtcgtatgcatttgatgaggctgatagttgggcatccggcggccagcttagatcgctttttgtgttgatgattgttcattgtggtattgctgatgagagtgcgttttttgagaagcattggcatgcgatggttgatgatattctgtttaatctgcatgcaagccttaaataactcttcgtactctgttcctgatactcaacttaaaaatatggttctacaagaattgcctacattgtatgtcgcaacggtgtttctatgtcttcttttaatttgccaagcatcaattgtgatagctcctttcaatcagcaatagattgattgacgatgaaatgtcttatgatatagatgatttatatgtgaatgctccattgctatatgaccagcttaatgttgatcaacgaaatgcatatgatcgtattgtgcaaagcgtcatgacggaatcacctgctttttactttgtttctggctatggcggcactgggaaaacgtttctgtggaattgtattgttacctaccttagatctcaaaaaaaattgttcttgctgttgcatcatcgggagttgcttcattacttttgctcggcggtagaactgctcattcccggtttaaaattccaatagaggttgatgaatcaactatttgccatataaagcgaggtacaatgctagctgatcttattaagtccacttcacttattatatgggatgaagctctgatgactcaccgtcgatgttttgaggccttagataggacattgcgtgatatctttgctgaggatgatccttctgctgcatcattaccctttggtggtatggttgttgtgcttggtggggactttcgtcagattttacctgttgtggaagggggtgttagatcaaaaacaattgatgctgcaatatcaaggtcccctctctggtcacatgtgtctattttagagctatcgatcaatatgcgtttgcgttctagctctctaagccctgaggtacaacatgaaatcgctgactttagtgattggattctttctatcggcgatggtacaacagctgcaagtgctcgtgatactgacactgaaccaacttgggttgatatcccacacgatctcttagtcatggataatgatgataaaattggagctattatatccgcagtctatactgattttgctgaacattatagtgatcctatatatctacaagatcgtgctattgtttcacctacaaatgatatatgtggcactattaattctcgtgtactagagcttgtccctgacgagatgaaagaatacctaagctttgattcccttgcaaaaacaaatgagaaatgtgatgatttagatgttttgtatccaatcgaatttttgaactcaattaaagttaacaattatcctgatcatcaattgtgcttaaaaaaaggtgtgcccataatgcttttgagaaatctagatcagagtgctggcctttgcaatggaacgagaatgattgttacaaatctaggtgaccgagtaatagaggcgcgtatcataactggttccaatattggtcagactatttatatcccaagaataactctatctgcaaacaataagaaatggccttttacattacagcgccgtcagtttcctgttcgtgtgtgctatgctatgactataaataaaagtcaaggacagagtctacgttcagttggcatttacttgaaaagcccagtattttcccatggtcagctatacgttgctctttctcgtgtcacttcccgtgcaggcttgaaagtacttatcgaagatgacaacgggaattgcacctctcgtactcgaaacatcgtttatcgcgaaatattcgctgctcttagatagttggtggttgctgtcgttttgtttattttattcctgcggtgtacatatatacttgttttgtttatatctaaaagtttgctatgctgttctatggatcctgtatattacctggttatgctgcgcttttgtttgctgtcctactatactctttgccataggtgatgcaccacatatttatctgcttattttatgctttttttgcccttttgcatgaccttgttttttgctttcctatagatggctttcgatttgctgtgtgacatatccccagcaagcagaggctggaagatccgtgcaaagatagcaagaatgtgggactacactggtacagctgacgatctgcctcctatacatgttgatctggtgcttattgatgagaaggtatatctcattagtccgaatgcagggcacctttatattccctgtccaatttgatttgcttacgatttaaatgcttatgtagggaaatgcaatgtatgctgaaattccaggcgttgaggctgataagttcagaccacttcttcaggaatcgaaagtctacacttttagcaagttccttattttgcctagcaaacctgcatacaagcccttccctaacaagtatatgatcaagcttactccatggacaaacgtggaacaggtcaatgaagttcctgctgatttcccatcccatgtgtttaatttggttcaattctcatatctaagcctgcgcgttgggatgcaagagtacttcactggtttgttctttcctttaccattactttccattatttatgctatttatagcatttatcaatttaccaaccactgttcttaattctttttagatgtgatcggtatgatcattggggtatcaaagctagcctatgtccgaatggcgtctaaaacgtcagacacacctaagagggtcattgctctaagggatcttgcgtacgtagcctccgtgatttacttgttgttctagtctttaccagcttgttgtttatgaccctgacctccaatgcatggccaattattttgataaccgttcattcttccgaataggaactgtgaggttaaacttgtcctatggggagagcatgctcccgactttgatgctgatgctgttcatagtgttggccaagataatgctgtcgttggtatctttgttgatactcttatgaaagcatataatagtaagcttttctccttctctgcatgtttagttctctctttattttctgatgccggtgttgtatcttcaatgtacacttgttttttttttgttgtctccacaatcatttctcctatgtattatgtagatgaagaaactcttagtggaggatcagcctgcaaatggtatttaaatgaggacataccagagataaaccagttctttgataggttagtaaaagcccctcacaacagagttaataattttttagagttctaccccctttctctaacatgtcgttttccatgccttgattagcctgggtgatagtgctccaaagatccagtggatatcaaccggagcagagtcctttggttcgtcacaacgcccagcacggttggagcataaatctgttgctgaccttaaaaagattgatccatgggaagctgcggtaatcactgtaaaaagcatattatatgctttcgcatatgtatttttcatttagttcatctacaaggttattgctaaacacttcctatgcagggtgctggcttctcatgtactgtgaccatagctaagttgagcccatctcagtcatggtggttttcatcctgttcccgttgtcatagagccgcaactgcatatggatctagctataaatgctccagcggttgctcatcagttactgccattccaaagtaatgttctacagcatacatgttcagctccttttttatatgtctgcttggcctctatgacagaaatttcatttttatatgttaggtaccgtctttgcctgataggaaccgatggaactaattcagcagagtttgtgctatttggacgtgttgcgcagcaagttgttggccgtcctgttatgaatcttatcaaatttcagggcagatcagacaatattcctaaagaaattgctgctgttgtttcacagaaatttacctttgctgtctctgtcactgagcggagccttatgcacaggaatatatcttttcaagttaatggaatcgagactttctttggaagacagggttctattccgcagcctagggaatagggtccatctgcaggcccttctactcctttggctcttgctgcttctggtatggataaggatgacgcctctcaatctcatgagtcaaccccggtcgattcatctacttcgactgctgatccagtcgatgaacttcctggtgacagcaagaagcggaaatccattgtccgtcatgtacgcccttccattcatatcccatacattaccttttgctttttttatggcccttctttttatatgtctgattgctattccagcctctagcagcacagaaaaaattgacctttgaaacagctccatccagcaaagaaaacaccagcccggttgaccctcctactaggtacaagtgtttttccacacttcttgttcttcttatatgttgaaactttctctatgttacatctgctttctaatttttatggccaacagtaaatgtggtttgcctctgctacatagcagagcacggtcagtccctccacttcaatcagatataagcatccaacccattctatttagtgagaaa

SEQ ID NO: 66991 - DNA, 3262 bp, Oryza sativa
cttttatatgggatgtaatgcgctccaaaatgatctgcatatggcctaccatgttttgctaccactgaccattgcacgcagcctaccagttatatcttttgctttgcataggcatatcatgtaatattactaaccatgatggctatctgctatattgctcagttcttctcgcactgatgaccaagctgctgataagcaacatgttgtgcctcatgaggttgatgtttcttagattgcagctgcctctgctaaaccaaatactcaggttaagcataaatacaccactttccagctaatttagtggtcgaatttttttagtgacactggcaacctaattattcccgttctataggtcaaagatatcctaccaactgaagccaaaaagaaaaggtataaaactacatattcaagctgagaacgaataagaaaatccctatttttgtactagcggtggaagcatgtcacattcattgttaaatagactgcaccatttcgctttcgctgctctcccgtttttggttcttctagattaaccaggtgttcctctttgctttagtgttgatccaggctctacaggcacacgcaagactaagcctcctgtaccgaaagggaactaaattgctcaccttagcttttgtgctgatgtgagtatcctgttctgttatatatctatgggcatggcattagtttcacctagattgctgatcactttaaattatttttcaggggaacaataccctacatcagcgatcccaccctatgtctacatatttccttaatcttactgttggcgatgcagcttgacatggcacatcgtatcagacaatcttttgtttacatgattgctggcaccactgtgtccatgcatgtgcatgtttggtcctctacctgctgctctttcgccctttagtgtcagtgtgctttccataccgtagcagagacttcctatgaaacgctgccatacgactgcacatcaccccatcttttgcttgtatgttatttattgtaaccatgactgtcaatgtccatatggtgctctgtcagtcctatgaactcgttcagcaaacccccttctgttatggatcatattaatgcactagcgttctatctgctgttgttctgttcatattacatgccttgcagctgctttggatatatctagcacttgtgatacactatcgtcattaaaagcttatgtttcatgtgctatgtgcctgtgcaggaatttgaaatttgtagcatttccatcctacccagctaatgtgataagtaggattttgtgccatcctttctgtcctaaagaaagggtgggcaaaatttgcagccaaaaatagcatacgcgttggatcgatctgcattttccacttctacagggcaagccagatgcaaatgacatgcaaatgaccatcgatgttctgtagaccacacgtgaatagtcaatgtattcaggaccacttaccagctctactgccactgctatgttaattagtgttgcaccttaagattattatcataggtactgcagcaccttacaaatatcagacatatgtatgttgttagcgctgcaatctacttatctattgccgtctgctttcattacttttcccccaccaacactttttaaccgttcttccctggctatcagcttattgggcggcacacgtgcgtacaggcggcacgccaagggtgcgccccaacctctagtagtgttaataggtgatttaccacacaactggtcaaactgtgcatttagagctagcaaatacttcttgtactcatttcctatttattgcttctccaaaattattttctagatcactacagaactgaatctcaacaagaaaaaacacaagttaccaaaacctaaatttgatgtatacatccaccatgatctgaatccatacttacatccaccatgcatgaccctacaaatgaacacaaattgaccatgcatgaccctgtgggatgaaaatataccctgcaaatttcccagtgaaagaaatgcgtctgtctaggaaaggtcaggaaaaaaacagaataaatattgctactggcatttgaattttaaatccatgcacacaataaaggaattttttttgaccgaacgaggcattcaacaggcacccaaatgaaccggtacgtcctatcgctaaacataaaccaaattaaccttatcctatcctatccaacagccacccaaagttctgtataatcccaacagcattcacatagtctcctctatcatcaatatcagtttgaagaaaacaggaaacatgtgtagactaatggcattttttttttcgctgggccggagactaatggcattttcatttggctgggcaacgaaaatcctaaatgatagagcagaactggacagtgaagcacgacttggtcatcaaacatcagtttcttatggccgcaaggtctcaactaatttgcaagctcaacaaacaaaagaatcaatatcctctcagtttatttttttgacatgtacttccacaattccatattacgctatctagcttgacaaaagattaggcctgcaatctaaatcagagaaacatattaagataataactttctttgccacactgcccacacattcgcataataatttattttctcacaggtttatgcacgtacacacataatagccatgacactgtaataatgaaggaacgggatcgagcgacgattaccttgttcgcgtcacggtggagagggctaaggtggcggcgcaacggagagcagatggcacgagggagtcgacggcggcgtcgcagtatagaagggggtgcgtgggtgagcagtcccggtggcggcgcgaggggccgggatcgacggcccgtgacaacgatctacattgtgtgggggcattggtggcgtaaatctggaggcgggaatcgacgacgatcctcgtgagggacgctggcggtgtcatctggaggcgggaatcgacgcgctggttggggcgtcggcgacatcgatctggaggcgggattcgacgatgatcggagtgagggtcgaggtggagagacgggaatcgacagcgacgcgagggggcgccggtggcgtcgatgtgaaggcgtgatggggcatcgatggcgtcaatctgaaggcgggagtcgacggcggctcgatggcagagcgtgggcggcgtcgcacgcgatggcggggcgtcgaaatcaacggcagcatgggataaaggaggaggtggtggcgacaattagggttcgccagggggagtgcggcggcgcttgtg

SEQ ID NO: 66992 - DNA, 4510 bp, Oryza sativa
atatcgttctgtagtttccctcaacttttatacatgtgtttttagtgactcaagcaaaggttgaaaaataaattatgataaaagaacattaaaattaactttaaattcacattttagttgtggctgataagctgacgaataaacgatggtagtttatactttatagtagcatgtgcttgcaacttttcgttaggaattctaccaatatattatatcctctatttcttaaaacaactgaaatggctaaaaatgtgtttcccattttagaattttcatcgatcaagcaaatgttgaaaaataaattatgataaaagaacatcaaaattaactttaaattcacattttagttgtggttgataagctgaagaataaacgatggtagtttatagctgcatgtgtttgcaacttttcgttaggaattctaccaatatattatatcctctatttcttaaaacaactgaaatggctaaaaatgtgtttcccattttagaattttcatcgaaattctaacatttgaaatattgtatctatatattccaggcacttaatttcgcggtccaaaacacaccgcataatataattatttttttcaccggatgcataatataattattgcacttttgacttttatgtcatatgattgttttcttttagcccgtagcaacgcacatacattccggtagtcttctcaacaacagtaaaatacctgttttttcgtgtataactagaattctttgtaatcttggtggcgtgcaggcatttataaatccgtatctgctgtactcgaatgaattaattaggcgggactttcgctctcttcgcaaaaaggttctctgcgacataccctctgctttctagacacgcgtggccctgaacatcgatgtacacagtacactgcgttccaatgcgtacgaacacctgttgcaaatggcaataatactggctccacacggtgatccactctaacgtgaaacaatacttcaatctcagaacatgggaagtcaacaaatgcagatggaatgtacgcgccatatgatgtggactttggaattggtatggaattcatccgatgcaacttggatccaacaagcactcaactcggttaattaccaacgggatatcagaatatgcatgcagatgatggctaatcaccagcaatggacgcatggttcattgtatcaggatgacgactcctaaatccggcaagtcaaaaaaatataatagtaactacttgaactacatatgcataattgcaggtatgcatgtctctcttccatgttttgatgtttaatctgcatttgctttgctgtttcactgagtcaatgaaagaatgtgtctctgtcaggatctgtaattaattggtatcaactgaaggttcatccagaagaaatcaaatgaggatttgtgcgaatgcgattgcatcatagatgacatagcagtaccaaggtcagagtttatttttatgccttgtcatatctaggcgcacaccatgccaattcatgatttcttacttagtacattgcaccttgcatcatcacgttgatgatatgttaatggttagcgacgaacatatctattctaggcatggttgtatctagtaaacgattattgttttctatcttgctatataaatgcaggaaaccaaatttgcagaaactgaaggttcaccaggttttggcaatgcgtcgtggatgacatgaaaccagttacagctgcagtttcagttatgtcaaagatgcttcatttatattagtgtttcttgaattgtgagccatatactttttctccttgctaatcttgtgtggatatgaaacaccggaacttctctgcgcctacttgtttatatctttcgtgagaaaaaccatttgcctgaattttcagagagaagcttgtttgctgcaactactcgattccaacccaaagtacaggctgtggaagcagaacaccatcgtccttgtcttacttttccttgaactcatcctcaagccagccaacttcccagtattttcaggttttcaaagagcaattcgagacgaaataaatttcacacttaattttcgttatctactattcttaaccgattaacatgtgcacaagtcgaacctgaactagcccgtttccttctactacttttcagtagaaaatacccttgaaccccttttgtttcagaccaggatgtgcccaggtcaagagaaaaaacttaactacccagctgttgctgtgtctgcaactctgaatgcaatcaagacatcaagatcagaagataccgtgctgcttttgaaggtgatttactgagttctgacttgattagcagtcgactacgtactgacttagctatccagtgggaaggaagtcaacacacgggaaggactagtagtagtgacctcgccactgatccaatttgcagcttctttttttcagagttattcggtttacttgccggagtagacgactttaggaagctagcttgtgcagtacttctcaagttgtcgctgaaaagccttacctgatgaaagagagaagatgagataacaagttgcttctgagattgaagtcttgtttcaggttagctaagagtgctgattaagtgtgtaaggttgacagctctcttcaaccaagctgagtttccagaaaaagaacccaatgaggcaaggatctatggaccatttgaaacttggcaggacattttgcaagtatagcacatgccctaatatttttgtatctgatctatttattaattttagatagagaaaggaccaaggatatgctaagagaaaatgttggggctgtttggttatttgccaaattcaaccctaccaaaaaggttggctctgccagaacatttgccacttgtttggtttgctaccacaaatttggcgatacctttttttttccgttactagtctaactaatcttgccagcaatccaagcaatcatctttgccaaaaaaataatttgcaatagccaaatcttgccaatggttgccattgtaaaaatgttagcaatactaaaaatggaagagaatcaagtaggcccattaaggctgcgttcttttgtagggttccctactcccctctcgtttttcatgcacacgttttttaaactgcttaacggtatgtttttttaaaaaaaaattataggaaagttgctttaaaaaattatattaatctattttttaagttagttttagttaatacttaattaatcatgtgctattgtactccgttttccgtgctggaagagaatagaaggttttcaactagcacaacgaacacagcctaagccctgctacttcatcaaattattgctgtgaattatttgctctatgctacttctcaagaaaaaaaaccagcacttattctaagtcatttgttaagtttatcttaaaatattgtattattcctataatcaagtagataatcaagtaaaaatttaggtctcatcttttcgcttatacttatacttatacttatcggccaaaatttaaatttaagctgattttaaggtctttttaatcaaagtttattttttagcctaaaaacacgtatataaaaattttatttacaaattaatttacgtttacaaatatgccgtttcgcttattcaaaacaatgccttttttgaatgggctctaacgcccctggccgaaggatttatttattgatattcttatctttttcttaaccgtaagtctgtaaccagcccaataattatgggccgttgtttgggctttgggccggatcatgatattgcagttatcggatttgtacccgaaaaggaaaaatccgcttcactcgcctcctttctcctcctccgtcctcgtcctggtctcgcggactcgctccctcctcccctccgccatcgcctcgctcgcgcagcaatccgcgacaaatccaccagccaatcgcggcatcgcgcccatcccttcccctatactgcaaatccgcttccccgagatggtaatttccttccgccagtctctcctctcacgatgtttaattgcgcgcatctctgtttcttcggtctagttatgtcgtttagggtttatgaccaagagcagatggtgaaaaatccggagttcttggtcactcggcgtgccattccatatcttttatgcgtaataagaccttttttttatgtttttgtttcccaaattttgctgtctggaaataatttcttgaaagggttggctttgatcgtttgctcgtgcaggaatcctgtccttcggtgaagaacattcttgtgctggattccgaagggaagcgcgtggcggtgaagtactacagcgatgactggccctctttgtcctcgaagcaagctttcgagaagtcggtctttgctaaaacccagaaaacgagcgctagaacagaaggtgattaaaatatacttttattctagttctgttctggaagaatcaaaacaatgtttgtttcttttttttcaaaaaaaaaaggtgctctgtgctacttgtgtagagaacaactgccttatccctgagaacatcaattag

SEQ ID NO: 66993 - DNA, 8978 bp, Oryza sativa
caaaaaaaaaaggtgctctgtgctacttgtgtagagaacaactgccttatccctgagaacatcaattagcaatttagcatctcacaatatggcattgttgattattgtaagactcctgtggaatattctagaggcatacacatatcttccagttcgagcatcattccattgtttggctcatcttctgtaaacctgtggtttgcttgttatgagatgttaattggtcgatttctgaattttggcagagttatcaccagattttgctgtggaatactaaccttatattatagaataacaggttatctgttttttactgctcatgaattccgttgcatttcttaaaattgactgaaagattcaagtttcggaaaaatgaatttttgttccaacaaatgaaatgatctcgatgcctgtgtcatctgaaatgccttatttttggttgatcattcattttgggggattttagaataattgcattgcacatgagtgtaaaatttgcatggtaggttgtttagttcaagtcatccaactatattcatccagtgatttctttcttttctttcccaatttgcagctgagatagtaatgtttgacagttacttcgttgtatacaagttcatccaagatctacacttttttgtaactggaggtgatgaagagaatgagctcattttagcatctgttcttcagggcttctctgaagctattgattaccttctcaggtgtggacatttcctgtgccgtacactcctatcttttttaacatccattataaatgcttgtcagtactgtatactattttaacaactctctttcttgttttcagaaacaaagtgcacagaagggctgcgcttgaaaacttggatcttatcttcttatgccttgacgaagttgttgatggagggtaattactatgtttgcattgcaatatgctaacctttgctttccatcaattgaacaagcccagttttgataactatcacatttttacgttcatatcaaaggcaacagacaaggtcttgggcttgtattgctgaaatgtgaggttaggcactagttggttaatgtaaagaaactacactctggccttgtttaggtgatgagaattgagccagaattttacacaaaatcagcattgacagctatcagttatctataatatttttatagttcattgttgggtatgctcagttcacagccaaccaattttcagataaacatttgcacaaatgctatgctaatgtagaacatctacaatcaggcatattaaacatttgacaacctgtagttattgattgacgctactaattgtttcttcacaatcgggttttgcaggattgttctggaaacagatgcaaaggcgattcttgaaaaggtatcaggtcatggattggaaggatccgggtctctcactgagcaggtatggcaagccgtcgcatcaccttaagtgcaattgcacaatgagatgcaatcatggtgtcgtaattgccaccaaaccaacatgagaaaattcccaagtgaattaattcttttttgtacatgcagaagttaagcagtgccctagcaacggcaagagaacactttgcgagatctattttcagctgatggcgtgtcatccttcaggttgacgatgagcaagcctcagatagtgtctctgttagcagatcagtactcccagtttgcaatgtcctttgaacatttgccacgggttagtggtaggtgcagcttaactggcgatcattgtcatcctaagaaggttgtggtcggcacacttgttactcttgtggtttcatgtcgatcttggctgtaatcgagcacagtaaccatgtagcaacatgtttctgctcaaagacgagccagtttccaaattgtcttcagtatacagccgccatgttttgacgtagtactacatacatttacttcggcctggtttggaatttgaatggtattctttatagctaagttgcttaataatgtttgactaatttcagaatacttgctatcaaaaccgaccaatcatcgaaagtaaccaaaattcgcattacaattctatcacctgttggtatgtttcatctcatgtcaaggtaaacaaaaagagacaaaagtaatcaagcaaagcgaccagaatcacgccggcaaactgctgccaatcctgctcacatactggcacagctggtccctcagcgcggccgcgccgacgtcggcgacatcgctgaactgctgccggtagccgtcgtcgtggttgtgcgacggcggcatgccgcccctcgccgcgtcctcgaggtcgatcatgatgttggtgagcaggcagcagacgtagatgatcctcggcagccggtgcttgtccggcctccacagctctcccttgagaacctgccacctctccttcagcttggccagagcaccctgcaccaccatgatcgtcgcggcgtgccgcttgttgaagtcggctttcgccggagatagatccttctcacggtatggagtcatcagccagggaaggagagggtagcttgcatccccaagaatgtagtctctgaccactgacccagctggctctcctggaagctccgtttgtccgtccagcctcgcgcctttctcgcagagcctgtagaatcctgaggtgcgcaggatgcacgagtcattcaagctgccaggccagccactgacaacgtctctgaaccgcatgtcggcatcgacgatggcctgcaggaccatgctgttcctgttctcgccgtcgagccagacattgctgttaggctgagctgaagagcacatgaggatgtgcgttgtgtctatggcgccgcagcagttggggaggccctgaatcttttcaaacttagatttgacggttgccatctcctcaggagtaggccacttaagatgattggcagcgcgctcctccaaggcctcaataaacttccaagtgatgtttgagatagctgagtggttcatcccgaagcggttccctatgctcaaaagcgactcaccggtggtcaatcttaacagagcaacacctacttgatcttccacgcctagaattgccttgtctccaaacctgaaatttctgaaactttgtgtctttcttgtgaagtccccactaatcagagagcaaaggtagtcaaaggtcttcctcgacatcttgaagacggactcaaagttttggcagtctttggaaaattgtcctgtggacataagacatagtcaaagatcgcagtggcgttagtcgagcatatcataaattatttggcagggaacttgaaagcataaaagggaaaattcagatatattgaaattcaaagaattcgattcgttctcctcatattgaaattagaagggcagaggaagaaacggggtaaaccttatgatagcaaatttaacagaagagattcaaatctatagaacatggtccacaagtgtcgagaacagaaaatgaacaatactagcaatatcatgaatgaactgagcatattatatgagaaaaggtttagctgttttggcaatacagtgaatatcgattcaaaatttagaagaatcatcagtagaagggacactgcccttgttaaatagatgactagaatgctatcattcctgtatctaccttcttaaatcactcacacttgatgctcaggtttgtactaattgttcaaaatgtcactcttgtcaaaatttgaaaattctaacaatgtcacttgtcataaaggataggtaggcattcaaaaccaatgttttccagtgtttcagatcatttcagcaatcagggaagctcagaataaatatcactaacgacttcaagaattcaaaaatatattgtctatgtttttgtaagaacatgtatgatcaaaataagaatacagcagccagacaaatagctatacaaatctactttatttgttcaagctaaattgtacttgtatgggctgcttcacccaatgatctctgaaagactcacttgaacaccatacagagaggcctaatgaatctatactcctggatgatctatcacattgaattataaaacagtatttgctgtggtaccaggtactataagattcaagaaacttatcgtgggaatccatttctcggaacacatcattcaaccgacctacctttgagccacactaatcattttctggatttgccagtcaatctattggaacccaatcccctcacgtgtttcctttaaaaaaaaatattaacagccaatcggatgatgaaattggggaaactacctgtgaacagatgagctaattacttaaaaaaaacgcatatgctacactttacaattctggactgaacaggcaaagcaattcgatggcaagtacagactaattgttctccgggagatgttgttttccccttagcaaaatgaagttacttcataagttgcaaagagaaaagaagttagttcttgcaatgtcaaggcatgaacagtcaaccaacctattctgaattagattgacacaatgggcaaaagccaacagcacccgtaaatttctagccccaaaataccattgcaccaaaggcttcatagatctggattggagaaggaaacaacaaaaccacagatggcacaaccaattcttctcccaaacacggtctactcgatcgatacccatcagagcaacggcattcacaagcttttccttgctcataccctcggagcaatcgacatccatggtggtctcaatccagaacatcccccccgcccgagatggttcgctgcctcggagcaccgtacaatcccaccacctccaaaacaaagcccaccgaaacagcggatttgcaacagtaaccaccctgattaaggagcactgcacgggcggattaagcgaccgcatcgaacagataccgcgcaggcacgaacagtgcaaattcaacggcgggtctccctgatctaaccccgcggaatccgcccgcgaacaatcccaagcgcgcgagggggttaagcacgcattactcgccgccgacgagggttacggtgcgcgggcgcgaggtttacagcgagccaaggaaccagggaacgggcatggacatggttaaggacgaggagcacagtgctcgcaaacagggaagagacgaacgaacgaacggcaagacgtatacctgctgcaagcctgcgggcgaagccgtcccaccaatccccgccgggcgccggcgccggcatcgcctgccccgccgccggcaacgccttctccggctgccgcttcgccgcttggctcccctcagtggtgccatgacgagacgagacgagagcgacgcgaacgcgaaccccggaaggaggagaagagatcaagaaaagaaaaaaaaaacgagcaaaccaaccaaagcaaaactcacccccaatggcttagacttgaaaagacccagttgttttagtgcctaaacaaaagcagccgcagcagcagctgttgcccagactattctgcttccgttatttttcaggcccagaggcatgcaagaatccaacaagttttttttttttttttacaaaatgtgaactcatgtgcttgtgcaatctgcacacagcctagcctctggtttttttttttgtgtgtgaggaatgtgagatgagatgagatggcatgcagatgcaacacagggcttggagaattggaaagacttgggcaggatggatgggttaggtcaaatggaatgctctttgttatctacctatgtgttattaggtggtctcctcagggctgtagtgtaaagaaaaaaaaagaaagagaggagattcttttgtttgataagcttgcaaattagttgagaaaaattcaaggtaaaaaatacctttattgaggagtgtttgggtaacctgcccaagggatttgtataactgactgatgttttttggggatctctgttgctgttcctggtgatagaactgatgatgctctgctgtttcatgtgatctgcagggcttggacaatgcttacaaggtagctctatactgctatatatgggtttctttacacatttctcttcctttctcgttgttttcacgctcggtcagtttaatttaggccgggtttagttcccaattttttcttcaaactttcaactttttcatcccatcaaaactttcctacacacataaacttttaacttttttcttcaaactttcaattttagtcaaacttctaattttgacgtggaactaaacacaccttaaggaggggatggtaaattggatttttttttaccccctgaataagaacatcagcattttgattgatcaacagatgttttggtttagcttgcattggtttcactagatgtacaaacacaagtgatgtgaaaatgtactgaagcatatttatagtatatgttgtacttaattaattcacgccatggtgtaatgcaagtatgcaaatattaaacaccgacgtacctgatgtcttatgaactacgaaaatgaaccaacaaccttgatttggtcacgtgtagatcggctggtgtagctatctgccacgtttacataagaacccttttttttggggtaattttgcaatgaaatatgccatttggtttgttctaattatttggttaatggattcacacccaacttctggagaaaaattcaagggtaaaaaaggaaacaaaaccttgtagaaacggtcccgggaatagtacatcacctcgaaaacgttttctggtccctttcttaggccccactaatgaacatatccaaatccaccggaaatgtctcatgcttaacttttttgctaggcatgaaccctctgctaatcttgattgtgcctaactaatagcacagattgcaatatatatgatctttacacgtcatatttaagtgccatacatatcttaaaaccggctccaaaatcaacataagtaaccaaacattttaaaaagaccataaataatctaaacataataacgataccaagacacagtattttcttataaggtttatttgaaaaaggacgtgtacagtacaatacattgatagtatataatactagtataaataaggttacattaggaatctatcatcccaattgcattaattacaagactcctatctgatctagcataattacaacgtatcatgttatccacgaccatcgatcggataggacgccgaccaatcatccctcgtctatgttattatcgttatacgattacaaccgatggtgcctctctatttaagagaaactatacgagagagttcgaccctaattatatcttacatttattataactccaaattttaaaacacaattgactttgtacacattcaacacatactctaacagaagaaatcactcacatgtgtggtctgctgagctattttaaatagatttaactaattaatgatttgattatatagacaacatatacagtgatacggataatgttaaatgttcagtagaccgtatgttaatcaacgttgttgacatcatggcattgtttatgcacctttgacctttatcttccaattcctcaggaagatcggagtataagacattttagtcataaatatttattagctgtgtgcccaacaacagagaaccatttcagttatataaaaaaatgaatcatgtgcgattcttcatttcttctagtatcaatttgtaaatcaaaataatgaatcactacgaaaaacaattgttcataatttcttatgcacagtatattcacttctaattgttttaatcagggtcaagcgactcaagcctggttaacacctatgctacagtctcttgatgtcgtgtgtgtttgaaacttatttcggttctctcttatgtcatttatgactagattcagatgcagcacatcgtgtctgggcatggttcccgtatctccagcctcaccgtatgcccaggcgacaatattttttttgaaaagactacagataccaatattatttatgaatagattcacacttcgagctttaattgtcagcttgttatcaatcacaaaattttaactgaaacttagctttagccatgttttttttagacattggatggtttggaaggaaagaaatgtgcgtgtgtttcagaaccagcggcactcgacaagtttcatgtttggttcaattaaaaaagaagtggcgatttggaaggaggttggggttttcagaaatatataagagagtaatttctcggtgtattttttttttttttggaggttgctcatgtgacaactttcatttacttcgacagcttcgtattgaagtcaaaactttatatatttgtacatatttctcagtcttaagtaaatttggttggcctatcatggccggcctatcattagccatgttttagaccgctaatagtacaatccataaaatatctttaattgtcttgtttatttctatacgttcttatcagctatagctcaactgatcgaaacttatctattatgtcccgtgagagaaacgtctatgggtcttcctgctagttctacaaagtggtgggctagacgatctggattcgaagcctcaatccttctaattattgaatattagatcattccctaattaacattcacgtttttccatttcgtcccgtgtcaatcttgttctgcttgtaagactacctatattaccacttcggtcagtacgtgccaattttgattgacagatgagaatcgggatcaacgagctagccacttagccagcaggataacattggaacaagtagcaggtttcaatgttctcaaatgaaaaaagtagcaggtttcagaaagtttggcaaggtatcaacaagacaacaagttcacaataagcttcacaggggtttcaacgatttttcaagtcgaagttctacaattctacgttgcagcaaagttccagagaaaaaacattcagatccacagctgccagtctgcccagttgacgctgtgcctcgtagtgcggcttgcccaccggccaccggccacgaggcccacgccgtcgctatggggctcgatcggctaggtggcgaaccgccacggtgttgggacaccgt

SEQ ID NO: 66994 - DNA, 4025 bp, Oryza sativa
cctcccccacccccaccccaccccaggaccctaattcgttggccctctactggagtttgggttcgccggcgccagagaagaagaggtggccgccggagttagagaagaagagcacgaatcgtaaagcatatccagtgatctaaaatttgcaaaatttgagataagattttctgtcgacagagttttagcaattccaaaaaaaaatcccaaaacattagctgtggatacgtatgtctacgtgatgagagttagtggcagaaagtattgtccaacttatataattatgcagaggactattaaaaactgccgtaaatttttaaagtgatctttcaaatctgactacagtatagttataatatagttttacataactacaatatatatatatatatatataaaagtataagtattaaaaaatatatgtaactttgtagtttgtactaagttatatagatattacaatgtaattacactatacttacactgagttcgatgtaactcagtgtaagtatagtgtaattacattatggttacattgagttatattagaaagttttttgaaaaaagcttgcgacagtttttagcaattccgattatgcaacattgaataactatgatatttgattatgttgatatggtacatatgcctctaaaatatttttaattgtatcgtggctttgtttgccttacaaataaaatgcctttacaattaatatatgtggtcagttttttttttcatgtctattgcattgcaccgagtgcttagtgagtttccccgtcacactatcaaacaggaaggatgcagctttgtgtatctttgacgcggcggcacagttatctttataaatgagggcaacatatactatgcacataggccctcacgtgtacacacgtgcacaccaactaaaaaatgtcaccaaaaaatctagaaaaaatcatacacatacttttaattgtattacacctagggttaaaatcttaacatcaaattcattatattttagccgtaacaaaaaaacaaaaaatctgacagttttaaagttgcaattttgtcagaattttatcttttttgttattctctatgtagaatgaatttgaagatacgactttacacgtagatgtaatactattgaaagtacatgtatgaattttcctagaattttttgtgataatttttagttggtgtacacgatgtgtacacgcgagggcttgtgtgcataggatacgctcccataaatgagaagtgtacaatttatctatttttttaattgatatattaatggcgtgaagtattaatacatatcaattcactaaaacaatactaccacgtgaaagtatacaaattagcgaacaatttccacttccacacatggctacaaaattgaataaatggatgggttgttgcaataggcattattgcccaaaaagagcattttatctcttgtctcgcacgtgaaggtttcttttatttcttggtgggttctacgatgcgctagcaacaaaaggtataaataaaaaatagaagtctttcttgtgacataaagtcaaagggatatggatcactgacataagaaaactacacgttagagacacatgtccctctgatgtatgttagagaaacctcgtcaatcggaggatagaggcgaattgatgtatgggtgaagtggcaatgataaagaatttgggttcaaaagaaaaaaagtatttggtatatacccagttacatttatacatgtaaaactttatacatcatcttggtgttggtgctacaaccaaagaaaggtaccaatagcctgtacccccaccaaaagagtacatattggtacatcttcttaagggcatataccaacaatcccaaaccccatctttgctgtacgatggggtagataggtacacaatcagcagtagctcaatttggaaattaatgacccggaatagccacaagagagcagtagtaaccctgctgagcattgacaatgacaagagcgagccacggaatggaggaagccggatcaaacggctcagaaagatcggatggtgacaggtcagcttgccgttcccgggccgtcaaaaagggcatttgccataggaataagttcacattgggtccctctatttctcgttcagtccgattttcgtcccttaccgtaaaaccgggtacgacccgtcccccaacttacgaaaaccgggcaaacaaagtctcttggcggttttaaaggcggttttggctgatgtggcgcctatgtggcttagtttgactaggtctctatccgacgtggcaatgacgtgacgcttacgtggcaatttaacccaaaaaataaataaaccttgtgggacccacatgtcagtttcacacagaaattataaaaaaaaggtggggcccacgtgggccccacatgtcagtttcacaccgtctttagggacatctagtgggccccatgctggccttcacggacaggcagctcaagtcccttggcggttttgaatgcggttttggctgatgtaacgcctacgtggcttagtttgactaggtctctgtccaacgtggcgctaacgtggcaattcaacctgaaaaataaataaaccttatgggacccacatgtcagtttcacacagaaattataaaaaaggtagggcccacgtgggccccacatgtcagtttcacaccgtctttagggacatctggtgggccccacgttggccttcacggacaggcagctcctcgtcgtccaggacatcgcggcggtgctcttcccggccaccgagtgcgtcctcggcagggacgacgacctcgtcctcctcgtcgagtctttgcccgccaagctcacggcgcgatcgacggcctcgaggccttcgccgcaggcgccgtggggcacccgctggggcacggcggtggtggcggccgagcacgggggagctccccatcccatccactgtcttccgcttcggcctagctcgccctccgctgctctgcccgcggccgtgctcgctcgccgcccctccgccgccgcgctcgccctccgctgctttgcccactgctgcactcacccgccgccgctcctccgccgcgcttgcatattttttgttagtggctggttgcaggaagcaggtaaattaggtagctaacaacgttaatgtgctaagcaagctaatgaattaaatatgactcatgcatgagtcatgcacgtaatggcatatatacatttgagtgtgctcagccatagacacatgtttggctaatatatatgtctgcatgttgttggcggcaaaccaacaagaagctagctagaggctatagctggtcatctccatgcatgcatatatatgctcgtacgaagacacatatgcatgcggccgtctgtacccggcgtatatgcgtatgaggctatgagctactcctatgggctcggaaggaactcgagaacttggaggttgtcacggcggacgacggcggcagtggcgatggcaacaccgttaccgtgcatggcgacaaggctcccgttgatggcaaaggagaggcagcgactccggcgaaacgcgccgacgtatcaggtggccaagaatgcggcgtggtccgcgtggaggatgtacagcgggtggagacgccagctgcagagatcacgaatgccatgaaggacacggagatcgtgaagaataaggaccaggagagaggaggcagcgagagggaagaagaggagactgttgccatggccggcacggggagcagggaggaagcatctcttcgatacagcatggaaataggggaacctccttaccggcgggagcggcgggacggcgggtgcgcttgcactaactcgtggccgcggcgggtcaggaaggcaggcgacgctgccggtcgctgggctgcggcggcggatggagtcgcgtcgtcggtaaccgctggcgggcgcgggcggcgaagggcgatggaggaaaaggggagagaatgacaggtggggcccacgtgggccccatcttttttataaatcttatgtgaaactgacaagtggggcccatgtgggccc

SEQ ID NO: 66995 - DNA, 7279 bp, Oryza sativa
tggggctgggtgtgcgtgggtcggagagctcgaggattccgccgccggccgattccgacgttgttgtgctcgccgactccgaccgcccggcgcgcgcgcttctccggtcacccaccgcctacgccgcgctgtccgcggcgctccggtcggggggcagcgccgaccatgcccgccgccgctgccggagctcgcctgctccgccgcttacccgcgtcgtccgttgcgatagagaggggaaggagaagaagaagaagagagaagggagagggaagaagtgaggagtgaggctgacatgtggggcccatttaattttttttgtgtgcagttgatatgtggggccaagctttttattatttttctgagatataattaccacgtaagcgccacgtcaataccacgtgagacggatacctagtcaaacaagccatgtaggcaccacgtcagccaaaaccgccttcaaaaccgccgagggatctcgtttgcctgattttcgtaagttaggggacgggtcgtacctggttttgcggtcaagcgacgaaaatcggactgggcgacaaatagagagacccaaagtgaacttattccaagaaatgacgtgtggcccgaagagagagagagagagagatatagtacagcccattatagcattgccgatgtgcgttcttccactaggcctgacgcttccaatccaacctcgtcccttctcgtcagcccatcaatccaccgaccttgatgaatttttcgtctcgtttcttcttttttctcttttttattctctattggagtagagcatgtctctttttaaaaaaaactgagtagagcatgtcatgttcatcgctcaatttccacgttcctcttgcgagggttttgaattccatgtcaacatacgttcacgcggttgttcaagctgcacgtgtgagccgcgcgaaggttgaccgcagtactgtcgagaattggcttctgcccttatctcaaagctcacataaaaaaaacagggatttcgagttctggatgtagacttgaacaaatgaaaagtaacatgatgttgttttcaagccaggcaaactatcgctggatttcaatgaaaaacaaatcatggctggagtaagtaagatttgctgttgcatatacgcgccgccgtctgtctgcctccagtctccactgcatcttccagtgtccagtcttctctctagtctgtctgttttttcaaccacggccggtctacaaaaggtacaaatcaaatccaccgttcttgttggaattgcttaaggccaaatccattcgcaagtcaagcattcagatttcactataggcatccaataaaaaaaaaagagcatatgggagtatatttgttagcattcccttcttttgatcgtttcccctcttctctcgtacagtacctacctacttctttggatttgactgtacttactgcagagttggtaccaactgccctatcaaccacactaccacagttgctaagcatccagaaattcagaatacgagtattaggcgatcccaaaccctccctatcatctccctatcatctactgtccatgtggcaaaagaattaataaggagagagataaaaaaataaagaaactatttcttatacaagaaactatctctacacagtaaccaagaatgaaaacaagaggatatgtgcagccccatcgtttggctatttggtggaataagccaaacatcatatttacaaataaaaaataatctgtgaataaaacttttatatacatgttctaagcgatttaaaagcaaaggctgaaaaataaactatgatggaaaaactccaaaatcaactccaaatttaaggttgaaaattcaaattttggctgataagcataatcataagcgaaaagatgaggccggtggataaaaggagagagaagagagataattagataataatttaatctgaagacatcattcattggatatatagtttctatgcataagttgtgtttagttcacaccaaaattccaagtttgtttgaaattggaacaatgtgatggaaaagttggaagtttgtgtataagaaagttttgatgtgatagaaaggttggaagtttgaagaattattttggaactaaacacggcgatagtgcttatatgatatggcaagtatgaaaactacttgccctaggggtgcgtttagttccacgccaaaattgaaagtttgactaaattgaaagtttgaagaaaaaagttagaagtttatgtgtgtaggaaagttttgatgtgatggaaaagtttaaaatttgaagaaaaagttggaaactaaggctgtgtttagttccttccaaagttggaagtttggattgaaattggtacgatgtgactgaaaaattgtgtgtgtatgaccaattgagatcccctgcagtactgcagcagtactgcaggctgacatgtgggcccgagggctgtggggcccacatgtcagcttgcagtactgcacatgcagtactgcatgtgcagtactgcagacgacctgtgtccgtgtaagacaggttgaggtgatggaaaaaattggaagtttggatctaaacacagcctaaagcactactccctccgtcccaaaaaaaaaggtaaaccctgagtttccatgtccaactttgactgtatgtcttatatgaaattttttttataattcgtattttcattgttgttagatgataaaacatgattaatattttatgcatgacttgtctttttaattttttttcataatttttttaaataagacggacggttaaacgttgggcacggaaaccatctaggttggggatgacattagtagtagtatctcacatcagcatgactgacatccacatcagtttctggataaagctccaagttgacttctaccagtggattgtatatactcccactctacccgtaactaccttgccgacttgcagtagcacgcgtccggtacgcgagaagcgcactccatcaaatagcttccggatgtactggcagtattctgctttcgcctttcggcacaagaaatacacgtatgcggaaaaagaaaatcaactgaaacaacaggaggaacaattaaatttcaattcgttccggaattttatatgcctcgccacacgtacaggcgaagtggtcgttgtcccacacgcctcacgccccgtgcgtggcgccgcacgcgtcacgtccgccgccgcgcgggttcgccggttcgcatgctcctctcgccgacgtggtctacacggccgccgcgcgctacactatcctttcttccagtagatttattcccacgatcaaacgcgcgaatatttatcagtacacgatacactagcttagctcgatcgggtgtccatgacgacttgttgcaccgtccactgacgtgacggaatggccagtgcgtgcactttcgattcgtcaagatatgtacgtacagttaccagatagatggtcaatgtacgcacacgattaagcgagatggacagccaagtgggatgactggacggatactcatcaactcgtgacgaatatccgtatcctgcccgtgagcacacggagagtagtgtagtgttcctttttcgctcgcacacaactgccaggtgacgtcgcggcaaacgtttccgtttcccacttgctgatatattctcctgcactctgttggagccagtcgaaaacggaagctccaggagaagattttttttaaaaaaaaattgaaacggcggctgcagaagcgagttcctgaagttgacgaggcttgtgaatgatcggcttctggaaagcgcgcaaaagcaagcaaacttttagcccaaccgataaaccatgtgtgcgcgaccgagcgcttcgttgcgttccgacccgagtcggggcacgccacgggtgcacatacgtgatgcacacgtacgcgagcagcgcgaccgcgtcacgtttcttcgtggccaagcctggcgcgctagctacctcctaccgctacctcgctcgctcatgcggcttgcttgcttggctctagttagtagtttggcgcccgcgcgcaccaaccttgacgtgaacgactctatcacacctcattagcgcatattaaccgcgtactctctatatataaaacgagtacgtccgccaacgtgaagggaatttttagctcgtcattaagagcgaaagaaagttacttggaattctttggtttgttgtaatgacaatcacgagagaagaagcggagagcaaggagatggagagcctacgggtgcacgccagcgcgctgctctcgctgtcgtcgcctgcagcgtcggcgtcgcagccgacgtcgtcgtcgtcgacgacggagggggtgttcgagtgcaagacgtgcagcaagcggttcccgtcgttccaggcgctgggcgggcaccggacgagccacacgcggctgcaggcgaagctgctgagcgaccccgccgcggcggcggcggcggcggccgagagggacagggcacgcgtccacgagtgcgccgtgtgcggggtcgagttctccatggggcaggcgctcggcggccacatgcgccggcacaggggcgagacgggcacgacgaccgtcgtgctcgcggacgccgacgactcgggcggcgccaccgtgccgcagccgccggagcccatgccggacctgaactacccgccgctggaggacgccggcgacggctcggagcctgagttacttaaccttcttgtataagttgcatcgatagatatacatgtgaattgaattggcgtctgtacatagatatggtggatggattctttaccaaatttgatcgaaaaaaagaactaaattttggagcgtgatgatcatagcatgtaagttgtaacaaatgattgttaactgtaagataggaattctattcatttgttctcttctgtacaaaattacaaataggttgattaattagttggtcggttgtggttgattctttgtaaaataccaatttactagtataaatatactgacagcttattgtttcaattgttttgcatccttgaaaaatccttgtttccatgatcgtaataggaagtgttctttcccaacccgcaagaaagtaagaaacggtcgatcagagaggaaaaagtgcgaaaacgctaatccatggttccattccatggaggaggtcaacatttccaggcgtatctggacctcctagaagtccaatcgtattagtctgggctgtgaaccgatctattacaaaccgtgtgggctgtgagcccaagtcaccaactcatattttgtcacttgggctagactatgtaacactgacgcgagcccaatacactagaagtccaagatttgatcagtgcttgtattcctaatagattacttgcacactctccagaaatagttctttagtacataaatgatgcattcattctccagaaaatgatataacccaagacaccagacagtggtcagaggctagtcactagaggcatatacagaacataattaatggctaacatataggagtatcaatttcggaattatcatcccgtacaataggtagtatgagatcaccacaccggcgcaagcctgaacccaagcccaaactcctcatcccccgtgccttttgctcccgtactgcccgttcccgccggagatgaggtaggcgccgccgtccttcttgcccctgggcctccgcgggatgcatctgtcgtgcatgtccacggcctccgtcgacggctccaccttctgcaccctgccatgccgcgaggcagagatagcataccatcatatcaccaactcatcatcatcatattctcatcgtactccatgacgccacacagaggcaggctagcctggctagtagtattgggttctttttaagcaacggcgagcgccgtgcagcagcagatatgatgataactacgttatcaggttctgggttagggctctggaccacgcttaaagcagagttcaatgacttcaaattgctgacaaaggctggtgctactgctgctaggagctcgcgtcatattcattagttactccgatccctcacctcgtcacacacgtgattgagtgcggcttatcattgacgcgatatggctctcaacgagctaatcaaggcttttcgatgaaggctcgcatggattaattagggcgggacgagaattcaagccccgtccctgacattccccattcatcccgtcggctctgtgcgagacagctccgcgagacctacttccatttatgaacgcaaccactaatcaggtacactactcctcatatcttgcatgtacagcaatggcatttgcagaggagttcagtgccgcactagcaattcttaactgccgccacggcagtatggttcaatgcaacagtaccagttcatgtgttattccttacaactacgactctacgagagatttagaggcaaccattcaaccaaccaaatggagttctaaactgctacggcatggtaactaactggtcgtaccgatttggatactggcgttgaacattgatttgcattgatgttttgcgactaattaaccagctatggatggattggtgtacctgtcggcgttgtaagaggatgaccgccggagaacggcaatgtcttgggacgtgtcggccggcgacgagcgcttcgtctcgacgaggctaccgctgaagtactccttgtcctcgacgatcttttggcggtagttcgggatctcggtggtggtcgacgcgagtgtaggtgggcgcggtggccgtggacggtagtgcgcggcggtgcgagccatcaccggcgaggcgagcgtgctcttgacggagacggacccgcacgagatgagctgcatgagcacggacgacgccctggtcctcccgccgccggtgacggccgccatgacgcgtccgtccgccttgatcagcgcctcgagcgtctcggggctcgtcgacgccgtcggcggcgacgtctcctctctgctcagctcctcctgcgccgccgcggccgcggcgcgctgggcgtgtctaccgcggctgctgcggtaaccgtcctcggtctgcgtcgcggcgtccgcggccgccgcggcggggtcctcggccttgtacaccctgtactcacaaagctccgacgtgtttattcccgcgcccttcttttggcgcgcctcgccggtgccgttctcccacccgggcggcgaggacgtggccgtctcctgcgagcccgaggagcaggacgacgcggcggccgcgtcgagcagcgggagctggatcgggtgcagccgctccgtgcccttgagcacgtactctcgcccagccaccgggtagatgtagtcgtc

SEQ ID NO: 66996 - DNA, 10040 bp, Oryza sativa
caacaagaacaagttcgtgaaaaaaactaaccttttggacgcccacgagtacatgcgcgccatccccttgcctctgagcgcgtcgagccggtcgatcacatctacgcacagcaacgacgacgacgacgtcacggaacggcggcgaatgcagcaacaaaaacaaaagaaaaaccgaaacgcgcgacgacgagacgatcaagctgagcacacgcacgtacctcggaggtagagcccgtcaggtgaggcgacggcaacctccatgaaatgcgggtgctcgaggtgcccgttcctcgagaggtagtacacgacggcggccctcgccggccccggccttggccttggcggccgcgacggcgccatgtcggggcacctcgcctcctgctgcgcctctcgccacggcagccgctgctgctcccctttccccctgctgccagccaccaccactgccatcctcgtcaacctaacctacccttgctggctgctgctgctgcccccagcaataatccctgagctatatgcagcgagctgcaatgcaaggctgcaggcgtcgtcgtcaccgctcagcagctagcgcttaaagggcgcgagtgcgacacaggggaaggtgcaaaggagggcgcagcggaggcagtgatgagtggcattcaaacgatgccaggaccagctcagctgtgagagagctggggcagagtgtgggttgatggaggcgagagcagcgatatcagaggatttgtagtaatagaaaagcttcactagctctctggttagttgctttctcctttaggttcttgaagtcaacacactgctgcattgtgtatcactactgatgtatggtagactgtcctattgttaagtactggtacctagagcttaattaccggtgatgttgactagtagtagtactaattaaggtgtttgcagtgtgggggtgagaccagtggattaagggtgggtaattattgtgggggactctagagggtggtgaaatggcagctggttcggcgctgccaaagcagttcttttaagcgaaaacgtttgactaacgaggcccacacgtatggggcgcggcgacgctgaccaagactagtcgctgggcccgtatgtcagtgagccaatcgaggacttctccctctctcttaagactcttgctaacgctctgtgagtccaactcccagtgcactgtaagtcctggatggtttgttaatctgattgctgtctcttaatgcctgatgtgtccgtagacaaataagccgtgcatgtgaagccttggagcacgggttgggtttccccgctgatgctgcgagtattaatatttggaagcatttgcgtgcatgggaaggctgcaatccctgtcctgtccatttgggcctccttccaagtcccaattaaactccctgcccctcccctgccctggtgctttgctttgccatggcacagagatcagcgacgcgacaagtgatactaatcccagccacgtgacagggaccatcctgctgattaacacacagcagcggcaaacacccggcgttaacctaacacgggccattaagcagcgtgacccaccaccgcgaggccccacgcgtcggcgagacggctgcctgccgctatcgcacgcgaaagcagaggcgagagaggtgtttcgcttcgtcagggttttgcagcggaggaggacaaggggggaaggctccaccgactacgagatggcaaaatggagggggtgtgtagcctatggcgcggacagcgagacagcacggcgtacgcgcgcgaaaccggagaggagagaggaggctgcgtttgcctcacggagatgggggcggtgcggtgcggtgggtgcccgccaccgccagcgccacacctcgccgcgagcatcgagatccgcgccggccggcgtctcagctcgcgctgccggttttcttttcactcacatgccgcgctcctgcgtctcgatcccggccgcagccttcgcgctttgttctttaccgcgccccggtaattgaagcctgctgattactggggtctactactcgtctagtactcctgattaccggaccagtaattcagtacggattctactgattcgtctgaggccatgcgtgcctactgtcaggtatgcaatcgatccggtcacgcagccgaggtgtgtcggaattcggaagcgagacgcgcgcagcgagcgacaccgtacgcacaggttctccttttaatatttgcgtaggtcgacgtctgtccgtatcggttcgtcgcacatgtccccgaacgtattaggtcgggtcggtcagtggctcagtgcgtaggtgaaacggaggctggaagcttgtgcgggttgtgggcttgtggctgcctgcacggcactgcggattgaatcgggaccagtgcgcgcgttgaaaacatgagacgtctaggtcacgaggccaagaggcgccccagcacgacaaatcatcagcgattcgtgaacagcaaacaaacgtaacaccttaacacgtcatgcagtttgccgacgaatttgagcatgcatacgcatacgcttcactgctggtccatagcatagagatcattctttctcctgtgctggtcaggcacagctgtaataacggatgatagttccagcgcaagaaagatactaatgccgcgggcgataggagtacgtacggtgctacatacgggtgtagaactagcgtgtttctcgtgtcgagctcaccaaaacgacctttttgtgcttgtcctgcctgcttcgctgacctgtatagcttgacctttagaatctctcgtgtttgcttcgcttggcccacaagctcacgggcctacgaaggaggggggatttagtgaggcccactgggccgaaaaggccgtcggcgcgggagcacaaacctagcggagtggacaggtccgaaccgagttccacctcccaaacccctcaaccctcgccgccgccgccgccgccgccgctcgtcgctctgctccgccgcagccatggggaagttccgcaagctcggccgccacgccgcccaccgagtatccatgctcaggtaccatttggcctcgatccttctctctcgagcgcgagatccgcatctctctgtgtgtgtcggagtcatggacatgtctgttcggcaggacgatggtgtcgcagctcgtgaagcacgagcgaatcgagaccaccgtcgccaaggtacgtactctctcctttccgcctaggatctggtcgaacaccttgtagagtgggggcgcctcggatttatgtgctgggagtcgtggttgattccaggcgaaggaggtgcggcgcaaggcggatcagatggtgcagctcgggaaagaggtaaaaactgctacctgtgaaacattctcctgttgccatagaactataacctgaaaaaaattactgtttagtgccatccatgaacctatgtagagctttggattgccgcatttttttttgcacaaccgcgcacacagttctgtagtacgagtaactagtaagcatggatgagtacttgattagttccatgagcgtgacattttgtttactgttaaatttcgtacaagagatgaattgactattgagggatgtagggatgtgtcttcacaagaatggcagtatggaaacaatttactctctccatcttgaaatataagcatttctgattttgtcctaactcaaactatcctaagtttgaccttatagaaagaaagcaacaatatccacgatatcaaatgagtatcattagatccattatgaaatatattttcatactttacctattagacatggtagtagatgttaatattcttctctatacacttgatcaagaacaaaattagaaatgcttatattttgggacggtgtgagtaatgttttacatcgtggttttaatcagattcaaatgagttttctacttttgtattttattttctctcttcgttatgagatggttgaaatgttcaggtcatatagctaatcaatgattggttgtctgataaattgtctcaagtttctgttacatactaggcgatccatctgaatgatgtcttcttgttttggagtcgatgctacataagccttcctgtgattgtgccattctgcatgttaccttaaacgtcttttgatctggctggaatgttgcattgatttatttaagtctattcttaaaggtattcgtccagaaacttatcttttatttgcataaattatagggcacattggatgcagcaagacgtgcttctgcttttgttcggggagatgatgttgttcataagctatttacagagctagcctaccgttacaagtaaaactccttcatgtgttgtgtatcaatttgatttgtttctaccactgtttaaaaatatgtcatgttagcatctcacataaggaataaagtaaaatgcctaccatggtctttgtacaatgcatctaaaaggtgtaggattttatgcatcacaaaattgtaatactagaacgctatgtactggtagcatagggtcataatatttttaggtcgatcctaatgattcttttgtcccttttgaatttaggaaccgagctggtgggtacaccagactattgcgaactaggatacgagttggtgatgctgcaccgatggcatacattgagtaagcttctcttatgatttttaaaatggaaaattgatcagtgacctttccattgggttattagtcagttttttttttgcggggaattagtcagttttgttattcgcttacttttactttgtgtttgctattaaaaaattactaccatgccaccgacttgtttttgcccctgcttcacgtggaacaatcaactggttgagtataaaattcagcatcatgcagtgttttttaaatgaaagaagctagcgtgctaaaagcatcttcaaaccatgcaaagttttttttttctaaaatgctgagttttagctggctgtgccagaaatatatcatcatatcaaattcccagaaatcataacttgctgttttgcagcccaagtcactcgctgtcttcatctgcaggttcgttgatagggaaaatgaacttcgagaagccaaacctgcaacaccacagccacctcaacggtctcctcttgatccctgggccaagtctcgtgctagccaacagtgggcgggacctaaaatcagcgagggctctagaaaagaaggcttatgaaaataatattcatgtgttgagttccttgagactgtattcaattttctgtactaggctatgaggcaccagcttgtcattttggaggagttttgtcacgagatatattgtcaatagaataatttgaacttggctgcttacttttaacaaagcctgatgccctcatgagatgtgtatcatgtatgactgcaaatcattcattgagatatgaaatgcagaattatccatacctgtattattcccggaagaatatcggtggagtactggatttcctatagctgatgtatatgagtcccccttgccaattcgtgattgggttagatgctattcgttctggctattgtgtgtacactgtatacatgtttcttttctgtagactgtagctactgacttcctacatgtccggatcctctgacgtactttattctacgtcagagggacgttcgaccatggatcgccgttccttgcgcatccgacggcaacaaccgttttagtctcgtcacttgtctcaggccccacagcgcaatgtctctgcctgctctccggcccattcattgatagggacagcggtgccgcgccggccgccggagagctcaggccgccgcacactgccgccagcggggaggtcggactaggacgcggtgctagcgccgtccgtcggcgaggtcgagggcgacggctacgcccgccttggtgtttgctgtttgtcccatcgcacagagactgctgttctcggaaccgtcgccggcgaagttggattggaatcgatctgtagccgatcgaacttccatcatcaagttgccttttctcatggaagaggcagctggttgaaaatcttgctaaggcattcgtgctgtcattaacttgtcccagaaactaagaaactacaagtaacctgaagaataaaattcagagctaaccagaagaaaagaaaccaaaactttgccaacagattcacagtagaatgcgacatagcaagtctacaattgcaataagaaaataccaaagaagatggtttttttccttgaagaagagatcaatcgagtgcagatgttaaccaagtaaagaaatctcatggcatgaaatgaagagaagatgagtaacttttctgttctatttgttccccgtatagctctccgacgacggttccgacaacagcagccgctgggcggagccatcgccctcgacctcgccggcggacagcggtagcgccgcgttccagtccaacctccccgccggcttcagcgcgcggcggcctgagctccccggcggctggcgcggtgccgctgcccctattaacgaatgggccagagagcaggcagggacatcgcgcttgcggggcctgagacaagagacgggactgaaacggttgttgccgtcggatacgcaagcaacgacgatctatagtcgaacgtccctctgacatagaatagattacgttagaggatccggttcaatgttcaggagatgttgtcattttcggaagtcacaagcaacacaaccaaaaaacgcaaaagtatgtacggagtagatgctagcagcagtggggagatcattctcaagcaagaattccaaaatatagcgactctggatcagatttagtgcatcttccataaaggattatgatgtgtctcatctaattcttagttattatattttgtgacgtggtaatatttattatgttttgaataaatacaaaattcttcaagataggagcaaaccctgtaacctgctagtagtctgcagcaccaacgttctcttcggccgattcggcgattgcatcagactgaccaacaagatacagaaatcctcatccaccacatccaaagcggcaaagctcgtccgctccaaaaggcccgactttcctgcgatcagatgcagcaccttgggggttccctgaggaccctgacctagcccacggcacagctggtggtgccgttcacacggttccctggatccgcccacaatctgctcgacgaaatgccgcaccgggacgtcgtctcggccacggcggccattggcgcgctcacccgcagcggccggcaccgggacgcggtcgccctcttctccggcattcttggggacggcatcgtgcccaacgagttcaccttcggcaccatcctgcagtcggcgagcgcgctgcgcgaccttcgcgtcggtgcgcagctccacgcctgcgtcgccaagcttggcctctgttccaacgtcttcgtcggcagcgctctcgtcgaccactacgccaagatgggctccgtgagggaagcccagggcgcgctgcaggacacccgcgagccgaacgtcgtctcttacaccgcgctcattgcggggtttctgaagaatgggatgtctggggatgcagcccggctgttccggtgcatgccggagaggaatgtgatttcttggaacgccatgatcggcggatccagcaaggcaggactcaacgaggaggcagtcaatctgttcctggagatgtgtcgggaaggcgtcaggccgaacgagagcacgtttccctgcttgctcacatccgttgccaatgcaggggcgctcggcgttggcagaagcatccatgcttctgctatcaagttcttgggtaagcttgatgtttttgcgggcaattctcttgtcagcttctatgctagatgtggcagtttggatgacagcgtcctggcgttcaaaaagatcaagaacaagaacgtggtgtcctggaacgcgttgatctgcggatatgcgcaaaatgggaggggggaggaggctttggatgccttcaggaggatgaaagctacaggcttgaagctggatcgtgttactcttcttggcttgctgtttggttgcaaccatgctggtctggttgatgaaggttactcattgttcaggactgccgagatggagcagccgggtgtattgagacctgagcactatgcttgtgtggttgatctcttctccagggctaagcgatttgatgatgccaagcggtttcttgagaaccttcccttcgagccaggcattggattctggaagtcgttgataggagggtgccagattcactggaatagggagctggctaagagtgtcgcgaagcatattcatgcactggatcctaaggatacttcttcatacatccttctatctaatgtttactctgcagcaggaagctggcaggatgtgtcaatgatcagaagggaaattaaagaaaagggactgaagaggatcactggttgcagttggattgaggtccagaaccaggttcatgtcttcttcaatggagaccgcagacatccaaagagtgatgatatttacatgatgcttgaatcttgtctgaatagcgaggaagatgaggactgccttgtatgattatcagacaccataaaaaagacagctcgaggaatggcattccaatgaaagctttttcggatcttgagataaatataaagttctgggcacatgtacagcaagcttgtctttgcatatcaagtatttgcttaaagattaaactatgagccctaacagcattagcaagaaatactgaaagtctgaaacagacctcataagatttaagcatggtacctggtaacctggagatgaacagaaatgaccacatgcaactctcaactctggatctgttgtggtgctgaccattttctttattttttgcctcacatgattggcttcttgcacaaagggaaaattgatcatatgctacaaatactgtcaaaattgaattgttagcgatagaactttcctgttcaaatttttttttgaatggaaccagcacgtgagtgtgcttttttttttcctgttcaaattgaaattcctttggatgagaaaacatattcaatcataccgagtgcagaattgcagataggagtctaggaccatcaagctccagcctcaaatggtttaatagtagacactacacaaaggatagattgtgtagtgtgtacaaaatcaccataatactggtgtcttttgatttaattttttcgggcgaaattctctcatttttggaaagaaataaacttgtttaaatcgcaaatcaaacgttagcgctgaaaacatcagtgaaaggaaactgatctggccacatcaacacttgcaaaaccatgacatgagatgagaccaaggatacacttctaaaggcctgtagagtacttaacatgtgttcaaaacattctatattattctgtaatctaatttccataaattcggtattattcactctgatacatcacaaactttttccactgatacaaattacaaaatcctccgtaggtagcctctgcggtcactcatttgacatttcctgcagcccgttcaaagcacaaaccacaaattcacaggaattcaagcaccaagagaaacacattgaaagttgtgataagatcagcgattcatttatagcgaatttcaccgatactacattgttccatgtgggaaatctaagagcgctctaaataaacatcagaacagataaacatccaacgaacatgaacagatcacgcgtcttaagacgacgtgaacttggtgacggccttggtgccctcagagacggcgtgcttggcgagctcgccggggaggacgaggcgcaccgaggtctggatctcgcgggaggtgatggtcggcttcttgttgtagcgggcgagacgggcggcctcctgggcgagcttctcgaagatatcgttgatgaacgagttcatgatcgacatggccttggacgatatcccgatatcgggatgcacctgcttgaggaccttgaaaatgtagatcttataagtttcgacgctcttcttggccttcttcttccccttcttctcgccgccgccctccttggcgcccggcacccgcttctcggccttgggcttcttctccgccttctcctccaccg

SEQ ID NO: 66997 - DNA, 2293 bp, Oryza sativa
ggtggtggggctcgcggccgttggattcgttgtacggctggatcttgacgcgccccggcgtggggatccgtgatgtggcggctccgtgggtggggttaggcggtaagctggagtttgggaagcgaaatgcaagcgggaaacccgtgttttggccaaagggaggaggcgattcgagttggaatttttcaggggattttggcgggccgcgcacggcccacgacgagcattgggccataggcggggggagaccaaccgccgctgggaagatggtcgatccgccggccgccggccgccggccatccctggccgctcgcttctccgccggcttacttgccggccggtacgatccatccctactttctccgtatccactctacatctctacagccagggccacgcccatcgctggatctccttctgcgaagatctggtttagatctaccggtggcctgacctagatttgttgaatcgatctaacacccccctgatctgatggtaaagcttttgtcggttgtctggataatcgtttagatgctgtcaacacgctatttgtagggttcgtggcatagttgttgatttgagtgagtttcggtcatttgggtgctatggaatcgtgctggtattacttagaacggagcgctgagtttgatctgacacgaaaattaacctaggcccggttggacctggtaattgcaggtttgcagcgcacatgagcatgagattaaggctcatggcatatggctgtatcacaaattcacaaatatttgctttgctttttcacaacaatgagttgctgctgcatgcattttagttctcccagcaaaccaaaacagtactatctcatcagctgctatgctttgctagccgttagcatggaatgattgtagtgacaaaactttttttttgggggcatatatgttccttatttcagttattgagtttggttaccttgccgatttcacttactacttgtttgtcatgtaccatcaacatacctttactggatacagaaatatttgtttgtgtatagtgctggtgagacttactccctccgttccataaaaaaccaacctagtactggatgtgacacatcctattacaacgaatctggacatacatctgtccagatttgttatactagaatatgtcacatccagtcctagattcactttttttgggacggagggagtatcttttaggaattgagagaaattcacctacagtttaacatgttgcacagttgtgcatccttgtcatcctgtgctgtttaatgtttatttatgttgtttgacagttatttttctttcagtttcgacagtctactgttgatgtttgttacctgtatatatataactatgtaactatctcccaaatcttaataaaattggatggcccttccttcggccaccctggcaaaataatgtttatctagtctgtaattttaaaacgtctgtaagttgaagagtatgcatttccttttgtttcctccctatagaaacagttcaatgcataccctttatccatagttattacattttgcttcagttcttggatgttactaatgctagctagaacttatttgcattggccttgttagttgtttcctctgcctcttgaaagctaggacatggatgcagatggcttttatgtatcaaaatttaattgtgtatgcaagccaacaacgatcatatagcgaagtggatatcgcgttagattccgaatctaaaagtcgtgggttcgaatcccactatgatcgatttcccttggcttttatttttccttcttgtttctggtgttctgttttcagctgacagggacatattggcatcatccacaagggcacgaggtattcagagttcacttttgaatatggttggtcccagaactttgctgcctttggagaggattggcacggagtgcagagttctgctcatttctaactcttgggagtcttaccatccggttttaccagctgcaaccctgcaaatacatacaagcttgcatgcttggaacttcatggcttatcgatttgccttctgtaatctgctggtagcaattgtgatctttctttttaccggaaatgggaccatccaagcaaggtttgctcgacgatggtccatcagcattatccaaaacatgaggctgtggcgtggtgtggttgctagtttcagaaaatctttttacgttctacctgtgagaccatagtagattcaatccagagttattgtgttcgtatgcgttgcgtggagaaaacatccgatatatatatttgtctgtggtagcttgattttgg

SEQ ID NO: 66998 - DNA, 1776 bp, Oryza sativa
aagtgaattgctagtgtcaactgacatttggaaatcgacagccaaatcatgcacatgtgacgtggtatggttaactttccccagtactgccggtttcttcagagcatttcttgtgatttccttacaaggcgcctaacctttttcttgaagtcatccctcttctctctccattccttctgcgcaagaacagtaggcagaagttcagaacaaaggtccaccaaacagcaggcaaaatacactacgcattgtcctgactacaattttctgtgtgtttaaaaagtcattcaaatgtctggtgtgtaaattcacagatgtttcaaggactatagcagtacctgagaaaattctcagggctgcaactaaccaaataaataggtgaatatctaagatgaaaggtacatgcagaatccagtatgcaaatgttgataataaagttaaatggtttttggactggaagttagattattttgtaggatctgccaactctgtgttttccctattgacaagtacttcaactcttcccccatccctccgtgacagataaaatgccatatacaccaaggcccaggaggaacagagttctcaatttccatagcaaatgttaagtgaacttacagctgcttcaatatttgctggtgattcatcatttggaccagaaagcatcgaaatgatgctcagaactatgctctcaacctgtaaatggaaaacactcattaaaattacaagaatcaggaatatgatgattagacagtaaaaaatggctacttacaaaaagctagagaagataaacatatgatcatgacaagatcagtgacaaaacaaacaagtaactttgcagcattgttcaaaatatgactattattcaaatgcaagattcaaatgctacaattacttttgacttttcagtataccagaagctgagtttgatatgtcaacgatggaatttgtagtgatgtttcaagctatcatactataaattaccgaaggttacaccaactctacatataaggcttcttatactttgaagtttgaaaggatttactatctgaactagataatatcagatgcacaaagattcttatgcaagtttaataacttgctagtccaaagaaaataacgcattgcactttacagtaacaatattagagataaaaggattacaaaaacgaaactctaggtggaaggcaaaaaagttatcatgaatatccaaaatgcaaaacaaagccatcatcattgttcacaattttaggaaatatttgcagtgtggtgttatgcccgtgtattgcattgcagatgcttaacaaactcccaaatttgcatcacaagctctttcctttgtcaaagcttattgattatttatgtaagaaaattcagcagacaataccctccaggcctccacgcagaatatatgtcaagttgtcaacaaaatggaactagtgcagaacagaatgaaaagggaagaaattgcttgcatcatagacaccataattcgtaccgtatgcactggtgtccaacgctcactcgcaagctcataaccattgggatcatcaccaggcggatgaagaatagaaatgcatacacgtccatccggataaactggcaattgaccaatattatgctgtgttaaaattatggatcatggagttacagaaacatgaagttacaatgaggaaagctgaccatttggatgccacatttctgaggtaaatctgacagttggaggactgttaggataattctgtggaaagctcattattgcattaaagtcacctccat

SEQ ID NO: 66999 - DNA, 1937 bp, Oryza sativa
tgctgccaatgtacttctctacggccagtccactatcctctctttattaacattgggattttaaaaatcgaacataattatctagaaagtcccgtcaaacgctaccattgtactcctctacggcccgtccactgcctcatctctttattaatattgggattttaaaattcgaacataattatctaagaagtcccgccaaacctttagcggctttgccaatgtactcctctacggctcgtccactgcttcccctctttgttattattgatattttaaaatttaaacatgattatcattggagtttatttgttaatttctagaaatcctgccaaaccatcaacggctttgccactgtactcttctatggctcgcccgctgcctcccctcaaacgttgtgacagtgctacttaacaacatgtctgtgttcctcctcttaatcttaattgggattctatttggagttctgtttataatttttagatgtaccatcaaccgtcatctactactttacaggcatgttgtttctcctttttattatcatttgtcatcattgtattctagatggacttttttttttgaaaattctatattctttattctggcattttatttataaattgtattcctgcatgaactcttctataatttttagaagtcctgttaaacaccgccactgtactcctttatggggtgcccactgcctcttctctttattttcattgggattttaaaaaaacaaacataattatcgtgttagttcagcttttactttctagaagttccgccaatccgttaatggctttgccaatgtactcatctacagctcgcctgttgcctcccctctttattgtttttgatattttaaaaattgtacatgattatcattgggtttattttttgtttctttctagaagtccagccaaccgctataaccataccgcataacgatctatccatcgttccccctcttaatcctcattgggattctatttgggttttttttcaaatttgtagatgtcccatcaaccgtcaccactcaatttctttacaggcatgaccatgatccaactgcttatattttttaatccgagaatttgtaagtcttgagagcaaacgtagagacttctttttacattactttattaaaataatagatagaatattttatttatataaaactacatcgatcaatatacaccattaaaatttagatcctttaaatacttcactttttattattaatatggtgatttccgccgcttctcagcattgccccattctcggagtatgagctataacatatggaccctaaatacagagaaagctattagggaatcttgttactaagaattttattttaaaaaaacatattgtctctaaagattatgcgatagtgcaaaacttgaatgtggttgaaggagtttggatgcccagttgttttgtctcccctacacatgattttgtacaggacgtgtcacagttgtgcatatttatgatttctaattttgctatgcagacatgacgtgtttgtctcgtgtcagtaaattaagtttcctaatttgattttgatttcaaaggctactgcatagcatgcaccaaaattctagttccacgctctttcacgtgtccgattcaaaaagtcaaagagtcaagcttttacatatattttgattaaatctcaacccttatagtctagatttgttatgatctaacggtgtaggttttttctttttccccgattaatgtgaaaatttctagcctccacggtgaacgtggtgccttcttttcgagctgtcttaataatataatagatgtggtgttgtagtttgcaactagtaaccacactcattactccatctattacataattaaaacagcagtatggcaattgtaattttacaaataaacgtgaaagatgcatagcaaatgcgattgta

SEQ ID NO: 67000 - DNA, 2949 bp, Oryza sativa
gatccgcacctttcagctgcttctgcaggaggaggctcgcctggctgatggtagccgccatgagatcggcgtggctagggtttttgcggcgggcgcaggagaataattctcggcctctgcaggaagcggcgacgcgaatcgataggcgccgtggggcgccttatttatagagagacggaggaggcgacgaggagagctcggcgagatgaatcaggaaaggaagaaggagagagaggacgataagggaaggaaagagggagaaaatgtggagcagcagagcaggcggataaaatgggaagcaccgttttgggtaaagggcttttcggttgtttaaccgtttaactatgatgatgttttttgtgtactatttcagagcaagtaataattcttttagataagcttttgtagtaattcaaagctagtcagattctgcagcatcacgcaaacgatcgtgtagctttgacatttcgtaattccgtccattctcgaatgctctccgagcaggcccagaatgcaggattgtagtaccacgcatctgtcaactgcttcggattcatcgccatgtacgcgcatcccggggggaatggccgacatgccgcttgtgccattgaacagagtccacgagcgaaggatggacacggtatggcgcccgcggccagttgacgaatcgagcgaagcgcgagcgcggaggggagcaccccctggacgctgccgttcgcggtttggagcacgcgacaccgagtggtaaaccgtaaacgcgaaaactgaacgagtgagccgacaagatttgggggggcgtaggcagtcacgtcgggttcccccgcccgtcggtttggctgcgatatgacgagtcagccgccgatcgaccgcctgtgctgtgcggtgccgtgcggtgatttccccccgcggcaaccgacgcgcaccaagaacagagcgtacgcagctcggattgaacggtgaatcggtgatcggcttggttgccgcaggtagaggggacccatgtcaccactcacccgccgtctcacgctcgcccacgcgaattgctcggtcgaacattggcgggaggcgagctcatcgtggtggtcaacaggctttcgaaagattcccgtcctgatatctcctttcacagatacgctcatactcaattacgcaagcacagcaagtagaccgtggttcctacatgtgtcttatacacacacgtttagagcaagtataatagtgagtataagcctactataaacttacgtggagaagagatgtaacaaaatattaagagtgttggctcttatgcaagagctagcttaacacaatttcaaaaataaatacattaatgcatataagtgtaagatagagaaagtagaagaaaattatagttaacattataactaatctactatatatgttggctttaaaataagataatagtagaaattgagctatactattcttgctctaacccgcatctagcatataagtagatgcatagggtagacggatataatacaatcacgcacaacaaagaaggacgccgcttttgcaccctaaaggaaagaacgagacccaccaccactcgtccactgggggctacgaaacctacaaattcggcacccactttccgtcccgagagacgcgataggacgggctgttgatttcccggaccccggacggtcccgcgcgactcccaccacccgcttcccttccctggtccactccagtactccaccaccaccacccaaggaacgcgcgatagcgagcggatctcgccctcgccttcgggtcctcgcgatcgtatcgcatcgcatcgcatccccgcccgcgcgcgaggcggagtcgcacgcgcgttcccgcgccaccaatagtgcggtcaggaacctgatgacctcgcggctgacgcgccgggacggcgcacacgctgacccgacccggcggagaggccattcgcccccaaattggcctctgtttcccgcaatccttttgctgtttcggggaatcgtttgccgtgccggggaaagccggcgtcgctctcatctcttgctggtgcaagtcgctgttttcttcgtcaggataacgatggatctactgtttcgtaggcttggccttttcttaaccctgcatgtagcggcaacaccccccgctgataatggtatggacgatgtaggcgggagctggagaggacacatgaacagcaaagagcgtttcaattctttccaccacatctgcacagttgcacgcgatggggaccgtcaggtatggcgtgttgacaacgagcgttttaattcgacaacatatctggcgatgacaacggagagcgccatacgaccaacaagtcaacaactcatattaatgcatcgagatcaaaacatgtttactttgttgctaataattaatcttttcgaattttggtagtattttatgggtcaaatttggagccttgccatattttggtggagtttttgtgaaagaaaacttatggaattatcaacttttagtaagtcggtaatggtaaggctatatttagtttattataaaaaacagaaatactagaagaaatactagaatgcaataatatagtttatgttgctgacgtcatgtttggcaccagatctattccattccgaaatggtatagcgttccctagtaactctataagaaaattggtagatttacaattgacaaaaaaataaatttgacacttgcatggaacccttagaagacgaaactataggcttccgttgcagccacactacgttatgtctaaagagaaacaagcctggcccattctacggcttcgtacgaacatgggaacatgtccctcgttgtcaccaaattacagaatcgtctctcaaccaaaaaatctgatatatggcatccctcaacttacaaaatcgggttactctaggcctttaggcgatattgaccccctattttatccgatatggcagctgagtt

SEQ ID NO: 67001 - DNA, 3774 bp, Oryza sativa
aaattttagaaatgtgcatatgtgatgtagggctagtaggagtagactaggggtctaggaccagccaaaattactgcagagaggcgccaaagacgcagagaaacaatccaatgcgctacctgaaaaggcagagcggcagcgccaatgggcaagaaaagtttaaaaggagaaaggtataagacgagcccgttaccagaagcagagccagagagaaggggcatacagggaaagggtctggggcttggggtactccttgagttggtgccgtgccattttactgcatctcgcgtgccagtaacgtggtacttttttttaaagtgaaaaaccgattaggagattgcgccttttcagcaatctatggtacttatgtttagggactaaactagtctctctcaaagacttaaaaatttatgtttttaagagagcggctaaagtttagccctgcatagaactatagaagtactattcaaggttgcggcagccggcagtcgagtccagagatggtggcggagataaggacgtgcatttcagaatttcagtgagaacatgcaagttcaaaccaaactcaaattactatatgtatatttacaattaaatttattatttttgttacgacttgtaaaagttgaatttgaatttgcatgtttgtggagtgatatattacatgttgatctatcttgtcaattttttcgaaagtttttcataaccatttagatgacatgcaataaacgggtgaacgtccattcgaactgttaaaacagtttccaatagtggagcatgtttgtaaacatctgaacacactaggaacatgttatttcaggctggaaacctggcagtaacaccattacagtcacagacatccctgcagccaacacaagcagcagcacaccgattacgggctaatcgaacgtaagtaacgactccagcatctaaacccgcgagctaatcgaacattagaacacagtcacagacaccccggaagggatcctaccgagtacgccttggcgcgctggattctagtggcagaagatgaccttgagctcgcgcggcgcggcgcactcgtgggtgagcgacgggctgtcgtgcgcgtaggtgaaggcctgcgggcactcgcgcttgaagaactccgagtacttggacgagcggcaggtgcgcgggctgttgtacatgttgcggcagcagagctcgtcggtgcggaaggcctcgcagccgctcttgcacgccacgacgctccccgccggcgtgcgcagctgcagctcgctggggcaggtctcggtcaggttcttgcggcacgccagcacggggcagttgccccggccctcgtgcggggtcaccgacagcccgacgttgaagccgtccaccacgctcacgccgtaggaggtctggtcgttgccgtggtggagggagacctgcgccagcgtcgcgggcgccgcgccgccgaggcccgcgcactggagccgcccgccgcagtcgcccgtggcgcagtggagctgcgcgccggcgccagtgcagcccgtgcgcgcccagatgcggccggaccaagggtgggccggcgcggcgaaggagcggtgggagagcgccgggaggaagaagccgccgccctcgaggacgtcgtggccggagttggcctggattcctggccacaccgggtatgggcagttgttcacgatggtcagcgtcatcggcgcgtagtcggcgaggatgacgccgcagctcaggagcgaggtggcgaccaggagaagcagcttggcagaagccatggcggcgagctgaccaggtctcgagctaatgagcagactgtgatggagtggtggtggtggtggtgataggtcaggggttttagggggtttttataggcgacgtggtgccattgttgttgtcgtggtttggcatgtccaagtataacacagagggaaggtggcttgtttttttgtggagaacttctaaattctgaatgggtttatcaaaacttggaaaaactatttgcattttcatgactcaggacttatcttcttggaatggtatcattcgagaaggttatctcgaagttacctatccttaaacttcttttctcaaagcagcttttcacaaacaatccgagcaaatgcaaagctagcatcgggccattttacacctagcgggaagaaaacggtaataatccgcgagaaccgagggtagtggccggccggtgttgccttcctggcaataatcctatagcaaggcacctccacctccatggaccatcatggcccatgccaatatggcaatgcggtatttttcttcgtgacctgtggataagcatggcagacagagacacagacataggactggcattgggcaaacaagggtagtccactggattggatacgagggaggagacgtaccagctttctcacacactgttcttccgttgttctccacctcgggttccctggcgctccaggggaatctgccaagagcaatacgcctgcgacgtggacgatatcatgccatcgtgctgaaagcctgaacaccgggatcgctttcgctttgtttttgctttttactgccttttcggttcttttttcacattgagccgtgtactcctctgcccccacatgttatcctagtgctccccctgtcaggctactacactttgttactccccatcttagcgcggattgcagtttaatttgacgctaactttcaaaaactctcgctttcattctgatgtttacttggacgcatgctggctgggtagcccttggtggcttcgtccatgtcggtctgagtaaggtggtatttggttggaggaactaaagtagggctaaactttaatccctttcacaaaaatttagtctctagttcccaaacaccccttaagactagacgctgtacgtatatctcgtcggctaatgaaactcccgtactcaagtcctttgccttcgcaagccccgcggggttcatctgttcggatctgaattgttcgaaacgacatagcccatgtgcttgttggtaatgtcgggagtggtcacccggattgagtgatgctaccactaggagctgaaatggcactgctcggtatctgtaaaaactgggcagcatgaagcgcgctccaagaagaaacttgttaccaggctgccagctactgaacctgagcggtaggggtgccgacagaggaatgccgtgctactgacaccgtgcgtgcgagtcctccaagtaaacagcacccggcggaggcttccgtcgtgcgcggtgcgggatcggaggacgaggtccggcggcgtttgtgtttcgcgcaccgcacggccggccggccagagctgggccgtggtgcatacggttcctaatcaacaccgtagatttgttcgtttatccgcttggactctcctaaccggctaaccgtccctctcagccgtaaaaccggatataactacaccttcaactattattaaaatcgtttaaaatgtctctctcagttgttttgagagcggtttttgctaacataatatccaagtggtaacccagacatcaaatgtattgaaaaataaagtgggatccatatatgaattaaatttgaaaatatattgttcattcaatttttctcaggaatattcgggatgtaaaaacttgtgcaaaaatataccgtcggtgtcgcagaaccgttgcgtgaaaatgacatgcgaatgatgtcgcggacggtatcgcgcggtctcgcgcggcaacgacgcgagaccgcgcgtgtcagggttatggataccacatacctaatagtagttgacgggctgcaggaat

SEQ ID NO: 67002 - DNA, 2566 bp, Oryza sativa
tcaggatttcgacgggatgggtttaagagatggattctccgatgataagctactcgacgacttcagctgagggggagatctaacctaaccagatcggaaccatcatcgtcatcgacaacttggtctatcgaaaccatccaagtctcaagcttcgcggcgtaccaaaaaatgtcagatcatatgatgtcgaacgagtacgcaacaaggtaattggtagattggttttttaaattgatctactaatttcgtagatacatccagcatgtatctacaaaggtacgcaatattttatatgcaatttatcgtacctatttttccaatctatacaatattgtcagatctataatttattatgttttcctagagcatgtcttttatacaatatctgttgcgcgagtgtccccgatgttaaatcgactacggtctaatgctaggggctcgctctattttcttctgtataaatcatgcttgtttatggtttacataatgcctgatatttacatctgctcgttatgtcctgataatgctagaagatccatgcagttttttggagtacataatcgatattctctgctatattttgtcttctagaaattatttttcaggaacaattgagcactcgagtaggttgtggtcgagtacacccccttgtcgaggacgttctcgataaggctgagtcgtcgcacccaacttaccaatgaagaccgacgatctatctcatagcaccggccatggccggactactcgagaaaaggttgttaacggataattcctcgcgaacgtcgtcggcttgatcacctgacatgattgcgaacggacatctggatatactacaagttgggtgtgtgagtcatgctggccacatgagacgcacatgtaataaaccaactctagcacctccattggtgttcgagagataattctacacgttcgctggtcctcgaaccagtacgtagcaatctctcgcaccgcaacctccattgatgttcgagagataattctacacgttcgctgttcctcgaaccactacgtagcactctctcgcaccgcaacctccattgatgttcgagagataattctacacgttcgctggtcctcgaaccagtacgtagcaatctctcgcaccgcaacctccattggtgttcgagagatgattctacacgttcgctggtcctcgaaccagtacgtagcaatctttcgcaccacaacctcggatggtcgaggtacgactacagcaataacgcagcggtcctcgtaccacgacttcaaatgatcgagagacacctactcattggttctcaaccagtcaatcgtagcgatctctcgtacatttacttctagtggttgagttacgactactacttggttcttgaccagaggtgtagcgattctcccattacctctacttcaacaaagttgatatcaggtacacaatatcgccaagtgttttacccagagatcccttaccacaaaagacacctagagttgaaacctattctcatgtccctttacgccgtcttgacaaggcctccgaggaacctaagggaacttcggctggggacgcccagagctgataaggccttgtcggatccttcagagacgaaagaaccatgtaagatctggtcgtgtaagagttctcaccgtgcgtattaaccaagccgtgtaatcggaaatggattttccaacttcacggctgggggctaggatcagtgcttgttcaaccgaggcaggtcaaaggtccaagagccttatcctccgagaagaattctccgacgacaaggctgggggctagggagagtgtataactcaaaaaaccgactgatcgaagtcggtaaaagagtagacgctcatatacaaaacattggtatgtaaatttaattcattatcagttttctatacattctataacatgttaccctttgagcgttcgctcgggggctatttctatctaatattcttttctgagtattgatttcaggaaaattctactcgacattgtcaaagacttcatgtctctctggttgtacaccaagatcgactaaggcgagtacggcaaatgttgacaaggctccgtcgcagactctacgcctactcgattactcgagaacggttggtggatctcgacaaggaatgcggaatgaagagatgttgtacccgccgagataaaatttcttgacttcaatccaaattctcgattacagcaagacgtgagacttagtcgtatgctctgtactttcttggttgacatcggagattgactcagacaaaccctttaggtgcccgcacgaggctgataaaggaagtctaacgttatctccaaactcaccgaaaacggtcacatgagctcgataacagttactccaaggcctgcacgcggttgagaatatgaattcgttcatttgcattgaagtcaggggctactgtcagggttatggataccacatacctaatagcagttgactaaatctcggcaggacccaccatataccatgtcctatacggaaacaacatgcggatataggaggagtttcggataaggaaagacaaccagagttttacatggaaa

SEQ ID NO: 67003 - DNA, 4999 bp, Oryza sativa
ctgatggtatatttgtgcaaaagattttacatcccggatatttctaacaaaaaatgaatgaacaatatattttcaaatttaattcggatcaatatatcatcttctttctctactaacgtctctttccccatttcttcttcttgacacccagtgtagcaggacgacagctgacagtagcagaatggtaggacaacaatgggtaacaacagcgatagtggtgggctctcctctctctccccgaccccttctgcactagcttgccacggggaggtacttccaccccctcccttagcgacaccatcaaaccaaaacagcatgtggtccctcaattacacaacaatggagctgctcatcgggaagtagacgtggtcagagctcgcaacacctgcgaggttggcaagctgctcttcctcatcgggttcgacgggaagacccctaagctccctgtcggtgacatgggaccggggatatcttgactagaggtttggggcagccgcggtcacccgcttggcctgaccccctcggggggggggggggggggtcgggcccgagggtgatgaggccgcccctccctctatctccccgaggggtcgggccgctcccgtttcgaccccccgagggctgggacgccccgaccccctgggggtttggcgccacgtgtgtgggttaggtgagcacagcggcgctcacctaaccgcgtttattgcgggttggacgagcgcctcacgccgcatttaatgcagcgtagcgcatgcttatccggtccgtgatcggtcgcagtgtgtgaccggtcacagaccggtcagatcgcgggttagggggcaacaggcggcctgacacacgcctcgccccatcccgtcggaatgatgagagcctccaggcactcgtccctagccggagccggcatgggaactcctggagttggcacgtcagccccggtcagatacattccaggcttcatcgcaaccattgcaaggaagtcgttgtatgaagaagggcagacgtgtagcatgctaaactgacacgtggaggacaagaatgaccggtctgtgactggtctgacgccggtcgcgtcatcagcaaacaaccgtgcttccacgttgcacctgcttccagcggagtggaggttggtatgacccatcccatcggagggtcattcggacagcagccattgcaaatctccgcccattaatgagggaggacagggttatcccggtgtcagacaaaggtacaagccaagttttggtcaaagtaggatgggtccccacccaaaaggagggtaggtagaaatggtgtatgtggtatccccttgagatataaaaggaggaccatgcctaccaaagggggaaagaaaaaaaagaaaagggggaaggggacctgagctggtagactggagaaaggaggagtgagaggggctctagagtttgaactctcttgctctccagctctttgtaactccttcatacacagatccaccagaacacaggagtagggtattacgcttctcagcggcccgaacctgtctacatcgcccgtgtcttgcgcatttactctctcgcgaaccattccacagatcaagggcttaaaacctcacttagcacccccggccgaaccggcaaaggggggcctgcgcggtctcccggtgaggagccccacgctccgtcactcccagtgtgcgtctctgactcgtgccgcgacttcctcaacaagtgcctccaccgtgacgccggcaagcgatggagctgcgatgagttggtgcaccaccccttcctctcctccacggacacccatgacgctggcaagccatcgcccctccccctacctccccccgccccaccccaagccgttcttggctgggggcaaccatgtcggatttctacttcggcgacttagacgacatggaggcgcacaacaagcgtgaggtgatggtgcatgccaaggaaaggctagtggagtgggcatcaaatgcaagcgcggcggggggggggggggggcgcgttgtcaccgccattgtgttgaagccggctagaaggaagggccgaatcccgaattgggaagaggaaggagatcgagaggggtaagggtagaagagagagaatgacacgtgggctccacattcttaattggtggaagggccaagttaacgtgccaagccagtgaaaaacaccatgaaaactgttaagggagtcaaattgcatcgattttaatagttggagggtcaagatatctgatattactgttgagggatgcgaataagatccgaccactaattaagggtgtcaaagtggacttattattttatcggctggtttattttgggccgcgaaaaagtgggtgttggttgtccatctgggcagaggcctgctatgtttgggttttggtctactcttagtccattacgcttttcgaggccctcgtgcacgagcatattctcaggcccatctaaaaattgcccgaccaacggttgggctgcgggcgtgatagaagtccacagaacaaacccgttaactgtagaacatactggactgttcaacgtcacggagggcagggtctcaccaactcgcgtcacccgccgacgaccccactctcccctcctggcgctggcggtggcctctgcgtaccatccagacccttccagaactcccatccgatctcaatccaacgtcccagattggcgcaccccgaacattctcgaaacaccttcaaccccaataaaaccactccccctcgcctccgtcccccaactctttgcaaaagaattccgagctcgcaaggcgaagaaatctcgcaacaatctcatcagatctcgagatctcatcaggtttggtttgttcccgtcggatttttcttttccactgttcgatcttcctgttcgtgcgagatggcgaagggagagggcccggcgatcggcatcgacctcggcaccacctactcgtgcgtcggcgtgtggcagcacgaccgggtggagatcatcgccaacgaccaggggaaccgcaccacgccgtcgtatgtcgcgttcaccgactccgagcggctcatcggcgacgccgccaagaaccaggtcgccatgaaccccatcaacaccgtcttcggtacgtgctcctgctatttcttccttttttttttgagctatcgttgttactagtccttttgcacgctctagttcgaatctagattgaactgtcatctggatggctggatgcattcgttattaagatgttcctgggttgcgctgatgttgatttcactccgaaacgaagacaaacattgtatctgtgctctgtttgggtgtgctaaattgctaatctcataaaaccaaagaataatgattatattaaacaagtatcatgcatttactacaactctcagggtctgtacttgaatggttgaacattgaaattgataggagttgctagttgtcaagaaattgataggagctgctaattgtcaagagattgaactgaacaatttaaacattgtatctatgctctgtttgggtgtgctaaattgctaatctcataaaaccaaagaataaggattatattaaacaagtatcatgcatttactgcaactctcagggtctgtacttgaatggttgaacattgaaattgataggagttgctagttgtcaagagattgaattgaacagtttgctagttgtacatgttacattttgttgcagtggtgcattttgttctatggaattttcgtctggaaattctgcttgttggctagttagtaatgcggtggtaaatcacagggagtaggcaactcatattctcgtggaatttgctttgagcgaaatatatacccacaatttgtttcgagtacattgcttactgattataaattaagctggctttactgcttgtgtgcctgctgtactctgctttagttataagctgaattttcatatgaattcaattgaacaatctgactcataatctcgttcgtcttgaaattctgcttgttggctagttagtaatgcggtggtaaatcacagggagtaggcaactcatattctcgtggaatttgctttgagcgaaatatatacccacaatttgtattagtacattgcttactgattgataaattaagctagctttactgcttgtcatgcctgctgtactctgctttacctgtaagatgaatttttaagctggctttactgcttgtcatgcctgctgtgctctgctttacctgtaagctgaattttcatatgaattcaattgaacaatctgactcataatctcgttcaattttgaatgcagatgccaagcgactgataggtaggcggttctccgacccgtccgtgcagagtgacatgaagctgtggccgttcaaggtcatccctggccccggcgataagcctatgattgtggtgcagtacaagggcgaggagaagcagttctccgccgaggagatctcctccatggtgctcatcaagatgagggagatcgctgaagcctacctcggctccaacatcaagaacgccgtggtgactgtgccggcctacttcaacgactcgcagaggcaggccaccaaggacgccggtgtcattgccggcctcaacgtgatgcgcatcatcaacgagcccaccgccgcggccatcgcctacggtcttgacaagaaggccaccagctccggcgagaagaacgtgctcatcttcgatcttggcggtggcacgttcgatgtgtcgctgctcaccattgaggagggcattttcgaggtgaaggccactgctggtgacactcaccttggtggtgaggacttcgacaaccgcatggtgaaccatttcgtcctggagttcaagcgcaagaacaagaaggacatcagcggcaacccgcgtgctctgcgccggctgcgcacggcctgcgagcgcgccaagcgcacgctgtcgtcgaccgcacagaccaccattgagatcgactccctgtacgagggcatcgacttctactcgaccatcaccagggctcgcttcgaggagctcaacatggac

SEQ ID NO: 67004 - DNA, 1006 bp, Oryza sativa
  unsure (1)..(1006): unsure at all n locations
cctgcagccctgctcatcctgaggaacaccaccatccccaccaagaaggagcaggtgttctcgacctactccgacaatcagcctggcgtcctgatccaggtgtacgagggtgagcgtgcccggaccaaggacaacaacctgctgggcaagttcgagctctccggcatccctccagctccccgcggcgtgccccagatcaccgtctgctttgacatcgacgccaatggcatcctcaacgtctctgccgaggacaagaccaccgggcagaagaacaagatcaccatcaccaacgacaagggcaggctgagcaaggaggagatcgagaagatggtgcaggaggcggagaagtacaaggcggaggacgaggagcacaagaagaaggtggacgccaagaacgcgctcgagaactacgcctacaacatgaggaacaccatcaaggacgacaagatcgcctccaagctctcggcggacgacaagaagaagatcgaggacgccatcgacggcgccatcaactggctcgacagcaaccagctcgcggaggcggacgagttcgaggacaagatgaaggagctggagagcatctgcaaccccatcatcgcgaagatgtaccagggcgccggcgcggacatgggcggcgccgctggcatggacgaggacgcgccggcgggtggcagcggtgcaggccccaagatcgaggaggtcgattaagctggtggtggtcctacgtgattccggctggaagggagtctgaaccgtgtgatgtggctggcgtcgtgtgatcccctgtgttttttagccgtcgagagtttcgtgcgatgaagcttttgtaagtgtgtatcgccgtatggttttacctgaacttgctctgaaatagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 67005 - DNA, 1578 bp, Oryza sativa
atatatgtaccaacgctgaaaaatatatgagtatgacaagaaccccaaaatcaacttctaaattaaattttaaaatttaaattttggttgtatagctaataagtcaagaaacaaatggtataaattgacagatactctctctacccctaaaaaatcaatagtaccatatgcgacacattgtcacaatatgtctagttaaacatgcatgttatgatctcacaaaggtaatcgcctctaaaagtaataaaacaatgttcgatctacaactcacgggcaactcaattacacattgtcagagttgaatcgaggttgtcgtgttacaactgacgtcagaaatatgcaacggaggaatgacaagaaaaaaccataccactaactttcatgaatttattgttatttacaacaaaaatacaagagttcatctctgagttcattctcaactaccctggcatattataaaaccccccaaaattacatcaattctacgaaatgttaaaaagtaaataaagaaaggtaaagatcaaaaggaaaaatcagcggtgtatattttatcaagaaacaaaggaataatcggcaacagctatcatgcaataatatgtgcagtttgaacggctcaaaggaaacaatccaacatggcgagcgccttgtgtacgccctgcccgccggcgccgagacccaccacgttccggcactttgcgcggttctccgacggcgtcaggttcaagtccaggcagacaccgccgccgtcgcaggccttcacggccgccgccttgcctacgtcgccgttcttcgtcgtcgtcgtcgtcgttgtcgccgccgcctcggcctccgcgcggtgccgacgcatgtgcccgccgagcgcctgcccgatggggaactcgagcccgcagacggggcactcgtgcaccctcggcttcgccggctgcggccgcggcggcgtcggctgcctcccgaggcatagccccgcgtcgtcggcgccggcgccgccgccgagcgcgtgctgctgctgctgcctcggccgcttgtggctggcgcggtggcccccgagcgcctggaacgtcgggaactgccggttgcacgtcttgcactcgaacacgcggtcgtgcgcgccgccgcgcaccaccaccggtggcgcgccggcggcgaagccgccgccgcccagcaggccgtgctggctctgctgcgcgaggagcatcagcacgcgggccgtgtccacgctgccgacgaactcctgcatgtcccacatgctcctgctcctcttgctcatggctatagctagcttaattagccacgtaattaattaacccagctgatcactaacgtcgccgatcgaaatctgtatatccgctgcactgtgcaacaatactgcacatatgctgcgcgtatgactatatatatagagagagttagaaagaccaaatggcagcaaagctgaacttgtggtttggtgcacacgtaggaaatggatcgagctagcacgacgaacaacggcccggcttgcttctagatgtggatgtgtgtgtacttttctaaccatttgaccacgagagagcatgatcagattaattagttcctccc

SEQ ID NO: 67006 - DNA, 2279 bp, Oryza sativa
tccattcattggaccggctggcagaatctattatattattaaatgaataggaaaaggagtctacacattcgttctcatggtctagaaattcttacattaatcgaagaaaaagaaaatgcagagtctatatagaaatacaatttagatatagctgaaattcgaaattaaaaaataagaaatattagaatagaagactagagtccatatagaaatacaatttagaaatagttaaaattcagaattaaaaaataagaaatattagaagaggagactagagtccatatagaaatacaatttagaaatagttaaaattcggaattaaaaaataaggaatattagaagaggatattagagtccatatagaaatacaattaggaaataactgaaattcggaattaaaaataaggaatattagaagtagagtatagagtccatatagaaatacaattagaaaataatagaaattcagaattaaaaataaggaatattagaagtagagtatagagtccatatagaaatacaattaagaaaaaaatagaaattcggaattaaaaaaataaggaatattagaagtagagtatagagtccatataggaatttaaaactaactaaaattcggaataaacataataaaattaaaggtagagttttgagtctgtataaaaatataatttacaaataactaaaattcgaaattaagaaaaacacgggaagaagagtttaaagtcaacataggaatacaatttagaagtaactgaaattcgaaattaaaaattaaagaatattgaaagatgagtttagagtccacataaaaatacaatttgaaataataaaaattcagaaataaaaataaataatattggaagaagagcctagagtctatatagaaatacaatttacagaaaattcggaatataatttacaaataactaaaatttgatattaaaaataattaataactaacacgtatataaaatacaatatgaatattacacatttgtagtttcgtaaagttattgcaaaatttaaaattatgatgttattttaatatatttgaataatataatgagaaagcatatatgctattatatgagagaaaatataatgatgctagccgcgcaatctgcgcgggccaccatgctaattgtattaaaacgtttaaccaagatgttctgtacggacaaaatgtgatcgaacacgagctgaattcagagagagctttaaaaaactagtgcagtactgtactagtgtgttccgttgggactgcataaggtactcgtggttagctagttatagctgtttgacacggcaatgttcatgccttcattcacccacaaatttcttgactggaatagtggaatgcatggtctttatttttactttctgatgagcacttcatctggattaaccttgtatgaataatcagcttgacagctttgcagtagctgagtcaaatgccaatccgtgttaattagctcacgttctgagctttaccgaggaattcaaacttacatgtttaaacttttggaacttgcgaagattattattgtggtgggcacacctaacttcagatgcaactccgcaattacgcttgtaacagaattcagaattgagaaagaagagagaaagatgagtttggtgatgcagtccaggtcttggcggcaaattaaacgatttgaccggttatcagtggggcgaaatggctaggtgtgtgcattttgtttggctgactgggcccatccaatattccaatgattcagttaatgcctttctctgcacactacttaacgcattctacgcttttaattgttgcaccgcctgttcataggtgagaacagcagatgccactacgagaacatgtcttcaatgcaactactcccccgtcacaaactactaattgccaatagtcaaattaagttttgatagtttgactaaaagatttccaaaattataagaaatcatagtgcctaaacttgataaatagtagtagaagggatcagctgaactagatgaactcccaagatcggtcaaatggtcaacacacacgcatgtcttaggctggtagcctggggcgttctctctctcaaaaaaaaaaaagagagaaggtattgagctgaacctcaaaagctaatttttgcagcacatatagatatagaacgaccactatcatgcatgactcatgcgtgcaaagagttctagttacacctaccatttgttcctgaatcctgcatattttgtcaacacaaacatcacgagtagtgagtaccatgttctaacca

SEQ ID NO: 67007 - DNA, 2281 bp, Oryza sativa
tgagtgcagtgtttttatccatttctgtgcgtgtacgatgtcgctatgaagcttcctcgagagtaaaaatatggtattcgtgaggcgtatgtacaggaatctcaggaccgagctcgccatttttattggggtagtgctccgctcatgaatcattctgacattatcagcagagaaccacgtgcaaaccgaagagagaatccaccagcagaatcaatcacataatactactaaccagatcaatcgcaaaaaaactgaaacatgcaagtacggatgccctgactaatcatgaagtttttctaataacacttgcaagaaatttcctcgtaatcctttgtccctgcacaatactatggctctagttgtgtacagatagtgctgttactacccacaaacaattgctaagaaattagtatcagttagctgtttcaataatttttccgatggttcgtgcttatcgcaatggaatcttttcgttttccttttaaggagcacaccactctgtttatgtaggtgctacaacctgatcaagctggatgtgttcatgcgtgcggaaagaaaaaaagaaaaggaaagggaagttgttaactgtcaaagaaagcaccatgcatgttagaagattccaaattcctagctcaaatccagcctcacatgggcggtacacgtgggttgatcccccacgcatgtaatgcaaatattattggggcccggggcgttcgctcgtgtgcatctccaacaaatttgctgcaagtcgccaaacttatgagacagggaaatgtgcaaggcagcagcacagggcgtgtatatgctcttctcattccaccaattaaaaggattgatttgtaatgcgggtctgggaagtgggaactgaattgttcataggatacgttgtttggtttgagtacgtcgatgatcaaaactgtggtttggcaggctgatctagtgctgtaaactggtgttcagtttggtattgataaggagttcctcttctgccaagactggaggaagcgttcgatgcttgagctgaaaagggaatatattgtagttcagttccttgtgcagattgggaactgcagccatgccggctagttgcctccttcctcattctgcgacgtgctcaacgccgtgggcagagtaggtatcgtggttcgtggacgccgttgggctcaacgccgccgccgtagaatgtcgcgttgtggcggtcgcggaagtaggcgtacggccgtgcatcgtgtacggtcctggtctttgctgtctccgacaccttgatctagtacatactgaactctcattccggctcccggccggcggccggtggtggaactgtcaaccgcgtcgcccactcccgcacgccggcggcgtcgacgtgggatttctttctcctcgagcggtcgtgactcttcaatgagcatctccctcgtccgatctgaacggagagcgcccacgacacgccatcctctgggttgaggccacatgtgcgatcgatctgcgagtccgttactccacccgtttcatccttttaatgagttgttatgattttttttctaattaaacttcttttatgtttaatcaaatttatagaagaaattaacaatattttttgacacaaagcaagcatattatcaaaacatgtcagatgtaagttttagcaaaattaatttcatgctgtagatattattttttttataaatttagttaaattttaaaatgtttaactaagaaaaaaaatcaaaacgagtcaaaatatgaaacagaaggagtactacaaagtggtcggcaacggaaagaccgcgtttgcattagtgcaatttatttatcctcggtggaaccaaacgtaaaatcgaaccgatatgaaaatggtaccggtctcaaaaacactaacggagccatcattttgcttattcgcaaaataagcgaaacggtatatttgcaaacgaaaagtaacttgtaaatacaaattatatatatatatatatatatatatatatatatatatatatatatatatatatatatatatatatatatatatatatatatatatatattcttagcgatctacaaataaatgctgaaaaataaattcgataaaaaaaacctcaaaatcaacttcaaatttaaagttaaaaatttaaattttgactgataagcataagcataagtgaaaagattaggccctgaaaaaaggaccggaatgaagatgttagaattttttttattttaaaatttttattttttaatatgtacagaaatattatatcatccaaaatatttacaggaatgg

SEQ ID NO: 67008 - DNA, 3947 bp, Oryza sativa
cgaatcttttgagtctaattacgccataattttgacaatgtgatgctacagtaaacttttgataattatgaattaattaggcttaaaaaattagtctcgcggattagctctcatttatgaaattagtttttttattagtctatgtttaatactctaaattagcgtccaaacatccgatgtgacatggactaaaaaattttagccccatctaaacaccccctaagttgttctggaatctgcacctttgaattaggagcgttgctaaactatatgtgctgttccatggcagcactgctggagttattgataccattttgtttcagtgacccaataacacacttttgtgtttcatatcaccaaactgcagtttctgcagaccctaggacattatttgggggacaaagtagcactgtaactaggatcatgaagtcaattttgtgtttatcatcaatctattgaattcgttcaaaaaaaatataatcaatctattgaaactttgtaactgtatgtaagataacctttctactaatatgatgcattaaatatcttagtataaaacctagctaatttaacatattgtgcaagtatagtattattatatcctctgcaagtatatcctctactgcctggggctttgctttgcatttcccagataacagtaatcaaacactcacttgagctttccaactaaagaaatcaagaaaagatgccatgacaaatactagttcaccacaaaagatacagtagtctccacaacaagagcactagttctgattattactattgtaatagaacaactgatacatgatgatgaattctatcaagagagctccggggatatagacactccattaccatcttcttgtcgagatggagaaggaagacctgccaaagttgtttagttgccctacatggcctagcacctgcctagtggataccttcgctgcatcggccgttgaggcatcatcttcaacaccaccggcgaagctgagaagtagtgagaacactgcatgggttgcatgcagggcagcggtgtcaggccattgttgggggtagagaggaatccagaagaagggtcctccatggaagatgctgtgcttggtttcatttatagagagtacacgaggtttctttcacaaagtggaagcttaggtggtggagtgccttttcgcagaccgaaatgaggtatcttccttagcatattccttagcatgtggaaacttctttttctgttctatgcttttgatttgctttggagtttttcaaagtatattccatgcttttgtgtgctttttggggcctataggtttatgaacaataatttagatgatgaatacactctagatgtattggagtaccttgacgaagcatgggctggaaagttggttttggtggtgatcacccggagcagatcttgcgtcatggacctacttagcaggtgcagtttggctggtcttgcattgtgcctgtcagattagtgctgtacttgatgcattgttgtcgtttatacatgaaaccaaatgaaatacaagaaccatatgtagattgcagaacaaattattttccttctaaagagggtgagatcttagtagaactttattgcttgtggtgccctgctgtttgacaatgtaattggtgcgagacactggcatatgatctggcctgagccttgtgtatgatgttatcagactggactaggccaggtgggccttatgcctgctttggtcttcatgccaataaacagagggagggcccaaaataagtcctttaacaggacactgatgttcatgttccaatgtatacttacggagttgtggacttgtggttataacttataagttgcaagggacagatattgcccaatacatttcatgagaaaaatctcgctatgcttttgcatctttgcacgctcatttggtgcatacggaggattggcctaaggctgtaaaataacaacaataataataaagctcaaggcttgcgagttgctcgagctcttaacgaaccgagctcgagcccaaccccaagctcgcaaaatttgttgagctgagctgaaagcatctaatgagtctggttatatgggctggtacattctaaattgtttttttactacgaaattatcatcaaatatatgttatcacgtacttaagccaagcccgcctgaaagcataaaggtggaataagcttggctcaacctctagcataaggcagccttacgctctggcttgcttgagctcggctcgttgacagccctaaattaaggcgtgtgaacctctgtcaactaatggcaggcacatggtggtggttcttaaaaaaaaatcttcgtttcaaaattcacattgaagttactaggttggtcacaatcaatttgatgcaaagcggatcaattactaaattaattgataataaggctaatttccccatctaactcagatactatattacgttgcaggcaccgctaattaacccaaaattaaaaagagtaaatttcacaaaactaaatatactttgactaaacgatcacaaaactatggatttaagacattactagtaatcgtgcacgtgcaatgcacatattaacaaatattatatgaatatgaaccattttgataagcatatcacattcaaacgattggcaatagaccaaggctacataaacccaagaaacatgtttttttttctttaagacattgtagttctgcttttatttttatatagcaaggacatattactatataaaaaagagaagaataaacgttgttccgcttgtcatagcatgttgactgtagcatccaggtgaatcctttggcgtggcagcataaagatttattttagttgtttattttggcaacttaaaatttacataaaacttaatctgagacgcatcccatctaaagaaaaccaagagataaatctttgagactatagaattgattcattcactatatgtaaatcaatctctcttgcagtgtttgtggcaaaagatgagcgatgcaatcttgatcgtttgacatagtttattctctttccatcgtttgtacacgcttgttttttggtctcctacacatcaaaagaagaaaacacaaaagaggtaagcaaatgacaatacatgctttactgaagatactggcaacagaatgctatatgaatgctacttattgcagtttcatgcaagaactactaatggaaggatgtgcatccagtaaaaataaactcaatggagcagaccatgaacatgattacatgaatggagtcagaggtggagacaccatcttttgcatccccttcactgtgtagaacttgttatcagtaatcaagttttagctaaaaggaagtcagtatagatcaaaatccaagcaattgaaatatatccaatctgatgcagagaagtggagaaccaacctcgtgcaatcgctgagcactgctacacacctatgaattcctacttcaataggaaagaccataaacatagtagagctacctgttttccttcaattcaagaatttttggtttcattaatcgaaacaaaaagaagaaccgaaaaaattgcaaggagaggaactaaagattttctttagtacaagagccttcatcctcgggatgttgctttcaaaataaaagatatagagcagtgcaaagaaatatttttcacaggttaaatcgcaaaccaaatttcagtacagccgaaaaaaaatagatactccaatcatgcacagacatgaaaaaaaacatatttcaacaattagagcccatttcaaaagaagcggtttcagttctcacaaatatgacatgcaatttgttaatcttaatactggtgggctgaccatatcaaggctaacatggaaataaagcacatcagttgaacttcagattcggtagtggtagaaaattggcatatttagccattttattatagtagtagttttttgagcaggggctgcaggaat

SEQ ID NO: 67009 - DNA, 1477 bp, Oryza sativa
aaatagcagaagtagtatcacccggaactaggaaagctaatatgaggcagttggtggcaggttagaagtaaatgacaagcatgatatgctcatgatgacaagcatggtatcctagtaatgacgagctgatctcgacgcataacgtgaaatgggtaacttctatgaggttgacgccaaaaatatgaactatgcgaagttctggaactgaagcaccatcctcaagtgccgcaacccagtcgaagtcagctaaaggttcaaccagggacaagtcaggtgaagagaagattccatctgcaacaggagattgagccaagcagtccagagtagagaagttttgctaggcaagttgttataaaagacgcgacggaagaagtcagacaagaagagaagaccgcccaacctatcttcttgctagcctcctcgaatctcggggacgagattcttgtaaggggggtggatttgtcacgtcctgataaattcatcccgaaataaaaatcattctctaaaaggaataatagaattaattaaaattcggaaagaaattggcaaacattaaaatacgtacaagaaaaattcaaatgtgacccggagaatttttgttaaattctccttggtctaaaaggagccctcaaattttagtggaattctcagagcacaaataataattattaagaaataaacaaagttaaaatgattttataaaaagaaaaaccctaaaaagtctttcccccccttttcccctcttgggccggctcggcccatccctttatctctctctcctcttccccgcggcccatccggcctcctccccgcgcgcgcgccgctgacgggtgggcccgcccgccaccctcgctgacgggtggggcccacctgtcatccctgtcctcccgccgctcccgccgcctcgcccgtgccctagcgccgccgccgccgcgaatcccgccgcctcccgccgtccacgcgcacaataaagtggggggaaatattccccgtgattccctctctctttccccccatttctccctctctctcccgcgttcaaacgggcggatttgcccccgcaaatctcgccggcgccattgatggcggccgacctcccgcgccggtttcctcccttccccggccaccctctctcgcccccggctctatataaacactccccgtgcctctctccaccgtttccgccactcgccgctctctttccccgtcggaatcgagctcgcgccgtcgtactctctctccgccgtcaccgccgagctccggttcgccgccgtcgttgccccggaccatctcccgcttcggcaccgcctccttccgcttcgccgcatcctcgccgacctcgtccacctctccgtttcggtcgccgagccgccggaacgccgccgtccccgtcgacccgagccgcgccgccgcctctctccgctccggtcgccgttcccagtcgtcgccatcgatcaggggtgagccatggaccgcc

SEQ ID NO: 67010 - DNA, 2339 bp, Oryza sativa
ccggcgagcatacgcgcccgagccgcccgagtcgccgccggtgctgacgtcatcgctgacgttgtcgctgacgtcatcgggaccgtccgccgtgagccggtcgtggaccgatcgatctcgaccgtccgttttgcacagggttgatctcgaccgttcgttcccatgaacagataccgtgcacccggtccaccgcgaaaccctagctgctgacgcaataatcctccttttccttttcaagaataattcattattgcgtcatattcaattaaaatccatatagtgttttaatccgatttaatctttaaaaattcataactaattcatttgaactcagtttaatgtggttcaagttgcaaaaattatataaaataaagatctacatattaaaattgtccataaatagaattaaatttatttaattctttttaaatgggctttaattagatttaatcttgtaaaattcataataaattcttatgaagtcagaatgaggccgttcaagtctcataattcatctaaaattatgatctacatgtttgtttactttatatgtactgtttatttggtttttattagtctttttcttcgttttgcgtgttagcttgtcgtttccgtcgttgcgaaggttcgtgagtgcgccggaagtgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgattactttattccttgataccttggattattataacttgacaagttgagctttatatattggttcagctagatattagatatgattgcttagccatgcttagaaacattagcacactattgggataacttatgactcattatttaatgatggcttaatgatagttcacgatggtcaatcgtgattggttaatttatcacttgccaactaagtcttgataatggtgggttgtgagcacatggttttgagagtcgtgctcatgacaattaaggaccggttcgcgaggctactattgtgaagcattaatcgtgccaaccacaagccagcgtgggcaacggcttgacctttcgtatagcatggttcattgcggggcaccagactgagaagtgacggagataagcccacgggggtcgctggggagtccatgccttatttataagggggtgattatgatccaggaatggtgcactgcggtggattgtgttatgcaaggggtaatgtcacagcccctttccgaggtaccgtggtggtactgaggcacatggtgacatgatgtggggctgtgtcttgtgggtacagtggtacacctctggccagagtaaactattcgaatagccgtgcccacggttatgggcgggttgagcaatgtttttcgtgattagtcccacacttctcacaataattatggatgttatatctggtaataatttgcttagctcctggattggagattagatctgtacagccgggtatggttgtttcagaatggttaggcctgagcagcatgggcgtgttgttcagtgttgattaaaatttctgattaattactccactgttttacttctcttaaatgttttgctaaatgctgcttttgcaaatgagcctatattatgccaacctttggtatctttgcgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagatttttttttttccgctgcagttttcttcatggtgaggactaagtgcctctttagtaagtatttatcgttttagatattttgatgaatctgtatattaaattgttagtttgtgtacctcggctgattcctggacgaggattttatgcacaaataagttcggaaattactagtgaattttcgggcgtgacaacttacgccatggagtaatcttaacaaaagataatctgattaaaaggaattggagaggaaacaagtctagttctttctgccacaaagatgaaactattaatcatttgttctttgattgttattttgcccgcgcggtttggtctttaattcagtttgcttcgaatattagttttatctaatagtacaactcatatgtattgggcattggataagaagacaatcacgcaatttgagatctttggtcttattaggtgc

SEQ ID NO: 67011 - DNA, 811 bp, Oryza sativa
tgctgctccagtgctctgtgctgcttccccttcctctctccccatacgtgatagcatgcgagtgtggcggcgtttgatcatggtggctgtcagcggcgagccggggcgcgacgtggtggctgtcggcggcggcagtagcgcatgggacgagtccctttctcactatccagatctgactaaagaatagaatgcgaaaatacaaaaatatcccccgcaaaaaatatagaaagacaatatacccttcacaatctattatattattaaagaaatagaaaaatgagcctctacgttcgctggggttttttataaattctcacattaattggagaaaaagaaaaagcagagtccatataaaaatacaatttagaaatagctgaaattcggaattaaaaaataaagaatattagaagaggagactagagttcatatagaaatataattagaaaataatagaaattcggaattaaaaataaggaatattagaagtagagtagagtccatatataaatacaattaagaaaaaaaatagaaattcggaattaaaaaaataaggaatattagaagtagagtataaagtccatactaaaattcggaataaacataataaaattaaaagtagtgcttagagtccgtataaaaatataatttacaaataactaaaattcgaaattaagaaaaacatgggaagaagagtttaaagtcaatataggaatacaatttagaagtaactgaaatttaaaattaagtttagagtccacgtagaaatacaattagaaataatgaaaatttagaaattaaaacaataaatatt

SEQ ID NO: 67012 - DNA, 1064 bp, Oryza sativa
cacataaccctccccaaaccatccacaccacgataaggtttcacccccacccctaaacgggcagtggagcagtcccctcgtgcgccgcggtgaatccggcagctggacaaccggacaccccggccgacccaactccatcacgcccacccacgccaccggtgcctaggaaagggtcgagctatacttcagatcaagcagttacccactcccgcttgtggtaagcacggtaagtctcccagggtttcccgtgaaccggtccttaattgccatgggtgcgaccagcaaaaccatgcactcgcagcccgccattcagtgtattttaattaactaacaccattgcggtggcaccaatccaaagctatgctaatagacaaagtctatgtaataatgtgatacccatttgtgtactagttgaactaagcatggctaagcattttcctaaaccaacatctagtcattttgatacccaagttatcaatggcataaggtaaacaataaatggctgagtaataggacccatcccacatgacattgtaaaaggatgcaacatttaatagaaatgcgggatatttgtaaattgggtacaatatgatcaattgtaatgcatgacttgccttgctctcgcactgatgagacctcagcaacgtcttcgagaaaccgcggatcgacgaaacggccagtctacgcgacaaacaaagcacacaagcaaaacatgctataagactactgaaacaggaaacaaaaccatttttaatggattctagggatttttataaatttactgagacttgaatggatttaaacagagctcggatgaattagttatgattttcagaagataaactgtgtttttactataaaaagaaaagccttattggtttattgcgcaatatatattcccagatgatgtcagcaggggggcgccgacatgcgggcctcactggcagcggctcaaagggggtggtccaccgtggaccaggtccacggggccggggtggtggtgtatcacgtggcgtcgacgtggcaccacgtggctggccacgctggccatgggatggacggcc

SEQ ID NO: 67013 - DNA, 1553 bp, Oryza sativa
cagagggggaggaggtggcggagtgcggcagcgcgagcgtcaggttaggggcggcaccgatctgggcgacggacggggacgggggcgcgggcgcgctccatggcaatgtgcagagggaaggtgtggaaagaggcagcgattgatttgctcgcatgcgtgattttcggccggtcaccccgcgtgcgcgcaatctctctcccacagtgtgaccccgcgtgcgccggtaccgttggatgcgagaagcgttggatgatttggttccgttagatataaaacccccacgtaatgtaggtgtaagagtgagttggtgaattatagggtagatagactatagttcgatttttatattttcctcaattttctactattaatgtaggattttctagacaatgagagtactaaacgtggaggcttctttttctattaatttattaagttaatagatttctagtatttattaaagtaccatgtggtaagttaggagcgtttgtaggagtgtcatatggcggtttaggattatttgtaggaagtttaatggatttctagtatataatagatagatagactagttttcacgagccgagctaagccgaatcggctcgttagccccccttacatgcgcgaggttgatccgacagctaatggcagtggactgagatctattatattattaaaacagccttgaaaggaggcaccacgttcgctgtggaggctaaaaattcccacattaatcatagaaaaagaaaagaagaatccaaatagaaatacaaatataaaaatagctaacattcggaattaaaaatatgcattattgaaagaggagtccatatagcaacccaatacatgattaattaaaactcggaataaaaataaaataaattttgaaattagaaaaagaaaaaaaaacaagagttcgagaaggaatacaatttaaaaatatcttaaattcagaattaaaaaagtccatacaggaatccaatacaagattaattaaatttccgaataaaaaaataaaaaacaccgaaattagaagaaagaaaagaaaagaagagttcaagtaggaatactgtcagggttattgataccacatacctaatagtagttgactaaatctcggcaggacccaccacataccatgtcttatacggaaaaaaccttcggatataggaggagttccgtataaggaaggatgaatagagttctacatgaaaacgacaaggactactcggattgtatctatattggtttccctagttctacttagacaaagggacacctatgggtataaatacaaggtcccctaggaggagaggggacacagaacaatagatcaagaccaagatcaacatacaagccaacatgcgccaagacaagacgccggatatcgacttcagagataagcatagctagtcccctacggtgtctacggatactatcaggagagacataacgatgtctttgatctcgccggatgcagattcgaggaggaaggctactctgttgtcgactacgagtcagcacttcagaccgccagtcgacaacagttatatagg

SEQ ID NO: 67014 - DNA, 737 bp, Oryza sativa
cggtgtgttcgccgtgttgtcctctacgtgctggtgccctctgttggtgccgtggtgccgccgttcgccggtgagcgtgcgccgcccgagccgtctgcctcgccgagccgccgccgccgtcggtgacgtcattgctggcgtcatcaaggccgtccgccgtgaaccgccgtggacccgatcgatctcggccgtccgatttggatcggatcaatctcggccgtccgttcgtgtgaaccgccgcccgtgcgcccggtccaccaaaccctagcccgctgacgcaataatccctttttccttttcaaaaataattcattattgcgtcataattcaattttaatcgatttaagtgttttaatccgatttaatctttaaaaattcataactaattcatcttagctccgatttagttggttcaagtctctaaatttttctaaaattaagatctacacattaaaaatatccacatgtactgttcatgcttgtttatgtgctgttttggtgattttgcttctttttgcttagattccgtcgtttccggagagtccgttttcgcgaaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattacctt

SEQ ID NO: 67015 - DNA, 1223 bp, Oryza sativa
gaggggacttcaggcaagtgctcccggtcattaggaagggcgctaggtctcagataacagatgccactctgcgcaggtcctatctttgggattgtatggttcaattggagcttgttcgcaatatgagggtgcagagcgacgtgtggtttgcggactacctccttcgagttgggaatggcaccgaggaggtgaaacggatatttgcatgtcgtgcaaagagaatgaaacggacctcgaaaggctcatcgatactgtgttccccaacctaaacgataatcttacgaacccaaactacatcacatgtaggaccataatgtccacccggaatgagttcgtggatcgaattaacatgaaaatgattgggcggtttagaggagaggtggtgacatatcatagctttgatcgaccagaggatgacccttataactattacccgcctgaattcttgaactctctaactctaaatgggctacctccgcatgtgcttaagctgaagattaactgccccatcatgctattgaggaacattgacccagccaacggactttgcaatgggacaaggctggtggttcgtgagttcggaagaaatgctattgacgtagagattgtggtagggcagcatgctggtaagagagttttccttcctcggatacctcaatgtccttcggatgatgagatgttcccctttcgcttcaagaggaagcaatttctggttagattgagctttgcattgaccatcaataaggcgcagggacaaacaattccaaatgcaggcgtctatttaccagagtctgtcttctctcatggtcaactatacgtcacgttgtctagagcaacctctagaacaaacataaaaatactatcgatgccggtagaagacaagaaacaaaagaaaaagtctaagcgtactggcgtgaaggacaatgagaagaaaggaaagaaattgtctaaacagacagcagcatacacaaaaaatattgtgtatagagaggtcctcacagattagaaaaggtatattatgtgactattaaccatccataatatgcttgcttaaattccattctttctgtaatttttatattccaagtctaacatttcgtgtgtttttttcttggacagcagtaaacattactttcggtgggattttggcacggactatatgcaccattacgggtattgtgatactactttttttctggatgatattgatctggagcccttgc

SEQ ID NO: 67016 - DNA, 716 bp, Oryza sativa
gggggtatattctctgggtgattgtatgccgttgatggtgacagctcagtatgggcgtctcccccgcagtttatattcctacatacaatttcctggggttggatacacctccgtatcctacttcggttggagggttatgacaggttatcgtaagaaactcggcaacccggggtaactttgcgatgcatcgggagggcatagctatgcttaggcttagctatgctgcattgttaaaggggttatactacatagtgtatactagttataatatactaagatgttgtatactagaagtacaggaatggaacatatctaaactactgccacttagctataattaggagatgtaggagttagataaatccttagttgtgtgtcactctacccttaagcttaacttacccctgcatagaccttgatgtatataagtaatatataactattagcatagtactctcttatcatatcttcccttgggattaaacaaatacagtaccttagaatactcccgagtgaaatgctacaatggtatatccgtgcgcttgaggatcacatctgtaaccataggaaggcgaagaccgagtggaggtcggcgcggacgctggcggtgcgccaggagctctgccgggacgctgatgtggaggcggtcgacttcgaccctgatgacgacgacctcatggacgaggacgtcgccgaaaacatgccggcgcccgccc

SEQ ID NO: 67017 - DNA, 929 bp, Oryza sativa
agccgcgtgcacccggtccaccgtggaccgtgagaaaaccgagtgggccccactcccgtggacccggtccgcgtgcccctcccctcggctgacgcaataaatccaattttagattaaaatttaaatgaagaaattcgcaaatattcatttaagagcatataaacttcaaatggctataacttggccatttgaactcggaattggaccgttcaagtctctaatttttccttaagaagtcaagaacccatttatgtgctttgttaatgctttttatatggagtttgttagagtaaaagccttttcttttccgttggtcgtgtagacgctgcagcttcggaggatccgctcttcgtggaagttgaagccggcatttgggaaagcgagcaaggcaagacacatcatccttgaacatattgaatcccaatttatgaaattattttgatttaaattattgcatcatcgctttatttaaattcccgcgttatcactgttttatttagccatgcctatttacctttgttatgaccttattattattgttattgttattattaccttgttcaccctaggataaacaaaacccccaactagtggacactctactcgtggtatcactagtatgattttaggtagatgcttcgctgattaattaggtaacattaggtggttttaaaactctagattgtggtaatattcatatcacttggacacattggatttgttggattgttgtggaattggattcataccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaa

SEQ ID NO: 67018 - DNA, 1140 bp, Oryza sativa
ccaccaattccttgaggctgcacgtgatgagaggatcgaaaccatgcactgtcaggttatcacagtttatcagtgttagatgagtgagggacgtgagattgtgagcagagccatggactgaatgctcaactcgtcgctgatattgagttccctgagggaagcagggaagaacttgttgctccgagctccggcctctaccatggaacaccgatcgaacatcttgccacatcccctaatttcgacttcttggagtgaggatagatcatggagaccccctccatccgccacaggaagaaccaggttcttgcagcaccagattctgacatagctcaataagttggaggatgggagttgcaatactgcttcctctccaacctcaaatgaagagaagatcaagtggaactcagtaagagctgggaaacggtttagtagctttgtcaatgaatttctggtaagacgacaatcactgatttcgagctgctgaactgaagggaagataacaccctcttcaacttcactaaataacatgctttcacatcctttgacggcaagtcttgttagggagctgagcttttggagatcagtcaatgaaacgtgtggcatttcttcgatactcatatcttctactttgtccaggttatcaaagaccaaagcacctctgtatccatgtgagatcagcttgttttcttgaagacgcaacaaatctgtcttacgctctgagacaataacacatgtcaacatggaagtgtgaggtatagggggcagtgacaacttggggcaattttcaatctcaagagaacacaggttggggaaccatctggtgtttatgtcttgtgcataggagacagagaacctagaggatggcacaagcagcatagagagattgggacaattttcacacctgatgcttgtaatctttgaaaacaaatggcaatgagctcccccaacccactccacaagttctggcatatcaacaaatctaactttcttcaggtgtaagaaactcctctgtgtaacaccaccaaaatctggtccgaactgacgaatgccagcaatattgatcaaagtaagttcctctagatatatgaattgcccgaaaggtggaagagtgccccagagatgccctctagatggagagat

SEQ ID NO: 67019 - DNA, 1191 bp, Oryza sativa
cacttcaagatctcctgagtgagttaaccacatcaaaatgagtagacacgcaaacccagacctttatagagaaatgtgcctctattgttttgtcattgtataggtattgggcgaaagttgtcttcccaattccaccaggaccaactataggaataactgatagtgttctactatgaatagtaaagttagtcatggcatcaagagtctgattaaagatgttttcccgcccatacaatttatcctgtgtaattgttgagctggtaggaggtcgcttcggtggtaatgcccttcctactgcaggatggataattttgagcaaattggatacaggtgtacatgaggcatgtatgccctctataaccaacttgattttattggacatgtctactcgattgaatgtcaacttgctaacatggtcaggaacatcactatgggacttgggtatatcatgtggatcatcggcgtcatctcgtgcagaggaacaacaaaaacatgaaagccagttaccggtggtatgatgaagagcatggcggccatggatgagcacttgaccacgaaggccatcgtctaccatgggagtggcctcatgggtgccgtcgatctggtcctggatgatgaagtactggagctcgtccaaaacatcctcagcctcgtcagcctgcttggtcaggatttctaggagcacccgtaggccatggttgtttctgacatctctctcttcggccgcgtcaagcagtccttgagtgtatgcaagatcggtcttgatttgctccatgttgaggccaagctctgtactggacacgtacgccgccaccatgccatcggacagctgtgtcaccacctttccgaggagccagctcgccgcaccgacggccacatccatggatggatctcctccgcctgcagatcgagaaagatggtgccagctgcagctggggttaattgggtttgagtgtttggtgctggacgtataagttgcagacttcagattggctctgagtccctgatgattctatttgtaccagtaaccaggcttgattgcttggatgaaacaaactactcatgtttgatgtctgcctcatgacgtcatggcattcgtcacatggctatatgttgattctgtgccaaaatcttcttgttcaatactgtccattgcctccaccaatcttttgtggttggtaaggacatgga

SEQ ID NO: 67020 - DNA, 2915 bp, Oryza sativa
aacaatggcagggatatgcaagataattggggatagctgtgctcaacatcgacatcttcgtcgagacacgaggagggatcaacatgaccattataaggtaagtgatgatgttctaggtaagatcaaatctgcactgccttatttcgagggaaactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaacgatatttcagagatatttatgttcccatgtattatgctgacattttgttcaacaaactgcaatgtttaaaacaagataccagagctgttacttcatactatcatgatatgcaagcttgtttattacgttgtggtttagatgaatgcgaagaagctaaagaattgaggtttttatgtgggcttaacaaagaaattcaggacatgcttgattgtcaaagatatacatctctttctcatttgttacaacttgcttgcaatgctgaaagtaaaatagaggaggacatgaagaagcaacatgctatgtttttgtcttctattactaaccatttgcaggaagtgcataatcatgaaaaggaggagagagacatgaaagagccgccagtcccattgatcacactcaaagtcgaggcacctccattatctgaagagggcatcaaaggtaaacttaatggtgctgaaattaataaaggtgagtgtgttgttaatgaattgaatttgtccacttttcatgctatagcagagcaaccattagtggaaccaactgctgagattcctttgtcacaaattgatttgtttgctgttccttgtgataaagaagagttatgcgataatgcttcacttatatccatgccacaacttgtgaatgaacatgctattcctactgttaattcatactgcactgattttaagcatgttgttcacattgctaataaaatagaggagcgtgaattgagatcttctttaaatactttgggttatgttcagtttgatgatttttgtgagctcgataatttcaaggagaaattatttgctaagtctgatttgccatatccaaccaatgttatatttcacatctttggtgaatataatgatcttggaatatattttgtgcatagagtttacatctgctcggatttagaacctcctgtacatgtggataaaatatgcaagctagagaaaaatgttattgctaaccaaattgtctcgagtttgcctagttttgattggaagaaacaggttgttgtaaatggactacgcaaagagcaccatatggaaaaaccgaggacggttttccgtgaagaaggggaggatgatgtgaccatggctaccacggatgcaaccattgctcacatcatggatgaacaagaagatatcgagatcaagtactccaagtgctggaatccgattcggccacctactacactgctgatttcaaacggccaccgaatctgcatacgacctccgttttcggcccgggagtacttgatggaaagctctcggagccctctttctaacggatccagcctcttctctgaattctatctcgtgtggccagaatcacaggaacaaggtgttgcatcacctataatgggcctatgggcttgtaacttcatttgggaccccggcccaggtggggcccatgtggggtgcgccccaagctggtggagcacgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatatggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcttggttcatcaaattctgcatggggaagacaatatacacaacatgatagctttacacaatccatcaatacaagaaacaatagaatgaaggaagagtgacctccatggttgcacggctacgcattctccatattgtgtgctaatcagccgttcggaagagacgtccgtaagaacgggtggatagttcggaaagaacgtggaaatggtggcaaagaatgtggaaatggtggcttgggctggcaacaagagcttcggttgctgctggcgcaacttatatgatgattgtaactaatcacgattagcgtgatcttgccatgccgtcaaaagcgaaaaaagaacaaaaaattcgttgcctggttgtttctggcgttggaccgtaacagtcagatgttatgtttctggcattggaccgtaacagtcagatgttatatgggccgattaggcccatagcttgtttccttggctatttctggcgttggaccgtaacagtcagatattatatttctggggaataagttcatctgaggtcccttgactttacaccaaatccgattttcgtccctcgatcggaaaaccagacacaacgggtccctcaactatcacaaccgatgcagatcaggtccctcggcggttttaagggcggttttggctaatgtggcgcatacgtggctaatttgactcagtcttcgttcgacatggcattgacgcgg

SEQ ID NO: 67021 - DNA, 1579 bp, Oryza sativa
aatcggattcggtgtaaagttaagggacctcagatgaacttattcctatttctggcgttggaccgtaatagtcagatgttatatgggccgattaggcccatagcttgtttcctttatcaattaattccaagagtgcaaataagcaagcaaaatattccatcaaaatattccttggcgggtgttgcagatctgctgcttggagttaacctttctagtttctaatcaagctagatgtgccacatctgatacagagagagcttcttggcagtgtgaagctctggaggtgctttaaaaattcttttttgaaattcatcagggacaatcacgtttcttgcacaatatcaattattcttagactaatagctcttgaaactctactgtttctgttgcatcagttatctggtagcattttctaccagctgaacacacgattctacgtacattttaattccaattttcatgacaagagaataattccttttgatgtaacctacccgatctcctctctgaaagcatattatctgtttaaattgtaatcccgaacgatcacaattaacaaatcacatctcatttttttcaaccggcaaacattgcccctatcaataaattgcatgatccacactttttatcagtaaaatcaagtacagaaatcacaaatgccagcaacacttctacaggaagacaagagcatgttcaaccagtgccattggcaatgaaaaggaagcttcttgcattgctccttccagtttacattcacatcaaggaaccaaatagctggtagatcagagtagtaaaacaccagtactggctcatgggttatctgcatgatggagtataaagtaagtatagtgcactactagtatacaatagcaattaatatttagcagaaaaagagtgtgcatataggtaaagaaggtatttttattgaattgtttaacaaattggtcaggaagacgtgtgaagaacagatcaaaagcattgtttcttccagggaattgattaagtcagatatgctgtagtaggagactttccctgctcgtgcttgtggacaaccatttgtaatgttcctaaggtaatcaaatcagctatacaaaatataattttcaactccaactaattatgaaactttgccatttaaatttgcagacaaacaaaaacaagttacatgttacgtatactgtatacagctatggccaacttatatgtttagattaattatttttttggcaaattttgctacaagatatcacgactttgtggttttagctgtagggcaccgcacgaagtcacttttggggaaagacactctcaaaatgtggttatttgctaggggacacttcattcattaaattaatatttttgtgctgactaagcgagaaggggcctacttttttacatggcatgaccaaattgccctcatctctttctcttcctctctcttcctccttaacagcgaggccgctactgaggcattgcaacggtgtgtggggacgggcgtgggcggcggtgcatgggcgatgggcgcggcgttgcagcggcgcgtggggatgggcgtgggcggcggcgcgtgggcgatggg

SEQ ID NO: 67022 - DNA, 1842 bp, Oryza sativa
acggcggcgcttgcgctagggtttcgggcggcggcggcggcgcgaggaggaagacaggcctgacagacgggccccacctgtcagcggctgagagagaagagtggcggctcggcggactgggccggactgggccgaggagggagagagatagagagagggagggttttgggccggctttcggcccaaagccaaaaaaaaaaaacctttttcaatttaaattattcatgaaatgcaattccatttattaaaaacacttccttagctcaaataaatcccagaaaaatctaggaattatagaattaagcaaagtatttaacaaaattttatctagcccaattttatattgagatttaacaaattaaaattagatcttctcttttaggcttttaaaatcatttctaataattcctttaaacaacaatttataatttaaggattttaaacaagaaaagcacttaacaattataattagatcattattgtcacgaccggaaataacccaacgggcgttccttacgtgcgtgtattattccttgtcctaggaggcaaggtacaccaaaagttgatacaattcagagtttaacaagcgaaagcgtaaatagttatttattacatgggcagcgacggcccagcacactcaaagacaacgaaaaacagcggaagactaaggcgacgaccacaggcgcttgacggcaggcacgagctagacaccaaagccttcatcctccaggggctcctcttctgggtttgggaaaaattgaacaagactgagtacaaccaccgtactcaacaagacacacccacaagtgcagcataattgcaaaggagtacaatggagttataatataggggttagggttttgcaataaacagcatttaaaagacccttagttgctcaaagctaaatttaaaacacgatcctagaactatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacaggcggaagacgtgacatagtttccaacccatcctagccatagacaagagtaccgacccaatcccgcctacggccggaacccccgggacaggcaggcaggactgagcccctagcagcagggcaccaaccctctgccatgacatctcgactaccgggccgcagctcgtgtagccttcatttgccctggagaatgtccatcgacccccgacttcatccatctccaatccgtgtacttttgtttaaaaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccatagtgtccaaatgatatgaatattcccaaagtctaaaattataaaaccacctaatgttgtcctattaatcagcgaagcatctacctaaattcatactagtggaaccatgaatagagtacccactagttggggttttgtttatc

SEQ ID NO: 67023 - DNA, 3049 bp, Oryza sativa
tgtgggtgtgtcttgttgagtacggtggttgtactcagtcttgctcaatttttcccaagcccagaagaggagctccttgaagatgaaggctttggtgtctagctcgtgcctgccgtcaagtgcctgtggtcgtcgccctagtcttccgctgtttctcgtttgtctttgtgtgtgctgggccttcgctgcccatgtaataaattaactatttacgcttccgcttgttaaactctgatttgtatcaacttttgctgtaccttgcctcctgggacaaggattaatgcacgcacgtaaggaatgcccgttgggttatttccggtcgtgacacaccatcacctgggacgagttttcatctgtattcaagagatcccatgttcccgcaggaatgatcacactgagaaaacgagagttccgctacctgaagcaagaagatttgaccgtcacagagtacctgcacgagttccatcgtttggctcactatgcaccagaagatgtggaaaatgatgaagacaaacaagagaagtatctccaggggttaaaagatgagatcacagtgcaactactcctagaggaatatgaagattttgagaaacttgtggacaaagccatacaactcgaaagtgagcataatcggatgaagaactgtaagagaaggattgtcagcatcccagtattcccatgtggtaaccaaagacagcgcacggagccacttcagatcaccggatcttctgttgcgcatcaagagtttccgccccaagaagatggacacaatgcagacaacaacattagcaatactaatgatgatgataccaccaacaaccatgcttcttgccccattagtgaccactcaaatcaagcgtgcaatgtcaacatcattcaccaaggtgtcgacgatagtatcaatgatggcacccaaaatgacaaccctagcaattgtgactctgagaaagactccaatggtgatagcaactatggtaccactgatgccaatgttagcaaggatttccaaccaccaattccaactccaagtcagaatgatcgtccccagacggatagctcagcaaagaagacgttgatttgctacaattgcaaaggaccagggcattactcgagggactgcctgcaaccaaggcaaagtcgatctccacattaccgccaatttacacgaagcagacatcccaatcgtattgtggtcactggagcaaacgccgtacccgtgaggcctcgtgttaatcagaacccatagcagaaacaatgtgccgatgctaagcaccttttcttttaggcagtgcttagtattcatgtaatgagggagaaatgtgtaatacagacaagttctatgagggttcttttggaagatgtggatatgtgattatgtgtataattgcttactgataaaggagacctagggtctcatttcagacgaactatgttctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcggatatacctgcaagcagttaagaagatccaggagacatcaatatttgagaacatagtagtcgatggttggtaattaatctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccctgaaggtagtcagtgcagctttttgacgaaccacatcaaggtttcactgaaaggcagcaagccaaaggatctcatcgtccccagaagcgtccgcaatccacattaaagaataccacctgttagaggtaagccgaaagatgattgataaaagagattggcaaagatgttctctagcatgaaagaagtaggccgaaaggtgattgataaacagaaacatgctctgcatcgctcacggaagacccctgattgtaattgccccgcaacagtcaccttgtcattaagtaagcaagatgacctaggtaaaagtgtttctaggaaggcaaatagtgaaatgtgcaactcggtatcagatgctacacggagtgaaaagtgcaagcaccggttaccaggcaatgccatttcttgggagatgatccaatgggaaagaacacatcaaggttaaaggtgtaaaggaatacgttgaatactaactgaggacaacctgaagatgataatgggaagtaaactgaatgtaaagaaagtgaatccgagttgcttgttcgtgagagctattcccagttatgaatcaagtgatatgttcgaagataatctacagaggtcagattaaaatcacatctaacaacgaagcctcagatttgacaggataatgattagacaataacaaatccagcagtaaagccatttgggaagacgtcaaagcatatcaagtgggataagttggttctcttgggaagcataattcaaaggcaaagttatcgacccttgcatcaaatagcagaagtagctatcacccggagaccaggaaagctaatatgaggcagttggtggcgagttagaagtaaatgacaagcatggtattctcatgatgacaagcatggtatcttagtaatgacgagctgatctcgacgcatgacatgaagcgggtaacttgtatgaggttgacgccaaagatatgaatgataagaagttctagaaccgaagccccatcctcaaccaccgcagcctagtctgggtcagttagaagttcaaccagggacaagtcgggtgaagagaagattccatctgcaacaggagatcgagccaagcgttccagagtggagaagtcctgttaggcaagttggttatagaagacggagcggaagaagtcagacaagaagagaagactgcccaacctatcttcatgctagcctgctcgaatctcggggaccagat

SEQ ID NO: 67024 - DNA, 2776 bp, Oryza sativa
ccgagaggctgacgcgtgggccccactcccgtggacccggtccgcgcgccctctccctcggctgacgcaataaacccgattttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgcttgttgtatggagtttattagagtaaaagccttttcttttccgttggtcgtgtagacgctgcagcttcggaagatccgctcttcgtggaagttgaagccggcgtttgggaaagcgagcaaggcaagtcacatcatccttgaacatattgaatcccagtttatcaaattattttgatttaaattactgcattattgctttatttaaattcccgcgttatcactgttttatttagccatgcctatttacctttgttaatacattattattgttattgttattattaccttgttcaccctaggaaaataaaaaccccaactagtgggtactctattcctggttccactagtatgaatttaggtagatgcttcgctgattaattaggcaacattaggtggttttatgactttagactttgggaattctcatatcatttggacactatggaattgtttgattatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtctaatgggtaaggcttaactcggtgctcaggctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctgggacccaggtcgggttgccagttcggtccgaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattattcccttgtacctcccttgcattaatcatgcatctgccggtgtggcttgctgagtactgtggttgtactcattcttgctcaatccttcccctcttcagtaagagaagctttggagaagatgtcttagggggagtcctggcttataccccagttgagcgcctgtgaagatggagccgtaggcccgctagtccgctgctgtttatttttgattgtcaggccttaagtgcctttgtaataatgtaaatattgtcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacccaaggacatattttataaataaaaattatttgcgaaagttcctttttctccttcccctaatgctatttgcaaaaggtttactccgttcttccttcttcggatttcaactagtactagatggtcaggtcagtgaagaagaagacatcgtcagttgttcgccgaagctccggaagactgcaggatctgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgtctaggttgtttgcttaatcaacttgcagatagtgcctaacatacatcataacagcaaaagtacttatatctgttaaggtcctatccttagtttctaatctgtctctcccctttgttttccctctctccctctccaaacctttgcaacagatggctgacaatgagaaaggcaataaggtcagaagtcaggacattggtacctcaagctctcgagtgaatgaagcaccagacaccagttgtgtgacagtggtccaacacctgattaaccagaacaaattgcttatagagatactacagcagcatcagacgccaattgctgaacctgagtcagatacaacctcaagtgcagttgcaggcagtccaagcactcacaccacgagtcagc

SEQ ID NO: 67025 - DNA, 2409 bp, Oryza sativa
acccaagcacacgctcaatgcgcgtcttttgctgttaaaagaaagatcatattaacatagattacataaaaggaaaaacatttatataaatggttatgctaatttaataaggttacgcaaacctaatttgagcatatatcttcaattggcaacagtcactagtctctacttactcttaggtgagtagatgatgaaattagacatgcccaagcttcccaaaaacattcctctaaactttgttggttcttcctgaaaaataaaccaagatatttcatcatacttttatgcttgtccaattattacagagaggtttttttaaaacaagcatacaaataaaaggagcaatgctagagaacggagaagattaaattagaaaaatgcaaactctttaaataaaaataacagacctgaacttatgaaacaagaatcccccaacaacaactagtgaaaagcacgtaatcatcaaagtaatgatagacctgccaagataagtcagtataaattatgaaattgatttaccatgagctaaaaatatattatgtgtaaattaggaatagacaaacttttcaggatgtgcaaaaagtgaaagtccagtaatgcagtaatctgccaaaagaagcatgaaaaataccaaacatatatgtctaactgctcaacttacaaggcaatgttccgttcaagctgtgaattgaataggtagtacaagcgtgaaatgctccatcggatatcaggcaattgtggaaaactaacatctagcttcagaggaacaggttttttcataggatctgatatgcatgccaatggtaaacttgtaatgttgtgtgacatccaagggagaaattttgtcatcaactgcatctggccaataacaattttgtgtagaacacagaatgtgatgcttacaacagtaaccacgttgaagtttccctgaaaaattatgattatgaaacattaagcaagacaaaggtgtttttgtatatcatccgttgtgaactgcagctgaagggaatactgaatacatatggaatatatttcaattgaaatcgttgcttcaaaaggcacaaatcaactgcattatttctaattatcgattattctcataacgaggagttagatgaacacgtcatttagcagtctctaatccatattccaacaaaggaagcatggaccaatctaaacctggttggtccagaaagcagtagctcacaactgttattcgtcaatcataagggcgggatttggttattggggtctgattatgcatttatgtgtataataaaatcattcttgtggcactgccagtgcagaaccacttaattagatgctctgtcaaacaacccgacttcaccaccattgacctataaagcatgtattctaaaaaacacatgccaccttaatctaccaatcaaatttttgcattgccatcataaaattcacatgctggccctggtgtctatcatcatcacatcacaattcaaaaagaaaaagaaaatgaatgatgtaccggaaaaaaaaaatcacctcagcaggaaagcttgggttatttccggatgtggaagtggttggttgttctagattaccattagtcaccttctcattcatccccattgctgagtcgaacactcttactagtcctggccaacgcaagcatagaaataaaggcatgcgtaaaaattaaattgataaaatcagaacatggttcggtcaccaatttcgtttaaataaagagagaaaacgttagaaatccaaatagcagacaggaaacgcgtgctgcatttgccgcccacgaacctcgcttgcttgggagatggcccgcggagcggactccgactccgattccaccaccgcgataaacgcgaacctgcccggggaacgcatgaaacctaggaggaaaaagaaaaaaaatcagagacgcggattcagatcagcagaagatcaaaaaaacccttgtacacatgtagtaacagtgtgtacctgagggccagtggcagcgcggggcggaggcaccgccgggcggcgggcgcccgcggcggcgacgagacggcggcggcgtcgagctgcgatctcatccctccctcctccacctctctcgctgctccaccggcggcgaggtgctcgcgcggcgcgggcggaaggaccgaagcagttgagcgagagtggcaagcgaagcgaaggcgttttgacttgacgaaaaaagcagtggagtctcgaagcagtgtgggggagggatgagggggccagcgctgaacacacaaatattttttgtgtgtgatcagtggatcaagcggattgggttctcttttttttttctgtgcaaatattttttttcgtcttcagagttcatactgtacagaaattcagcgaaaatgaaaatgaaaaggataagaaggacgacggggctgcaggaat

SEQ ID NO: 67026 - DNA, 1916 bp, Oryza sativa
acagaaggcatcaaaagctggcagcataaccaagtactaatacatgaactcgatacagtaacgaaccatggaaggaaacacatcaaaatataagcagtgtgtaagaagagattagtagacggctatgcagtacttctacttggattttcaacggagcttcatccataggttaatggagaagcaggtcacccggatgagttcatcggtgtcagtggagaaaacggttgcaggagttgttgttgggcacgtgcagacgaagaacccctcttacaaggggctgtttctttggggcttggacttcatgttatgctggccaagcccgagaggagagcagaatgtacaaaagattgggaatctgggatcgttgcagcaagacattcttccatgatcttgagttgcctttgcccaacatcgacagccttggttccgttctccattgatttctcctgcaaggtagtaacaaccaatgtcttaagtcttaacacagtcacagaggtaggagtattggttagaaggctacagtagtgctcactacagaaacataataactcagctccatgattagtatggataaataagggagcatgattcacatgcaaggataaaaaaataacatctgctgaggtttggaggactcatgctgatagtcaaaggtaccatgttgagttggactaatggatcatctagtgcaaggacaacatttaggcataaggagatctccattttttacttgaacataaggagatttcttgcagatagtacaaacaagctctccttaccccccaaaaaaggatcataaatacccaaaagaaaaactaataagctgaatggactaactacatgagcagagagaagcatactacatgcaaagcttttatgcaactcttgcagattcacattcataatttcatcattgaacctgtaatggtgtcatagtatacttcagaagaggggttttgttgcggggatataattcagaggcttaacattcataaatgaagtagggcctatcatatgcatttgtcatgatcagttgaccaccatcagcagagttcttaatggttccgcacccatcatcaaataatccctaaataaactttgccactgaatggatgttgacataatgatgcagtatgtcaattgggtaatgttatttacattcacatcattataaattatgttagtaatcagattcttacaagcttaaaatgccgaccctaaaacaaagaaagatcactacaggaaaatgtggccccttcatacactatgttcaggctagttaattaggtccatctcacagagaacctcaatccctattgactcaacttacaaaaccctgaatttgcctacaatctttatctctatgacaaattaagttgttgaagacattaaattatataaaagttttcaatgctaagttcttacgaggcttgcaacatttattcctgaatgattcctactgcattttagatttttagttcactaatcaactaatactccacagccaggaaaatccaactgctcttccatgaagttccaatatcaggtaaatctgtggatgatcgaacccacctataaaatcatctcaaaccttatcaactaataaagcagcaatcaattcgtcttccagattggaccatcctaaacactcccaatgccaacaacacaacctgctcatatcataagaggatggcacaaacagatactaaaatgctggataacatcttcgtatgagaacagtagccaccataccaaaccaaactgcacaaatcgcattccgcatcgcaagcaaacggaaccccccccccccaaactacaacaacaacaacgcgtgcctcccctcccagaactcctctcaatcaatcggcggccaaaccaaaaccatcgcaaaggagagcaacatacctcggagccgg

SEQ ID NO: 67027 - DNA, 1058 bp, Oryza sativa
aacttaccacccatgtcgaggacgacgtactgaatgcccatctcgcccttctccttgcactggtcctcctcgtcgtcgatccaccgcgcgatcctgaatgagcatcacaagtcgaccatggtaagagatccaaatttttttcaagctggacacgaggtgagtgaatctgcttgctgaattctgttcatcttgctcacctctcacgcaggtagctggcgttggtgaagtagatgggcgagtcgacgcggagcacgagcacgccggggaccctctgcgcggcggtgtactggtccatccgccggtagatcatcgtgttggggatgttcccgagcaccgtcgtcctcggccgcgccacgaacagcagcacgcggaggatggagatcccgacggcgacgacgaggccgatctcgacgctgccgaagacgacgccgaggtaggcgccgaggcagacgcagaagtccaccttgtccacctgccacaggtggacggcggccgggtagtcgatcagccccagcatcgccgacatgatgatcgccgacagcaccaccagcggcgtgtagtggaacagcggcgtcaagaacagcagcgtgatcatcaccgccaccgacatgatcacgttcgacatcgccgtcttgcagccggcgttgtagttgacggccgacctcgagaacggacctgcatacacacatggtatcagaaacccagaggtctcgagttcgaatcctggctaccacgaatgtgcataccggtggtgaggtagcaagaggtgagtgatcccacaatgttcatcgttccaaacgcgatcatctccttgtttccgtcgatgtggtaattcttgaacattgcaaagctccttcctacggcaatcccctcctgcattcgtagaaacagacagtatacatcagcactccggtctgatcaagtaatgcagaactgcaattaatgtctgcagaaatcaatcgatttttcaagcttacagcgagggcaatgacgccagtgatgatcccggtcttcagggccagcatcatgtacggcgacgagaagttcaggcttgtggc

SEQ ID NO: 67028 - DNA, 6340 bp, Oryza sativa
  unsure (1)..(6340): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnaataatagtagtattagttcgttgttttacatggcgccgaagaaatgaagaatagacccggtcacttttgttgcacaccgcctttttaccaccaaactctatatataaccaacccccgtcctgtctctcttccaacaaacctagctagctaagcttcaatattaatttcttcatccattttcacgtacgtaggcagccagcttgaattcttgtctgccatctctgaaacaaatctagttagtaacttagtacagtagtaactgcagctgaattcgatcatggcgtcgtcgtcggcgatggtgagggtggtggtggtggccgtgctgctgatgcaatgctgcaacgcgatcatggcggcgaggctgctggaaggtgacttgtttggcagcagctggctgcagggcctgcagggcggcgtcgccaccggcgagctcatcttgcaggtccttgacaagggcacgtcggattcggaaggcaatggttgtcaccaaggtcccggaggcggctccggagccagctgccaccaaccgtaactagccgcgccggcgcgccgccggccggccaacgcgcatcgtcccgtccatgggtggatcgcggccggttttgctcgatcgctagctgcagctgccgtgcgagctgttaacatgtagacatgaagattggagatcttcatagacattgatcaactgttcattattggttaaatttattctttttcttcttcttcttttatctgtgagagagcttcatccatgcaaaaatgctggaaagcctcgcaaagctagctgttcatccatgtagaaatggagtagtttagtcagtttaggattgatttggaataattaaggtgatcctgacagctactagctagctacctctaggtcctaaaaatctgtaattagtcatgttggatgcttgatatatacttgtacgtacgtatagatcgatcatggagtcacaatgaaacaagatgctactcctatatattttacctttcctgttgattcttaatacaacagcgcaattcccttttatgcatggtttactccttgattctcactccttcaacacacaattttctctttttttaaatcagaagaaaaacaacgcactattatgtactccactgcatacacgtacacccacgcagatttactgccactatcaatatcttcttataaaagagtgtttactaaggtcacgaatttattttttgcaaataccctcatcgtgccaccttacctacccatttgtattttattaattattccttaaaatttttaatatcaagaaacaaacaaatcttaatgtatagccgcatgtaaaattaaataagacgaatattccccgtaacaaaaagataggcagtacatatttcgtaagaaatatatttttatgtattttagataatattataatatattttcttttagtatgcagtaaagtatggatattcaactagtttatatgaaaagtatactcacgcatgtttatatcaaaactaatgtattatcaataccgatcgtaacaccaaccgagattaaagatcataaagtcccgttgaagtttttaactgggactacaaatgatctttagtcccggttcttatttgaaacggaactaacgtgatttttgcatgacccggtaaagatcacttctccagtagggctagctaactctctaatatcgattggatgatcagtgatgagattgcgtgcgtaattaattaacttcgtcgtatacaaagctagctagatcagtcagtccagtcggtccgatcgatcataacaatcggcggctgactatagctcgttgaatacgaccctctcttgctcatcgatccattgaaatcgtctcgatcagccaaaacgtgtagttagttaattaagtacatatttacatgcaagccgggaagtacgggtcgaacgtacgggagctgacgcaggcaaggaggtcaaacaatcgagttcatgatgatactattttaaactacttgatgagaatgtagttagctaacgaacagcgtactgtacgtacgaattgaacctggctttaattaatttgttggttgatcgtatctcaaaatcccttgaaatggcactactacagtagtatacttgtcaatgtcaaacgtaggaaattgaattaaacgagaccgcggcccgctcgcacgctatcgctaaaaaaaaaaccgcgtttttctttttgttccgcgcgcgaggcgagactgacaaatcaaaagcttaataatagtagtattagttggttgttttacatggcaccgaagaatagacccggtcacttttgttgcacaccctttttactttcaaacgtatgtacacagtcaccaaactctccatatataaccagcccatcctgtctctcttccaacaatcctagcttagcttcaattcttcagccacttcaattcaaggaggcagccagctcttgaataattcttgtctgccatctctgaaacaaatctagttagtacagtattatagtaactgcagctgaattcgatcatggcttcgtcgtcggcggcgatggtgagggtggtgctggtggccgtgctgctgatgcagtgctgcaatgcgatcatggcggcgaggctgctggaaggcgacttgggcagctggttgcagggccagggcggcgtcgccggcgagctcatcttgcaggtgctcaagggagggtcgccaccggtaggcaatgattgccaccaaggtcccggaggcggctccggagccacctgctacccgccgtaactagcctcgccggccaccggcgcaccggcgcgccgccggccggccggccaacgcgcatccatgggtggatcgcggccggttttgcttgttcgcgtgcgagccgttaacatgtagacatggagatttggagagccgagtagagatccactgttcattttggttcaattcctttattcttttttttttcttccctgatgtgtgagtgcttcgtctgtccatgcaaaaatgctggagcctctcaaaggtagctgttcatccatgtagaaatggagtagtttagtcgatttaggcgcattgatttggaataattaagggtgatcctgacatctactaggagtctaggtgaaagtctgtgtaattagtcatgttgaatgcttgataattgtatataagaatcatggagtcacaatgaaacaagagatacactcctatatattttacctttcctgttggtttcctttaatacaacagcagatttcgcttttatgcatggtttactccgttgattctcacttaaacacacaattttctctttttataatcacaagaaaaacacacacactactactccacatgcacacacccctacacaaatttactgccaccatcaatatcttcttctagcagagtgtttactaagatcacgaatttattttttgcaaaaacccacattgtgccaccttacctgaaaaacttttttacaaacattaattggtggtgtattagcaaacgatatatatatcggtttacgatgcattgccactcgaaatttactccttaaaccttttaatattaaaaaaacaaatcttaatgtacagccacatataaggtgaatattggcctataactaaaagatagataacatatttcataagaaatatatattttttattttaaataatattataatatattttcttttttatatgtagtaaattacaagtattcaactagtttatatgaaaagtacacttgcgtgcgcgtgaacgtaggcataaaaaattagaaacttggtgaatggagccatacactcgcatcacaagtccatcacgtacgacatccgagatgctttacaaaactacaaatagtatgactaaactattgaaaagctacagataaatttattgagcttatcacgaaactatagatttaagacatactatcccaaaattacatatttagcactaaatctatcataaaactatagttttgcgatactctattctaaatctatgtaatttcgtcataaattttgtattaataaatttataattcagttattaagaatgtatctttactgttgatcaaaatatattgttttgtgaaatttactcattttttatcataaaatgttggatgaacttaaataatttcaatataatataatcgttttgatattatcattctattgctattgtgccattctataattctcaccccaaaaatttatatatatgtggattattaattgtacggtgtgatatattaatcaaaactagttgacgtggtaggcgacatacccgtcgacagcgaggcgcctatgataacttcgtcaatctccaggatttgccgtcccaatctttgaagatgctcataggggtagaatttgcatgcgtgcgtttataggggtgagtgtgcatgtgttgtaagtgtctgcgttgtactgtgtaattataatagaaaatattaatcaaaactagttaacctattagtttatccgtgtgcatctaacatgcaaatatcacgcagccagcaagctggccgtctagtctttatgttaacgtaatggcttgacgttggacttgatcaacaatatcaaaaaggtcagcatatacgagccgtggccacagaatgcattatataatttgaattgtttcagtacggtacattatataaatgaattaattaattattagaaatttgatgaattaatttgaaaaaaaataagaaattccaacgaagaatttttttgataaaattgtattatttcaggagtttcggaaccatactttcaacaatccataatccataagctataaacaacgcacccttaattcacagcagattatcccgcacataagtactcgatcctactgtaaaaccataccgtaaaacttcttcacattaaaagaattgggtaacgatacagtaccgttgcccaatcatcgttagccaattatctctcaatcatcgttagccaattcttttatttcacttttagatgacgtagtaacaaccaatgtcgtgcttaaatgtatgtgattttggattttttttttcagttgaaacttttctagagggagttaaggggtttctcccatcacttatgtctctatttttttatcagaactcaatagttgtgtgtctaatggctgtggccggagatgtaaacaatttttattatctaaaataatgaataaacataatgagaaaaagatcaatgtataaaattaaagattgtacatcgatctttttgcgagtcatatgtctatttcacccgttgccccgtaggcttgttaattaatttggctggtcaggcattttgactctccagccgagccaaaatgttcagaccaggaaagaattgacttcagacgtacatgctttgaataaaataaaataaactttgatttgaaagattcaatatgcagtctttggaattagaccgactattcacatactcctactacgtactctgtacttacgttgaggaatctaaattcagacaaaaacagtgaccggccagtatgtaagtactactacactatttgttcatttttcatctagtgatgattgagagatgtgtcaaacaaatgaccgtgatcaagagaagtacttgcagtcaggtgaaaatttaatggacctaatccaagtcattacaaatcctagctagctaggcacacaaagcaaccttatgcttggaaattgaagcagtacatgatagttgatggtggcagagtcttggcatgcctactaatcctttcggtaaaatttgacggctgcaggcagcagaccattgaagcacaactgggatgaaaacggtacggaaacgaagtgaaaccatctttatcgttttcgttttcatatttttttcggaatcagaatcgaaaaccccggatacgaaaacggaatcaaatattatcgaaaccgaaaacgaagcaaaaatgaatcggcgcgaatacggtgactaaaatttatcgaaataaaaaacccctcaaactgataaatccaattctcaagtctcaacggtcaacaattcatcataaaacataatcatataagtttaattgttaagtctcaaacagtacatcacaaaacacaatctatgaaataaattatctatatttaagagagtaatgttgttgataaatcctaatgcagaaaaaaaattcttatgcaacttcatatttgcataacaaatatttttttaaaaaaaataaaagccaaacaccatggtattcactattcagtacttaaaaaaagaatccag

SEQ ID NO: 67029 - DNA, 12224 bp, Oryza sativa
  unsure (1)..(12224): unsure at all n locations
ttcgttcgcatgaaattgtaaagtatggctgcagtcgagactcgcgagagtacgaatgcatgactaccgtgtagaagcagtagcacaggcttgagtagtcacaggtttttggtgtttgttggtgatcgatgcactctacacgtacgacgagtcactgccgctgcgtgaattgaaattttgaatcgcggtggcctatcgagcagggcacgactgcttctacctctacttgtgctccctatagttcctcaccggcaagaacggaacgagagacaaaacgaaacgacttcaaaagttcaaaccaaactctgccaattctgaggcgacatacgtgcggagaagatgggcatcaagcaccgcagcttcaccggaattagccgggatgattgcaaagcgacgtgtttcggctacgttcttggaacaaacgggtgctcgtgtgttgattaatttggttcgaggagtagcagatcgcaagtacgcacggcacggcacgaccactactcctgctcgctctgtcccattaagaaaaatactttttttttagtttttactccctcctccgtcctaaaataaaataaatgcagttttgcactattcacgtacaacgtttgaccgttcgtcctatttaatttttttttctatgattagtatttttattgctattagatgataaaatatgaatagtactttatgtgtgactaaatatttttaattttttcacaaaaatttcaaataagacgggcggtcaaacgttgggcacgaatatctatggttgcacttattttgggacagatgtagtatataatgttttgacactgtcttatttgaaaatttttatgattagtatttttattattattaaatgataaaacatgaaaatgtttgatttatcttcttcaatttttccatattttttaaaataaggtggtcagtcaaacggtgcaatgcatataaacgtttctttgtgggatggaagagtatagtgcaacgaatggccaagggacctgaaaaccgaaacgatcaaggtcgcagggttgaaacttgaaaggagaggctgaaatttggagtacacctggcagatccaccacggcgtatttgtttcagcggtccattcagacgtccaacaccaacagcacgttggccgcttaccaggactccaggagattttgcagatgtcaacactttgttacagcatgattagaattctatggaatcccatgttcttgatgcaggttagcaggcttttacgttaagcagcacagaaatactagtaacatgatctttatgtcactttggaagatgcatttgagacaaaagaaaaaaaaagaagaaaatatcaagtcaggttatcaaatttaaaaagattgacggtggcatataaaacctgttattgacacctgtgctgtacgtgttcgaccagaaaaagaacacgactggaaaatagcaattcaaactatagtactaatcaagactgaagattaaaaacttgacctattcatatgtctgtttagaaattgaggtggaaggtctgacactggcagtttccaaaggacattttcagcagcgcaatgacaatttatttacaaaggcaaacattcctaaccttaatcagctaaaatccttcagccttctcttcagaacatccatggacctcttgcgagcatcctgcttgttgcggtttgaaaggcttccaaacaacccatctgcaaaatccttgtacttgtcacaaacgatggcaaccttcttgtagtctaatgacccatagttcctcccccttatcactggattcatgaaattctctggctggctgctaaggaggagattgactagctgccttatttcaaccaaacaatcggcgaatgttgtttccttacccaaatccaccaaaccgccctataaaatttctcttccgcgaatgcctccagtaatttcaagtcaatgtcaaggcccataactgcattgacagtgaaccttttcacgccttcgttaagaagtgttgtcatgatagagtccgagatgtggctcattgcaccagaaaccatcttgtatagagcttctagcggtaaaatctcctgcgctgttgatactagcgtttcaagatagataaggacctcattcatatattcatttggattatctggggcttcctccactatccagttgacatcgtccaagagcaccataaattcatcaatcttgaaattggccaaatttatcaaagagttatatgctgcattctgggaggcttttaagacagcttttgcagtcaaaccggaatgagatctctgcgcaatacgctttggaatgccacacagttgagcagaatacaagaggaacatatcgcaggattgctcaagaacagaaatatttcctgcaagttgcatcatctgtgacatggctaacgagcgagcataaaccatgttcagaagactatcatttaacacctcaatcaatagcctgtctaggtaacccttcacaatttcatagatgtttgtgcgagcactgtaagaaaaatagctgacagaatccccaatgaaggaccggacgatacgacaaatatctggaacaccagaggaaaatggagccacatatggaaactccgggactacatcatcaggttcaaaatggaatgccgtgacattcatgttatactcatattccttctttataatcatctgctcatatgagtcattagcaaggatatcatctatctgctttcgactctcaataagaagcaactggtggtatttgtctttgtatttcgcaatgacttgaatcaattgtgcgatttgatagccatacttactaacagttgtgcctaacaaagtgacataatctttaacgaggaggaggtggctggctatactcatgcgagcaaattgatcctccagtatagatgtgatcttagcaatagcagtctcccatgttgattcaacttggctttcagacaacaaaccatcagcacttcgaagtacacgttgttctacaatgaaaaatccagctacctgagcaagtaagggttgatgggactcaaggaagggttgagaggtggagatttgcatgtccaagttgagctgcattagcctattcttgtagtaataatctcgaaacttctccccaataccaaggcatatgtgcatgtgatgtgcccggtacactggcgtgagatcaaaatttagtgttgattcctcatctgtattctccacatccaaggtgtacacatgctcatcagatctagcatcactatgtgcttcagcctctctcttccgggcacgcatttcctcatctttttgtcgagccatagaggcctgacttattgagacctgtccaatctgcttagccatccttctgatatgaacaagccaatcattaaactcactgcaaactttcttctcaatgtgcatctttatcaatggtatatgttttgcaactaccttcttcagaagtttcaaaggaatatttttcaagtagcccttctcgatcgtgtcgagagtcttaagcgcaggatgaaacttagcttctgcaatataaccattgcatgccatgcataaactgatgactttcacacatatcttcaacgttgttatggcttctcctatgtttttcttaatcgaatataactcaaaaagctcatcaagattcaacaatgtggcactagaaaccttttgcaggtgtatgttctcaccagttagcatgccctttagctcatcagcatcaaccaacacaccacgtagttcatcgacggccaggatgaaatcctcgtaatgaagtctacaaagctcttcgatctcaacttcctttttctttacaatactcctgaggttttgcatgagagcttcaggtttaccagaatcaaatccatgccgaatgatagggcccaaatcttcaccatttgagataaataaagcaaggccaagaccaagacctccatctccactttctattacactcctcttctttggctgagcagtcatgattcaactgtaaaatgaaagcaacataggtaataaagttcagtagaggttggaaattaaaggtcatatgataagtactatcaattataatgtgtagcatgttcagacaaaataaagcaacggtcaggccagcagaagagcctatttgttacttccttcttttaacaacattgtcatgcttttttttttaaggttaacattgtcatgctcatcacgcagacagatcatgttgagttcagcattactttgaactaaacaagcatgaagatcactatacagtcactaaactagtatggaggtcgtcctacagatggtgatattcttgtcatatgaaatcctaaatatgagtacataatatgtacagtccacattacagaaatagatacggatcagcactaatttcgtgcatcctcccttccttggcatttggcagtaaggagcttggcaccttaacattgccccaggaaattttggaaagatctccatcatggcgctgcaactaattggcaacgaaaatggatgcaacaggagaatttcatagagaaacgcaagaattgaatttaaaaaatcacttcccaaaagtatggaagagaggacattgtacaaacagaatatacagggagatgaatagagaatctggagaggggtgggactaaaactaaactcaatgtgattatgcatggctaatttaaaccattattgctattactgtaacatgacagcatgtaaatcattgtcactatcatcaatggtcaatccccataccaattaagaaaataccatacactcaacaccaccaatcaattgaaatgacaccgcatatcaaagtaaccatgaagtatcatcttcgaaattgaacgtaacttgatttattcagattatataggttcgaattaacaagagaagacaggagggattacaaattacctgcttgtgacacgggaatcgtgcagaggttctcaacgagcaagcgatcaaacccaaacagaaaagaacagagagaaaagagtggtgtggggaatatcaaacgacgatgaaagaaagaatcacagggcaatagaaagagatccttgttatcacccaaggcgcagagggaagcaaaaccaatgcaagaacagagagctatcctatgaaattggctgtggctctctctctctctctctctcgctctgcatgcatgaaatggaatacaaaaatagtgagttagccgtgcctctctccgcggcagatcttgactccttaatagcaggaactaagggtgagtttgagagataggggattgagaagattgggaagatacgcaaaatgagataagccattagcgcatatattttactatagaaaatttttaaaaaaacgcatcgtttagtagtttggggagtgtgcgcggaaaacgtgttttctcaccctatctcacacaaacgaacacagcctaaataacgttgtcagatgcagttttttttttttttttgactaacctgtgatgtcgccacctatctagctgatgacgcggatctcaaaaaaccgccatccccatccgttccaccatccatgggtgagggtgaggtcgccgctgctcaccggactaccctggggctcgcgcccactcgccggggcgccgctcctctgcggtcgcaggcgtgaggacccaaaccatggcgccgctgctcctcgctcgcccgcggcacatcgcgctcgctggaccaaaacacgccacctgccgccgccgccgcccgcggccggcgcttcctcagatctccgagcgcaccggatgccgccgccgctcccccgagcgctccggctcgtcgtctgctggtaaactcggcgtcggcgtgcctctctaggatttaccgcagttgagcgttagattaaatctcagccacaaatccaagttgggacggctgtgattctccggatatttctttgcataaggcgtggcgtaggaagggtaattttatcatcctactccgattcctagtagtctcctagtgcaagttaaatcgagaaactgtaagaacccaacggcccatattaatgcccaccgatccctctgtctcgatcccacctccttcgtctccgccgccttttacttgctcgtcgcgtctctctcaacgttcatctgctcgaggtgcatacatgtgatttgctttgctcctttttcttttattgcccctgattctgattctcatatgaagacttgtcgatctaagctcatattttttagataataaaaataatttacatctccgatctctgctataagacacacaaccaataaattttagtacttgaaaataaagccgtaaagtgatgggataaaacccccagctccctttaaacaagtttaactaaaaacatcccaaaatcatagactactagtagattctagcacgtcatacagtaggtactacctcatccaaaatagaataaaaaccccttggctaccgattctaaaaatatagcaccactacacaatactaggatgatttaagttcatgtaggtgcatacatgctattgggaatggatttggctataagttgtaggcgtgggattgtggtggattggttctttttccgcaattagttttgtcgggtattatgcttttccgatttaaggtagaggtaggattggagatggattaatccttattttaccgctcatcgtatgctttttccggtttaagttggaccatgaaagaggaattgaatctttttgtgacttggtttcgaatttcagggtggttggagcattatgttggggtggaagggaaactacttccccaacgaaaagcggcgacacctttatcttgtacttgatgactggtcacggggatacagcattcgcaagatcgatttgtcggttggcaatgacggtgatggggagcacagcatgccaccggccatattcagtttcgaggcaccccgtgctggtcccaagtactttgctggtgcctttgactccaagattttggcaatgcagcccgtggatccccaattcagcttccatcccatggctggtatccctatttatgacgttcgcatgcggagctgggtggtgggccttggccaaagccggattccagttacccccatctacatccctgttggtggaggctctttgctctctctgtcggttcatttcagctgctctacccgccgccagatgacgagtctgatgatcaagaggaggaggaggactttgtatgggggtggcacgctcttcctaatcctccattccagcatgagcatgtcacctcctacgctgtgcacagggatgggcgaactatctttcnccctttntnttgggtncagccattggcggtgagtcctctgccacctttagctttgacacagcggagtctgtgaggaatggttgtatgtggaagaaccatggccagtggcagctgccgttctccggtcgtgcttacttcatcgctgagttggacgcctgggttgggctcagcagaaaacctggcaccaccaccagttggcgcatatgctcaatggatgtgatatctgacgattgcgagaatggccaggcggtgaaatacaccagggaggaactagctactactgtgtctgatcatgagttggtcacgggtgtcaccctcgttagcatgggtggtggaagcaaattctgcgtcgtggagtgctgcctggatcactcagtctcggtgccgtttattcaattggtgacattttctatgatgtatggtaagaatggagaacttacgactggcaatagccgccaatttcgagagtacaaaaacattcctcaaggagttagtagtgaaatgcttgagaatcctgtggcattctggatgtagagaccttgataatgttttatactggtaccctagcgtgtctggaactctgaatccatgctactttataagagcaagtttaatagtgtagccaaatactagctccaaatcatttatagtcaatttaatagccaatagttacgtataaacatatactacactattgatatctggtctcacctgtcatacacacattgcgtcttgcagttcgtgctgcagatggctataaatatgtagcccgttgctcttctctctattcttttatcttctcgatatatgtttatagctaagttataatcagctattgtacttgctctaaatctgaggaaatttaactatttgccactcttgtgacatggcaattaacgatttgccacaccgtgtttatgacatgtgggccctcatgtgtctatgacatgtaggtctagtggcaaatcgttaagcaccactcgtaagagtggcaaatagttaaaagccccctaaatctgcatctctatctctactttatttagttaaaaaatgaaacatgtttgcatcatccgccaccgtatgcttgagtcatttgattttgcttcgtgttcaccttgcgcgtccacaacctccatccgattcttatcaatcaaaaagaaaacaggcataatcgcacccctaatcgcaccatcgagtagagaggggacggcacaagctggtggactcgcacccctaatcgccagtaacttccagcaaacgggcatatcatcatacagacagaaaataactcaaaaagaaatatgcatcttttgctgcaaaatttcaacatattaggaaatgctagcacagatatgatgtaaaattcagattaggctgagttgtactaccaaaataatatttcttttttttcttacaaaatttccaggctgtggtactcacatggtgcagcacttatttcaaccaagagaaggaaaacagcagctaatagtgtatcaccgtgttcaagctacaatagatgcaaaaaggggatcagagaatgccagtcagcgctatgatacaagtttgctggcttcctgtcatgggtttcctttccgtggataccgctacaaaaaaaaattgtccgcccagtgtaaatcagctgctcggaagtagagaagtccctctgagaatgcctgcaacataagctagataagagattatgatgacgctgaaccaatgcacattccgtggatgcttacaatgaaagatatctgaatacagatttgaacttatgtgattctgcctaacaaagcaaataaatataggtccgaaatatcctcccacattaacaacaaaatattcagtattcaaacaagtagatagaattccagcaaaaagagggggagagaggggatagaagccattcaattagtcaaagatgtcacttgactgaattttgctacatcttggcatgtgaaacaaccataaatcaacactacatttgaactatactgggcagtgggaacaagatattattgtgaagtaaacaagttatggacaatactatcattgctccacgatcaaatgtgcattgcaaagaccaagagcaagtgccagtgtaaatggactgtacttacctcctatctgtactagttctgagtaacaaccttatctttagattctacctggaatgcagaagggataacatgtaagcacaatataaacaaatagctacaggcaattctagttgaaaatggatagttttaagaaaatactatcattgtttaaagggtattatcctgcacctcatctgttgtgcttctccgaacttttctagttgcatttctcattgtgacaaattcctctgcagatgttgggtgaatgccaatagtggcatcaaaatcttgctttgtcagcccagctttaacagcaattgcaactccctgtcaaaatgtagtaaattcatcagcagtatgtcaggaataaagctgaaatggagagtaagaatataaaacaatgcagacctgaattatctcaggtgcgtcttcaccacacatgtgtactcctacaactttgtttgttgtagcacacacaatgagtttcatgaaaatgcgatcaggtaatccagagagagttgccctaagtggcctgaagtttgctgtatagatatcaacatctccatactcctcaatagcctgcacaaaatacaaatttaattgactttcttttgtgcatcactttatatagatgcgcgtcgtatgctatacctgctcttcagtaagaccaacttgtccgatgggtggttgggagaaaacggcagatggtacagctctgtcaaatttgtgcaattcacaatcaaggagcatccaatggaacaacaataaccaaaaccaaataaaatttaactgataaacagtgaaatactgaaatgaatcaataatttcagtacaaagtcagtcatggcctcctaggagcttcaaggactactagaacacatcacaaaaacaagaacatcacgacaaatgatcaataacaagataattctagataagcaagaaatcatccaaactaatctgtattagcatatcaaacatggaagtggaagaatggggtatttactcctcaaaatgttccactagagattactgcaagcataaaaatacacaggaatactagcatgtttaaacaaggaaatagaggttatatctgcaatcaagctattcaagcccatctcctgcaaattatacattaggatgtgaccaagtaacaaagttctctaatgaaatgcaacagagatacccgttcactgtcaaaaatatgcagctcaagtgtacactgtacagcaacaacaaacattccctcaaacatgcgatgtaactgaggtattcttgatagggatatcctacatacctgtaatctggtttggtaggttcatcaccaaacactgtttttgcaaatgcaccaccttccataagtgcaactggtgtcaggttgaccctatcagtaacatctcccactgcccaaattgaatcaactgaggttcgagaatactcatcaacctagcaaacataaatacagtgcagaagctcaacatgttaaagagtcgcaaagctgagaaactcgaagtcaagtatcacttgattgattgcttaacctaccattattgctccgttcttgtccaatttcaccccaacctcctctagtccaaggttctacaagttaaagaacaacatcagcaacaaaggatggatgcatcaacaaatggagatgcaagatctaacaaagtgaaaacaaaaggcgcatatggtgcagacctttgtgtttggtttacgacctgttgcgaacataacatgtgagaacccaccaatagtttctttgtttgtcttcagagatagcaaaccatcatttgatttggttatagcttgaggactctgttcagtatgaaatgtgatgccccttagagacatctgttcagcgatgaaatctctgacctgcaaatccacaaccgacaaaaataactccagtgaacagatcacttcatctactgtgaatatgattttgttgttcccaatatttgctcacctcttcatcaaaccctcttaaaactttcttctgccgaataaacacatgtacctcactttttaagccattgaaaattccagcaaactccagagcaatatatccacctcccactattgcaattttctcaggttttgaaggtagatccagtgcagcatcagaatctataacatgctctattcctgggatatttggcatcgatggtcgcccaccaacagctataagtatgttcctagcagtgtagagctttccatctacacttacagtatgtggatcaactatctgtactaagtaaacaaagttacatcaacagctgcaccttaccatagtatttgtttagggaaacagtctattcaaagtttaacttgatttacgaacatcacccaacctttccacggccttcaattagagtaactcctgagttgtttaaaatattcttgtaaatgccaacaaggcgctgcagctctgtatttttgttggcaatcagagtgttccagtcatgctttggatcagtttcatacacccacccaaagccatgagactcttcaaactcatgagagtacttggatccatacactaataatttctttggaacacacccacgaagcacacatctgtgacaaaaacaaataacagttcttatgcatatgcatatccttctaggcactggtattacagcaaggtggtagctattaaaagcatgcccatcttttaggcttcatatgctggtatgttatgccaaactgcttacatattattggaaatctattgtctaatattgtacagggtcattaaaacgcatgggtttagctctggtattcataatgattcaaattgtaaatcccagtaaatactgaaataagccacattatgccggtatagcagcgcaaatcgtgcattg

SEQ ID NO: 67030 - DNA, 6564 bp, Oryza sativa
caaaacatcagcaaagatggaacccgcgacaaaattggaaatgattcctggctagtcattcacaaatcacaaggaagcgctccaattacggtgcatgcaaaaaagtaaagccaaaagccaacgatgctaagttgctaaccttcctacgaatcaaggggaaaatgtgatgaactaatagactagtctatatagtagcaagagaagcgtccacttacgtgccgccgactccaccgaggtcgtccgaggcgacggtggcgaagggcatctcgcagacggcggcgcgggcgccgtagagcgtggaggcgaagcgcgaggcccggaccccgccgctcccggcgccgatggtgaagaggtcgtagtcgtactccccctcggaggacgcgccgttgggcgccgcggacgccgagacgtggcggcgcgcgtgggggaggaggggaggtcgcgggagcgggagcctcgggagggcagcgagggaggggaggtggtggaggaagcggccgcggtggaggcggaggcggagggggatggtgcgggttagggtttggagggtggaggagcaggagaaggggagggtcgcggtcgtcgccatgcctctctcgcgcggtgccgccgctttgcttccgacttccgacagtgtggggcggagagaggagaagcgaaggcgatgatgtgtggagagtggagacgatgagcttgtttgattcctttttccgatcgaaggcgtatttgccactttacgtattcgaagagtggagctgtaaagcctgtatgactgaaggcgtcattccggacgatggtgaatagtttgaggctttgggcctgtttgcggaggttctgctgctggaaattctcctattagctgctactgctagaagcttcctaaacagtaaagattttcacttataagctgttactgctagaagcttcccaaacagtaaggattttcactcagattctgagaagctgtagatgtagaatctagaaaataaactagaagcttctcacaaactgtttctcagaatcttaacctcctctaaatagggtctttgagcacttgtttgaatatggagattttaggaacactgttggtttgccttaattatttgattggaagcaagccgccatgtttcagtcatctctccttttaaaatcctgcaaattcctatggagtatctaaacagctcattttctcaattactgatcccaaataaccatttttttacccgcaagaaaaaactttttttccattacacagcagacgcacaccttaaacttgctattttttttttattgaaagcatgtttacatgtatgtaatatctatagaaaccaaggttaaatattttaatggttggagtcatacaccatccatcatacaccactggtgctttccccaaaggaccttactgatcccaaatgacccattgtggagtcagattggcaaaggctacaccatactgaaatctctgaaacatcctctttctgtttacaaagataacacagcgaaactgtgcagattctctgtccctccacctccaatcaagtcctcttcaacagatgcgtgacaatccacaatttcgcacaacattggtactatcttgtttcgtgaaggagcaaaggacccgcttaacagccaacagaacgtaacaacagcaaaagttagaaaaccaccatccactttcatagtatcatcaagaaacgatgtaccaacagaaggccagcaaaacatacgccgtcacagccagcaccgcgaagaacgcggtgtccgatatcggcgtctgcgtcttcttcctgctggccctcgcctccttgtacaggactacgtccaccatcatccggctgaggtagttctccgacgacggatcgacgtcctgcttgcaccgccttctcagggagagctcaggctgggcaggggtgaactggacgtcgaagatactcctcttacgcagcaattccgtgtcatggtgatccgaattcagagcgtccatgaaggcagcgtagttggccacatgggacgtggtgccctggtagcatttctcgaacgcgatcaggttctgcagcagctggatgctggcatcgctgacctccagctgagggatccgcaccttgccatggctgaagacgatgtcaaggaaggtgaagggctcctggaaatggctcaacggccaccaataccattgctgcctcctggtgatgcgaaccccatcggtgtcaagcttcttggcaggatcaatgccggttcttggtggctttggtggtgtcttcatcagatcactgtgtagcttggatttggaaggagtgaccggtagagcagctgcagaaggcagcgcacgtcctggcagcggattgggcgtgttgatgtgcacattccagctggcaggtacttgttgaacatgttcctcgcgcatgccgtcaggtcaacagctttgtcatgctccgtcttcagaatgtcaaacaggatcctgacagcgacgaaaggtatttggttctctagcaggagcatgtcgatggcgaccaggctccattcccagggtctctcccactggagtgtctcgtactcatgatcgagaagcccagcatccagctttgtccagtattcatgctccgcacctttgttcgggtcatgcctcagcaagaaatgcagaatgaagcagccgtcaaacagcagcatcatgccgattccctcctctgtcatatcaactggttttgcgtatagctgctggaaagactttgttttgattgtctttgacagtctaagcaggaaggcctgaaccaaaggttcaaggctgtggttgctacgctccagcaatctgttgacacaccagtgcttatgttgttccattcgcctgaagcttggtgaatttctccctgaatggaagtagggaccgatgcagacagccttaggatggtaagcctctgggtcgcgcaaccgagtttcttcagggatacgggtgataccattttcatatgaagaacacagcggtacttcacagctccggggagttgttaagcctgaagtttcatcggtatccccatttgcactcgctgtcatcttcctcatccttgtgttctgccctgcatgcatgaatgtacagatgcaagtaattacaggtgagaaataaggaaaaaccgaagacaacaaagaactcacctcttggttgctctggagaagacatctcatgaagccaaatcagaagatttcccgtagttgatggtgcacgaagaaacaatctgaagaaaacttttagtagtgatggagaagaatgtctcctacaaacaacaagaaggttgcctcccacttgatcaaatcaaactcaaaagaatagttatatatggttttattcaatagtcaaaaggcaacatcaaagaactttcctttccatttctttatgcaagattgctacatcagacaagttgactatgtgaatcaactatgtttacaataaacagaaaagattctgcagtttagctgcagataaataaaagaaaagctcaaaaggttctacagctattaaggcatatatgatattttactaaatggcctttatgactttttttttatttccctttgaacccaggggaaagaatgattaacatctaacgtgatacaagacctcatcataatagatgaagctactgaaatttcagcagaacatcaagctggaaattttatgtggaagtgtctccaccccttacaactggctgttcaccttcaaactcagatatcacaatgagttgatctgtcatttcaaaagaaagtagctccaacttgttcgtaggatttatatactgcatggcatacaaaatataaattagttggtggttattaacaacacttgattcatggactgctattcacaacgccaaaagaacctcatgtcaatacaaatcaggtccataaagctagatggcaaagttaagaaggacctgatcttaacaaggtcttatgtacttcgaaaatatcacacccttataaggctacagaataacatagagaatcttaacctgcttcttgcccttgacatagccaaccgcaacttcacgacgcaaaatcgccctttcagtgagctctgaaaatgatatcttctccccttctttcatgtagaatcctatttcctagaaaatgtgcagcaaaaaagttccttgaactatcacaaaaatacaagaattggtcagaaacaccgattgtgctcatattaccttgatgtagatctcatctccttcagcgttcagaatatccttccatacttcattcaactcactacttcccgcaactacatcacattttcttttatcatgcgatagatttcagagaaaataaaataaccaagattgattaaaaaaaaaactaaccctgtgctgttacaaggctcataacttcctctgctccaataaatgagagggatggttttattctagacatctgcaaaaaatgaaaggctaaaagatttgcttccaaattaaagtaatttgatgaatttagtaatagccaacaagcgaattctcacttgctttcccagtcccgtgtctacaatttctgatacaagatgctcaacctgtaggaacacattcagataaaatacaaaattcaattatattttattatttataagaaaactattgaacgagatgactagttgaaccacatcatattcaagaagaaaacaaaatagcattgaaccattcatattttattgaaccattagtaatgcaaaacaacaggataatgattttatggattttagacaaagtgtatcacagtattccaaaaggaaatgtgttgcatgctgatgagagaatggaggttcacttagtgtgtttcaagcactataaataatgggaacttgagaagaactgaccttaatgtcatgtttctggcaaatgttttcagcaaggagaagagtatacgctaactgtttatcaacctgtgcagtatctgcagaatccattagcaggtgaacttcaattttatatataacagggaaatagcatggttctgttactggcatgtaacccatacctccacctagccagtctttgtcagatattacgacaactgaaaacggaacattttggtcatgcttcctggatttcttaaatttaattattgcttcctttagagtatcatagttcataggacatcccacctgcattaatgctatcgcataaaaattagcgaataacaatagtagagttatttttctgcctgtgcaagcatattatcagtggacatcagaggttactattcacatagagggtttaagagacctgatggttaactttaatatttttcagttgtttctgcatgagggggttgacaatactgctccgctctttaataggggtttctgacaatatttcctgcacatcaaagttaacttattagacatgaacatacgtatggatgtggcaatgtagtcataaactcctcattttctactgcagctaatatttttatcgttcctattatccctacacataccaatacactgccaggtccaaggtaattatcatattcccgaatcatatcagtaacttttggccgccaaccaacaataagcacgtgctctcttggtcctagcgtgtaatcattgctctgcatacagtcaaccacttatgaacccagtaatctgacggagaggggatggatttccattggtacatcattacactagcatttaccttggagagcgtttttgaggggcgctttctgatgctatttagccgtgtttcattcacctcaagagccatactagacgatctttgtccctctgttgactctgagtaatgacttgaattttgtgctccatttggagaatttgagaatgtagactgtgctcttctcctccaggaaacaggagcaataagtagtagctgtgaattaaaggaatcaagaatgtatgacatcatcagctacaaaactcaattgtcaagtactatgttctcctgattgatgatataactggaaatcacaaccgcattatctcttgtagggaatgcaggtaattccagtggaccttttagaagaaaaatgcctactagtaaaatattcagaaactaacagatacttaaacttatgctaactttagtaattaacaagataagaacctaatcagtatctatttaacagaacaatggaataagctcactttggtaatggcttaggacggtggttagaagggctttaagacttcaatgaaaagataattcttctggaataatatgttgagaaatgttttctactagttgtcctaacatgaaaaggaaaacaacaacaaaagaaagaaaaacttactttgtctttctctgtcagcacttcatcctcacatgggtgaaagtgcatcattccagatcggaaaataccacaaacaactgcctggtcatgaacacaaagcagagaaatcacgaaaatgaagtcatacagatctgcagagtttagacatccacttatttgaagtaatattacatctgggatcctacgcctcacatccacatacttcatgcctactacttcccgaaagctgaaaaggttgaagacgttttctgcatgataagaacaacataa

SEQ ID NO: 67031 - DNA, 1458 bp, Oryza sativa
  unsure (1)..(1458): unsure at all n locations
nnnnnnnnnnnnnnnnnnnnnnnnnnnnnnnnnnnnnnnnnnnnnnnnnnaagaggagcatgagtacaaaagagttaaagcccctgagaaacgttcacgcgttcttttgagggattatatgactgcaaggaaggacaaaaatgatgccggacagaagacgaagaagaagaggatacccttctgtggttgtgtccgtattaaatcaagaactgagccttaaccattaagtaggtagcaggaggaacatattcatgtcagcccaataggttgacagaacgtgatgctcttaggatctcttctgagatgagtaacactatgatattaacaagaaactcgtgcactcaaatttccctttcttgtcctgaaatgaggcagtgatgtctagtgtaatgagttaatattattaatgctgttattaattgaagcattgtgcatatgtgtttcctcttgtattgcctccatatgattgctgtgaagctaccaagatttgtgtttgtcatgaagccgccattatgtatagtataatgcctcctttggttacacagttttcgctctcttataactgcgtacatatcaatttcatcttttatttctgtactcagtaatgaatatctgtggttgattcagtgtagttgatgataggaatgctggaatagtgcagtacattgtacagatgcaaatgcctgtgcattgtatagtgtcctcttctattacctgatcaaaagcaggaactttgagctctcttgctttgtttggatgtggtgagtgattgagtgccacttatttgtttttctgggactgaacacagatttttggtaagagtactaatctcaatgccttgtagcatgtttgtgttgccttcagcactgcgaatcgattactagtatatgaattttgagctgacacctgatgattttcatttttgccatgtaggcgctcattctctttagacaatcatcatgcaagaatcaagaattcaggatggatatttggaaaaaaggtatgatcttgagtcaatacttcaaagaagtagctccaatgcatctgtacaggctctgaggctcatcattttcgccttgcaaaaaaaaaggtgattttttttcctttgaacttccttgacaacttagtactacaatactcgagatgcttatatttatctcggctttgcttgttgacaacctcaggttgatcaaactcaaccatactacagtaagttcttctccaatcagaccaggttctcatggggtgctccactgcccatgaccattcccggcttctgcgagtgcatcacgaagtcgcactccgccaccgcctcgcccaccgtggggaagatccactcatggccgatcgcctcaagcaccttggagctgtccaacttcttcatgatctcgctccccgggttcgccaacacaatctgaaaaggaaatggcaggtaactgaatcagcctgggttcctga

SEQ ID NO: 67032 - DNA, 6271 bp, Oryza sativa
catgtcaaatcagtactcaaattagtgatgatggcgcgaagaaataaatcagtaaatctaggataatcagctgatatgcatggctcaagaatgtagatgagggccctattttctccaaggttgctcacggatttactatagaaaaaaagttgatatcaccagttggtggaccttggccatttgcaattattgggctattctgtgagcagcccatgacactgaattatctgtcacttttcatcagtatatgcaaagtcaaatgtactggaaaaaaacagcatgatacaaaacttgcaaaattacaacttgcacgcctaaaacttgctctccatcattgcatctcaagcaagacagttttttcattttcagacgcaaaggaaaatcacggatgtagtactagtactccctccgtcccataatataagggattttaagtttttgtttgcattgtttgaccactcgtcttattcaaaaaaatttaaaattattatttaattttttgtgacttactttattatctaaagtactttaagcacaacttttcgttttttatatttacacaaattttttgaataaaacgagtggtcaaacaatacaaataaaaactcaaactcccttatattttaggacgaagttagagatcagtatagaagttgcacgcatgctaggaatattcaggccaaggagaagatgacaatagaaaccttataggggacaggaggattaggtcatcagatatgctcatatgcaagctatccaaaagtgaccaatggatcgattcccttggcctcacgagtttgtgtccttacatacagacatgtgactccaaaacattacatgacaatttctcttaatcatgcctctcaggcagactttgtcagttttgactttggcagtaattacatcttacaagtaagtaaccactaggcaaaagagagactaaccatagttttacttcaaccacaagactaacctaccttagttttcttaacttgtaatctactgtttcagaaatgttcaagctctagaatcaagctgaattgctcaactactgttgccgtcggcttacttgtcccaactcataatatctttggggttacttactacacgaccacacatgcacgaatgcaaaacggaatcttatcgccattaactatcctaattatggtgtcacaaagctaagcttttagttgtcgcaatcgtgggtattagtgtgtggtgtgatttcccgtcatgaatggattctctcgtcgtcgtcatacacactactgtactgcttttaggatgattggaccaggcatttaccggcgattcttatggctaatacactacttttttttttctgctagtaccaagtagtatatccctagatcacacttcatcaaagactgaaagtgtaacatgtgctaattaatatgctatattattctcgagtaaaagtgcatgcatatctagaccttaatgttcttttcttcaaaaaaaaaaaagaaaaagtagtatgcgtctatgtctaattagcttgagttaattacaacagcaaaagtaaagggaaaggaacgagagtgttaagcatggacttacgaagaagcgggtgatgaggaggaagaagaggaagccgcagcccatgacgacgctctcccatcgccactgcaatcaaccaatcagtcagtcagtccaattcagtcacgaccacacacacacacacacacacagctcgtagatcaaatcagcatgtaaaaactaattaatcagcttaattgatcgtagattagagctgtaaaaactctccggttttcatcgcgagaagaaactatagtctagtactatactcctaggtaggagaggtgaccggacagatcgatcgagacgaggttgcaggtgcagggtcatgtccctgtcgcagttacactcgtcgtcgtcctcctgtgtcacctctccccgttgcggacagacagattgccagtggccgcacgacgcagctagaatactattcactccattccaaaatatatcatattttaaaccgataagatactttctataacaaatttaaacatagagtctgtttagatttatcgtactaacataaaatattctatctagacagggttcgtttgaaggacattgagggaaaaagcacctcgtttttcgcacgcacgcttcctaaactactaatcagtgcgctttttgcaaaaattttctatagtaaagttgctttaaaaaaatcatattaatccatttttaaaatttaaaataattaatactcaattaatcatgagctaatggctcacctcgttttgcgtatcttctcaatctcctcaatccccttcttctcaaatacacccctaaaatcttttatattttgggacctaggaattaggcacatgtacaccgacactggcttggctaatgcaaagatccatccgtatacatgcataagtacatgtactgtacatacgtatgtgtattcgaattagatattaaaaaaaacgtgaatattagaaaatgactttatattaaataattagaaaggaggaggttttaaattcaggtcgactagcccatcatcttgtaaaactagtcaaaatcttgtgaaactagtcaaaaagactcctcaacgtttctcggatatatacaggagtagtataatttaatgtgtaggtacgtacgaggtgggtttgggagaagacggagctcatgacggagacgaggtcggtggcggtggtgaagtggtcgaggccgaacatgcccttgagctgctgcaggcacaccacggtggcggcgccgcccatgaacccgacgatggtggcgtgcgacaggaagtccacgatgaaccccagcctcaagacccccagcagcgcctggaacacgccggcgaagaaggtggcggtgagcgcgacgtgcaggtacagcgccgggtcctccgccgccgacacctcctcgctcagcatcgacccgatcagcagcgacgccaccgccaccgtccccaccgccaggtccctcgagctccccatcatcgcgtacaccagcggcggcacgaagctcgaatctgcagccaggaacacatgtcgaacacctggtcgtcatgcatcatcgcatcaatggcgtctaagctagctactgtatgtgtatgtgtgtgtgcgcgtacagaggccgaggacgggagggaggttggcgagcttggcgtagctgatgccctgggggatggcgaggctggcaatggtgatgccggcgatgaggtcggacttgagggtgccgagggtgtacgacggcgcccactccatgaacgggaacacgtaccggagcgccgccgccgcgcgccgcccgcacccgcgctcccgccgcaccaccctgaacgggtcgtccggcaggaatgtctccttcatgttcccccccagcgtctccaggaacggcttcgccgccggcatcggcaccctcgccgcccccgcccctcctccgccgccgttcgccgcgcttccactacccatcttagctcgtcgcactccttcgtctacctcagctccggcgaccgcgcgatcgagctagagcttggattaactaatcttaactgcgcttgtatgtgtgagcgagtgagtttgagatgagcgttgttacggcgagggatatatatagcggccacggcgcggcgagctcgagctcgagctcgagctcgagcgattactatggcggcggggcccaccaccccgccgcgtgtgggtcgcgatcgcgtgacgctgcgccgtgggtcccacctgtcagtgagacgtgtcccggagcccccggcacgcgcgcgtacgtgtggcacgcggccacgcggggggaatgataagttgggcacacgggacacgtcaccggtcgctgttggtgcaggttggcacggggtgtctggctcgtgtgcgaccgagcctgacccgacccgacccgtatgtggctcggctacgcaaatctcccggtttttgcatgctcggttcgtcgattaatcgggtaaacaaacgggttcaaaaaaataatttttgaggggggagtagagaaatgacgcatgtgaaacacaattttcagacgaatttttgttaggcacaaattcagtatattctgactattagccgctacatactccatccgttcaaaaaaaagacaaactctgattttccgtgtccaatatttgactatccgttttatataatttttttataattagtattttcattgttattagatgataaaacatgattaatactttatgcgtgacttgtctttttaaaatttttttataattttttcaaataagatggacggttaaacgttggacactgaaatccagggtttgtcttttttttttttttagatattactcgtaaatatgtgtctggctgagacgtgtgttcatgttactgtcacgctgcagagatgatgattgatgatgagatgggccacctgcatccgtgtgattatagtgccgtgttttgttggcacgttcgtacgtgattttccagatttgctgggatatcattccacagatacaaaccgggtttaactcgtccatctctcgtgtcctaactcataaatatgaccagtaatttgactaaaataaccaaagagcatgtggatatatatagaacatcgtatcaggccaacgtggcatgccacgtggtttatgttgccatttggaacagagagagcacttgtgtgatgacgtaatctcatacatatgtaaactatactgtttgttgcgtgctgaatttatttttttttaaaaaaaatgaaagacaaggtgtatatatatgtatacgtcatgtagcgatcctgcggccagatcgagccaaagaaaagagcactaatctagatactctttctgaaagctaggccaatgcaatccacacaacaaaatcaattaactaataactaccaaaagaccatttaattagagtatcttcccaggagacggcacggatcgacgtggcctaaacacccactaatccaacaattaagacgcacaaacacgtattaaccttttctcaagatcagtggctgctgccccagttggaaacgccttttaaattagtggcagtatgatgataatgacaatgataatgatgatgattaatttgatcatccaaagtgtgtgggtatccaacacagtggcaggcaaagctagcttaagctgggctcagctagtggccacagttgctgcactcgttgcgttgccttcttgacctcccaaaaacaccacaagagattggagattagccccagcgaccgatcgacgtcttaatcgaatcattgaccaccctgcatgagtgcacgtgcatcgggcccagaaacctaataattgaggccctagaagatttgttcatcggccaggccttgtttagattcttaaaaaattttggccaaaaacgtcacatcaaatatttgaacatatacatgaaagtattaaatgtggaaaaaaaaaaccaattgtacagtttgtatgtaaattgcgaaacaaatattttaaacttaattacgccatgatttgacaatgtgatgctaaagtaaacatttgctaatgacgacttaattaggcttaataaattcatctcgcagtttacaggcggaatctgtaatttgttttgttattagtccacgtttaatacttcaaatgtgtgtccatatacttcaaaaactttacaccaaaacaacttaaacacaccctaaccatttttacactatgtttcaaattactcattgttttagtcttttccaagttaaacatgagtatctttaaatattattttttaagaaaattaccgagtttaacatcatgataaactataattacagagttttagtattcactattagcaatattttataagtacacaattcgcatgctagtaaactataaatttttaaatgagttgataaaaatagtaatgtttaacttaggaaaaaaaatgataagtaattgaaacgtgtgtagtacctgttatggtgtacgcgattccacgtcactaattaaattaatagatagcgaaatgcctgctattttagaaatttgaaagcgtcaaaaacattttcgatttgaattcttgggttgaatgattgaattaattgtttagctcaattatcagttagctcgttgtgcaaggcaacaggtcagtgtgatgcagatacgcagcgcagcgcgtgtacgccaccgaaagagctaattagacgcgtatcagcttatcagcgggtcaaagctgcactaaggcgttgacctctctgaccagagctcagaggaaataac

SEQ ID NO: 67033 - DNA, 8253 bp, Oryza sativa
cgtctcgcgatttcccttctaactgtgcaattagttttttgtttttatctatatttaatactccatacatgtgtccaaacatttgatgttatgtttttggaaaaaaaaattgtgaactaaacaggccccaaatcagaggtgccatgctgagaatcacaggagctgttcctgtcagaaattctgctgcacactttgtcaccataaacagaaagttaggcagggtaattaattaataattactgcttagtgcaaggctaataatacagccgatctgctggctataaggttctttatagtcttctctcagcctacccatataatagttagctcttcacaattaatacatggcccacttgtctctctcacagagtttcttggttcttgtgtccaagccggctgttagtttacaacccgcttctcctctctctcctctcttctttcctccaactcagcatttagccggcttatagcctactttttgctcttaggtagaaactggtcagaattcccaatccagatatgtttctgctgctcagtatgttaaattcagagaaatggttacagtgactggagacacctgaatcatgaggtacagtaccagtaaacaattgtgctgaccgaaggttctgaatgatggcaaaaggtaatgtaagaattaaactaaccaaaaggtagtactattttctttggatgtagtatcaaggcagatcaagaggttctttacagaaaactttattatcagaaattcagaacctaatagcatggtgcctacacaagaactgacatcattgacctggtcactcacacaaggcctaatcacacattcaactgcatctgtggagttggttcccttgccaaccttagctactttcagataaaaattctaccttccaacatactaactttaggtttattactgataaatactactacaataagttcccaagaagaaggttcctgaactgctcatgttagtggccggttcccttcatttcaagctatagtgccttttctaatcaaatcaagagaggcttccagaatcaagatcagggatgctaataaaatcagtttgacaggacatggataattactcagtgtttgcacacaaaagcaggtgtgccagaagcaacagggcactcactagcttttgaccctgttgggggagttcaagttttgagaagtagtgggcgagaaactagttgatgagaatatagaaaagttggattttatagcttcttgtttgtagtttattttctaaatttcacaactacaatatataaaaagttgggttttgcagcttcttgtttctagtttattttttataaatttcataattacaaatttttagaataatttatgttagaatctggatcgtgtagaggagctgaagattttagaagaagttgtatctattaaaagctccttaggaccttttgtagggtggttgggagtagaacgcaactgcaaacggccacacaccaacatctccatggatggtcccatggatcaactcacgaatccaaactcatctttgcttgcagaaagaagttactggtccaagccactgatgtcttggcttatttggaatgcagaaagtgttgcagtttcagaagaaaaactgaacaatttgagccccataaaactcttgaaaatcttgtcgttgataaggattagagtacaaccactgatctcaatgatcagacaagtgtccactctgacaagacgtcaagagaagcagctcttgtaatttcgatattaacttctggtttctggaaatgaaattcagagttgtccatcgcccaagaaagtattgacaatttccaacctatctttatatcttcgtatccagattaaatctgaaagaaatacggttttgccggtcattttggtatccaatttacaaggcccacaaaatattcccctccatggaactcaggacaataagttagtagcattctcagaaaaccaattgatctcgtctcttggatgatgaacagaaatgcatggcacaaagcatctcggcattattcaagcatatctgaatcatcatcgcggcgagtcctaaagaagtgcaggttcacatctccacgaggatatgctattgctgctgctttgctttgctgcttgacgttatttttgtcagtgggagcatgtgtggcaatgcaagaacgaactgagtcatcggagacagcgatatgagcagtagcacattgcaggattcttgctcgctttagcttgcctttttcttctttttttttggatcggcgacgagtgctcggctgccatttcatctcctccacttctcgctggattttgctgtgttcttcgtgtttagattctcgcccgccgtctgctttagctagacacgggtgcctgctgctagattgttttggagcagaagcaggtgtcaccttgcgaagaagaatcgtcagaaatgtgtgtggggtgactgaatcgatatgcagaggggcatttggttgttgagacgaaaagatggaatactgtcgtactttcagtttcagtgaatttaccttttcttttttgtacgttgaattattctctgtcgacgtgttacgtgctgatttcatcacgattatcatatatatgtttggtgcaactgaacaaccctctcctgaccgatggtagagaatttgtttgaactcctaatcacccaccaggttcaatgcatattgcacaggatctggcttacgtccaatttgatggtgttacaacgatatatcagttcttttggacagaggaagtacacctccctatttgaatacatgatgatattgttaattgttcagtcaaacttttaaaactgtaaccaccaatatctctcaaaatatttagtttaaaaacataaattcctataggtagatctttctttataggttgtttaaggtggtgtttgaatctcctgaagatgaagataaagattaagtatttcacacaaaacgaggtgataataacgtttgattaattgagttttaattattacaaacttgaaaaatggattaatatgatattttagagtaactttcatatagaaagttttcgcacgaaacgcaccgtttagtagtttgaaaagcatgccatgtgtatccaaaatttcatcccctctttttagtagaaacgaatgggacctaacaatgttataattttattagatattatcattaaattctaatagaaaaataatggtcaaagttaaaaaaaataaagtcaacagtgtcactgtgataatattacttatagactatgcagcaactaaagatgcatatggttttatttgtggacactggcatttgaatttttgataggtaaaatcatgcacacacgactccaccactatgccaacaggtgattggagtgcttcttccaattaatatatcgtcactctgtacaatctatttgcaacgtgaagtacatactaatataatttttgaactcaagtgtagccacgaccactctagatttttgcacgatattttactaagaatcatcaaaattacatacatctagagcattttgaaatatatttgcaaaaaaggtctagaatgcaaatgtgtgcaataatatttctgtatctaaatacagtaatatacatctgtaccataaaagcaattgtaatcaaaaaaaattatgcgtttactttcacataaaaatttaggtaaacatattttaacatgctctatatgtatgtatttttcagtacttctatctataaatgaagaaaagaacctggagtgggtgagtgtcgcagtagaaccttccaagttacaaccttcctcagaaaaactctcatgcaggctgaattcgtttatcatgtggataggtcacccagaaagatccatgtcaattacaaaagttgaatggtggcaatggtgcatgtcctgaaggtgtatgcaccttttgtttagatgaggagatgcatcagcaaatggagcagttcctccaccactttcatcctcagtttctacattggtcggcatgactttttagaaaacggttctacttctacatagtttggcattacttttcagttaatggaagaaactcccggtctccacagtacacaaaaatacttttgattcagtttttaaaagagcaatgctacaaccatattaaattgttctataaagctattactagaaactatggtatcaactgtgtttgatttaactagatgaaatcataggaaatctagatgtattcacaatatgacacataagtgttagtaagagttcatcaacctttgatttaactagataaaatcagtttattacgaaatttttagtacttatctagtacgctttttagcactgcaacctctattttttatatgtatgatgcactcgtctttttttcctcaatctttaatcaacaatatttatttaattacctaattaaaaaaatagtgcaaccagatttaccatcaaaaatactttaaccatgtctagtacatttttctatttgcaccaataattaaagaaaaaaaatcatcaaacaattttaaaaagtcaactacgtcatattataaaatgcagaggtagtagtacataagctggcatgattaaccagtgagcaatttggactaatgactcctgaaatgaaacatcaacattggatgaatgttccattagatggaaaagtgagaagttagacaaggcagagtattgccttccccggttgcacttgaatcataaagggctttggcctcataaggtcaaaagtcagaaaagaaaaaaaaaagagtgagacctggacaagcagagctcacaccctcttcatctacgaaaaggagagagagtagagtggttgttcaagagcttttgttctagttctaccactttttttcttttttaaaaaataatttaaaccaatccagcctctacatctcaacgtatcctatcttattttatcttttgttttcattttttctctttttttcccttttggaggaatcatttgcctgccgaagtatgtcaactatgcattcttctgttgacctttaatttacaccatcatgttaatagtaagttgtaaagaagtcacttttggataactgaaaggaagcaacagagctttgctatctcttattttattttattttttaaaaatagaagtatgtaactacttggtgatatttttctgaagattttctaaggaaacatgtttttgcaaagcaccagagaatcttttgcataggtccatgcagaactgttggaagtgctaagttcagatatgctgaacagcatatatatcataatatcaacactgaaactgtattatacctaccatcacacagaattgtggttcctggtgaatcaaaactccttttcggctcgtattattgtactgcctgggtttcaggccattgaaactgtttctactgcacacgacattctccaccgaatgtctcatccagaaaaagaaaagaaaaacattctccactgaagcctaaatatataggttcttcagtttattaggaggtcagctctatagcccatcatatatatcatgcagttgtggaacaagatccggacacaaattatttgttggctgcataattgagcaagaaaagggtgagattttcaatggcgactcctgtagattgcgtcgacaaacagcaacaactccctgttcatcagaagtatacccacactctcatagtctcatgcagagatttggcttctttcttttctccaccaactgaatcagatcacgacggccatcatatccttccctccacgtctctacgccgaaaacgattgcgtgcaatgcaaacccgtttatacaaaacaaacaacagttcactggtcatttcaagaaccaagctagctagctagtaatgtgagatgcagagaatgagtgagagagagagagagcaacatctgtttgagcaaaagttatctgaactgacacacagtgacattacattgcaattgttgctgcaccccaacgacatcgatcctcttcctggattctgaaaccgatggctctttatctcatctcagaaactgttggtagagatgcaggtaaaaaagatggccatttcaagcccggaatctgctccatttctgtcagaaagaagcagtagcagataaacagcaaccgtttcttcgcatttggtttttgaaccggttgctgtcagaaagggcccggttgctcccccctcctcctcaagctccggacgccggtaggaccagacggctgccaccgacgtccactcgaccattcgctcgcgccacgcagccatggccacgcaccgtcgctgcattctcggccacagccaaaaaaggcgcgaaagaacactctccagctagcccaagccacatagattggtgaagaagaggaggaagagggtgacacattcttggacagcaaaactccatggacaccggaaaccacagacaaattccagctaagccaccaagatgactagatggccagatgggcatagtacgttctcactgtctgtactctggtagacaggaatgtatggtaaaatagtagcctcacatttgttactagactactagctaatgtgtgcatggtgacaaacaagcaggaatgtttctgaactctcaagcattccatcagaaacctgacaagctatctgaaaatcacctgatcgatcgatcgatcagtatgtcagtaagatcgagaactgcacccaaatgtggtctgggaatctctccatatatatggcgggccagtccatggtggatcattgaagccactagttaattattggcagaaaggtgagatggcaagtgaccaaaaaggagagcttctttttctctgaaactgaagcatcgatgaacgcgcggcgttttcagcgcactgtggtccgtggtgggggaggaggaagaagaagaagaaggagaagaaagctaattaatggggagataatggcggttgacttgcgcagcagcatttgatttgctaattgcaagcgtcaactgcatcaccaccgatgctccactagctgtgatgatttcatgttttttcaactgtatatctgatgatgatgatgatgatgatgattgatgaatatctggtcgatgatgatcagtcggaataaagcgaaagccggcgagctttccccctgtgttgcgccgctatgggccgaaaatatctcgaaaaatataggaataagttcatttgaggtcccttaacttgtcaacgaatccaattttcatccttcaaccgaaaaaccagatataacagatgagtaaattccctgtgtacccctgaaaactcactcaatccctttcatacccctaaaatttacccgatcccttctgtacccctgaaatttcaatttgatcccttccatgcccctaccgttacattttccatcattttactgttacgtttggttgcaaatgtcttttttgcccttgatgctttaggtttaaatataagcttcaaaaataattgaaaattttgtttgagtgcacatcgtgtgcattttataaaactaatgagactaaataattagtgcagaaaattttgacataaattttgaaaataaaataaatgtaaaaaattaaaaattttatttgaaattttaataggacaatggatttttttatcaggagcattcataaaaaaaatgttgtgaacattggtatacctatctttatatgaatgctcctcatttttatgaccttttttttaaaaaataaatacgtattttttttatttcattatctaaaaatatttttttgggataaataatgcatcgcacaacaaactcataactataatagtctcatgcgagaagcttttatatttttaataatgtaattcatgaatttctttgttcatccaagggtaaaatggtcatttttatagaaaatacacggtcaactaacggtcaactgacgggaggggtatgcaagggatcaaaatcaaattttgggggtatataaggaagtaagcaaaattcaggggtatagaagggattaggaaaaatttcaggggtatataagggattttctctataacagatcccccaactatcaaaaccggtgcagaaaaggtccctcgtctgtttagatggcggttttggttgacgtgacgcttatgtggctagtttgactcggtcttcatctgacgtgtcattgacgtggcgcttacgtggcaattcgatccggaaaaataataaaacctgtgggacccaaatgtcagttttacacacaaaataataaaaaatggtggggcccacccggggcccacatg

SEQ ID NO: 67034 - DNA, 3814 bp, Oryza sativa
aggtggccggaggaggaggtcaccagcgagcacgttcctgctcctgctccgactgctaccgcgctcccctctttagccctagctccaaaactttcacttcgctagaacacacaaccctttctctccctcgcaatgccacaaaatcagattagtcgaggccgagaagacgccacttgggcccggcgcaaggagtaggaggggggagtgtgtgcggcgccgctggtcgcagtcggcggcggcgatggagatcggcgcggcggcgcaggtagaggcaggagatcttcgatccgtcgagcgcaaggaccgattaagcttacgtgttttttagcctaacaccatataacgccggccggccgcactgccgaggccgcgacccgcgctctgccgcacggccacgctcgcgtcatgcagctcgtctccatctccaagaaccaccgcggcggcaacgacgtggacggcaagcacgatagcagcgacgtcgacgagggcgccaacgccgacggtgagcacatctcgccgcggggctcctactaggtggtccggatcaagaaggacaagatcctggcgccgcacgtgcacttctgcagcgtgtacagcaagggcttcaagcgcgacgacaacctgcggatgcacatgggcggccacggcaaggaggcatctgcaggagcttattgtgcgcggccacggcgatgagtacaagtcgggggcagcgctggccaagcccggcggcaagggcgtgtcgccatcgctgtcgccgtcgccagcggacgtgccgaggtggtgcttctactctggtcgccgaaccttgcgtgagagagaggggagatggggagagaggaggaaacccagggggaatgacatgtgggccccacgtgagccccactattttttattattttgtctaaaactgacatgtgggtcccacgggttttattatttttctggatcgaactgccacgtaagcgccacatccacgacacgtcagatgaagaccgagtcaaactagccacataagtgccacgtcagccaaaaccgccatctaaaccactgagggaccttttctgcactggttttaatagttgagagacctattgtatctggttttccgattgaaggatgaaaatcggattcgttgacaagttaagggacctcagatgaacttattccccaataacatgggcttctcttacggcccaatttaggtgcatcttcaagagcatatagcccagtctagcaaccatattaacggacatatgggccttttttctccacactacctatcaataaagcccataggaaagtctgatatcgaggtgcagcagacagttagccacagagcccccataggttgcggccaaaatttaaatgggagtgaattgcatattaggccacttatttgcaacttggactaggcctactatagtgttttcactttacaccaagtaagcttaccaagtgttgcactttggtccaccttatcccatctcctcttttaactccggcaccattatcccttcacctgcccccgaccagctcccttctgtgttgctaggactgcacgacgctgcctcctgttaaacatgtgatatgtatttgtgtgatgcacacggcatggttagatggatagatatgattagataaggctagattgagtttgttgtaacagaataggagcatatctatccatccacctgcgccgatctctgtaacccacagcggtggttattatcgctaatataagattaacaaaggtgcggcccgagagggttgaacgcttctgaacctctgatgtttgatatggtatcagagcctttccactaaacaaatcccgatccaatctatggccagctcgtcgtccaagatggcagccactaatcctttcggaggaaacacaatctcagagaaattagccaaaaacaactatgcgctatggaaagcgcaagtcctggcgtcggtgagaggagctcgtcttgaagggcatctcactggcaccacagcagcgccggccatcaccatctccgtgccaggcgagaaggaaggcgacaaggccaccagggtggctaatcccgcctacgatgaatgggtggctacggatcagcagatcctagggcttctactgagcaccctgtccagagatgttctggcgcaggtggccacctgcggcactgcagctaccgcctggagcatgctggagagatgtatacctccatgacaagggcacgcttcatcaacactcggatcgctctctccaacaccaaaaagggcgatctctccatcacagaatatgtcgccaagatgagagcacttggtgatgacatgacggcggctggcaaggtcgtcgacaacgaagatctcatctcctacatcattgccggcctcgacgacacgtatgaaccggtgatctcctcaatcgtcggcaaatctgagccgatgtccttcggggaggctttctctcaactgctcagctttgagcagtgcaacaatctccgtcacggcggtgagtcgtcagcaaacctggcgaatcgagggtgcggcaccaccggcggcaacggaggccaacgcggacgcggtgggaacaaccgtggacgcggcggcaatggaggcaacaacagcgcaaaccgcggcaagggtggtcgcgggaatggcggcttcaatggaggacgtcaaggaggtggcgtcgacactaggcccaagtgccagctatgttacaagcgaggacatacagtaatcaactgttggtatcgttatgatgaggattttgttccagatgagaagtatgcaggttctgcagccacctcctatggtatcgataccaactggtatgtggatactggggcaactgatcatgtgacaggagagttggagaagctcatcgttcgtgatcactacaaaggacatgatcaagtgcataccgctagcggtgcaggtatggaaattagccatattggtcactctattgttaaaacccccagtcgtgatattcatttacgcaatattttacatgttcctaaggctaacaaaaatttagtttctgctcaacgtcttgtttctgataattctgcctttatggaactatattctaaatatttcaatcttaaggatctggccacgaagaaacttctgcttagggggccctgccgtggttgtctctatgctcttccatctacaccgccacatgcacactcaaccaaagaagtttatggagtctccaagccatcttttgaaaggtggcacagtcgtctcagtcatccctcctctccaattgtagagaaggtcattagcaaaaataatctcccatgtttagttgagtctaataaatagtctgtgtgtgatgcttgtcaaaaggcaaagagtcatcaattgccttattctatatcatctagtatatctagtcatcctttggaacttatttattctgatgtttggggtcctgcccccacttctgttggaggcaaacagtattatgtgagttttattgatgatttcagcaagtttacttggatttatttaattaagtttaaatctgaagttatccaaaagttccatgagtttcaggctcttgttgaacgattgtttaacagaaaaatcctagcaatgcaatctgactggggaggagaatatgagaaacttaattccttctttaccaaaataggtattactcatcatgtgtcttgtcctcacacacaccagcaaaatggctcagctgaaagaaaacataggcatattgtagaaatgggtcttgctcttcttgcttactcatctatgccattaaagttttgggatgaggcttttacttctgctgtttatctcatta

SEQ ID NO: 67035 - DNA, 3260 bp, Oryza sativa
ttttattattgccatcccatcttgatattcctattattcctggggtgcaacaaatgagtaccactgtggctaatgttcctactaatcctgctaatcaaatttctggagatgaattatcgctacaggaaaattcggcagcaaataatgcagctccagatggtgcggacgcagccacagctgccacgaaagatccagcggctgactcccctcacacctctgacgcagcgtcttcgagcgtcctccagcgtcgtgtggaggccaccgcagagtcctcctgctctcctgatcggttgcatgtcgagctcacaccggcgcactcacccgtggccatgcaatctccagatgccacgtctcctactgcttcctctaactcacaggagccatccacgtctcttgatgcttctgttgcaggggaggtagatacacagcaacaacagcaccatgtaatatctagaccggctacgaggttgcaaagtggcattcgtaaggaaaaagtttatactgatggtacagttaaatataggactacttttctcactgttactggagagccagaaaatttagatgacgctttaaaagataataattggaaaaaagctatggatgcagagtttatggctttacaaaataataagacctggcatttagttccacctcagaaaggtagaaatgttatagactgtaagtgggtgtataaaattaaaaggaaacaagatgggagtctagacagatataaagctcgcttagttgcaaaagggtttaagcaaagatatggcatagattatgaagatacttttagtcctgttgttaaagctgctacaatcaggattattctttccattgctgtctctaaaggatggtgtatgagacagttagatgttcagaatgcttttcttcatggagttctcgaagaagaagtgtatatgaaacaaccaccaggttatgaggacagttctttgccagggtatgtgtgcaagcttgataaagctttatatggcttaaagcaggcacctagagcttggtactctaggcttagcaagaagttatatgatatgggattccaagggtccaaggctgatacttctttgttcttttataacaaaggagatttgattatatttgtactcatttatgttgatgatattattgtcaccagttctagacaggaagctgttccagccttgcttcgggatttacaaaaggagtttgctctgaaggatcttggagatcttcattactttcttggtattgaggtaactaaagtgtctggtggtatagttcttactcaagataaatatgtcaatgatttgttgagaagagtaaatatgtttgactgcaaaccggttagtacacccctgtctacaagtgagaaattgtctataaatgaaggagatcctttaggaccaaatgatgcaacacattatagaagtgtagttggtgctttacagtatctaacattgactaggcctgatattgcttttcctgtaaataaggtttgtcaatttttacatgctccaactacacaccattgggcagctgttaagagaattttaagatatttgaagcaatgtactagacttggacttaagttaagcaagtctagatctatgttagtaagtgcttattcagatgcagattgggctggttccctagatgacaggagatctacaggaggttttgcagtattcttaggagataatcttgtgtcatggagtgcacggaaacaagctactgtttctagatctagtacagagtcagaatataaagctttggctaatgctacagcagagattatgtgggtacagactttattggcagaattgcaagttgagagtccatctatggcaaagttgtggtgtgataatttaggagctaagtatctttctgctaatcctgtgtttcatgccagaactaaacacatagaggttgattatcattttgttcgagaaagagtttcaaggaaattgttagaaattgattttgtgcctacaggagatcaaattgcagatggttttacagagggcttgtcagttcgacagttggagaattttaagtacaatcttaacttaggaaagttatgattaagggaggggttaaacatgtgatatgtatttgtgtgatgcacacggcatggttagatggatagatatgattagataaggctagattgagtttgttgtaacagaataggagcatatctatccatccacctgcgccgatctctgtaacccacaacggtggttattatcgctaatataagattaacaaaggtgcggcccgagagggttgaacgcttctgaacctctgatgtttgatacctccacctatcttgcactgctaaatgctgatctcctacacttgcctctaactctgctcgaaccgcatcagcatgttaagagcaaccatcccccaagtttggtgtgccttgcacttgatctggagagagcaggagcatgatagcggtggtggctcattctggagcatgaacaagaaagtggtaggcttgtggaggagcaggtgcaaatagcaagggagcaagagggtaaagcagcagcatgctcgtggatgtgcaagagcaggttggtagcaagattatggaggtcttctccacggctcccccttgtggaacccgccttgagcttaagctctgtacagcccaaattgtgcctcccaccatcttcatcctccatctccacaatgggcagcggttcgacaagtcacactaggagatattcctggcggagcgccttgatggagctcaccagtttggagctgcaagatgcacccatccactcccattgattttgatgcaagaacgcatggtttgctgttggcccttccaggtaccacatgacctccttgtagagaggatggaaatggagtttatggcgagcggcaagcatccaatcaacggtgctggtcgatggtggtgatgactgacacacagcaaagctagtccaaagtgcaacagattgcaagtgtagctggtttaaactgagaccattgtaatagagctagtccaagctgtaaatgtggtaaagatagtgacggagcgtggggctcctcaccgggagaccgcgcaggcccccctttgccggttcggccggggaccctgggtgagattctaagcttctagtctgtggaaggttcgcgagaatggaagaagcacaagacacgggcgatgtatacaggttcgggccgctgagaagcgtaataccctactcctgtgttctggtggatctgtgtatgaagaagctaca

SEQ ID NO: 67036 - DNA, 6820 bp, Oryza sativa
agcgcgctgcactgcgttacatgcggcgtgacgcgctcgtccaaaccgcaataaatgtggttaggtgagccctgctgcgctcacctaacccatacacgcggcgcaaaatctacaaggggtcggggcgcctcagccctcggggccgaaacgggagcggtccgacccctcgggaagacaaagaggggggcggccacatcaccctcgggcccgacccccccgagggggtcaggcctcgtgggtgattgctcctgcccaagcctctagtcatgatactcccggtcccatgtcaccgacagtagcccccggcgttatgccagggcgatcgccctcctcgagggaagcggtcgggcgtgacgccacttcctaaggcctggtgacaggtgggaccggtctccacagttgggcagaaacccaacggtcgccaatcacgcacatcggcaatggtaactcgactgtcaataatgagcggcctcttcaaggttgccacattactcgagtagcacgcgaatcgggacgagccggttcgttttgcctggagatatggtgatggcgcttcggtcggcgagcgtaattaacgcgcgcacgatatgttccatctcgactgccacagccgcatatccacctcatgcgccgcaagcgggcgaatgggattagtggaagcgtgggcgcgagaaacgagagagcgagatagtgggcgcgagaagcgaggagccgggcacagcgttggcaagggtataaagacaccgaggaagagatttgcttccttcctctcgccattattccccttgtcttcgccgcttgcgccctaactccttgtttcctgtgccctaccttcgccacacgcgctcgctctcaaacatctcttcctccggcgtcatggcacggggctccgctttgctcgatggtagcgtgctgccgccttcccgcatcgtgagcgagaggcaggccgggctgccgcgccgcttcatgccggaatctgccaccggccgggagatagtcacgctgggcgagggacgcccggcgccacactacccggggcggtccgtcttcttcctcccttttgcaatggcagggctggttccgccattttcttctttcttcatggatgttcaggagttttacgatctccaggtggcgcacctcacccccaacgcagtaatgacattggccatcttcgcgcacctgtgcgagatgttcatcggggtgcgcccatcccttcggctgttccgatggttcttcaccgtacagtcggtgtcgccgccgtcggtggttggtggctgttacttccagccgcgggggccggtgctgaaccgctacattccctgcgtcctccgcaagaagtgggatgactggaagagcgactggttctacacccccctcgccgacgaagcgcgcctccgacttccgagccagcccccggcgcaggcctccagctggcgggcgccggtagatctgggagatggctatgacgccgtcctcgaccgcctggcgggcctgcgatcccaggggctcacaggggccatggtgtacggcgactaccttcgtcgccggattgcgccgctccagcggcgcgcccggggcgcctgggagtacaccgggtccgaagactatatgaggacccatcagggagtcagatgggactgggctcctgaggatttcaagatagtggtccaacgggtgctgaatctcagctccgtggaggcatccctcattccccaaggagtcctccccctctgcagcgatccagatcgcgcctccatcctgaccatcatgcaggcggtcggggcgtcggaggagcgggctcctcgaagccacgatggcgcgggcgggagccgcaggggggaacaatctaccccgggagggggtcgtgcttctgggccccgcgacgggggcccggggagcagccgccctgccgacgcccgggggaagaggaagcaggaaggaacccctcccccatctcctccccgagggggcggggcggcgcgtgccagcagcaggcgcccggagggggccacgccgacgtcgcagcccgagggggagcggaagaagaaacggctccgcaagatgggggggacagaaccatcccggggaaaccttatttcccctccaaggtggtcgtttaaccgaccccctcgcaggttcgtcccacgcccatcgtggctgtattcattctctcaacgcgagttttcactcacccatcttgtttgtcttctggtctttcttctgtttcagcgagatcccgtcgcgtccctcccgccattccaagtccggccagtctgaggccgaggatccggcggccgcagaggctcggaggcgggaatctgaccggcgagaagccgcggatcgcctacgggaagccgaggaggccgctcgggaggccgcccgggctcgccaggccgaggaagccgctcgggaggaggccggactccgccaggccgaggcgacgacatcctccgaggcgacccgtgaaactgaccggcaagaggccgcggatcgccttcgggaagccgaggaagctgcccaggtggccgtccgagctcgccaagctgaagaagccgctcgggaggaggccaaacttcgccaggctgaggcgacgacgacttccgaggcagctcgcgacgaggccgcgggcgcatcgcttgggcccactccctcgtgcgacgctcaggacaagccaggtccgggggacatccccgagtccggcacgtccatcggcgggccgagccgcgcggcatcctctccgaggcggctcttccccacgccttccgttgccccactgagcgcagagccccttctgcaggccttggccgtcgcgaacaccacggtgttggacgggttaagtgcccaggtggaggccctgcaagcagagcgggcggagctcgacgccgcatgggcgcgtgtcgaagaggggcgacgctcggtggaggccatggtggaggtgggccgcaaggcacaccgccggcacgtctcagagcttgaagcccgtcggaaggtgctgggggagatcgccaaggaggtggaggaggagcggggggctgccctcatcgccaccaccgtgatgaacgaggcgcaggacaccctctgccttcaatacggaagctgggaggcggagctagggaagaagctcgacgccgcccggggggtccttgacgctgccgctgcccgagaacggcgggcggcagagaccgaagtggcatcccggcggcgcgaagaagcccttgaggcccgtgccatggcgctggaagagcgtgcctgcgccgtggagagggacctggcggaccgcaaggccgccgttgccatccgggaggcaacgctggcggcgcacgaggccgcctgcgccgaagaggagtccgcgctccgcctccgcgaggacgcgctcaccgagcgggagcgagctctcggggaggccgaggccgcggcgcaacggctggcggacagcctgtccctccgcgaagcagcgcgggaggagcaggcgcgccgcaatctggaaggtgcccgcgccgagagggccgcactgaaccagcgggccgctgaactcgaggcgcagacaagggaactggacgcgagggcgcgcagtggcggggcggctgcgggcgaaagcgacttagccgcccgcctcgcagctgccgaacacaccatcgccgatctgcagggcgcgctagactcgtccgccggggaggtcgaggccctccgcttggcaggcgaggtagggcccggcatgcttcgggacgccgtctcccgtctagaccgcgccgggcggcaggcgggtctctggggcaagcggactgcgaagtacgccgctaaccaggggggcctcgcccagcgcctctcggagatggccgggactctccaacggctccccgaggagctcgagaggacgattaagtcatcctcgagggacctcgcccgaggagcggtggagctcgtactggcgagttaccaggccagggatcccgacttctccccatggacggcgctggacgagttccctcccgggaccgaggacggcgcgcgcgcgcaggtccgggacgccgccgaccacatcgtccacagcttcgagggttcggcccctcggctcgcgttcgccctcaactccgacgaggaggacgatgacagcggagtgggcggcagtggcgacgaggctggcgacccgggtgcattggattgagcccccaggcccccgccaatctttaaatagttttttctttcttcttccgaggccttcgggcccccttcttgtatagactaatttaatctgcaatcaaataaagaggaaatttttgtgtcaattctatttgttgtgtgtatgagacgaggatggtctgtgccgcagtccttttgtgtcttggcttgaacaaggactcgtgcccaggtcccagtcctcaaatggctcgggtcggggctagtgcctggggagatccacatgtcgagactggccaggccgggagcgtggtgaccgagggttatgggtgacccgattgtgggtttttgccgattccccccccggagttcaccacgccccggggcacggctcggttctgggccccttttggcgattttagccgacccgagcccccgagggcaggattgagcacgagtgacctatttcaagtcaagattcttcaaaaagaaataacagcacagacacagcctttaggaaattgaaaatgcttttattaaaatacagatataagagaaataagaatatgcatgtgtggtagcccccggccaaccctgcacgcccgaggggggtgcggggttggcccgagcccgaaacctgacacccgatcccccttaggggtagaagcgacgaaggtgttcgatgttccacgggttaggcagctctgtgccgtcgccggtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgcctccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggtgtggttcggtttgcccagagcaccgctggcaactcctcggtccacgaatcgccgtgcttcttgaggatgttgaaggtcttggttttaaggcctctgaggatttctgcattggcgcgctccacttggccattgcttctggggtgggcgggggaggcgaagcagagcttgatgcccatgtcttcgcagtagtcgccgaaaagctcactagtgaattgggtaccgttatccgtaataatacggttaggcactccaaaccgggctgtgatgtccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctgggccggctgatggatttgcttggcgtggaattgacacgctctgcaccgccggaccaggtcgaccgcatcattgagagctgtcggccaatagaaaccctgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcatttggagatgcgctggacgcgttcactcccttcgcggtcctcgggtagagtcttatctgtgaggtatacttggatctcagcgatccaagcaatcaatctaagggagctgggagcgctcccctcgggtcccgaggcctggactccgacgggcctcgggggccggtcaggcgcgtccgtctcccctaaggggtcgggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctctatacgccgtacttggcgcacgtaagcgtccatctgcgggtcagagcaccggtactccttacagacctggttaacgaccagctgggagtcgcctaataccaggaggcggcggatccccagtccagctgccaccctgagtcccgcaaggagtccctcgtactctgccatattattggtcgcccgaaagtcaaggcgaaccaggtatctgagaacgtctccgctcggcgaggtcaacgtgacccccgcaccggcgccctgaagagacagggagccgtcaaactgcatcacccagtaggcggtgtgaggcagctgcgaggggcccgagttggcctcgggaatggagacgggctcgggagctggggtccactctgccacaaagtcggcgagggcctggctcttgatagcgtggcgtggttcaaagtgcaaatcgaactcagaaagttcgattgcccatttcaccacccgtccagtaccctctcgattatgcaagatttggccaagggggtaagacgtaaccaccgtgacccgatgcgcctgg

SEQ ID NO: 67037 - DNA, 3259 bp, Oryza sativa
ctaacaaagtagacgggccgctgcacctttcggtggggccgatcctcttcgctaggggccgcatccttggggcgctcttcgtccaagcggccacgtggggcgcactcgtcttctgtgccgatgacctcggggtcggaggacgacaggggcggccttcccacagtggcctcggggccgtcctgggggtcgggggctcttggcgtcgtcggacaagcgggcagagggccagctccggtcgtcgggggccttgggccaccgttcggctcgggggcctctcctccctgctctctcccgggtcgagtcggcacagggttagcctcggggtcagagggcgataggtgcggccttcccgcagtggcctccgggccatcctgggggtcgggggcacctggcaccgtctgacaagcgggcagagggccagctccggtcgtcgggggccttgggccaccgttcggctcgggggcctctcctccctgctctctcccgggccaagccagcacagggtggggatgcgcggaatgaggattgtcctcatcgcgctccacaaccaacgctgcactaactacttgcggggtcgccgctaagtagagtagcaagggctcatctggctccggggcgaccagaaccgggggagagctgagatacgccttcaactgagtgagggcacgttcagcttcctccgtccaagtaaacggcccggagcgtttgaggagcttaaataggggtagcgccttctctcccagcctcgatatgaaccgacttagggcggccatgcaaccggtgacgcattgcacatccctaagtttgctggggggggcgcatccgctctatagctcgtatcttctcggggttggcctcgatgcctcgggcagagaccaagaacccgagaagcttgcccgcaggtacaccgaacacgcacttatcggggttcagctttatgcgggcggagcggagactttcaaaagtttccgctagatccgagagtaaggtctcttggttgcgcgtcttcacaaccaagtcatcgacataagcctcaacattacgtcctatttggctacccaaagaaattcgagtagtacgttgaaaagtaggacctgcattctttaacccgaagggcattgtcgtataacaataggttcctatgggggtaatgaatgcagttttttcctcatcctccctagccatgcgaatctgatggtaaccagagtatgcatctagaaaacacaaaaggtcgcaccccgcggtggagtcgacaatctgatctatgcgaggcagggggtaagggtccttaggacatgccttgttaaggtcggtgtagtcgatgcacatccgaagcttgccgttcgccttaggaacgaccaccgggttcgccagccactccggatggatgacctcgaggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccgttcagaagaccaccgatccgtatggtcttggacgggcctcgcccagggcaacctccttgaccgggacctcgtcgcatgtgatcatccgctgcctcggggcggcggggacggaggtgccaagcctctcgtcgccaccctcgggcttggacgcggcggcgaggtggtccgcgcgctgctccatacaagcaagcgcgactttgaggtcgccatggacagagatggggccaccggggcccggcatcttcatctggaggtaggcgtaatggaccgccgccatgaacttcaccaacgcgggcctccctaggaccgcgttgtagggcagacttaggtccgccacatcgaagtttacccgctccgtgcggaagttggcggatccaccgaaggtgaccggtaggtcgatatgacctaacggccatgtgtgccccggcgtcacaccaataatcagctgggacggccggagcaccatccccggggccttgatggcgtcaaaggctgcaggggaaaggatgtcgagggccgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtgaccccaggctcttggaaacctaggtcatcatcgccgtcatcgatgtcctcggcaggggccttttgcttggcctcacttcgccgattgccggaaggaaccgccggggacttgcccactcggcgctcctgcctcctctcctcctcccacttcctcgtccgctcagccaaacttttgactgcgcggcagtccgcgaggtcgtgaagggaggtgttgtggacggtgcaccacttgccggttgggcgctccctgctgggagcgccggcctccttctttttgtcgctcacaggcctcccctttcgggtggcccgcgaagcgccctcgacggcgaggacatgaccctcgtcgtcggaatgggctgacctcttcttcctcctcctgtcacgccgccctgtctgagcagcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctgtactgcgtgcaagtccgcttcctcacctgggcgcggatatgtgccttgaaagttcatggtgaactgttggcacaaatcctcccaagagtggacggacgcgggtggcaagttcattagccaaccccgcgcctgtcccttcagggccatgggaaagaaattcgccataaccctgtcgtcacccccggcggcctcgatcccgg

SEQ ID NO: 67038 - DNA, 4126 bp, Oryza sativa
ctgcacccccggtcgaatggcgaacagcggccgccgctcgccgcgccctccgtcttgacgacgcggagccggtggtagcagtaccagaggccttggtggcggaggaccgcccaccagcatctaggcgctgccgcgccgtcatgaccaaaatggccacgtcgtccagccaacgttgggctggagactccgggtcagggacgacgggcgggtgacgcaggagcgcgcccgcagcttggagcgcgccctggggcgtgctgccgtcgccgtagacgaggaggcgacgctccccatctcggcgcccttctccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctcacactcggagagaggttgtgcgcctttgcttgttcggccattgggctgaacaggaaaagcttggcgcacacgaaagaatgcgagagcttagaaaaacacacgcagagccccctacctggcgcgccagatgacggagcgtggggctcctcaccgggagaccgcacaggcccccctttgccggttcgaccggggaccctgggtgagattctaagctcctagtctgtggaaggttcgcgagaatggaagaagcacaagacacgggcgatgtatacaggttcgggccgctgagaagcgtaataccctactcctgtgttctggtggatctgtgtatgaagaagctacaaagagctggagagtcagagagcttttactctagaaaccctctcctctggttctcaatccagcctccatcgttctggatcccttctctaagtgggcaaggtcctccttttatacctcaaggggataccacatgcaccatctctctcttttgtgtggggacttatcctatcttccccccaacttgacttgccttctcttcataaatggacggagatttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgtgtcagtttagcaatctgcacgttcgcccttcttcatgcgatatcttgcttgtaatggttaggatgaagcctggcatatatctgaccgggaccaacgtgccatctccaggaggtaacacgccggctccggctagggacgagtgcttagagactctcatcctgacgggatggggcgaggcgtgtgtcagaccgcctgtcgccacctaacccacgatctgatcggtctgtgactggtcacagaccggataaacgagcgcgctgcactgcgttacatgcggcgtgacgcgctcgtccaaaccgcaataaatgcggttaggtgagccctgctgcgctcacctaacccatacacgcggcgcaaaatctacaaggggtcggggcgcctcagccctcggggccgaaacgggagcggtccgacccctcgggaagacaaagaggggggcggccacatcaccctcgggcccgacccccccgagggggtcaggcctcgtgggtgattgctcctgcccaagcctctagtcatgatactcccagtcccatgtcaccgacagatagatagcccaatatgcaattcactctttaaattgtaaaacttaattttaagattatactaaaatttatgtagcttttttttaatattggcttttaagttgctaataacacatatataaaagttttacaaataaattattttctgatcactaataggatacttatggcttataataagcttttgagcaaccgatgaaactcacctttttctttttaatggtgcagccattgcacacatttcatataaagaactctcatttttagagaaaaaaaatgggactaaaacttacaatgcgtaattaattagagaaaactagacgaaaatcatatctaccacagaggcacagacacatcattaagtagtcatcaactaacttaaagttatgttttatagtttggaaaacatacacgtggaaaccgagaaatatgaatcgggaaaatatggtaaagaacacagccttagtcacagtttcgggctgtgcagacagaaaaagggacgcaacgcagtgatgctgctgtaatcttttgttttccttttgttttgaactaggaaagctaggcttcccccatttcttttattaaaaaaaaattaagtaattattaattcttttccttcatttgattcattgtgaaatatacttatatgtatacatatagttttacatatttcacaaaagtttttaaataaaacgaacggtcaaatatatgctaaaaagtaaacgatgtcaaatatttagaaacggatgaagtatcagatatgacaatgtgtgcttacagaaatgtcccccatttccaatacgaaacgaaaccttgtgcggcgccgcgctccgatccgtgcggccattgaaggcgagcgaagcaagcagccaaaacccacgccggggacctcgcccctcaactgactaccatggtgtcccgacctccagctaagccccagcaccagaatgcgatgcgaattagagcaaggtcaatagtatagccaactaccggctacaaaaatatctatagccaatctaatagtccatttatacaatagttaactgtaaaaatatactacactattaatatccggtcacatctcttatacacacataacatattggagtccgtgttgcagccggctacaaatctgtagcgtgctttcttctctctcttctcttttcttctcgatgtatggttatagccggcttatagcctgctattgtacctgcccttacacaaaatccaatcctatcctgcatgctctgctgcttgctacggcgtcgccgtcgcgggctctgctccaacaaccaatcgctagctgcatccgcatccgcatcggcatccacatagcatatgcataatgcatttgcaattttgcatgcgatgacctgtaactccagatgcgatgaacagatcagggccttggtccctgcactgcacctctgcttcgcgtattgatttcagatatatgtagatggacagtcagagaaccaacacatgtgcgcttctttggccgcatgccgaccgctaaccccaccgcaatccaatggaatagtctccatggatgcatgcattgttttcgagtatgtttaattattatatcgtcggtcattccgcgttgattcgatcagtctttgacagtctaacgaatgtcagactgatctgcaaacaaaggacaaatttttagggtaaattaatttactcactgaattcagggacatggagaaagagacaacagctaatccagtataagaaagatggggcacagatcacgcacactacagttcacacggttattattctgatcggcccaaccgatccatgattgtcatggagacatggacccggcagtgtacagacgagcagttctcataattccattccttctccggatcgatattaataagaagaaaaaaaaagattctgacagccaaaagggcgatgctgttcaggatctatgccatgttcttagcagtttgtccaaaagcttcacgtggctctcttcttaattcttattcagctcgccacactgttgactgaaaaattggagcaggcactgcagggtggttgtctgaatttgatctttgtatctgtttaggtagtagccatggatgacaaattgttcgttgtgatatggtttgagattttgtgaaatttttggtgaattttcagtgatcggttaggagggaggaggaatggggaaggcggggagatggctgaggagcttcttggccggcggcaagaagggtggcaagaagggcgaggcaatggcggcggctttgcccggagaggcggcgaaggagaagcggtggagcttcaggcgaccggtgcacggcgagaaggcggcggcggaggcggcggcggcggcggacggcgtggtggtgggcgaggccgaggcggggtttgatctgtccgcgtcggagtcggagttcgaccagaagagac

SEQ ID NO: 67039 - DNA, 6924 bp, Oryza sativa
ggcgcggcgcggcggcgagtacggccaccacgggcggtggtcgccggcgccgtcggcgatgacggaggtgatgagcccgagggcgtacagcggccacttcgaggacatggcgttcgccgcgacggcgcacagcagcccgcatcacgcgtcggcgtcgtcggagctgctgtgctgcccgagctacatggccaacacggagtcgtcccgcgccaaggcgcggtcccagagcgcgccgaggcagcgcaccgacgcgctggagcggcagccgagccgccggaagagcggcggcggcggcggcggcgccaagatgcagcggtcgtcgtcgtcgcacgccgcggcggcccagcgcggcgcgcagttcccatggccggtgatcaagctggacacgtcgagcgcgtcgctcaaggacagcgagtgcgggtcgacgagctccgttctcaccgccgccaccgtctacagccggacgcggtcgctagtcggattcgaggtgagttacgacttccgagacatcgtccatgtttttttctaacgaagatgaaaataaagttaatgtatgtaaaataaaaagttattaggatatgatttattgagctttaactattacaaacttaaaaaatagatttatttaatatatttaagcaacttatatatataatttttttaaaaaaaacgtagagtatgaaaatagaggtaaattctactactctgtctaaaaaaataaactctagctatgaatatagacatgtatgtgtttagattcgtagctaggattgattttttttttctttggaccgagggggtatatcttagtgtgaaaaacataaggaaaaaattattcactcgcacttgttctttgcatgatccaggtgcgcaggggtttgtactgagctacaagaataaaaaatgccattgccggacgaaccgggagcttcgccaatcgccatggattgaatgttcgtcagtttgctcgacgtgtgatggattcaggatcatgaactgtacattctgtgtaggttattctgtgttgtggtgactgtaacataccaggaatacatactgctaagtgaaagcgaaatgtaataagcaatccactgcaatttcttccaaattccagtgtttgttccaatttcttccaagttttttgtgggcctactcgaggttactgggctgtacttgcacacatcccacgagaaaataggccgaaaagaaagcccatatacctgttcatgggctaactgggccggcagctcatctaccaatcagaagaagggccatcgttcttaacttctcgtagagcacaccacacgctttttcgccgaataagcgaaacgacatatttgcaaaggaatagtaatttgtgaataaaatttttatatatgtgttcttagtgatctaaaagtaaatgctgaaaaataaactttcataaaaatatctcaaaatgagctttaaattgaagattaaaaatttaaattttggctaataaatataagtataaacgaaaagatgagacctcatctcactctcatcagccatcatacaggtttcatggcctggttgcttcctacagatggcgaaacaaccgaagccgttgtgttgctttcgatggcggaatcatggctcagagacgcgcttagcatggccaaatttgacatcaactgatgaggaattgaggataagcgtcgtgaatggctgaaatcgacaggtattcgggttgtttcttcagcatcacaacatgtcaggcagggacacgacgcacttgtccagaaattttttattttcttcctgggtcggcgaagaagatcgaccaaatttcgttaagattaggcttgtacagacatcttattgctcgtgatctggtttgctgacgaagcaaaaggaataagcccttttttgatggacacgagggtaagagaagaaaatggtcggtttgtgagatcgaactgtcaaagaagtcacattcaggttgaaggataactgatcaattttttgaaagaacatacatcatcctcgatcctaaaatatatgactttgttgtcttttcgcataatatttaattattcatcttattaaaaaatatataatttaattttattaaaaaaatatcatttattttgttgtgtttttatcatcaaataaattataatcttaatttatatttttatatatttatactattttttaaaaaaaatataaatagtcaaacattatacgaagagtgtacgacatctgaagtatataaaaagtttgaaaaaaagagatggcgtgttctaccagtttgatgagtccatacatctgtgagagatgcaatgaatgaaagacgagggtaataatttctggtcacaatcgtctcatctccccaactaatcaagtaaccattcgctttaaaagctagtagtagagcatccacacttgtacaaattctcaggtagaaacatgaagagaaaaatttggaggggtaaaacaaaaggtgacaaagtttgattaatgaaaaacctgaaagctaatctgcaaagttggcaaccgatgccattttcttctacgaacttaaaatccaaagattcttccgcttcccaaacattgccagattgcctaaggccgagtttagttccaaactttttctttaattttttaactttttcatcacatcaacactttcctacacacgtaaacttccaacttttccatcacatcgtttcaatttcaactaaacttctaattttagcgtgaacaaaacccaccataaccgtacaaattatcaggtactgtgtctcctgccagaagaaaattggactggtaaaacaaagagtgacaaagtttgattaatgtaaaacctgaaagtctgcaaagttaaaagatgatgtcatttcgttactactccctttgtcctaggacaatgtaattgaacatgaggcttgtccagatacattcttctaggatggatatttgctatattccgagacgaaggtaatacctctattttattttaagtgcagttgtggtttccatatccaacgtttgattgtccgtttcatcatctaataacaataaaaatgctaaccataaaaatttttaaataaaatagacgatctaatgttggatataaagaatacaaaactattatctttctatgatctttctgagacggaggtagtagaattaaaaaaaaaaatcatccctttccaaacattgccagactgcctaactgtacagtcacggcgccatctcggacggatcacgcatttgactttgccttttttttcgacttcttgctgccgagtcaattccgggaaggcctccataaaaactccatctcgatcgtctcatctcatcgtctaccaacaactaaccgccatctctctcctcgcttttaaactcccgcgaaacaaccgctcgctcacacacacacacccagagaagcgagacaatctgctgctgctagtggcggacagagtccaagaaggaatccaagaatcgagagaaatcgagatgctcgcggcgaggacacgattcgccggcggcggcggcgcggcggtcgtgctgctgctaatcgtcgcgtcgacggtggccaccagggcggccgtcgccgacgatttcttctcccctctcagcccgctcctcgcccctgtaatcggtaaaggcaccttctcaaaggggatgatttctttttcttcttcttgttacaaatttgatggtttcttgatgatttggttggatggatggatgggacgggagcagggtcgatgtgcaagacggtggcgtgcgggaaggggaactgcacggcggcgtcggggttcccggggtacaggtgcgagtgcgagcctgggtggaagcagatgcacgtcggcgaccaggccagcttcctgccctgcgtcatccccaactgtaaggcttccgcagctcgcctctgccctttgctgctctcacaatctcacatgctctggctttctgcggttcttgttgtgtcatcaatgtccagctgaaatacggctgttcctgtgtccgtgcataactgcataccaacctaacttttgatcacaacgaattgatgtaggatgttggcatgtttgtatctgcaatttgggtacggttgttaggcatgatcattagttttctaatgataaattatagtgcgtgaaagggtatgtagcctagtggttgcagtgacctgagtagcaccctaagatcctgagttcaaatctccatataagcgaatttcagcctgttcaataggctaagttcctactttaaagatattgcatatatctagttggatgtagaggccggctaaaaattacccttctaaaaaaaataaaaattacccttctctaaaaaaataaaaaaaattgatagtgcgtttatggccaatttgcactgggagtgtgcgcgtgcactgtagttagtgggttgaagcaatctgcagaacagtaaaattcttaccaatagttggattcagaatgaaatgaacatccgaatgttttttttttcaagtcgtttcagcttgtaagttgtactgacatgccaatttctgaacataaaacaagtggcatctgcggtatgctgcttttgatgcttcaagcaactaaagcagattggcagcaatacggttgtttgtagtcgtgtcctgaatgtgcttttccaagcaaataatgtatttgaagtctagatgcacaaaaactttaatggaccaatcagatgcagatggaatgaattccaatttcttaagtctgtttgccgtcccggcatggcgaaaaaagtctgtttgctgtctcttttactaagacaaccagttaccataatttcaacatgcgtctccatcagacaggaaaaggctagattacttaaaaatgctcacgcctttgtgtcatcttcagagactattttttgaaccagcagcgtcatcttaagagttcctatttgttcctacattagaagacattcaagcgattattaaacatcatgtttactaatgttatgtggcccatatcagcttacatactcaaatgttatttttccttgcaggttccattgaccgtgcatgttctaacactatagcaccagcacctgcgcctttaccatcacccaaaaatttctccctcccaacagaccgtaactactgcaactggctgttatttagattttccttttaaaaagacttcctcagaactttttgataaaaataccatttccatttcatctgtgatctgatcatcaattcaccattgactgtataattgtgtatgcatagcctgtcaattagcttactgcggttcgggaggcacatgcaagaatgggacaggcctcagctaccactgcgagtgcagtgagggtttcagtaaccttctgaacatcaccacaatgccatgttttcagaattgtaagatcaaaggactcaagccacttgtccatgattgtgcaccgtattccctagctaactagtgtcaaaaatgtcattgtttaaggttcaatcggtgcggattgcgcaagcatagggctctctccatcctcaaactcttccagttctcctgcaccaccgggatctgctggcatatctaacaatggtaatgcacctgcatatggtataacttttttttttccagatgtgttctataggacatgttctctatttgcttcatgggattatttagaaaaagtataccatttctattaactttgttcgaactttgcaggggcgatttcacataaaattctacttcccttgctgattttgggctcactgatggtctgtcaggctatatagatagagaatggagcatacgtagtacatttgagctagattgtttctgccacggacaggatagagcagttagcctgttagagatgtacaccttttgggatgtttgaagtgttgtccagtgtccacgttatggttcttttattctgtgtgagatttgatcacattcatgtgaattaaaatggaataaactgtctctgtgaataactgaataaagggatgtttatatgggcattactttgcttgaaatgatctaggactacaaaagcaatatgatatgtttttatggtgcttatacattacaaaaggagaatattttctccagtagaaatttgtaataaaatcgttgcaagcctagctgattctttcttgcttggattccgcaatttaaaatgaaatctgtaaggagtactacaattcaggcaagttcttgtatcaattcggccagggaataagttcactttaactccctgaactaatgaccgaatctaattcatatccttgaaccgtaataccggatatatcgacccccaaactattaaaaccggtgtaatttgactctctttacggttttggagggtggttttattgacgtggcagtgttgacccggtctattttttgacgtggtgcttaggtggtattagaattaaaaaatatatataggtccattcgtcattagaaaaattagggacccacctacatgtgggtcatcccctccctatccttctcctccctctctctcccgtttgtcttcctctcactttgctcgtcttcagggggcaggatctggagcgacggcggcggtgagggtcggagcggcagcggcgatggcggcacggcgtcgaactcctcctgtacggcagcatcctcatcggccggtgctgctactcatccggggttcatgtatggccgcatccccatcgccctcgctcgccagatcagggagcggtacacccggcctggcgccattgccgagcaggccggtcatcggtgcgcacgaatgcacgatgtactcgtttgtggcagagcggatcaccatggctcagttcttggcggagccgtgtcttgatgaccggagacaagccggcaagcacatggacgctcgtcgtcacgggtcgccacagcgagagatcccccatgtacacgctgtatgtatatatacaaggacatc

SEQ ID NO: 67040 - DNA, 16424 bp, Oryza sativa
  unsure (1)..(16424): unsure at all n locations
tatacaaggacatcgacacgtatatcttagtagtatcaacgcagatcaatcgatcacaagaataagctagctaccggtggtgctgctcgtggtggtggtggtggtggtatctttgtcggcgccaccaccggcggccgtgtccagtgcgccgctcatggtgtgggtgtggacacggaccggatggtggcgtattgcgggtcgtactgcatgcagggccaggagctgggagcgcgcaccgcggcaggtgtcagtggagcccgacgatctggaggagttcgacgccgtgcagccgcagccgctccggccctcgcccctccgccgccgctccgaccctcaccgccaacgccgctccagatcctgtcccttagagctgagacggcgaagtttctcggaaggaagagaaacagagagaaggatagggaaggaggagctgtgggtcccacatatcggtgggcctcacaaatatgtttttgtgtgaacgactaatagggcccacatatatgtttttaattctaatgccacctaagcgccacgtcaacaccatagactaggggcctatttggtacagcttcaactcctaaatataactccaggagttgagtctggagtggagttgtggagctgtctaaacccagcttcacaactctattacattttgtgatagagttccactcaactccactcccagttttgatgaagctgaaactgtttagctggagctagagctgtgccaaacaggccctaggtcaacaaaaccaccctccaaaaccatcaagggagtcaaattacaccggttttaatagtttgggggtcgatatatccggtattgcggttcaaggatacgaatcagattcactcactagttgagggagtcaaagtgaacttattccattcagccagtattgatactgggccaatatgtacaatgggccggtaacctactcaccgtcagcctatatagcttcttgctcgttggcccattggtctagctatattgcatcagtacattgttcaatttttttttcattttttttcatttttgttactggtcagcagaaggttcctagtagtagtggaatggagtagtaatatgagttgtgaactccaagtccaagatagttctacagagcatgaaaacattgaatgactgactgaaacttcacttgggagacgatgaatttcgtgcactagcgtgacaagtttgatgaggaactcggagaaaacaacaagcatggaaaagttgcagattctgaagatgatgcggtggcaagtagaataataaaattatgtgtatagagaatcataaaatggaccggacatcagagtccataacaaccgccgctgcaggcaatattcagctccgggagcaccaaattatgggggctctcagagacatgtttcgttgtctcccctgctctgattttttttgttcgcaattatggggtcacgtggcaagcttccatcttttcagaaaatggaatagtagttaaaacaggagtaaacaaaacatatatagaatcaagaatttagaaatagtagttaacacagtagtaaacaaagtatatgttgtcatatgttggaaccgaaatagtcatagttagagatgatttacaatagtttctaccagtagtagaacccataaatctatgattaaggccacatctaatgataataatattagtcataaaatacttacggcagagaccatcgtagagttactcaacagtttaacataggagtaaacgtggtactagtaattaacaataacagcatgctgtcaatgtttatcaccagtatctccaatggttgcttgcatcgatcctctagggaaggttaaaatcggattgggatcacatgcagtcatagtagagactgcaagtttagcagttggaatcatttttcatcatcggatcatggcaatcaacggctgaaacaaatgctacaggtgtattaaacagtatttgctacagtacatgctacaggaacgcactttgtatggtcctttgtgaacagtatttcggaaagatctggggcgttaatttataatccaatggtgtcggtaggactgcttaagttgcagtggctcccaatccgttaaaatcaagcagggaaattgaggtagtgtttcataccgacgaagataataaagattaagttggtgcaagtaaaacaagcaagccattagttttacggagtacaactggcaactgaaacaaaagagttgttgagtcgttcagcgaatcgctcgtccttgtctcatagccacagaaattctattgtatccacacaagtgctatttactccattttctagtgtctccgtttttttctcttcctgatagtctgatacagtagatgatatacctgttcatcacttgtttctgcagagaggcgagtaaaaagggctccttgctgtaacaacaagcaacctcactcccaagaatactgttaaaaaacaaacagatgtgaatctttcacagggaagcaggtgaacggtgcaaagacatgcgtgcccttttcgttttgagaaaaaatagggagagaaagaaaccttcttccaacatttttcgctgttcatctgaaaacacatcttttggctattcaagcaaagccaaaaataaaaaagaagaagaagaaaagaaagaaatgcggaggggccttgaataataattgcaccctgataaattggagcatcgccacattactccatagccttttggtgtcgtgagctcaatccttttttagggttcttgtacctcctctggccaccgtcatagtaggctttaaaaaatgttcagggacagggctcgttgtcaatcactgacaagagctagtattcccaggaaataatcacacaacagctgtaaccagaaaattactggaacaaaaaataaacaagaccgcgtaggtgtagtatcgagaaaaaggataatatgccatttcattcattcggtgagtttcgacgaaataccacccaatacgatgcaaagaataaaatgccactccatagattatctttaggatattttgtcactttaagaggtttcaagaccaaaataccctggagagagaggaagagaagagaaggggagggggggcgaacgttgaaggtggcggcatccgtgctcatcgcctatgagcggtaagcgagcgcgggcagcgccggaggcagcgagcggtgcgcacacatgggcagcgcatgaggcggagagcgcacgcgggcggcgtcggaggcgagcgcatgcacgttggggagccctccacgtcgtcgtcgtcgcctcctccctcctatcagtgctgccctcttccctcatcgccgccgccgtcctccctgatcagcaccgtcgtcttcctgcccatcgcagtcgtcgtcttcctccctcgttgtctccaccgtctcccccccccaccatcaccacggtccgcccgtcgcaggctgcccccatgcactcgccgcccatcgccgccgagcatgagccccatccggctcaacctccccctctctttcctcttcctctctatccacagccataggtattttggtcttaaaatcccccaaagtggcaaagtatcctaaaagtaacctattaagtggcattttatcctttacaatacatgtattgggtggcatttcgtcgaaaccccccaatggagtggcatatcgtcctttttctcgtgtagtatgccctatctgctgagaaaataatggattatctgtttttttatactagctatgtgaggatataaacaaataaattaactactataaaattttaaaaaaagtttttggcaaaaatcttatatagataaaaacttccgtacgttaaacttataatttgatagcttgggaactgtgcaaacagtaatctactcgctccgttctaaaataaatttattttccatatatctcacacataataatcagaaccaaaaactaaaatatcattgctttattaaattccaatgtaattactgcctatcttatctactcccagtacatttatccattatactcataaactccgaagcaatgagtatttgaaatgaacttattttaagataaaaacttattttaagataaactaataaaagctaaaaataagcttattctaagatagagtgcgtaaaaataaacctatttccaaccccgaagattcagttcaaatttgaagtgtcctaaatccccagcgtaatgttcagagagaggaaagaatccatttcttgcaattaaaaggtggctcctctcctcatcttgcgtgcctgaatgacacgaaatgctgccttcttctgcgaaagattataatgaaacgatgattgaactactctaccaatacataggcctgcagataaagcccagctaaatgcaaaagaaaatgagcattctgaacataaaaggacacgaaatggggaatgccgaaatattcaggcttccctctctagggaacttatgatgatttgacgtgagtaaagcagcagcagtaacataaattagtgccaccagcagaggcagcagtgccaggagtgctcctatatcagtaggtcgctgttcattgacatttgtatacaaatcgcagagatatgcttgtttttatctttcttgtttcttgttcctgaaagaaagctgagctgcaatcctgttgctctacaaccccctcctctcttatccaagctactgtttgttttctgatcttttggggttaggtctagctcctttctgtggatttctgcgctctcatatactcctacagttcatctctgctgcccaacacatgctctatgctgtgtcttgtagttgaagttcgtgtgtgatcaaaaagtttaagttagtgcttttttttgaaactttattttaagtcagtactaatgtgacaatgaaattgttactaatgtgacaatgaaattgttgtgtgaaatactgtagtactgaaatgtgcatgcacgggtgcactagcctcaagaacactaacacgcatcagagctgaagatagaagtaggagaggtttttcattgttcatctacctaaagatgtttgaatagcaagaattgaacagagcaagacgatgatgtgcagctacgagcaattacaaagttcatggcaaagatggaacaaattagtagggaaaccactccccaaaaaaacgcaagggaagaacaaacaacagagaaaaaaaaaacaaatgaaaggagaggaggaggagaaacaaaatggcagcattaacatctctcgccctcgtccgctccctctttttgtacacaacaaacaagcatctacttacagcagcattacactcgatgttcaatctccaagaactcaacaatgtcgttacacacaccaacccatcgaagcctgcgtgattgatcgatcttcgcagcaatgtccttcttggctgcagtattgtctcttgctccgtgcagcaatggcgacgcagccgggaagagcaagcttgggcagcttagcagcaatggtcatcaatggcggagtggtgaacgagaacgacgcttatgtgcattgcgttggtcgtcccaaattaccgtcagggcatgaagagcttgtcgccgcacttgcagcgccacgcctccgggtagtactcgagcgggaagctccggcctggctggatggccacgtgcaccggccggcatgggtggcagccgccgcaccggctccggcacgtcggcggcgacgaccccggccccaccagcctccgccgccccgccaccgccaccgccgatccccagctggagtagtacacctcctccgccaccgcaccgccgccgtcgccgctcctctttctcgccgaactgcacgcccctgcaaacacgacggccggcacgcgatcgagcgcgtcagaacaagcatggaatgcgaagaaaccaacaccgagttctcgacccataccgagggaagctgcgaggaggaagacgaggaggatgaggagcggcgaggcggcgaccgggactctccgtcggcggccgcggcgcgccgaggccatggccggtacgtagctcgcgagatctcgagacgagcagcttacagctagcgcggcctactgtcccggcagtagtgaggtggtagctagagggagaagagaagtggagaagcaacaagcagcagcagcacgcgtgcgtgcgcggatcagctcagcttcagcttcgcacgagtcatgggtgcctgcggggtgaaagaaagaggagacgacgcagtgagagagcgtgtgtgtcgccaccgtgtcgcagagggtggcgtgcggttggcgaggcggtggatggctggcttttctcgttctcgtcgtcgtggctattctacttggggcgtttctaccatagggctactggcagtctgcgcggtggtggcgggggccgtcgcccgtcggtctcggcctcgcgattcgtgcgggaccggggcctggcactgcgcgcggtggccgtgcgcgcacgcacgcaccgtctgatcgtcgtcgatcgcgtacggccgccgtccgtccgatgctcccctgctgcatgcaagcaccgagagatcggtcaatcgttgtgcagtgcaatgccattgccagctagtacccctccagtagtaaaaaaaaatcatggtgttctgctcgatcgtagtactcctccgtagcaatggagcagacacactattggcggcctggaatcccggatggcatgaagccgcttcgtgttgtgttgggccacgacggcgagctcgtgcgtatcgatagtagtagactcggggacagttcaaaaagtttctaactgctgcagtttcttcaaaaattaaaaactctcttaaatagtctagttttattttaaattctgagacgttgtaattgtagaatttagaaactaaattaaaaaatagattctagaaaacctagttttttcatattttcagaagctagataatcagctctttcttgggattttaagttcccagacaggttagtagtacatcgtagggtgattctccaccgaatactcgtcgttgcaggtttggaacccgtaacgtgacaggccgcgacgatcgatcgattgagcacgcagtttgtgcggtgctctacactacagaagctcgtcgcgtccccagctgctcgaacagtttttgtttgcttggatctgtcaccgagaggcgccatttgatatagggtggctagattcctcctactagctgcaattctgcaaaggccgtcacatcggagacgtcaatccttcatgacctgctcctagtatagctttctctcctcgataatttcatcggttagagagggccaagtacacacttggtaccacatggctctgacaatattgctcttaagcaccgaccgatctgctacagtacttgcttttttgtaaaagatgaaaaagcagaattgaactcactcatggccaccgctagagtagcacgcctccaaaatactcgaccaggctaccatgtcatgcaacatgcatgcattcggcctccgaactttgctttgtgtttagatccaaagtttagatctaaacttcaatcctttcatcacatcaacctgtcatataaacacaacttttcagtcacatcattttcaattttaaccaaaatccaaactttgcgctgaactaaacacagcctttgtattctcctgtaaaaattttcttacggctgctagcatgagggcttgtttagttcacgctaaaattaaaaatttggttgaaattagaacgatgtgacggaaaagttaaaagtttatgtatgtaaaaaagttttgatgtgatggaaaagttaaaagtttgaagaaaaattttgcaactaaacacggccgaaatccgaattcagatttggccgaaatccgaattcagatttcctgacgtggacgtgacagccggatctatcccggaatccaagcagaaattactaacgaaacattaacccgagacgcatgtactactatgatcaaattaagggcacgtttcacagttgaaactgtagaaatgttgcatggatatcgataggagaggaacagaccatcacgtacggcatcaccccgacagaggatcacacgagccccccccaattttnccccaaaaaaaatccaaacggccttgaaacgccttaacaactcgcagtaccatgcactagctattactccatccatatctaaatatttgacgctgttaattttttttaaaacatatttgaccgttcgttttattaaaaaaaataaataattattaattattttcctatcatttgatttattgttaaatatacttatatgtatacatatagttttatatatttcactaaagtttttaataagataaacgatcaaacatgtacttaaaaagttaacggtgtcaaatatttaaaaacggagagaatactactaagggctaaaggaacgatttgtcataagaaaaaaaaattaagtgtgtactaaagccgatgtatgcgggagacttaaaaaggccaggccagataaggtagtctatgtgcacgatagtgcaggaaaggcgaaagctatcaacaaacgagatcatcgatcacatgtcgtacgtgtactcgtgtcgattaattgttccgttgctggtcaaaacgggtctggatcctcctagctagctgatgagaggttgaaggctcagtcatccgatgcgatttgctcccggttttgaacaaaagaagggtcagaccaatgtgacataccaagatcgctgtcccccagtactcccaatcatgttgctagttagcagagaaaacaagcgattaacgtgcattgtgatgttgagagcttaactggtgggaaaattagtacctatcaagctgcgtgtacaacgtaaaagtttatatcaattttgtttcaaactaaaggttttgtttgggatcagcttatcaattagtatgtccagtcgtaaatacttcatttgatatttagggtaatatttagtcaaaattttaaccaccaataacatctgaagtgtttgtttttttaataaaaaaagtacgagtagctaggtatattttcaagaatattattactccctctgtttacaaactaagcacttttgaaatagtgctcagtcatacctttttttaactttgattatcaatagtaaaaagaattaataaagattgaagatttaagaatgatattactagatatattgttaaaacgactatcataatacgtagcaactctttttattttaaatattttccttacttgtatatatgttattagtcgaagtagtgtattggagggaagccaaaagtgcttacgtttgtcgatgaagagagaaccgtagtaacataaacatataaacttattacttctatattttctaaaattattatagtataaattaatggctaaaaaacataaattttactcagtaatatttttctttgcatcaaaattttacaactggatgaaatggcatgaagtatgcctgagtgtggaaaaaaacataagacctattcgatttacatgatttctaaatcacaggaatataaaaaacatagaaatattgtagaaatgcacatgcaaaataaatgattggaacatatgattttttttctacactgagctaaacaaaagatgatagagtggatgtgttttcattcctatggaattagtatattttggaggattggcacagtgttcctacagaaaatttttctttgaatcctacgaaacgaatgcatgaatagtactatttctaaggaactgagatttcctacgaaacaatgcatgaatagtacttatttctaaggaactgagatttcctctaggaatctttcaaaatgaataagggctaagcaaggtgaaacgatcgatagagtagcaccaaacggtatccgtatactgtgcacacaagtggatgccggcaattggatcccatcgggccaagcgatcacatcgaaatgaccaaaagcgaccgagcagctgtggcccgtgcccgtgtcgtgtttggggcgcgcttcctactagtgaaggctcgtctcgtccattattcaagcgagaccacgctagaagtacgcgctacgcagtcacgcacgcatgtgccacgcagaccaaacttggttttcgattacttcctacttcctttgttctattttaagggccgacatgatttttcgtatctgaatttaaattttttaaaaaaatttaaaaatataagtcacgagtaaagtattattcatgttttatcatttcataaaaacaaaaatactaattataaaaaaattgaaataaaacgaacgattaagttggacacgaaaacttatgattatacttaaaatttaaaatgagacggagccacggagggagtatcttcgattttacccatgtcgcctggcgacggccttttgaccgtttgcaatatatcatcaaaactcaattttcttttgatatacagtagtaacgtgtaatccttttggcgttccggggggaaaaagaaaaaggcaccgcgtcgcacgtacgtactcctctcgtctcgtccgtccggtgcacgggggctatgcgtggaatgagcctatctgcctccccgcgcagcatgggatgggagctctagtactaggctcgattggtggaacagtgcccctacgagtcgtaggctacgacccccgatttgactgctccctggggcccccgcgtcccgcgcgcgaggatgcatgcatgcaatcactggtgaacttgcgtgcaaccccaccatgctgcacactcactgtgctgcgagctgccttacttctacttctaccgtgcagtaattaatcgtcacaatctgaatcacaaatgtggattgtggaatcacaaatttgtgcgtttctttggcgatgtaaacgccgtgtttacttccaaaataattcttcaaacttcctaacttttcgatcacatcaaaactttcctacacataaacttttaacttttccgttacatcgttctaatttcaatcaaacatttaactttggggtgaactaaaccagccaaagtaaaagtatttgtcaaggtgtcactcatgtcatgctcttttgggtttttgcataggggcatatgcatctccaacgcctgcaaactctctagcgtacaatccaacacgcagtgatagaccctggctcaggagtagtggcgtagcgtagcgagcggcagtgcagtagtagtacgggaaaggcgcaatggggtatccggttgagggggaaaagggctgtgtgaccgtgtgggtgggggagcaggagagggtgggttggctacacactcccgtgaaaagggaggacggccacacgtgcaaacccacacgggagctctgtctctcgcagccttgacagtactgctccttggaccattccatacattggcagtgtttagttgttttagcgattttttttttacatatacgaagacacatttaaagtattaaacgtagactaataacaaaataaattacatattccgactgtaaactgcgagacgaatctattaaacctaatttatccatcattagcaaatgtttattgtagcaccacattgtcaaatcatggcgtaattaggctcaaaagattcgtctcgcaatttacatgcaaactgtgcaattagttttttttttccacatttaatgctctataaatatgtctaaacatttgatgcgacggaaaagttaaaagtttaaaggtaactaaacacaaccattgttttctaccccatcgccaactactcctattggttgattactgtcgcttgtagtaccatgattgtattcacaccgtagtgtagttgtacacttgtactcctacgtagtactggcgcagtagtacctgtctggctgtctcgagcgttcactgtattgtactccatctattttataacgtaagattttttagcattatccatattcatatatataaaaagttttatattattaaacagagaaaatacttagcatagtattgtattattgtattagcaggggattgataattgattccagtgttcacactggtggagaaaccatctttggtcagtcgaccaaaatccacaatagttccggttccactaaaaacagggactaaaaatcatctttagtcccggttggtggctacagtgggtatatttgatcttaccaaccgggactaaagatcatttttagtcccggttcatatgttgttaggggctgtcaggccctcccgtaatctttagtcccggttggtaacaccaatcgagactaaacatcttaactttagtcccaaccgggactaaagttatgatttttagtcccagttgttaaacaaccggtaaaacaaagcctctatccacgtgcgcatgaaagtctcctattaattccatccttatctcatcctctcccatccagtcatcctctccatcttatctccttctctcctcctttcctcccatccttctcttccttcttctctcaccccatctcctcctcccctcattgttctgaagatattgtagatctgaacaagtgtaaataatatggatgttttgttgtttgattttattcattctatctatgatttaggctttgtcgttgattttattcattcgatccacgagcgaaagctaaagaacaataaaaaaggaaaaatgccaaccggatgaaaggaaaaggaaaaaaacaaaactttttagtcccggttggtaacaacaaccgggaccatattttttagtcctggttggtaactccaaccgggaccatattctttagtcctggttggtaactccaaccgggactaaaaatcgatctttagtcccggttatttaaaccgggactacaaagggttaccaaccggactacaaagcttttctccaccggtatcagtacaaatatgattaatcggcgtgctgggtttcaaactcctgattgatccaacccattgccgcttttgttcacgctaaccccatgctctgcaaagttagaaacggaccagctttacgagttctctcatgagggttctccccatcacggaaacggccatgtgagacaagcatggaagaaactgagtgccaaccatccactgcatgctcgcgttgcagcgcatcaacccatcgcccagctcgtaaaggggaacgaagctcgcatgagcaggagctaagcagcggccaccggcgatgtatagaccggtcaaacgtttcccctcttctcgagtggcccccaccggtcggtcggagagcaaagtgacacgtggcgacacacaattgggccaacggcgtcgtgaacctctcgctgaccggcttcgtggctggccgtattgaccgggccgagcgtgcggtcgcggatgggggcccaaccggccccgcgtggtggggccggggggagggaatcgtatccccgacacgtgggcccgtcatgtggtcgtttccgtcacctcggcatggggtgcacgagggggtgcacgcctgctgctgctgctccgtccaatggatgatgaatgaatggccgcgtaaattcaccgtcccttttctcccagtccccacacgctgacacgcgcacgtacgcgcggtgacagacatgtggtccctgcgtgtcagagtcctgaccctcactcacgtactgtacttgccagatcgtgtactacgggctacgtattgccagatcgtgtcagagtagcattttgcaccgctacagctctatctctcctcggtggagcttcagatccaccaaaaatagaagcggtgctgggtggagctctatcataaaataaactagagatgtgaaactaggtgtttagggagctacataaccactccagacccaactcttaaggctaaatttaggagttgaaactttaacaaatagactcctaactccgtattcgctccgctcttaaaaaaatcaacctacaaaagaatgtgacctctcgatagcacatattgatttttttttttgatggtggaagtacggagtacataactccatactcctagctgctacttgtacttgtatttccttttttttttctcttcgaaatggtgcgatcgatctagctagtttttgagtagaagcatttgtatatggtgcgagatgacaaggtaataagtagtaggagtacgtatgttcctcggtcgtggctgatcgagcacgaacctccgcagtagctagctagctggatctacgcacaaaagaaatactaccagtatatagtactccatccgtttcgaaatgtttgacacagttgattttttagcacatgtttgatcattcgtcttattcaaaaacttttatgaaatatgtaaaattatatgcctacataaaaatatatttaacaatgaatcaaatggtataaaaagaattaataattacttaaattttttgaataagacgaacggtcaaacctgtgctaaaaagttaacggcgttaaacatttcgaaatggagggaatagtaaaaaacaagccggtgatacgtcgtacttccactactatacatgagtcgcgattgaacatactcctatgcatggctggatctgtcacaacgtatactacatgtcctcggtcggatgcatcaactcacgcacagtacccgcaaagggacaagacgcggtacaaccgtacaaccaggcaaaccccagctagcctttgccgttgttgtttaagcagaaacgcagcagcatcgatatgatcggactacacctactccgatcggttggtacgttgacacgttattatgttcttgcggatatatcatggacttgatggcgagtagggatcacagtcgcacggtgagacaacctgcttacacggttattataaaattaaaagtgtgacgatcgatcagctagctacatctaaaatgagatgggatatgtataataaatttagacaaaagtctaatttaacgtgtttagatttattgtattttattctattttaaattaagtatttttagtacgaagaaagtagtggtaataactgataagtgtacgaggattgagctgacaagacggtttacttcgccgtccggatcaagctggcatgtacagtgtgtatgcgtactggatcgattggctagcaagcgcaagctggagtagaatgcactagttgaacattccaatcgagatgcattgcatgcatcacacgcacaattaaacgcacgcattgtacgtagacttacatttacacacggcactccatcgatctctccatctgcaaaacactgttcgaatgttgggctggcatcagctagcttgcccatctagcagtacgcacgtgtacgttcttgttgcagtaattgaagatatccactacacatatatgcagacatgcagtgtagttaaagtactcttccatctctgaaatataaacgctttcataattattcattggaattaaggagatgagagaagtaaaatttaaatgtgaatggttagattgagattatgaagttgatcaaaccaattttaaacttaaaaggttgtttaagagggaggaaacagtagattaagatataaagatgcatgtgtgtccacagcactaattcctctggtcgatctgccaccactgtgtgtgcttgcatgcatggctgctgttttgccatagccacacttgtacacgagtgaccaatcaatgcatgcacgtctacttctacctgctcgatcgattgattgccatctgcaaccaccgtacaccggccggtgaccggccggccggcgtctcctgccctctgctcctttcttcttcttcctcatcctcttctctgcaagtttaatttggttcaggaccacatcctgtgatggaggagtaatagcttgtccgtgtggtactactccctccgtcaacccctggatttttgtgtccaactttaactgtccgtcttatatgaattttttttataatttgtattttcattgttgttagatgataaaacatgattaatattttatgcgtgacttgtctttttaattttttttcatatttttttcaaataagacgaacggtcaaacgttgggcatggaaatcagggtttgtcttttttgagatggagggagtacgtgaggactggtccagtgaccaatagtccaatacatagctctcgatttgtatggctggctggcattaacattcgccagtaatggcttgctgtcgaagagttcgatctgttgatcgatacgacatcggtcaagacaggactgtatgaacaagcgacagtaatggtttgcaccttgggaaccaatcaatgtgtgtgctcgcagttgcaggcacggttcctgcagggcttattgcctttgacctggacgacatcatggtatgtataggactcgatcaggacacttgaaggttaaattcacttgtaaagaacggctacacaatgatatatgcggattcacttacggaagtgctaacgggcgatcgatcgcccagcgacaagggtagcgatccatcccccttccccctccctccctccacctgctttccttttttggcaccgcattgggctgcag

SEQ ID NO: 67041 - DNA, 6777 bp, Oryza sativa
ggagggagcgatcaccccccattaggagtacccattcacttatgcaagatggataatttggtcgttttctgtagtttccgcgaaggccttccatataaagtcaggcccggcaaagcctttgaaggcctgcattacttatgtaacacaatgtggactctgtttgtttgtctagtactgggcctcaattagctcttttggtgaattctctcgtcgttcttttctggacctaatcctcgttgagattctctgaatatgacatgttactagctccttccacacaaattaattccctgtgcatcacgttgttagtaggggctggtttggtgagaattttcagaatatgccatcgaatacgcaccgtttttaggatagcccactcaatttgtactactctcaaaacatgccatttggacgcgaattttcttcagtccgtgacactccatcacctgaagccgcgcggcgtcagttcctcttctctagcgacgtttacaagcgcgcatctgggcaccgccagcgagctcttgttcccctaccggcgaggtcctcctcccccacaccggcgaggtcctcctctcccataccggtgagcttcttcacgcacgacggcgacctcctcctcccccatgcccgcgagctctagatcggggagcggcgcgtggagacctcggcggccagatccccacggctacaagccgccgcccctcgtcatcctattgccgccgcgcccgagcggccgtcaacggtggggctcgatggcaatggctggtggggcgaacgaatggtgaacggaattgctgcgccgacacgaagtgacggtggaaggacgggagtgtcacggacggtagaaaatttgcgtccaaatggcatgttctgaaagtagtacgaatcgagtagcctatcttgaaaacggtgcatattcagtggcatattctggaaattctcctggtttggtttgaggcctaaaataggcttaccaatatttggcaatttcaatagtgtttaggatatatttggtttaaagccaaattttggcatgcctaagaaaatagaccatttcaatagtgaacttaggctattttggcttcaattcaaatacaactttacattaccaaaattagccatgccaaaacttactaaaatttggcattgacaaaatttggtaaggcctgtttaggccataaaccaaaccaaccctagatcatctctgttggttttgtctctggcagtgaatggatagctcaagtgctgagaggtgtgaaaatggatcgaagaagagttccctttgtatgactgaaaaccgtttgagttcagagaaactattttaaagtcttgagcgaacatcttttctttatttgcattgtcattcaaatgattaaaaaaatacttcataaacgttcaataaagtagattaatactccctccgtattttaatatatgacgccgttgattttttaaccaacgtttgaccactcgtcttatttaaaatttttatgcaaatataaaaatacttatgtcatgcttaaagaacattttgatgataaatcaagtcacaataaaataaattataattacataaattttttgaatgagacgaaaggtcaaacgtttgttaaaaggcaacggcgtcatatattaaaatacggagggagtatgtgataaatctgtctccagggagttggatgactgatgagatcgcacttactgttctctctccttctctctaggttggcttgaattcaagatctgtactattaattctcaaattacgcatggttctttgattgttattctttagatcattccagaatcgtgcctgatcaacaacgaagaaattccgattcacagataactgaatcgatgcatggcaggcagagctctcatctaggatcgcaaccaattgtagcgatcctgatagggatgtgtttcaacggatacaagataaatgtacggactttccgtaaaaacttacagccacttattccatacgatctgagccgcgtattctcgatccgatggtctgcgttgtcccgaaagaagattgcgatccacttggggtgccctttaacggagtacacgtaaatagtaaggtcttttcgttaaaaattaattcaccgcatgatctgaaccgcgaattgccgatctgacggttctcgttggtaccatgggatcactttgaacgactcactaaatagaagggccttttatgaaaaaacgcacgctctgccgccgccgtcatctccgacgctcctccgtggcggccggcggccggcggccaccggcgctgctcgtcgctgccccttcccatggccacgcgaggagagcaccaagctaactatgggtggtcgccgcggcagcatccttttctaatgaaagcgacctcgcccgctctggcgcggcagcgtggagcggcggttgctcgcggcgtgtttgacgaaatgccgcgccgggacgacgacgccatggccggggcatccacctctgggaccgcgcgacgcgacgagtcttctcgcgtctgcagcggaaactccgtggtctccgcatgattcgtgtcttcgtgagtcgtgacacgggaggggaggcggcatggacttcttcaggccggcgccagcgcacatgtaagaaccgaacgattcgctcatcgcttttgtcatcatctaaccaacgatcgatgaaaagcaatgtttatcctgatggcgctgaaacggacaatgttgccatcagatcatgcttgatttctttttaatttttatttatcgacagcgtgattcatgcagcgtgtgcgaagtacaccagatctcagcaaacttttgtcaaactcaaacacgacgccttgttccaggggtgtcaatataaatagcaaaaaattgggggaccgtaccagcaaaaatctcagattgcgttgagctgaagctgttcgtgtgactcttctacaccttccaggctatccggaatcgggagggtttcccaataggaaagcaactcaggactcaggagcggcgtctgagaggtttcagagatggagaaccagttccaggtgagatctctgtaccctaatccttttctcctgctcttgtttgtgtcctgaccgacctgggatgccgaggacatgttgcgccaagaaaagcttcctttctttcccgggcatgtttcgtctaggttttcttgatcttgtttagggttcgtgttgaataggcggaagttgtacatgcgaaattggaggcggtattatgggattgcgaatctcctccggaaaattgatttagctgctttggatgattggctttgggggtgaaactgtgcttgtaaaatctcagatcagattaggcggtcaattattcgatttgctggtgggtttggtactcgagagcaccccaaagttgggagctttggtatatgtagcatggaacttgctatccagtcctcaacatggtgttctagtcctgtttgagaataatctaaaggttggagttaaacagtacgggatatctgatattttaaatggtacaacatagagtttagaggtccttatttattgaagaaatgtttccactatcaccatcatgtctagatcacccccacttcaataccgttgctctgttgatactagaactctagaagtattgaggccccttaaaggcttcaagcttgctgtcacttggttgacctgatgcagtcttattatataactaattacttcatttataatggtttttccattttttttgcatccacttgctttggagcatttgttgggaggttcttttcctaaggatatctgtgtcctgtcaaccagtcctggagcattactagaattgcatggatttcatcacttctgtttgtttttgcattccttagtcttatgaatgagatgacctgatacaacgtaaattatgttagatgtttaaactagacctcagatagtgggttatacctgtttctacttgttctgaagtatgttgtccattgctaatttaggatggcaaggaggaggtcatcgaagcttggtacatggatgacagtgaagaggaccagaggcttcctcatcatcgtgagcccaaagaattcattcctcttagcaaactttcaggtttgtgcatctattgctcaaacaatatgtttagcttttgtaactaactcttagtagaactagtgccaaattgccaaaaaacttgccagatgttaatgtggtgcacaattgatacaccagagttaggaatattaagctggcgcctgaatgctgatgactgggagaatgatgagaacctcaagaaaatccgtgaggccaggggatactcttacatggtttgcatttcagaacttgttgtgagtttccattttttttgttcgcaaggttaatatgcttttccttgtgcaggatatttgtgatgtgtgtccagaaaagctgccaaactatgaggctaagctgaaaaatttctttgaagaacacttgcatactgatgaagagatacgctattgtcttgagggaagtggtatgcatctttattatactagttgagcacttgataactagtaataacttgcttccagcaataatcatggtggcatgttttgtggttgtcacatacttctttttctcatgctcctctaggatacttcgatgtcagggaccaaaatgatcagtggatccgtgtagcagtgaagaaagggggcatgattgttttgcctgcgggaatgtatcaccgcttcacattggacagtgacaactacatcaaggtatcttttgctttgttcctttgttcccacaaatagttatgttataagcatcaaactgactttgacgtgaacttatgcgttttaagtatattggtgaacagcggtcaccatttttctgtcatttacttaagtaatctgttcatttcctaaacctatgttccatttctatgctcttatcaaataaggaacatcagtccaatatggttttttccttactatgcttctgcaggcaatgcggctctttgtgggagagcctgtctggacgccgtacaaccgtccccatgaccatctgccagctaggtatctgttctttctgttccttgttttcctctttatctctggcttatttttccggttattgttgactcagtggaggttttgcataatttcagaaaggagtatgtcgaaaaaattatcaacaggggtggaactcaagctgtcgaagctcgttaaaggcatatcaagatgtgcttcctagttcggtgttctgttacactctacagatactgaataaactgtgctatcagctgttgcaatgggctcctaccgacatcttacatcatttggcagtattttgcacaaacccgcttaaaatctccctgaaaatacgcacgtcaccatgtcagagtgtttatatacaataatgacacttcagtccacagtcagcaagggactaatgacaatcattgtacttgtggtgtgtgtgatgaaaccacaatgatcaaaccgagtgtctgaatctctgaattgttttttttagcacaatgattgtgtaccaaaccctctgttgctgtgtgcggtggctggctcacctgatggcctttgtgctactcctgtcgtcttcaaagtatctgacggtgctgaccaaaatctttgaaatgatagtgctaatgctgttgattaccgaaaagttggggcacattgatggcagataacctagtactgtgggtttctatggaccagagaactgcaaggaagattgtattgtatgctagtgagattgaacacgttcatgtgtacttttggttgccacttgcccagttgcgagtccggccaacggtggaacaactattttcaggtcagagcagaacgcgctccgatggatcatcaattcatcattccactttttttttgtgaggcagcaaattttgcttgtgtgtgtagtgcgaaagcctcacactagtatatcaaccaatgagtagcaaatgaaaatatcttggacagctagttttcgattggttgcagaatttggggtttcaacaacttgtttctattctttattttggtttaatactccctcattccctaaatgtttgacaccgttgacttttttaaatatgtttgaccgttcgttttattcaaaaacttttgtgatatgtgtaaaactatatgtatacataaaaatatatttaacaataaatcaaatgatagaaaaagaattaacaattacttaaattttttgagtaagacgaacggtcaaacatttttaaaaaagtcaacggcgttgggatggaggtagtaccatataactattgggtaagacctgttatagtttcggaaaaccattacactcaatttaaattcaaactttttatatcgtgtctggtagaatcatttttttttcaccaatgtttgaattcaaatattcctgtttgatttgaatgtttacccaataaactccggtaaagaacaaaaacagcacgtgagtcccacgtgagattgaaaaggaattcagataagctaagaaaaaacccagagagaaaaaaagaacaaacctttttttttctcctgacccctgcaatgaatatcatctagccggacgagatcgtgtgtgccaatcaccgagcgcggcaaacaaattctgtgacccacacgcaaaagcgtcgtcgaggccggatgagattcggatcagaaaaaagaaaaagaaaaaaaaagaaaaaaaaatggcacgagccgtcgatgtcagctatcgattccggcatcccacttgcggccgtgccggcgaacctcagccacactcccaggcttcgccttccggaagct

SEQ ID NO: 67042 - DNA, 15516 bp, Oryza sativa
  unsure (1)..(15516): unsure at all n locations
cagctcaacacctacgtgagtccccccaatttccattgccaccactagtgttgttccctgcttgtcttcagttgttgggaaattgtgtgttctgttttcttgttttggatgttgttgttcagttcttggtccggacgaattacctgaacaagcgatcacatttctacagtttgagatttcaggttggattgttagataattaaaatgggtgtgttctcacttttgtggttgccattatgttttgtgccacatcgtgtgtgttgagtattgataggaatcttgacactagaattaaatggatggagcattgtaaaattttcagtgcaaattgtaaacccggcggtattggttaaataaatcggttgtattgtgcatttttccactcagtgcaagaactttgtgcatgcacaaatgcacaattatgtagcaatggagctagaaactgggatttacttattggtgctgacctgttggttgtagaaaattacgatggctacaattgttcaacggactgttttgtggacttgacattatttgcccaaactcagctatgtccaatccttttcagacacatgcatataaaccctcaattcctgaaatgttctcaatgattcagaaagaggaaaaaaatctccatggacgaactactcagtttctgacatgctgttttcttcaatttgttactgtgtagctagatggatcaagacagcggatgaagctacaagaatctgcttgtttgttctagaagactcctttgatcaccatcaaaaaaaagaaaaagtgatgtagtatactgctacctgttctcttaataatgctatgataaattttgtcgcaaaactatgtgaaaccaaccgttttacatactttgtgtgacttgctatcctaattgagttttgtctgtggcttctgtacttgaactaactatacctgtaatattctttgtgtttgcaatttgcagggtttcagaaagattgatcctgacagatgggaattcgcgaatgatggtttcctgagaggccagaggcatcttctaaagatgattaagaggaggagaccattgtcttatctccctggatctcagcaggcacttggcacctgccttgaggttggtcagttcggattagatgaagagatcgacaggctaaagcgtgacaagaacatcttactcgcggaggttgtgaaactaaggcacaagcagcaaagcacgaaagccaatatgcgagccatggaagagaggctgcaacatgcggagcagaagcaggtccagatgatgggtttcttggcaagagcaatgcagaaccctgacttctttcaccagttgattcaccagcaggataaaatgaaggggctcgaggacacattctcgaagaagaggacgaggtcgatagacatagtgccatttctcaaccccggggaggtcagccagggcgatcaactcgagtcgacattgctgtttgatccaaggccatttgctgaactgaatgatgagcctgcaaagtctgaactggagaatttagcactgaacatccagggtcttgggaagggcaagcaggatgtcaacaggactcgaaatcagccacgaaatcaggctagcaacgaaaccgagttaaccgacgacttctgggaggagcttctgaatgaaggagcaagagatgatgctgggattccagggatggagcgaagaagacctagatatgtcgatgcattagcgcagaagctgggttatctaagcaatagtagccaaaagtagatcaagtggctccgatttgtccaaccatttttgtgatagctcttattgtatatcggtgtaattgtattatagtgatagttttatagcgataggtccaatttatattgcggatccggcgtgctgtgtagtatatgtctggtgatgtaaagttgagccatcattcttaatggtatatattgacaattttttgcattgttgtggccttctttttgtcatgcactcgtctatgctcaactgcttggtttatggtgatgcctgctgaaaaacctgaattttagctgatgccggctgtacgcggccgctgtgcagacatatctgggtgaagtctgaagaccatacatgtgaattttgtagtaggataaagtgagtgaaaattacgggtgaagtctgaagaccatacatgtgaattttgtagtaggataaaacgagtgaagtctgaagatcatacatgtggattttgcagtaggataaactgagtgaagtctgcagagcatacatgtggattttgtagttggataaagtgagttcagacttcaccccgatgagtttgcagtaggcaggatcaactgagcaagtcgctctggatagatttgttggagaagaattgccgcttgggatctggaacattagctagacgatggaagcagaagcgtgcagtacactactgtagagtgtacaggagggtgattcctggatgctagtacctgattgatgaaagttgtatacgatgattagcttcacaagaatgtggtgtgcacctggttgtgggccttgtggcgacttgactactactagtagtctagccgtctaggggtgtgtttagtttctgaaaaaagttggaagtttgggaaaagttgaaagtttagaaaaaaagttaaaagtttatgtgtgtaggaaagttttggatgtgatgtgatgtgatagaaagttgaaagtttagggtagtttggggtgaactaaactaagcctagtactccctccgtcctataaaaaacgaatctatgaccggatatgacatattatattactatgaatatattctaatatatgtatatccagattcatagtactaagatgtgttatatttggtatttatgggatggagggagaacttcagttgttgtgtacttttatggtcgatgatcatcggtggcgactggcaaccacggcatgaaccaggagaattttgcgcagatgcacgcggggaatagcaaaccgcgcacgcatgggccgtttagctgcccgcaccgcacacggctcggcgaggagcacgcgcggtgggccaagctctgggaatcccacgtcaacgcgtgtatgggccaacctcgatgagactagctgatggaatttggaattgggccgagttgctgggctcttcaccacaggatcgcactcgaacccacgcgacccccaggcccagcagatcgatcgctgcgcgtcggctctttgactccacttctgctgcttcctcctgaggctactaaattgtcacgaccttaatttctcatcaataaattaactaggatattacatttcacaactcggaacacaaagagtacaagcaaatagccgacttctcctcaataacttaaaaagtttttttttacatatgcaactcaatacatttaacggaccctacggcatatttgcaaacaaaaaaaaatttatgaataaaacttttatatacgtgttcttaacgatctaaaagcaaaggctgaaaaataaactttgatgaaaaaactctaaaatcaactcttaatttaaggtattcaaattttgaccgataaacataatcgtaaataaaaaatgaggcctttaacatctcctaaaatactgacttgtagttttgtctgctagagaataaaagatgaggtgaaaagactgatacccgtaattaggttccttgtggtggaacctatccaccctgtttcaaatcctaaatttgacataagtgttcgtatttacggctaattattcttttagtggtaggtgatgtacccgttgacaacgagacgtccgtggtgacttcgtcattttcaagatatgccgccccagtcttctataggtgctcatacgggtaggggtgtgcatgtgtgttcatagtgtagtaaaccagctcaactattagcggagcaccaaacctgctccatgtccatcccaaggcattgaagcatgagaagatgtagaacactgcacttttctctttgccctcaagaacattgcagaagtagacaatgaacagagatgtggggctttttctttattatagatatgatatggagtataaaccaacttgagatgtctcacctgctcttgtatatatgagtcttaagatgaaataaatcttatctctactccggtttagattgacccatgagaaacttatctcctacagatttatttcacaacacatagggttgagtacgcgtgcgttatgagcgcatgtgtttatattgtgtttcttaaataatattaaatggggttagaagggcccgagggggttacgattatttacaaattaaataaaggttagttggtgggggaaaatagtgctctagaaaatcttatattttacaagttttattaaatgttacaaatctttatatcttagaatgaaaagagtatcttatacttatcttacatcatttgcataggccagaagagcgacacgtaacacaaacgacacaaattaggcgtggagatgcatgaaaggaccattgggtgtgcagcttttagaaagccccaccataagctaatcacaaaaccttggcatgcatcacatagtgggcgagcatgccatatattctactttccttccattctccatatatggaccacctcccacactcctttgaattattcttgcgcatatatcgatcatctaccttttctactattacatccattttatattataagtcgtttaacctttttcatgataaatttgactaaaatttagaaaaaataatattagtactttcaacataaaacaagcatattatcaaatatattcaatattagattttataaaactactttggtattttagatgttgctaaatttttaaataaaaccactcataatataaaacggagggagtactatacacaaaaaaaaaaaaacattagcctctccaccaaaaaggtctctccataaaaagccctaatcaccttctcccactccaccaacgcacgccttattttgcccatccccctaatctctctctttgataaggtttcttctcccatatctctctagctagctactaggcatggcgattatggaggtagatgagatgggctgttaattcgctttgtttgtgcgccataagcaggtgaagctgccagcatgatctgaaagcatctcaaaccagcgatcagatcatccggcagcttcatcttctcatggcagcacaccagcttgattgattgatgatgaaaccctaggagcaggtagcttggcttctcgatcttagcctgatcttatacaaggacgatcgattaggccaaatcaggagttcaacagtccatgtaagttcagcttcagctttttttaatttgctccttgagatagcaaatcaagatctagggctttctggaggagatgaagtcgtgtacatgttcttagattgcgatcttggtagtttgtttttgtttctgcagatcgagtgcaaatatatgtcttttagatctgcatatattgatattggatttgtaactttgaatgtgcaatttgatctgtatatgcactggatatgacattattcatgcatcttacatgttttatatcacttattagtatgcagaaattgaagtctgaataattaagcagtaggatccatctgacgaatgaacatatatttatatataagctattatattatcaggtaacgcatcagactatcatctcatattgccccgtgtccctcttaaacacaactacacaacctaatgttttatatgtatatgcatgtgtgccatacacgcttgcgacatacatttagatgttctatgatatccattcactcatcggaatatatctgacatgcatggagtggtgaattgaagttcccccatgcatcctctttttcaaaaaaaaaaaaaatctatatcatatatatatcctctatcccttgtctttcctactttcccttacatcatacatgcatgaagatgtacatatatgaaaaaaaatgattaatactagtattttgcagttactatttgtccaatccaaattaatcttctgatgctattttcatatggcaaatcttatagtatctcttgtatattttttttctctttatcttaacgatgaagttgttaaagcttgattgcatacgttctaataattcgtgatcaggaagaagtattaagttacagttcaagatcagggaaaagcataatttcatctgagtcttgctctgatcccgttgaaaacgttttaaaatcttgcaatatgcatggaccactactatgaatcaacatatcgccatccttgatattcattaactgtggtggcttaattagttgcttcggcatatatactaatttgacagtacaacagttatttcagatgctgcgtgatctgaagaattttcgtccttagaggcatcttacgcgtgccatccatgcctgaaggatgatctcacatctgagcaaattaaatgcgatgaattagattcccatatttactcgacctcttattgctagggatatatataacctctctttggtgcgtactaatcgtctgattatctcctgtcactgttgcttactcaaagctaattatatgaggctcatttcctctcttttctactgtactcaccagatgcaacttttctgcactgcagatatatgtggacgctcattgtcatccaaaagcaagattagctcctctaattttgagcactgacgcatgccactgataaaccttttaaactatataaacaaactttcagttgcaagaaacgatacagtgcatgtaactatactataaccaggaaatgaaggggactgatgtctatagcatggcgccgacgaccactgaatagatgcatgcgcgcatcctctggcttgcaagaaattgcctgtcaattctggcaggcaacaagaggatgaaaagaatcacaacccctgaatggtcacaaatatttcacaatagaagttagtattttctccgtttcacgatataagactttctagcattacccacatttatataaatgttatgtgtctgggcattgatagaaagtcttacattcgtgaaaaagagggagtagcaacttaattttaggtccgtgcagtgttgatatccagattaacgaaatgtttttttttatccgtgatatgttcctctgtatatggtctgtgtaatacacatatactacttttaattattttggttttcttctcagatttcttcttgcgatttacttatgttaaagggtaattttatcattcttaatcaggtactgtcacaccccaatctgataccgccgtacaacggcacctgacaggagcgtgtcgtagggaaaatggcgcgaaccgcttcctacgaaaccgcgatctcggtaccagtcccaggacatagtgctggtacccacggtgacaaatatgaatcatagcaatccttaaaataaatagaggacttatttaccttaacttaggttgcagctcagacagcccgagaatacaaccgacgacgcggatgaggaaacaccaacagcagcagcagcagcagcggaaccaacggtctaacacccaacaccacaggcgacggctgggaaccaggacgaaaccctaatcttcacttcactttatcttctcttcagggcggaggaactatatatatatatttatatagagcaagggtgagtactttcgtactcagcaagtcacgggaatttaggtgtttaatgcaagcttggaagagaggcaaggttgttttgcaaatcttttgtttgaaatcattttgaaatcactaagtgatttatttctttttaagtttgggtcgaaaagagaaacttgcgtctcaaatcgacttaagagatgcttttcaacagctcaattggaaatgtaccgacatcccgggtcagatcattacttctcggctcctagagccattccacttgattaatcggctcccagagcctttttcattttctcggactcccagagtccagctgcccagcagcacaacaatccgcttccactcgggaagcctagtctatgatgcccacagacatcccgaatcacacagattcgtttctgaccactcaggtcatccatctgccacataggctgattctggttacgattcccataccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacccagggatacctcatgccacatagaaggatcaaatcctcacataaacataggccattttaggcgttcacaaatcaaactccaaccacctcgatcggtaattcagcaagcttctcattcttgcattaccaggaacccggtttggctccaaccgaccccgccccggcgttcccaactattggcatgcgaggtttccctgaaccgactagttacttagccagggtgtctcattccaccttgtggttgcattttgattatgttcgatgagttttccacaggaatcggtccttatatgcgaatacgggacagtgccacataggcacaacccccgcatcgcgagttttcataattcattttattttcaaacacacctacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggagcaattgatcaaagggtgacttgccttgctcaaggtcttcacgaagcttcacgaatcttcgagaaaacccgcgatcgacgaaaatccgataaccacaactatacgcaaacaattaaaaacctacacaagacccaaaataaagatcctatttagactagataatagtaccattagatagatctcaattttacggaattattggaagttgaacggagtcaatcggatgagcggttgagaagatatggattttctaaggattaaggaatttctgtctaaagaaaaaggatttaataatttattaaaccctttctgcaaagaaattgaaggagggatatgatttagacttcctcgggtggcttgggtgcggcccaagagggaaggcacggctcggccgaactaatgggccggccggcccggagaggcggcccaagggggcgcggggagagtgagggagagagagagggccggtgggccaagtctaccttgcggggtcccgagtggggcccgcttgtcggtggcgcggctcactgtgggagcggcgcatgagggcggcgctagggtttcgggtgagcgcggttcacgcgcgtgcaccggatggaccagggatgcggcgggcccacgcgcagccggttggcgcaccgtggaccgcgcgcgggggggggggaggaggcggctgaccggctctgctcggtcaaagccgaggtggcgccgacgtggcgcctacgtggcagccacgcaggccggcgggaggaggaagaaggggaggctgagatggatggcggacggcggccgtgttcaccggagcaagcgcgacggatttggtcttcgggggggcacaccggagtaacgagggcgtcgagaaggagcgagccaacggctcggattcgccggagggagttcgacggcggtggaattcgacagcggcgtccggcggcgagagaaaggggaaatcaccgaggggcgacgaagactcaattaaaggcggcgggagcatcttcggtgttcaaggagctcatttccggggtcggatgggtctgagcggcgccgtgaaggtccggcgatgagaggcggcctccgggggtgggcggcaatggcggcggggccatgccgggtggcggcggtccttggggcggcgtctacgcgcggtcaaggggaggagctggcggtcgcgcccgtggtccaggcggtggcaggcggtgacgccgatggtggtagggaaaaggaaaaaggagggggagaaagggagctctgctccttgctgtttcgggaaaagttgaaggagggagagggagtgagagaggggctgcctctctcggctttggaagctagcggcgtggagcggcagagcggcagcgcacgacgcaggcgacgccagggcttgacgcggcggcaaccgggcggctgcgcggcgcaggcgcggcagggctgacggcggcacgaccggccggtcggccacgcgcgagcgcgggaaagagcgaaggcggtggcgggttttgggcggcgacggcgggaagcggcgtcggcgcgagagagagaaaacgagagagagagggagaaacagcgagagcgagagagctctctctcggctcggctcggcacgtgcaactcacgtgcgaggctgagggaggagaaacggctgagggagggaggtggctaaggggggaaacggcccacaacacccgagggaggtaaaatagacttttgtagagaagactgatttggagtggattcgaattggggttttggattcgaattcaaatttgacattcgaactcgatggtttagggaggaatcaagggagactcgaggagaagtcaaggaagagattcaaaacggaaacttggatattttttttgtagtcggagcgaatattcggcaaggattcaaaggaagggattgactttcggaatttgatttcggagacttgaattttggataggaaatcttgaggtggaggatttttgatttcgatgagagggaacaacgggatcgaattgagatccatggcataacttagactctcacacaaagaacgaaaattttcgcaattaggattttgccgagttagtttttaacgactcacgaaaagcggagcgttacaggtaccaggaagtaaaatattttctaatataaaatttagtacctcctggcattaggtatatggagatataccaaaatttttaatgtaaaattttaagtacatttttttcatgtactagctacctccgtcccaaaagaaaaactcacttcaaggcttaaatctggatatatgcaaaccctaaagtgtttttttaagcaaaattcatgcgaaattcctgggaaccattgagccacttctgagcacacggcgacacatgtaggttatatacagtggtgacaaatgattagagcactctactcggttgaactttctatactcatcatcatccaagttatccatggatggataaagcgcacaaaaagcactacactacaagaggccaacgagttgcatgaagaagatatagatatctaattatctatcagcatcaccaatgattaatcatgcaagagaccatatacagttgcaccgtctagtcacgatcgattagtatcatagtacgtacacctccattcctaatataagtatctataacttatttctacaattttaaaattgaagatatttttgcctgtagtttggtacgtcattcgtgtataaattggtttttaagtttgttcacttttaaaaatacatattcgtatttgagtcgggttataagttcgttcgtttttagaaatacagaaggagttgcataagaaatttatttaaaaaaactcacatactaacttaagatgattggacttctaattgtagctcatgattttctagacaaatatatatccaaacaaattctcatagtgaatttcatcttaactaaaccgtataacaataataggattaaaatagtctttacccgttgcaatgcacgggttttttttatagcttagtaaaacataaaagtataaagaagcaatatctctcggtcatctcattggttaaatctcaaattttaaattgtttagatttcggtcttatgtacttgattgactgaaaagatgtttagattgttgtgcactggaatcaatgttccagaaatgcttatattgtaataaatcttagaaatatttatatttgagaacctgagggagtataagcaacttatatatcaagcatactaattaatccttagatctccccgaaaagaagatgtaatcctaggtgattacatagtgcatatttctactcaccggacaagattattctgcaatctgcagattctgcactattgagaatcgattcattggttattattttatatacatatattggcgtaagcagccttggtgcgaatctggttccaactttccgccttccgagatcgaaagcgtgttccatccacatgccgctaactgacagcgtcacagcggttactaacgtacccgtcttctctgttggaaagcgtattttattcgcaacgtgcggttcttccagtttctcggcgcctcggcggtgcccgcgcagcgatcgaggggaaattcctgagagttaaattcgttgaatcttaccatcttgtttgttatgattggatccatttgcccttgcatgcttgattttgcaggtgtgggcgaaggggaagcctcgaagtgcaaagccgcccctgcttgcacgcgatgtgttcggtgaaatgcctctgggacgcacaggtgtcatttcccgaggaagctctgttctcgtaacattttgaggtagaggtcactgattctgattttttaacacgatgttttaagcaagaagttaacttttctcagcaactcgatctaacttttagggagatgcacattgccagtggtgctactacagattactgaaccataggcgctctatgctgtgaaaaggtaaatccagtaatgctgtccgctgttctccacaatttttctgaaattggtagcattatgtctgctttgtgggcattgatgtgccactgccgcctcagtcaaagttaaaatcgacgggatctccatgttcctgacacggcaaattcttcgattcgaatgaaatgtttgctttagcatcctaaagaaattcttttgttatatttatttttcttttaatcaataatcagttatgccaacacggtgcacaacctacaaacagggcagctaaaatttcaatcaaatggatcaggagcaccttctgacattgaatgcttgcacgtcatggaatgtggttaatgtgatcaactgatcatccatgtgctgatgggatctttaagtagctgctttgtgtccatcaccctatctgtcaacatcgtagagttcttcaccatatcaactttgaggtgtttcagattctttttatttggttgctgtcatagttagtggagacaatggggatatccaggcaaggaatctgaagagtatgtaacttctactcacgcgcatcaaaatttcagtatctcatcttttactgcctgcttatctggtgagatattataagagggaggactcagtaaactcctctaaaaaatggttcgaagtaaaccatttcaattattcagctcagtacgcaaaacaatgaggctggctttaggtatgtatccttcctccctgcttccactgtaacagttcattagtctaagtgaaattatttagcaattaggtcctaggtaactagctgagtagactaataaactaggctctaaaaatcttctggatcttattttgtagcagaaggggttgaccaggactgctctgtcaaagagcagaatgtccttaacatcagcactgcctgcttgcaaattatatgcttacatggtatgtctcttgctctcttcattagtcattacaaaacagtgttcgtagagatgcatacttagatccatgctattgttgcccaaatagaaaaaaaaaattatgattaacatcgtaacatgttctgtagaatgaatgggtatggaagcattatcagtatataccattgatagactagctagctgattcgcccctccttccagaaaacagagaagtgattggttgaatgtactcatgaaagtcgcaaaccaaggaccactatggaggcttcaccttaagatatgcatattaacactggaaactatgttcatgcattggctggcaatggcacatacatggttggttttgtcaaagtgcattgcatgacaagatctcatacgatttgatctctgggttctaggaatgcctaagatgcatgcaaagtttacttctagaaaaacccaaataaaaaaaagataatattagaagtatatacactatttccctttttttcttcattgtcctgaaaagattggtggcaatcattccaacagtagtgacagaactcataaaaatagccctgtacaatgtaaggtgtcccccttgtacattcagtcattcacttccccttatatataggggagagactagagagggaccctcaccctgagctcattgaggtggccaaataggttctgatcacacctttctcctcctccatgcttactacactggcactgtagtgcatgcaagaggagaggcaaaaagatgatgatgtccttagcagcttaggttgtggctacctagctcttcaactagcttcttcccagaatccacatagagaggcagagctatatagcagagtaggaagatacatacacacacatatgcatataattcctagctctagctggtgctagctctaggagatgtgtccattccattgcagtgccacagagggctcgactagactagtctgcatagcttctttcggtttacacaagagtnnaggtgtttgtttccaagaggccagagtgatcgatcgagcttagctcatcggttcttgggccatcgatcgatcgaccgatcatgcaggggcagcagaagcagaatgcaggtggtggtggtggtgacaatgcgagcccttgcattgtgctggatgggcccatcatcgtcggcgccgggccgtcggggctggccgtggcggcgacgctccggcagcacggagcgccgttcaccgtggtggagcggtccggtggcgtggccgacctgtggacgaaccgcacgtacgaccgcctccgcctccacctccccaaggtgttctgcgagctcccccacgtcgccttcccgccggacttccccacctaccccaccaagcacgacttcctccgctacctccactcctacgccgcccgcttcgccatcgccccgctcctccgccgcaccgtcacccgcgcctggtacgaccacccggcctccctgtggcgcgtgacgacgacgacaacgtcgtcgtcggcgacgtctgtgatcaccgagtacgcgtcgccgtggctggtggtggcgagcggggagaacgcggaggtggtggtgcccaaggtgaaggggagggagaggttcgccggcgaggcgctgcactcgagcgagtaccggagcggggagaggttcaggggcatgagggtgctggtcgtcggctgcggcaactctgggatggagatgtgcctggacctctgcgagcatggcgccatgccgtt

SEQ ID NO: 67043 - DNA, 1199 bp, Oryza sativa
agacttatagctttgcactgaactctattgcaagtagtagcaacaagttgagtagtattaattgtgtccgtctcagaaagaaagaatgtacgataattctggctatgcatctggacaacgatcgttctttttgaaatgggtcgaggtagtagtagtactactgcagagtggtgtacattccgtttgacttgaggccggcccggccgggctatctctcacatatgtccgtataatgtgtatgttgtgcatgtgcacctctgatgcctcttgtgctgtaacaaacgcatatgcatgcagatagtaccggaggtggagtcattcagcggcaacggggcgaggttcgtggacggcaacgagatggcgttcgatgccgtcatcttcgccaccggctacagaagcaatgtcccctcctggctccaggtttacacatacatatatatatctctctgtatagctagactgtagaatgaatgcagttaaggcaatgttgctgatcgataccagtactgtgcttgtgatatgtatcatcaggaggacggtgagttgttcacggaggagggcaagctgaggagcagcggcagcagcagtgagtggaggtggaggggtccaaacgggctctactgcgtgggattctccgggcggggcctgctcggcgctggagcagacgcgctgcgagctgccgccgacatcgccgggaggtggcaggagacgcagcaggcagcagccaacatctcctcggtgtagtcgtccacaggccggatcgaggacggacgggacggacggtgcatgctgcgctgtgcacacaggctcagctacctcagctgctgctgctgctgctgctgatggcctctcgctcgcatgcatggcaacatggcataggtagccatggccggagtcgcatgcattgcaaatattccacagctcgcgagctcacatctgttgctagctagcgagcagcagcggccggctggtgaccagcgatggcgctggtgaccagcagcagcgagcagatgcacagagatcatatgtagtcgatgcatgggagaggaggaggaggaggaggaggggtgtgtgtgtacgtgtatgtgcagtgcaggtgggttgtgacaaagttttgcataggatgttgcttgtctgatgcgccccatgcaatgcagatacggctgaaagagtgcagtcgttctttttgtttttataat

SEQ ID NO: 67044 - DNA, 2059 bp, Oryza sativa
taaagtttaaatttaacatttacaaagtttgtaacggatcaatttatagaggttgaatttaaacctgcatgttttagtgtgatatgatataacccatattattatcttaccttttcttttaaaaaaatgataattattaagttcatatgtaagaactagctaggattgtcttctggagagatgaaaagtcatcttccctaccaaggtggagtatatggaaagtgatttcatccctcaaggggatatcctcctgtttttggtaagataaattaatatgaaatatatcagtacacaaacacgcaagttaaaattcaacttctgccagttgtaacaaagataacaaatatagatgcgaaagtacgataattattttcggtttaatttgttctttttgttgtaacttatagatgtcgaatttggtcttgtatgtttgtggattcatattaatctatgttgtcaatttttttataactatttaactgatatgaatgacgaagaaatatcccctcaaggaatgaaaatccattcctgaagtatatataattatgtacactgcattgcaggggtggggtttaggagtaaggtagctagggttgcacccctactcttgaatctaaatatacattagaactgtaaaaacttcaaaaagtagagaattaaaggcaaaactatgtcaattacattagttgagccttagacttggaagaatcctggttctgctacacgtactgtatagtagtcacactgctccactcgatctctgtagccggccttaccgtatacgtacgtaggcataagtatgacatgtacagggatgggctctatatctcctgatgcgtcacttgtcatgcatggacacacacatcaccagctagctactgtacgtcactccactctctccatgagtcttctcgatccggtcttctctactgctctcctctacgacgaccttcgtacgtgcaaacattttccattggggcacgctcacctgatacagtccctgcttttatatctgaaccctgtactcttttttttgttcataccatacaccaaaaaccatcatacatcaatttggccggctatctcgtcgtcttctcacctagcaagtcgatcctaacacagagatcgaactagtgagagaattgaatcagtgagagattcagaaatcgagagagagaatcactgagagagctagaggtgtgtacagagagaagctggagaaggggacaacgcgccaattccgatcgatcggcggaggcgtcgcgtatgcgtatacggacgaaagcgagatgcgtgcggtgcgtggacggatgcgtgcgtggtctcggtctccgtctccgtctaccccctcctcgtcgagccgcgcgcgggtgggctagcttggcgccttgcgctacctcctcggagtttattttggccgccaccgcgcgcgactgacgagagaccccggccctcctccggcctaatttcgtctccttcggctgcatcgtcgtcgtcgtccccggccggtcatggccggcctcctcctgccgtaccagctgggccacaccaccgcagcagctgcctagcgaagaactgtgccacacatgtacaagccggccacaagctcgatccatctgctgtgtcgggttacgttaccgccagtaaccgcgcggttaccatggttaccagtcttaccgtgaggtacggtaatataattaccgcggtaacctccttaaatttaaataaatttaaaaaataatttgaacttttgataaattttacatgatttttcacggttaccgcttaccaccggggcatggtaaccccggccccggcggtttgggaaacccactcacaagagagggagagattgatcgatcgatgcatgatccgcatcgagatcgatatagaccagcggctattaataattctggatttctgtcacgcagagataaccaccgtgtatatacgtgctacgtactgtaaaccagtagtactataccaccagtgcactgttcaaggccttgatttgggagcggcacagtgctgaagcatgcagccgcgcctgtacctgtac

SEQ ID NO: 67045 - DNA, 2082 bp, Oryza sativa
tttgatgcataagagagcatataatatttgaactgtggtgtgctgatcagttagtacctccaatgacaagcacatagactcatagtttctctcgtgtttgatggattatactagtacaatacaacactagccctgttgcagttagttaaatcgcccaatggctataagagcaggttacgtcgttgaaggtcaaaattaagtatcataaaaaaaaagtgctacagtttgtggcactatgcaggcagtatgtatcagcgtagcaggagagaagagacaaaaagaggtcggcttaacgattgcgagaacagggggtccagtgaagcaagaagcacaggatgcatgctacctgacgctgctctcgtcactactattcgtagctaatactactgccctacatgctacattctgtagctgccaagggctggacccatatttgttttcgtcccaactactaatgtcattgctgttccccagctactgatttcgtctatgtcctcatcaaggaaacagtagggggaaaagtttctccacacttaacattttctcgttaattgctacttcgctactcgttcatcaataaatataagacattttgggtttaaattttaactgtaaataaaaagaattatgctacactactcttcaagcttcggtaagtttcatcggattaggtttacgggtttagagaaacattaaaggatagttgagttggtaaaagacctgcaataggcggcaaagataggtcggcggtgaggcaccaacgctaaaaccgtggggatggatggatcggatgatgatgcatggttgtgggtggggttaataatgtcgcccggggggagcggcaagagaaacatttttcacttttggtgagctaccagaaaaaatggatgagatacggagtggaggaaacttaaatgcactagctcaacttggagacagtggaggcaactacgtgttggcggaagatatgggagagaagaacgaggatgagagctagagaggcgacaaggagggagtgagttgagtggctagcctcatcggaaccagcatggtggagggcaagagcatcagtatatgtaacaatttgccctttagaaccgcgtggcctatcctatatgaccggcggatccatttacacatatcactgcacttacacacatcatcgtttcatgtaaaagaattaacccatgggtgatatgattggagggataagcccttataaaatggttccacccttattaaactagtatggtgatactaaacatgcacacattgctctaatggaccatgtatgtcaaatcctatttggactaggatgtcacagtacactaggttaggcgggagtaaggtggtgggcaacgaaagtagtgtgatcaggcggaggaagtgaggaggagaagtggagttatagattagttgattgatgaacacataaaattacgagtaaattacagtttgggctatatattcttcccaaagttttcctttggtatattgaaaaggggatgattctaacaaaagataatcttgctaaaagaagatggaagggtaacttgccttttagcttgtgtaactctaatgagtcaattcaacatctcttctttgattgcataatggctagatacatttggaatacaatctatcttacttttgaaatcaagcaaccacgtaatagttcacacttgtttggaaattggttaagaggtttgaacttaaacttaaaagacaaacttgggtgggcatagcggcgatttattgggctttgtgactcagtagaaatgacttagtctttaatggctacaatcacgtatctttcttgcaggtaattttcaaagcaactcagttgtcaaggctttgctctttgcttcttaaggaagacgaaggcattgaagtaatcgcgaagtgcaagcttttagagaagcgtatgatggagctcttctctacttttgggtgaaactttagaagaaggattgaagcatagcttttagttcctcttgcttgttgtccatctttaaaacttatttatgatttacccatgtaacgggagagtcttatgtactcgtgtttgtgacttttaggctg

SEQ ID NO: 67046 - DNA, 8848 bp, Oryza sativa
gtgtaaagttttaaaagtatacggacacatatttaaagtattaaacgtagactaataacaaaacaaattacagattccgccagcaaactgcgagacaaattgattaaacctaattaatccgtcattagcaaatgtttacggtagcatcacattatcaaatcccggcggtaggctgaaaagatttgtctcgcaatttacatgcaaactgtgtaattagtttttttttcacatttaatacctcatacatgtatccaaatatttgatgtgacgtttttgctaaaaaattttggaatctaaaccaggcctagatataggtcttgtttggatcctccggactattaaatagccttccagaatcttgctatttaggattattaaacgtagattactgacaattaaaaccgattccataacccctgagctattttgcgagacgaatctaacgatggatattaatccataattaacggctaattactgtagcatcactgtagcaaatcatggattaatataccttgttagattcgtctcacaaaatagactagaggttatggaatgtattttgtcagtaatctacgtttaatactcttaaatagcaagattttggagggttatttaatagccctccgaatccagactggccatactctatcggtgttggtttcagaaagggaatttgaaacccagaatcaagtttcggacgcatctctagctctcagggtactacgattgcacgaatcactatgatccagcaggcagtcaggcagagagagttcacgtgattgattgatcggaggcaaggcagagagaaagaatgcatgggtgcacgccattgacgagatgtatctatcgagtactagtagtagtggtatgagaggagagagggtgacggttgatgatctcagagacggaatgcaaccgtgtccacgtcgatctttctcggaatacatgaacaatcccttttgcctggctctcgcagaaacggtgtgccagctctcgactcatgctcacatactactatgttcaaaaataagctaaccctaattatgaatgtttcgttgataggattagtattttttatagggcggagatagctagcgagagggagggagagagagagaatgagagatgatattctagatgtagttctgggcaatgaggcgtctgcgtcgtcgtcggccctgcgtgtgctgccacaaaggccagtggtggggaacgcacacatcttcttaatttatgtgcatggcgccaaactccccgattgaattcgatcgataccgctgcagatcgatgcatgcatgcgtagtagtagtagtagcagctccctcgccagattccaccaaattgcgcgccggtcgatcggtgtacatgatacatccatccatccatccatcggctacatctacccaagtctcgtcgtcaagcctcgatcgcatcgcaccccacgccaccgctcgctctctcatcacacacggacaccaacatgtgtagtacgtgtatgtgcacatgcagggtcaatataggagtcgtcggtggatcggtcgatctcccgtctctccacgcaacgtacgcaaacgcatgcgtatacgcgccgcgcgcggcagaacgggtgtgcgtgcgtgcgtacgtcgcgccggccggggcccgtacgcaagtacgccgtgtgtgtgtgtgtggcgctgcgtgcgatcgatcagcgcgcgcgcacacatgcaaatttagcccaagcgacgacgcacgtacgacgagcgctgcggcgctacatacgcatgcatggatgtatatgccgccgtccgtaagctggctggccggccgggaacccgggacgtcgtacgtacgaacgcccatcctcgatatatccaacacaaacatcatggatgcatacacacacatggttcatggatagatgcaccgatcaataaatcggagatatccttgtgtatattatacgacgtacaatagcatcgggtacttctctatcatgatatatagagatcgatgctagtataaacagagtatgatcatcggcatgggtggtacttccccggctgcctgaatgggtgctacttaaggcactactcccatgagagatgaaagcacaacatgcatcaatgcatgcacacgggactagctagtagcaacgatatgatcgacaagtactactcctatattatacgacgtacgtacaattagtatgttgcgtcacaaatcaatcggtcagacttaggacccatgcagatcgatatttggttcgattcgatagatacatgtgggagcgtgacgtacggccgctgaatacttgtatctgttgcatgtacttgtatgtatctcgtcatcctcactgtgtaaattttgccgtttctttccttcttcacatgacggcactatagtacgtgcgtagaagtgtaatttgtttgtttgtttttttggaagacgtactgcgttgtttaccgtacaggcgtacacaaccatcctggatttctctggtggacaagtacgtgtacgcccatgatacggggaaacacttttaactacctaggtggagtccatccatttattacatgtcaaccaaataggtatgaaaaaaatttagaaaatttaacaagataccttcatatgtaaatgtcacatcacaaacatacaagtttaaatttaacttctacaagctctagcaaaaatatcaaatcaagtttgatttgttatttttgttacaacttataaaagttaaattttaatatatatgtttgtatattgatatattatatatcaatatatcttgttaattttttataaccatttaatcgacatgcactaaatgagtgattaaaatccatcgccatgatacccccaggttgttcttgtatgtgtgccctacaggcttttaggagtacattctaaccccatgcccgctgcacagtaattgacgcggcccatctgcgtggccgtcgacgtatccagtatatgggtcaatttggatcacagattatgcagtggtcctaaatgggacgggctagaggcccacaatattttttcacgttacatccaaatttgtgtggcccgattaggatcgctgccaactattcccttcgtctcaggattttgagtttttgttttgcactatttggccactcatattattcaaaaaattttagaattattatttatttatttttgacttactttattatccaaagtactttaagcacaaattttcgttttttatatttgtacaattttttaataagacgagtgatcaaacagtgcaagcaaaaaactcaaaatcccttatattatgggatggagggagtagtcagtttggcaggccgacaacaccggcttccctatatattttagcaactttataggtgtcttatattgatgtcgagttcgaattatatccttaaactgtaatactgatgttgagctcgcattttccaaaacaggttaaataatatcttaacatagtatgtatgtttattttagctgacgtggcaatatagtcagaaaaaatacatgggggccacatgtaatttaacttcaacctcttcccatatatgggctccacattttttttactaggaagccacgtcaaaaaaaaaaaacatccatctatattgtcttagaaccttattttcctgggttttaaaagatggaggttcaacatttatagtattacgattccaggatgtaattcaaactcgacgtctagattagaaaccttaatgaacttattcctactagaggctctaatcttttggcccaatcaacgtatgccaaagccaaaatttaaatttttgaacttaattttgaagtagtttttgagttttttcaatcatagtttcttatacaatatggtcatttaagtcgctaagaacataattgtaaaagttttaatcacaagttatattttttcgctactacgccaaatagcgtatattccgcatatagccatccgatgaggctgccgtttatagggttctaaagaaaaaggctggtttgggccgagcaccagataagtcgggccgatctcaaacagaggcggtggcatggcccagtccagaagaaatttcgcatctccaaaaatttccacccgcgaaaactccgtgcgacagtgcgccgcccaccaaattcaaattttgaacgcgaaaacttcccccgcgcgtcttcctctcatgcttaaatctgcgcaaatcacgcgctcctcgcaagcaacagtgagtttgaacagaacaacgcgacgacccttgcagcgcacgaccccgcggactcgatccagatctagggcttctcgtcggcggcgatggcgggcaagggaggcaaggggctcctcgcggccaagaccacggcggcaaagagcgccgacaaggacaaggacaagaagaaggcccccgtctcccgctcctcccgcgccggcctccaggtacttcccccttttgcccatcttccctttcggatttgtagatgtgagtcttgcttgttctctcctcgagctgcgaatatcttggatttcggttttggtgcgcggatttttcccaaatcctccgtttgaattcacgatctgaatttgtcttcctcagttcccggtggggcgtatccacaggcagctcaagtcgagggcgtcggctcatggccgcgtcggcgccaccgccgccgtgtactccgcggcgattctcgagtacctaaccgccgaggtcctggagctggccggcaacgcgagcaaggatctcaaggtgaagcgtatcaccccgcgccatctccagctagccatccgcggggatgaggagctcgacacgctcatcaagggcaccatcgccggcggtggcgtcatcccccatatccacaagtcgctcatcaacaagacctccaaagagtgatgcgaaaaaaaaaaaactccctcatgtgctttgcttgactcgaagtttggtgggtgttttactgttaatttgttatgttttctcatttgatttgatgtatttgtgctacagtgttcaatccttagtgggtttaggtgccttttagtcttttgaaattatcgtgacaatgttggttgcagctgaattcttgtgaattcttcactccgtatgctgttctgaaccatccatctcgatgcttcagttcagattatcttgttaatgtttaagatcagttcgattgattggcatgtgcccatgtgtttgtcaagatgttgtactgctggtaatttggtctgtttacgtttttgaaatttggaaacgtatctgtcatgatttgatgcgtttgcgtttttgaattgtaccaatacctgtatggaaaccacaagttatggaaaccagtgcaacatcttacagtgccagcaagtcacaaaagaactaccaagacagtttacagtgccagcaagtcacaaaagaactaccaagacagtttacagtgccagaacagctaagtagctgtatatgattatatccttaagcaacagagttttagactttagctcctgtgttttgtccaacagcttctttatccattcctctaagcaccttttgtcatcctctttttcaatcttgttccatcgctgcacaagcgagatcatattgtatatcacattaagagtaggtgtttgtttagttcctaactttttcttcaaacttccaactttttcattacatcaaaacttttctacacatataaacttccaacttttttcttcaaacttctatttttggcgtggaactaaacacaccctagaattcaaagtttattttcaaaaatccaatcattcctaactagacacaaagttctcttttttaaaaaaagataaaaggatggtgcccagctattgcaaatttagggggcatttaagatgtgacaattaattatttgccacccacagtttatgatatgtgaaccctcgtgtctatgatatgtggatccagtggcaaatcttaattatcactcgtaagagtaacaaatatttaaatatctccatttatatacaacaagttttgctgggattgcaatatatctagaggaggtaaaaagtctaacagcccacaaggcaagggcatcgggaggcgcctcgtcgaggtggtccaagtcatcatctggaggcggtgatgacggttgtgccccctctgcggcggacctcaggcggcgaggctagccacggtggaggatgacgaccaatcgtcatgctctggagcgaggcggcacagtcgctactgcatcctctccaccggcgcgcctcctcgcttgcgtggttgtgaaaaaaaaaaagaggaagaggtgggcgctgacatgtggccccgcatactctttcttctcacttacatgtgggcctgtatgttttttatttttatttttatttttgctgactaggattcaatgtcagcgaagcgagttgctgatactgttataggaccgaaattgtatggttttgtataatttaagggttaagattttagtattggagggaagcgatatcaagtaaactcggtgtaaagttgagggaaaagaaagggaagtagatggaccgaccaaaacatttacctgggccgaaaactgaaaaagtcgcgcgcgcgtgggccagcgtcatctgggccgaaaaaaggaaatgcctttggaaggtacctgggcctctaatttctaccttccctaaaagtgtccatttgcccccggtaactcacaatcacaggtatgcaacgtgactacgattcacaagcttccgtgactgtagtcgatacatgtacgcaaccaactatgcatggcatgcatgatccattgatgcatgaaattgcagcactggtagatttgatccttactgcatcatgccatcatgtacctggctggcatggctgcactgaactctgaagtttctcgcttctatcctttactgcatcatgtactatctatctatccggtgtcatcgtcttcgtgaggccatgatcgatgaagctaccgttcacggatagaatggccctagccttgtccacgattctcgcttcgtcttcccatcctcgacaagaacagcattgctcttgatcatcaaaccagtgggccggctgcgtgcgggttcactggacgtcaggagcaaaacgaattcaattcctggccggtggtttcttcgacgaggccttttgtgctcttgcgggttggaagcgagcagggcgaatttcgcaacaatggtagcgcgtcccccaccaccacatcaactctggatgggtcacttcaccttcccctgtccaagcgcctcacgatacttctcaaaaatatcttctctattattctttcctttcttccactgggttgtattcttcagctattttgaggcaactccaatttacccccaaggaatacaaagcgtagaaaatagaattttgtgctcatgaagtttagaaaaccttttgttgctactactaacttggtaccgggtccattctttttctaatcgagatacatattgtatcttttttttttgttagaacgtttttaaaactgttaaacggtgtgtttcgtgtgaaactttctatgtaaaagttgctttaaaatatcaaataaattcatttttctagtttatagtaattaaaacttaaataaattcatttattgtcttcgcttaatctttatcttcattagttgtgaacagggtaataatcttcatatctgatcagtgcaggatttcttgattgagtccatatcaacagtagctagcatatgtatcagcattattgaagttgtcaacagcttaacatttgccaaggcactcgtggcaagaagaaaaaagaaaacacagtatgtcgatcgagatcaattaaagccatcgttttcacctcacaagccaggtgatcattcagcgccttatctatccgtgctctaatagcgaacgacgaaggggaggttacacctaaccaccactcatgatccatgacccccatcaaccggagggaccatgcacaatattcacaatttgcacatacacgcaggaacgcagcaagcaggcaaccaggcatgcacctacatgccgcgctgctcggacgatcgacgccttcctccgatcctcgcatccaccgcaatgatccgctgatcttttccctgcacgcacgcatgccggcccgcggcaacacaccgcgacggtttcggttgatcactccggctacgatcgatcgatgccgacgtatcagccacctcccatacatgctgggcatcgcctcgtatcggcgaaatgattcgttcgttcgttcgttctcctttgatcaatgatgcatcgtcacgagcaagcctgagtgactgtgaggccgtgaccgtgtgaccgcgacgcagtacacaccagctagctcgatcgtctcgcacactgccctgcctcgatcggcagctagcgatccaccgatggcgacgtgcaacacaaaaccatcgcgcgatcggggcatcggtggaaagcaagtgtacgacgcggatgactgtgtacgtagcagcgtgcagtgcatgcgaggaggaggaggggcatgggaatcatggcctgacgatgggggtgagatccccttgggttgtgtggacttgaggtcatggaggaaaagggagtcagttgcctttcctttccttccctttctctgccggtgcgtactacgtgagcccaggccacgcgcaccttgtgaatgaagcgcgagcagatcgatcatatcgctgcaatttgcaaaagctccccctgcctttccctgctccccgcctgctcttaccatctctagctaatcgactatgcaacttgagggaaattaacctcgatgaacagggagatttcactggattagagaatcaagctgatcaagggggggcagtactagtgtactactgctgtcatgtgtccgttcccagttcg

SEQ ID NO: 67047 - DNA, 8333 bp, Oryza sativa
gggggggagagaacagcataacaacaggggaagttctgaagataacattgaatgcgtgatgtggccacataacctgatcacagctttcatgtattgattggtgtatgaagttggatatgacctgttatccttttttgtttttctttttctcaacgaaaaggagagggcggtccttttccaacaggattgtggtatcgccccccctgtatagttgtattcaaccgatacgaatggcaccaaacacagtgacggcttgtgtattttgatgagaaaatcagcacaatggataggataactaaagaatcgttctgaataattgaaacagttgacattttctcacccaccttatttatgattggaagcaacttgaaatacttaccagtacaagaaaacggctcaaatgattgcccgattctcttatggcatgtggagcagagcaatattttactgcatctgaagcctttgcaacgggacaatctctctgatcaggaatggtacattatcctctctgcaacaccctcacacatgttcttcgggtggctatcgctcagccacggactcacagctatacctgcatacaaccttacaagcctgtcaatctgccacggcgtgccggcctgggatgtgttcattgttcatgtcccaatacccaattcgcaatgggcgagaagttatcagaagaccacgccgtgtgttcatcagccgtaacgccgtatgcaccaattgcaatgcttttccaatttgctcaccggttgctgggaatgttgagagtttacaagatgagagtagctaggcaggcatgtccggacccagctgataccgacgttgcagggaagcacagatggactgtatagcagtagcacgggaacagtgtacgagggagcatcgctcatgatgttgtctgatgaatggaaccaaagtagtagacccgggcacgcctacagtggaagaaaaccacaggaattttcataccaacacgtcctgggtctggacaaacctcccacagtcccacggtaacaacaacggcatatactgtgtttagttccacgctaaattttaaagtttgaagaaattgaaatgatctgatggaaaagttaaaagtttgtgtgtacgaaagttcgatgtgacagaaaagttaaaaattttttttaaaaaagttggaatctaaacagagccatagttatttttttcatcagtacagctgtgtgtaccatttgatgcagaggctaggatatttaattcctttatcaaaaacgtttttaacactactagcagagagcaatattggccaacaaatgagactgatattttgatacctgaggtgcggttgcgatgacagcaagattggggcatagcttgcgaaccggcgaaagcggatcggaacaagaagagacggggtcccctaatctaacgctaaagctctagccaaacaagtgcccgagttttccccgcaaaaaaaaaaaaaaaaaaaaaaaaaaaaggaccaagtgcccgagtttgagtgagaatccggggaatcaaacgcttcaagacatgtgtaacccctatggcgtgtgctagctcacgtcccgtcccgcgaccacgacaaaacgccattttagcccgacgcgtccagcttcattggcctgatcacacagtagttgaacctgccctgtttatcagccatgatgcgtcttggcgctacgtgagatatgaccccgatggatcgatcgctggtttcactgcacgatccgtggcaagcaacgcaagaacccttgggcgcaagtttccttcaccgattgggtgactgatctctgatctgatcagtttttgcttagcccacttttgtgtgtgtgtgtgtgtgtggttgttgcatgcaactgtggaacacattatacacaacatggcgtctgatgctgctgcgtatggtggctgggttggtttattggacggccatggccaaaaggcttagacgtcaagttatgatcctgagaatgtgatccagtggatggatggatgctactgtcagatattcagattgccaatggtggcaccatgctggattgattgatagtccatgggaccccggtcttctttcttgatactgttgttacaaacagggttggcctaatcatggattcccgggacatttccatgtggaaattgctgtgtagtgcaggcccgtttcacgcgtacaacaccaatggcgagaacctgatcagacctgaactacagctacaaaaaaaaaaaggacaaaagttctgaagctaggtgacatttcgtgtcaaagtatggtgaccagttttggcaaaatttgctacaggacacttaaaaatatgtaattagctgtgggacaccgcaaagacgtgaatttgtctgaggacacttaaaaaatgtggtaatttgctgtaagacactgaacacattaaaatataatatccacccaattgataagagagaaaccacacaaaatgacatttttgcccgtatcttcttctcccctctttcagtcttcttccaacgctcactcttgcagtgagctccattggcttgcccatggtggacaggcgctcagcgtagttgacggtgcggtcgcacggtatgccgagaatgagcgtagcaggaagttcctcacgaccgtttagataatttaaaggtgacggatttcctcgccgctgcagccataccggcatccaccaccgcgccgctactgcctgactccgagccgacggcgaccacggcgccgacactgtcactgcctcactaccttgcttgttctcctttcaaccagccgccatcgctccatgcgctgacgtggacagactttcagcgccatgccaccagtgccgctctgcgcgtgccccgccatgttcaaggagagagagcgcctccgccggagcatacacgccatgcaccgccaccacctccactgcactctgatgttgcggcgatgtggtcagcaagctccggagtcagttcttgatcatggccagcacaatgccgccgttgccgttggctgtagtggcactcaccatatcactgctgacgccatcgtggatgacgagctgtgaggaggtggctaccatgacggagtcagcgaagtggagcgaggaggagctaggagggtacatgtagccgacgctgctgccggagcttgcgtagcaagtggcaccggtgctgcccttgccatgatgctgctgttgctccgagaaggagatgatgccgaggaagtcctctagcttcggctctgcggcgagcgccgacaagaaatagatggggtgatggggattggggtcggccggtcggggatgtattggggaattgatggaggatcggggaaaagaagaagggcaaaactgtcattttgtatgatttctctctcatcaattggatggatattatattttaatgtgttcagtgtcctacagcaaattaccatatttttgaagtgtctttgggcaaattcacgtttttacagtgtcccacagctaattacacatttttttaagtatcctgtagcaaatttttgccatcagttttttacatgccgtgaagaagttttgtatcatcttgcaaaataatttttcaaacttccaacttttccatcacattaaaatttttctacacacacaaactttcaacttttccgtcacatcgtttcaatttcaaccaaattttcaattttaaggtgaactaaacacatcctttgtttccttctaaatcgcttgaaaaaaaaaggctttccactcggtttttgccatccaacgatcacctgatcgatggaagtgggagcatcacgaaacgagcggcaggactgacacgagagtagtaaaaactgcaggtctgcagccttaacttctcctgtcacccgctaaataccaaaactacccacaaaatacagcaacatttacagcttcgacactgcactcaatgccctcacacgctaaaggccaagcaggggtaacagggtcatttccggtgggaccgatgtgtcagtcgccacgtaggacaacgtttagataggcacgaccacgcagcatgccacgccgatctcctcgcgccacgtcacccctccggatccctttaaaaccaggctctcctcttcgtcttcttccaacagatcgacaccgaaaattcgaagcaaaaaaaggagaagaaaagaaaaggaaaaaaagaaaagaaaaacaaaccctagccgcaccgatcgaagccagtgagacgccgccgacggctatgcgtgaggcgatcgtcggtgaccacgatcgccgccgccgccgcacccgcatccagtgaaaccctgcactgtcgtctcgttcggttgtgaggagatgagggcggcggcggcggcggcggggcagatcgatccgtcccctggggcgccggcgaagtcgcggctgaagaggctgttcgagaggcagctgctgcgggtgtcgccggcggagaggctcccgtcggtcgcgggtgtcggggagaaggatgagtcgtcggagccgagctccgtgtgcctggacggcatggtgcggagcttcttggaggacggcgtcggcgtcgagcggccggcgggcgccgcgcgctgctgcaattgcttccacggcggggaggcgtctgacgacgacgacgacggccccgctgctgccgaggcggcggccacctccgacgccgcagagaccatcaaggtagtgtggtgtctccgccaccgctagttattatcctcccatgttcgccgcgttgccggcggcgagaaggcgacgaacgccggtgctgaccgtttctcgcatttctcctcagggcctcgtccactgcgccagcctccgggaacgcaacctcctcgccgacgtctccacgctcgtcgagcgccaccgcgccgcgggggcgcgcaagcgcgacctcctccgcctcctcgccgactcgctccgcgcggcggggcacgacgccgcggtctgcatctcccgctgggacaagtcctcctcccacccaaaaggcgagcacgcctacctcgacgtcctcctccctcccgcctccgaccgcgccgagcgcgagcgcatcctcgtcgacgtcgacttccggtcggagttcgaggtcgcgcggcccaccaaggcgtaccgcgccgtgctccagcgcctgccgtcggtgttcgtcgggaaggaggaccgcctccgcctcctcgtggccgcggccgccgacgccgcgcgcgccagcctcaagaagcgcggcctccacctcccgccatggcgcaagcccgagtacatgcgcgccaagtggctttcaccctacgagcgcgacgttccttcaccgcagcagccagatgcctccgccggtgagctcgccgtcgacggcgagggaggtggagcgtggactcaatgattgatgatcaaggactcgtcttttgttgattcttttttcttcgggaatttgcatttgcagcgtcatcttgggctggatgcaaatgttttattctttcttttcctttcctttttcccccttcatttttaccctttaatgggtttcattttggccatggagtagtagtaactgtagtagtaagcacggataagacgaacgggaacaaaaaaaatgtagtgttagttgaacagaaaaaaaagagagataatggattacggcaatatctacttctttcagtttcagtgttggtctgataacagaagataaatttaacttaatggagtacaataacataaaggaaaaacagttcagaaaaaaacaaaagaaagcagtacattgctcagcgaccagtttttaattggaacaatggaacgtatatttgcatttcatcaagttatttcttgttgatttcctatccggttcctgtaatttcacgtggagcgggtgtgcaatttgctgggcctttccagttttgcagaacaagataccgggaaccgcagtgacagtagcttgatctgaactctgaagtgtgttgacatggagcggctttgatattttgcagcttcaacgtctccggcatcgtcatgctgatgggtttagcttgtgaagcggagctgaagaaatggttataaaaattcttaatggaattgtttaagctgaggttgctgtcttgtgcaagctaaagctcaggtggggggaaagaagcaagcaaggcagagaaaagagcaagtggatataggaagagtatataaatctgcatcggtatacgcgcttcttatgggttgtttattcctgctagctcgatgagaaacggcgtaatccgaatctggatcataagataatctgagcaggtcacaatactctgtagatctaacttaactgctttgtcgatcctctgcggcctctctctttgcttgcttcccatgtaatgctcggtcgatgattggtgaaagaaggaatccacacggcttaattgtactcgatcgatgagtaatagcacaataacctcatcccgaaaggccaaaacttgtccactgaagtgttgttatcggtcgatctgtcattctgtactcctttgtccagccacacggaacgaacatgctctggtgatgcctggacgcccggatcacgccagagagagatagtggtggtggtagaaaaacaaatcgcgagcgcgaaatgcacttgacgaggcggggacgcgggccgcggcctctctcccctctcgcggggaacgcacggttgttttcgcgtactccgccgccgtacgcgccgctcgcgacctgtcacctccccaccgcacctgtggctcgtacgcgagcgcgagcgagcgagcggcgcacggcgcacacgcgtcgtcctctgcaaactgcaaggcgaggcgattgttgggatcgactcgcaaatggccgagacggggatgcaccgtgcgcgcacgtactccgtactccagtaggagtaaacgcgggtgggggtgtaccgtgtatgcgtgaccacgcaccgctcggtggcgcggcgcgcatttacggccggaatggcctcgcatcggcatgcctccccgtagttttttcagttcgaaacggcacggctgttccggtcgtttatcaatttatcatcgcactcctcgtcttttttcgggggtttccgttggaaaagggagagcagtagtactggcgagttggctcactccccggggtgggggagagaaaaagcttttggaactgaaactgacccgggtaagaaagcgtagctttattgcgtgctccggctgtgcccccgctgcgcatcacacaatgattgtactccgctgcatgcaaaagcaggcagggggaaggggaacgaactgcctccccgtgcctttctctctcacactcgcacacagacacgcacctttcctttcctttcttctctctcacacctccctcttttgtttctgaccgggaaaaaagagacagccatttcgctctcccctctgtgtaaaaatgatctgtttggtgtcacacttgatgagtcatgaaggggaccctcctttgtatcggtaccagtacgaactcttcttgatcttatctcgcagaaaatggccggtctcacttcaccgagaaacctcgttaggtctctgacgcttatttaccaccctatggcagaaaacctacatggcaccaaaccgatcatcaccactctttctcccccccccccccccttcttcttccgtgcatcacaccacataattcatcgatcgattggggggcgcagtggacaatggtacatgcatgcttggctgcaatgactgcgtgacgcttgcggcccttgcaaggggcgcaaacgcaaccgcggcgcgtaaatgcgtgctccccctttcgcagctctcccgtcttctctcacaccacaccacccggctgcgtcagctacgcataaatacacggcagcctatagctgcactgttgcacacaactccgggtggtagtaggagtgtactagtacgtagtacggctgcttgcacttctcatgcgatttacgcctgctttagttaccaattttttctttaaactttcaacttttccatcgtattaaaactttcatacacacaaattttcaacttttttatcgcatcattccaatttcaatcaaacttttaattttgacgtgaactaaacacacccttaatcaagagtcacctcgtcatcgcgctactccgactttacactagcaccagtacttactactccctccgttttataatataagagattttggatggatatgacataatgaaactggacagacgatttattgtactataatattatattatatccatctaaaacctattattataggacggagggagtactctactactccttcgtacgtataacgccgtaacgtggcagtgatgacgcgatttattactaaaataatactggtagtcttgtactgctacaccttgcagg

SEQ ID NO: 67048 - DNA, 9092 bp, Oryza sativa
tagtgtagctgccgtagaagatcagatgcttccattattcctgacagttgaacagaaaagaagagcctattctctgaaccaggtatactaaattctgtaattgctgaaatttttaaaaggactatacccctacttttactttgctctcctagtagtataaaataatacatctaatgtcattgttggatccattttgcagatttttgtattcttcacttgtcctgctctctctggatagggacctgccaacttttgatcaagtgatgttgtatcctgtgtatgaaacggagacaacccgtgatggtgcttaatccaactatttacgcctcactattcatctcagctctcgagatgataacagtgccttaaaaaagaacaggcctgttacctgtacatgcatgttccagtgttcttgcatagtgtggatgatttcttcagttgccacatttctgcgaacttggaactggttggcgaagtatagtaatatttcagcaaacttgcattatggagtagtaaaaaaaatgcgtttttagctttcaggagcagaaaatttgctaggatttcaaagctacactctggagttctgtatatcattgtgatgaccaccgcatatacaaatacatacagacagtgtctgaatcagtccaagatcaatactaaatgagactgttggtgcatacaggaccacttttgtctaatggagaagtatacccctacaagtatcctgtctacatgggcaaagtcagtagcaatttattggtgcaccgggccgtgtatcaatctggcagtacctttcgttgtgggtcctgcaaattttcagctgaaaatgcagtataacagtactatggtgtcgacattgtctcgcaaacagcatctcagttaagtcgaagattagctcgcaatgatcaaattaagatgtatgtgtcagtatcacaaacaccccagcatctctcaacattcagtaaatacttacatgttcagatctagcatacagtacattgggatgagaaatttaacgtgctccccattttgtattgcagtgtgcatgaaaattgacattgggctctgagacttttttggatttggaagcatataaacgggaatggatttgggatcggaacagagagaataacttctcggatccagcgactcacatgggacagaaaacagtggagtgagttttgcacataataccagctataatgaatgcttgattcctagttcaataaaccgaagtagtacatgtatgtacacatggttgtaagctccacaaaataggcaaatgaattaagaaaaccatgtgtgcctattggcagtaaacaacgccaaaaatgttgtgtgcgctttggtgattagtagataagcaggaatcactcggtcgtgagctcgttgattgtttaggactagtggtgtactttaattaattgttctccaaccaagaatcaaccaagttgatcggtttttaaaatccatggacgatcaaaacagaatgcaatacagtattcagcttgcgtaggacatacacacaccagaaaacgctcgacgatcgatttgcctcgagacttgaacttgttacatcatcagcacacatgcatggattagctagcactctagctcgttgctacctcagtcccaaaataagtgcaccgtggatatccgtgcccaacgtttgaccgttcgtcttatttaaaaaaaaatatgaaaaatttgaaaatatgtagtcacacataaagtattattcatgttttatcatctaatagcaataaaaatactaatcataaaaaaaattcaaataagacgaacggtcaaacgttaaacgtgaatagtgtaaaactgcacttatttgggacggagggagtagtttattaccctgatgtcctccgacgagctaaatttaccagcagtaactgacattgacgggctaatcctagctagttaatcactctattaaacatcagaggctctagtatgtttgtggttggaatgtaattagagcagatgacagggcagaaaggacaacagatctaggggttaattaggacgcattgcatgcgttaatgactaatactagtacaagtagatcagaataggtctaaatgtgtaataatcgagccgcgtcgagccgagcgaggttaagtagactgaaagtaaccagatggtagggcgaatctcatatcatctaatctcaggtggtcctgcacaggatgatgtctgcagaggaacaaacaaaaagtctgcctgggtcgctttcccttaattcccgcttaattttggatctactatcttcattctccgtaacacacatttggatctacgttcaccagggtgtcacttcatgtgttttgttttgttcggttgcgtcgtaaacaacttgtctaaatacctcagcctcgatctacgtctctggaaagtagaaacgccaatctagctgaaggccgtcgttgtgatgggccagacagcccatattcggtctatgcaaaaccccgcgcggttgattccttggaccgaagctggctataatgcagctcagtaagtctatttcttcttcctccactactgctaatgatcgaatcgcctcccttaaccacgaaacagagtataacgccttgtccattttgaaaagcagtgcaaaccgactacttctgtggttttaaaagcagcttttgttaatgtagcaagttgactgcggtttcctctacatgggttgactcactaagttgacgtgctcagtgaaactactttccaaaccaccgaatgagttacaccgtgtttagatctaaagttttttttttcaaactttcaacttttccatttcatcaaaatttttctacacacataaacttcaaacttttccatcacatcattccaattttaaccaaacttctaattttgacgtgaactaaatacagccttagtgtgcatagcttttcgaatttaaggaggcattatatacggtttttcggttgagggaggagatttttgattaaaagaaagagataagggagataaaatagacttattattaacgcaacacattagcctagcccacgtttcctcaaaagccttaaccgattcggccggcctgcgtacgtgcggtgcgggccgtgcgcacgcgcgctcacgcgtcacgcggcccgcagcgtgggatgcggagacggcaacgcgaggtgctcgcgtcgggaacttgggctagtaggagggcggcgcggtttctcctgggctggaaggcaacaagcggctgcagagtttgggcctacttctagttctagtccgctgctgctttcgacgtcgtttatcagcgacgattccatcttggactctctcatcgatgatcgggtcatcgcacacgttttgtgttgttcgtttcggccaaagccgtgccgtgccaccctagaaacagcggtggccggattgagtttgattcagcgattagttgttttgttcccgtgcatagacttatccggccggcgccgtggagtttgtttcagcagttgtttcgtccttgcagcgtcgaagagcactaccgtacgtcgtagtcgccgtccaacgtacgtaatgcagtagcagatagcgactacgtactgcacgggcgatggagtgaccaaagcacaccggtgcaacttggctcgacgatcgacaacgctggcgacgagttgaggacccgcataaatgcaccgatcgaagcatgcacttgctgattctgctgtcgatcgatcgatcgatgcgtgtcgaagggtgaaacgcatgtgcaacgacctagctggtcaccggctctcgatccatcgatcgccggaacgtaaatcgaccaatagtcaaattttcaccaacacacaaaagaattacacgtcaatatttagaaaaaaagagttataattagcagaccgtttatgtcaggtgaaggaagaaaatgcaaaataatcgatgaatagtcaagaaatcgagaaaccccaagggtctttcggctagctctataagatgatgggctagacaatattcgcgtctttttatagtcaaagaaatcgtatgcatgggagatgatgtgctagctttgcatgcccgtgcaacttgctgtgctgcaggatcatatatagtcaagaaattggttgaaacagcgaataatttcagtcggctgcctatcctattagacagtcccgatacatagggcaacttgcaataacaaaattaagcaagatcctgccgcgtactgtgtgctgtgtgcaaaccaatccaaaactgttgatgcattaactaagtgctactcgatcgtcatttctcgcagagttgctcgatcgatttctcccatcgtcttctgaggatcgaattagagagggagggtacgtacgtaatgttgtaatgagctaacgcaatggacaactcatatgctagctcgcgatataatgccacaccccggcaaatctgcaaatgctgatcagatcagtcgtcatctacaccgaagaaaaacggtggcaagcgcgattattgtgcatgtggatgtggatgctgcatgccgctacagtggctggctgcagcgctgggtcgacgcccggacaccggacgattgcggtggcgttccagtccttatgcagatgaacagcgcgcgtaaaaccgcatgtctgcacacttggtcggacgggccggaccccgggcgaatgtcgccaaccacgtcgatcggtcggttgatatgtagccatttcgtatgatttttcattggtgcaaagtttcgtcagagatggagccccatatatataattacgtcaaaggttgttgacaggatcggatcagcatacgtacacaaattaaagtactcatccgaacttgcaggattaagtttcagaaaattgagtaactacatgcatcaaattaagctagctagtactagatctgaatggttcacatatctctcgatcgtgccatcagtagctaggtagaggtatcgtgagggttgcaagggctacaagctgatgagcagataatgaagaaatataatggaatgcatggtcgagtggaccgcagagcatcgacacatttcaggatatggccactggaccatgagctcgaacagtgcactacctgatctccatgcatgaatgagacgagatcggaagggacaacgaggtttgcaattgcagggaatagtctcgcttgttcaaaattgagctcgaaaattaatccactcattaactagttttacttatgttaggccgctgcggttatctctgaatttttctatccttgtttcccatttaatcctggaccactgttcactgtacgatgatgcgaaaaaaaggtccatgttccttgaacaatggctatttatgttgtaacctaattctgacttaaaatgcacgtctaactgaatgaatggagaactagtgcagatctaatataatctgccataagtgggaactaattaatccttggggtctcggttaaacgatgaattcattgcaccgacaactcctgttattttccccaaagtaaggagcttttgttaaatcagtttcagactttcaggcgcatgcatagcatatgtactatcatagcagccgttttggactttggaatttcataattatgttgtgtaattccacgtgaaatccctgtggattaattttatagtagatcgtccaatatgatttgcattctggattgggcatgtagtatggcatggtcaccctcaacttgtacaagatcgagccagttaaaaccttatatgtctgaaaagaaaaacattttatgtcctttgcaggaaacctgtgttacatcaagatctgcctaatttaattagttcaaagccaggatgccatcattagagtatgccaacagtcactactatataaatgatttttctgcagtaaatccatcccctataggttgtagacataccgtgattggtcacgtctgtaaaaatcaatctctattttcgcgaatggctccgcatataaaaatctattttcgcaaacgagcttcttaaggggccacatataaaaatattccatctcctcaatagaatgtttttcttctctttcttcatatcctctccttttctctctctttcttcctctcctctgagtggttgggaggcggatccggccttgagagggtaggatccgccaccctagggagcggttgcggcaacggtggatggtgagggcggcggatctggtgacaacaccctcgagagggtcggatccgtcgccctagggagcggctgtagtgacggcggattcggcgacgccgtcccgagagggccggatccgccgccctagcgagcggttgggggcttggcctcaaacgggcttggcctcacttctcctcctccacaatcgggtgggaggtgtggtcgcggcgagcgcgaggctcctcctccaccaccaccgccaagcgagaggcgcggcgccgtcgaatctggcgtcctctttccctcccgtgtggatccggccgttggtccgtgtcacgcctcgaactagtcccgaccgggactagcccgtgacgctccaaattaacttgttaatcgataccagtcccaggaatcagtgctggtatcccaggaagacagaatatcacagcaacagaggtctctttattatagagtaggagtacagtcatgttgggctgcggacagatcccgagctcacaactgcattacaaaagggaagcggaagccaagacttggaccaaacatcacaggcgcgacttggggactaggccgaaaccctaaaactcatcgtagccggcttgctcctggaagaactcctcgtcagcgggatccgcttcatcttcttcagcaattggggggggttatttatatagagcaagggtgagtacaggagtactcagcaagccatgggaaataagtgtttaatgcaggcttcaaagaaaggctgttgtttttgcaattgattttatttgaactcttttctgaaacaactaagtgagtgcttctcaaacgacacggatgagacagtgcgtctcgtccggtcggagtatgtgcaatgtttcagtcttttgaattgataaagattggcacccggccaacagctttcaaacggccacccggacctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaataacctctgcagaggggatacactttacccacacgacattactaacctggatcatccagcccgtgcagaacggccacgtctagagaccttaaggcttttatgtcaaggcatttcgaaagccgacacaggttcaccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcatacttgtcttatgttcggatgaaattccaaggaaacggtccttaagtgcaagagcgggaaaccgtacacccggtacgttccccggtccgtggttttggaaattcatttagttcgcaagcaccgacccaggtgtcgggttttccaagtcttttgtaaaacccaagttttacccaagatgtttctcagattttaagtctgaaggcgaccgtcgatacccgtgcagagagcacgattaccgaggcgcaactaggtgggtacaagggaacatggtataacaattacaatggaagggtcaaatgcaacaaattaggtaggtctgccaatctgccttgcagacgggacaagcagattaagtgcgatcctatcaatgcataatattttttaagcaacataattaagttcaaatataggctcaagatgttcaaaggtggcttgcctcgctcgagatcttgagcttgatcctcgaaatcctcgcactgcgggtcttcgagctccgaaactacacgcgaaacaggacaactcagcaaacggcgaaaataaagccctattactgacctctaagtgtgccattaggtagatctcgagatctgaggaattttggaagttgaatggagtcaaacggacttacggttgggaagatattgaatttctaagattattggatttttggtctaaaggaaaaggatttatttaaatcctttttgaaaaagaaaagaaaagaaaagaaggagggagggaaattagacttccctcgggcggctagggcgcggcccgagaggatggggcggctcggccgagcttaatgggccggccggcccaagaaggcggcccaaggcgcgcgcgcgggcggggaggggagagagagagccggtgggccgggtccatcccgcgtggtcccgggtgggacccgcttgtcggcgactcggctcaccgtgagcgaggtgcacgcgggcatgctagggtttggggagggaggcgtggcgcatgcgcgcggttcgcggaggacgcggtgcggcgggcccacgcgcagcctcacggctcaccgcggaccatgcacacgggggggaaacggagggagcggctggccgggtcagccgatccggtcgcggccgaggtggcgccaacgtggcgcctacgtggcagccacgcgggccggcgggaggtagacgacgatgtcggccggaacggacggcggacggcggtggcgattggcggagcgaaccacggcgatacaggcgaaagcgagcacgccggggggttgcacgggacgaggggagacgagccaacggctcggattcgccggagggagctcgacggcggcggattgcggcggcggcaaccggcggagagaaaagggggaaacggcgatgaggtcacgagggccgattcccgacggtgagagcatctacgtggctacgggaatccgttgctagcgtcggattgggcggagctacgccgagcgaggccggctacgagcgggtgctatggagcacgggcggcgacggcggcgagcacacaacgagcggcggcaacggtcggggcggcgccggctagctacggggaggcta

SEQ ID NO: 67049 - DNA, 7593 bp, Oryza sativa
agggattcggcccatcgaaccgcgagggaggcgaaatagacttttgcggagggatttgatttgggaaggatttggattcgggatgaactcgacgatagatcggggatttgagatctgagatggcacggacactagacaacaagcaaagaaacagatttcgcaattaggatttttaagagatagttttcccgctaggcgccacgacggaacgggcgctacagtccgcccccatgtgcgcggatcttgctatgacaaggcagatctagagcgggtgatggcgggaggtatggaggtggctgcggcaacctcagcggcgggcgggtgatgacgggagtggcgacgatggttgcgatgacctcagcagcggtggctcagtctcagacggttggctgggcgtgggactgccgtcgacgaaggagccggaacagcggcggcgacaggctcagcctcaaacggccgacgggtgtgggaccgccgccgccgaaggagcgggtaggtgggggggtttcggtgcttgggttttttcttgttgggattttttttcgtggttatttttttcatgcggttagcttaagcacccgtatgttaaaatcggatttttgcaaagctttgggtgcaagcgggcaacccgtcctcatgcaaaaataataattttggccgccgaatctttagtagcgagtgtcaggcatatgtcaaaatcagaatattaaattaattttctgtaatatgggaatatgcgatattcttatgttgtacggtgattcctgaaccaatagtagcagtatcatctatatcattaattctgcagtcactctactgcagcctgttgagggacaaatgcgatttccttggaacaaaactaacatgtaaaattaagaaaaaaatcagatttaaactattggcataaatctgcataatgttcaaattacaaaccacatagctagcactaccttttcaaagttaaggtgatagtgtacacgtgcccctagtaataacagaactcaaacttaaacattattatgtctcgacagacatttccagcaatccttacaattactaactaactttgcatcatgcgtgtattctggtcggctatctgctgatctcgtatataggacactgtgattcattatctaaaaaattattaaagcctaactccaaaaacaccgtcaaaaaactgtcagcgctgccaagtactgatatctgaagatcctgcaggcgccgatttgcctgtctaccatatattaattcatctgaattgacattaccttattcatgtagaacatctgaatcttattgagatctctacttgtttatgtagaacatccaaactgatcaatcatcggtttgattaattgcagcaccgatgcagccaaattaaatactatcgctccgtaccaagacaagcagtaatctgattgcaccgtaccacacggaactctcactctcaagagaccagatcgatttgctgaaaattctagcatctaagggtgtgtttaggccctatttatttccaaagtttttttttcaaacttccaactttccatcacatcaaatattttatacacacataacttttctatcacatcgtaccaatttcaaccaaacttccaaatttcagtgtgaactaaacacagccttaagttcacgtcaaaattggaaatttgattgaagttgaatgatgtgacgaaaaagttggaagtttgtgtatgggaaagttttgatgtgatgaaaaagttgaaagtttgaagaaaaagttgggaactaaaccatgcattaattggttaccttcactttctctatacatgcatgtgtggtcagtactaaacgcctgactgtaaaaggctaaatgattttttcccactattttctagcagggcgaactatcggtgtccaatatatagtcgacacacgcatatgcaatggcaaccggtcaataaatgcaacacttgcaaataagaaatcagtggcatgtgtatgtatatgcctgtactgttgaatatagtcttatttgatactgttgaacttgaggttataattggtgatggagagtaaagttaaagtcagacaccataaccggataaccctttaaatagagagggtgtgttacagtgtaaccatgacgactactataatataacgtagacatgcacatagagagaggatgacgatgaggctaagaactcatagcggctagtaggcgctatgtgagttagggaggaacaaccataattcaagtttcggggattaagtttcggatgaagtaagacttatcaatacacagtattttcgaacaagttgaagtactatatagtactgcattagctaaaatttggacctactgaatctctcaagaaaaggtccaaacacatcggtttaatttatcgtcgtaatcttcgggatccaagtcagtgcctgcgttattgtatggcagcctctagtagcagcggcgcgcgacggcgcgagatcgataaattaatgtgcagcgcgtttatctggtgtcacgacgactcaggactcacgagaatgcatggcaacacgtaccggccgccgggtcgttgcccatggcaccgccacacggtcggtgtgtgacagtgtgagcagtgagcgcgcgcgccacatgctgcgttctccattgccacgaacacgaagtcgtcacggacccgtgcacgcgctgcaaatctacctgcatatgcatgcgctttgacgcacgaaacactcaacgtggagcatatcaatggcacaacgcacaacgctggtacatactgtagcacactagcactaggacactgtacgcctctctagctacaaagtgctaggctactgtagagctagcccggatgaaaattgagacctatatcatctatccatggatctgatcgatcgatatcgttcgaccatgcaacgtacgtgcgaggctcttatctctcttgcggtggcgccgaccgccggcggccgcatttactgtgtctcgggccgcgaagatcgatcgaagaggggaacatggggatcgagaacgagctagctgaccatggcggatcgatgcgcgcgcgacgacgcgaaattccgccctgattggcggtggtggatggcgcgcgcgcggatgccggttgcatttatgttttcgtgcgtgcatttgccgtcccgcgtcccgcgtcgcgcgctcgatcgagcatgggatggccggtttcgcgtagtgagtagcgacgttacgtacgggaagatgcattcttgccattttgaattggttgtagaattctgtgtaggcgcgccggccgaatgggttctgaaaaggatggcatgcagttttgtgtaggttttctatcgtacgtgtgtgtgtgatgagagttgtattatcactttggaattatggaagtctgcatgtacgtgatggcccagaaaattaagttcagcatatgggcacctgtacgtatctagctatagttgtgggattttgatttgctaaacttcttatatatccattgcatcgaacgttgtttaattgtcactctcagatacattgtcgatctagttatctgctgaaacgatcatgtcagttcctgtataccaatggctatatctacaagaacagcttgaaacatttctgttcagtctcgacgagtagtcgacgtaaccaattaagagaacagagaaggacaccaaaacacagaagagatcgatcgacttgtcgagctaatcaccctgaataaactacagaccatatcagtttttagcccttcgtccagggcctaaccgagtagtagtaggggttgttaattcgcgcatacgcgctagtaatagagccgtgcgcgcgttttccttttttccttttttcaaatttggcgtacgtctccctcccctcagcggcttagcgcgtttttcttttcgatttttttaaatctatctcacgtgttttcaattttgatttgaaagctttcaaatcttaacttaaaagttttacaatctgaattaaaagttttaactcaaaattcaaacttgaacaaatcttgagtcgaaagttttcaaatctgggttgaaagttttcaaaagttgacttaaaaggtttaaaaatttgagttgaaagtttttaaatatgaattgggagtttcaaatttaaaggcgaatgtttaaaaattgagttagaaagttttaaattatagatgtactcaaacatgcactaatcacgtcgttaatcacacgctaattatgaggctaattacgtgaaggatgacgggcgtgtgcatgggcagtgggcctgcgcgtccaaaacgcgcgcgagttggctcgccagcgcgtacatgcgcaatagcaatctctgtagtagtggccattcaagatgttgtaccgtacctagctgttggtattatccgatgatatatatactccctatttaaaaaatttatgagaaaattagtcacgtataaagtattatttgtattttatgatctaataaaagatactaatcgtagaaaattttttgataaaacaaagagttagggtgtgtttagttcatatcaaaattgaaagtttggttgaaattggaatgatgtgatggaaaagttggaaagtttgtgtgtaggaaagtttttatgtgatgaaaaagttgaaagtttgaagaaaaaatttgaaacgtttgtgtttaattcacatcaaaattaaaagtttggttgaaattagaacgatgtgacggaaaagttgaaaatttgtgttgtaggaaaattttgatgcgatggaaaagttataagtttgaaactaaacccggccctaaacgttgtatccaaatgaaatgaaattttggtagtacggagggagtaggagcgtgacggcggggcggggcctggatggaaaaaaacgcggagatcgcaagtagcgcattgaaggcctggggaagaggattcatgtgaccctgcaccggagaaatttgattccattatcgtcccatcagcctgagcaagatactgtgtgcggtccaagcttcggcaatgggggccctagcttcgctgatggtcgccgcggtttcggcgtcgacgacccctgctaatggtgaactttaatggtgaactttgccgagcaccaccactgcagtttcacaactgttgatcacctattcatctgcatgcgtatggctggcatgtgcctaaagaatcgaacatccatatgaacattgtgaaaccgggggggccatgcatagcggtcttgtgtttggacgccaaaaactgttgagcatatgaccggttttccggtgaagctacaataatctgctagctgttctacgagtgtgacgtagtatacgttttcacttacagctaccatattaaatcctgcaaatcttgacaggtgcgcaacagttcaattaaaactggtgaacaataatcctatcaacacaaaacactaaaaataaacccctcaaatcgttggtgatttttttttagacatgtacaaatatctatatacaaaggcatgtacttccacatttccataaaaaacaacctagtgttagagctgttgttgacgaaaaaatcgaacacaccggcctgggagatctgcttagctcctggcaggtccaaatcttgatgagattcgggcgtgccagtcagtttgatcctgcaactgacaagatatgcaaatagtagatcaaaatagccgatcggatgacaagccgatggagtagtttcagccgatagccgataatagccgatgccgataccaaccgatagcgatagggtttaagcaatcggctatatgtccaatgtagataatgatataaaggcaattggctgatgatgatgtaataaaataacaatataatccaatataaaccaattagctagcaatgatatgataaataagcatcgatccgaaggttaaagcacacatcggctggaggtccggtgtcatgaaatccacaagattagattaaacaatgaaacctttgttgtcattggctaaatccaacttatatgtatatgcaatcctcatgagccgatgcaacgtccagataactcaccggctgaaaccccgatgaaacccttattggcaatcaataagcaggctagagattatggttctaagcacgacttagtagatcaaacttaactgatgcagcactaagtatgaaaagaaacataatatctagacaatcaagccgatgactgattttcagggtggtagatgcctaggctaatctaatctagaaaggcgatttagctgataccggcagaaaccctaaagcgagagatagtcgatagagctaaattgatatgctaagactagattaacatagacatatgataaataggtaggcaaatatatcatccaaaccagagcaattcaagaggtcgaatgtactgatgcagccttgaacgacgccgacgtaaacgatacaattgcctgggccggcggaacattggacttaccccttagccggagatcgaacactgatgcagccccgcgtcaggtgccaagtcccgccggacgataaaataaagtagaaaaggtaaaaggtggcgatgcgccgaattgtattgatcgtgaagatagattacatagaccccgggtgtacatatttatacccacgggttgatacaagtccttatcggataagaaagaaactttcctaaagataaaaggaaaagataaagttcttataggacactaaacacactttcctaaagataaaaggaaactaacaaactattcctaattaatagataacttgccatgccgcatcctctttgaactcggtctcatctggataagctccctttagtagatcaatttccttaaccgaatatagcaagaatccgacaactgacgacttgacaactctcatcggctaatcttaggacttcgaagccgatgctgactctaagccgatgactacttcgggcttaccaaatttcactgttaacagctgtccagattcattttaataaaaaaatatcacctccaatgctagattagttttctttttgaaacggtgggagtacatgtgagtaagtagcaacatcatgatactatgtattgctagatgctttccttcggccggtcagtactgttaggatgcgtttgattgcaagccacactttaacacagtttaccacatcctgacaaatttaataggtgtttggttgtagccacaattatcgcaatattatcttttccaactaattgggtcctacgtgtcaatgactaaaaaaattattgcaaaatttccttaggcttgataaattatggctaagaatttaatcacctcgccttaggcaaggtgtagcaaactagcaactatattattcacacatgtaatagtgtgtcccatgatctcccgcgtagtacgtacgcgaggctacatcgtggttaactccatgacccatattcacgtagtacgatacccatgtgtccatgacccggctgcgcctacacatgactacgtgacacggtcgggagatcatataccggcgcctcgtttttcttcctacttggacgcatatgtacttgtacacgggcaaagcacatgccacatggcgccgcaacttaattaaccgctacctcctcaaccacagcttcccgccattattactccccccccccccc

SEQ ID NO: 67050 - DNA, 6003 bp, Oryza sativa
gtcacccacaacctcagcggcatgggctgcagcgccggcatcatcgccattgatctcgccaagcacctccttcaggtacaaattaattactactcaccatgcatgcatgcagatcagcacgcaaccaaccgttgtaacatcttctcccatgcaaaatgtacaacgttcgtgcatgagctaattaaacacgaacgtaatagtaacaaagaaatgacatatcaacgttggacatgcatgcaggaactaatagacgaattataactagcagggtgcaattatacaccagtaatgcaatcctgacagtatatgaactgtgtcaatgagtaggcaaggatataggattatattacacgtcccagtctgtgcgtaataaagattccttgttttgtttttctggtcaacatatttaagtatatctggagtcaaccctgttggctagatttaatttttaaggcatatagctttattaatctttacaattaatgaatctattgatagtagtagtagtagtagtatggttttctaccaaatcattttttatttacattaagaacagctaaaagagtatacttacacacacacacacacatatatatatatatatacacacacacatatatatatatatatgtaaattaattggtgctacatggagtatgggctccaagattcaaattaagtatatacccaatttgaatgagtatgaatttttttttaaatgtttagatatgaacattaacttctttactaacaagttcaaacaagtttgaactgagtttgaacttttttttgttagattttggttctaggtatataacattcaaacatataattcgttaggtatgtaataatgaattgtgaaataaagttaagtttgagttgttttgttgttaggtatatgtatgaatcaaattcatatacctaggtatatactcacaatttaaaattttttaaaaatttgagagaatttgtgtgttttataccttggagcccgggcaccatggagtcccatatgggtatcccacatatatatatatatatataaccatatactgattaattaacaagattataagtttttctttggctgctaaggctgttgtgtgcattaataacctatagtaaacatagcaggacatggtcagttcatgactgtccagttggacattgttaagtccattttagatagtactactcctcaaaaggacaataagccatgaaacatgaatagtccaattaatctgaaacagtagagctgatagaaatagatagtgactaaattccataatacaattggtcggtcccatgcatgcgcgggaatatgggctgctggatctgagacaaactactgctagattgacaagacggtgccatttgtaattgaagggcgtaatgagaatttaattaatttgaccacccgagacgtaccaccatactattcctaccacagtactcctgtactacatatctataagctaatactactatacgataccttataaacatgataatgatctatagggaggcacttaccaatttaagtattaacactactttctccgtaaaaaaaactcaccctagtattttccagtactagattgagttttcttagacagagaaaatatatagtaaagaatcgtcgtaactatagcttctacgtaaaaaaactcaaccgagtattgggatgtgatatgtcacgcctctcggtacttagttgaggggttttttttaaagacggatggactatataagctgtgttcagtttacggtaaagttgaaagtttggttgaaaattggaacgatgtgattaaaagtttgtgtgtgaatgacaggttgatgtgatgaaaaaagttaaaagtttatatgtaaactttggatctaaacacaataaagaatcgtcgtaactacagcttctgcggcagtagacacacatctccaatattttgatcaaaactgtgtgctacgaagaaattcgaaagaacgcccagatcgattcaggctgtgtcccatactcccataccacccattattcaggctgctccatgtgaccactgtaacactgtcctgtttccaacacccaaagacagatcctgatctgaacgctcctgtgttcagattcagaacactggccagctatagcccagagagttaattactgtggttgggtggcagttactgccaaccttacctgctgccaccaagtactccgagatcggtagcactgtacatacagctagcaccgaaacgtgaaaaatctcaggccgtcgcaggacatggcaacaatgaacacctgcacctaccatgcactagtcacttcatggtttaactccatttcagaaaaaaatcagcacttcctgatcactgcatgcaactggtttttcacttagatctgtttagttacgtaaaatgaaaatttttagatgtcacataggatgtttaaccgggtgttagaagtggttttcgaacacgaatgaaaaaaaactaatttaaatcgtgagacgaatgtaacccacatatgctagctaatggcggattaattaggctcaaaagtttcatctcgcgatttcctcctaactgcgtaattaattttttaatatatatttaatgcttcatgatgtttccaaaaattcgatataatgtttttaagaaaaattttttttggaactaaaccaggacttgtgtttgtgtacatgcaggtgcacgctgagacgtacgcgttggtggtgagcacggagaacatcacgctgaacgcgtacatgggcaactaccggccgatgctggtgaccaacacgctgttccggatgggcggcgcggcggtgctcctgtccaaccggcgcgccgagcggcggcgcgccaagtaccagctgatgcacacggtgcgcacccaccgcggcggcgccagcgaccggagctacgcgtgcgtgacgcaggaggaggacggcgccggcaacgtcggcgtgtcgctgtccaaggagctcatgtccgtcgccggcgacgcgctgcgcaccaacatcacgacgctgggccccctcgtgctcccgctgtcggagcagctccggttcctcgccacggtggtgctccgccgcgtgttcggccacgccgccggcgtcaagccctacctcccggacttcaccgcggcgctcgaccacttctgcatccacgcggggggccgcggcgtgctggacgagctggagcggagcctgaagctgagcgcgtggcacatggagccgtcgcggatgacgctctacaggttcgggaacacgtcgagcagctcgctgtggtacgagctgtcctactgcgaggcgaaagggaggatcaggcgcggcgaccgggtgtggcagatcgcgttcggctccggattcaagtgcaacagcgccgtctggaaggcgctcaggacggtcgacggcggcgccggccgggacgccggcgcgtgggcgcaggacatcgacgcgctgccggtgcacgtgcccaaggtggtgcccatcgtcgacgacgacgacggcgccaatggcggcgacggcgaccgacacgacgcggcgtcgcacgtacgaccggaataagctacatacttaattatgtgtacttgcgtgtaaatcgtcacgagtcatggatggactgaaaaatactgtcgcgtgttgtttcatggacatgaggacatcgtatcgtgtcagggaaggactgataattccttgtgcggcattttgtctaggtatactgattaatcaatcgtgtgtgttaaatgtgtgaaaggttgagtatatacgacaataacttgagtattttctctttgttatgaatcttttttgttgttgtacgaattaagagatgagcagggttcataaaattgtttggtttttgcgaaaaatgatcggtttcgtaaaaccgatgatactcagtttgtggaagccgacttgtattagccggtttccatacggtattgatcaaaagttattggtttttgtcggttttccgcgtaaactagtgaccaggggttttctacttcgaaaacgaaaaatcacccctacacgagtgcaatacctattatagaagaaagtttacgccggaagaaagcttatatcttaaaaaaaatagcttatcgtagaaggacgcttgcaacataagcaagcttgcaggagaatcaaccttatggcgtaagcaagtttatagtgtaagctattaatctcatccgcctgttaataggaccatgaagttccaagacgaggcggaaccctcccagacaccaccgactctttttgtactctaatccagaaaaaaataaagtatattttttcagtgttccacaactttgtgtttctttgattatgcgttgatcggtagaatacgtaattcttaacactcttggtcctatacttctcttctttttagagaaaccacgagtggcatatattcgtagaccttaaatgggcccaaaatataactgggctttactagcccagattccctactggacaaggcccacgagtccgtgacacctgtcctaaatgggcctaaatggagtactagcccctttagccggtgcaacggattccaccaacgctgtcctgtcctatcctcccatctccattgctcccacgcagccactgccgctgcggtggttccggagcgccggccgccgcctccgccgcgacgacctcactttctgctatcaacctgtagcaaaccaggagcagcgtcggcctcctcctccgcctccgagctgtgtcgttctccggattgagccggggtaagcgactagtacttcgccttttccctcccaaattgccgtgccatctccgcctcctcttccattctctccatggttggtctggctcgaattggtttgcttatttggttctcgtaatccagagtagccgtggaagctgaggccgaggtgcatttgtggttttcttggcgcggataaaggctgggggtggggagatgatgagcccgtgcgattgcttcctccatgccaccgcgccgccgctgaatccgccgtcgagtctcgcggctgcggcgccgggagctcgctggagggatagcaacctctcgttccagagcagcgcagtgtctgcgccggcgagaaacgtcgagacttcccccaatttggtggttccatgtacggttcatacgcaggctgctgaaaggaagaagagtgggaggtgggtgaagtatggcgggtcgattccggcgatgctggaggcgcttgagcgtaatgaggatatcggggaggcgctccggccatggagggacacgatgagcaaccgggagaggacaatcattctcaaggagcagaaggattggaggagagcggttgaaattttcaactggtttcgcaggaggaggcgccatgaggtcaatgtgatacactacaatgttgttctctgcgcggttgggagggcgaggagatgggaccttgttgctaggctatggcatgagatgcattccggtggtgttgcgccggataattcgacgtatggcacgcttattgatgtgcactgcaaagggggcagagagaggatggcattgctttggcttggcgacatgatcaagcgtgggttgctgcctgatgagattactatgagtattgtgcttcaggtacacaagaaggctggggagtatgagaaagccgagcttttcttcaagagatggtccttggagtcagatgtaaagatgaaagggcatccttgctatagtttgtatacttacaacaccttgatcgatacttatggaaaggctgggcaacttgagaaagtatcagatacattcaatcagatgttaagagaaggtgtttcaccaaatgttgttacatttaacacaatgattcatgtttggggtaaacaccgtagaatggagcaagtagcttctctgatgagaacgatggaggagtttcagtgccttccggacactaggacgtataatattctgatctcgctatacagagaaatcaatgatattgatgttgcggagtactatttcaggaagatgaaagctgaaaatctgctt

SEQ ID NO: 67051 - DNA, 1800 bp, Oryza sativa
aaagaaatgtatgagaggaacatggtgattgatgaatacacacaatcagctgtgacgaggatgtatgtcgatgctgggatgcttgagcaagcgtggtgttggtttgagaagttcaattatcagttaaactctgagtgcttttctgcaaatattgatgcatttggggagagagggcatatactccttgcagagaaggcttttatgtgctcataaaaaggaagatgctaagcacttgtgtttgtaatgttatgatcaaagcatatggtttagtagagaagcttgacgaggcttgtgagattgctgatggcatggagaggtatggcattttgcctgattacttgacttacagttctctgattcatctaatgtcaaccgctaaattgccagagaaagctctttactatttgagaaagatgcaggcagcaaaattgctgattgattgtgttccttattctgtggtaatcagttgctttgctaagaatggcaatttacacatggtcgactgcctgtttagagaaatgatcacttcagggatccaagctgatacttatgtttactctatcttaattgatgcatatgctgaagttggagatgtccagaaagctgaagcatattttggtttgttgaaaaaggctggtttatgtgagagtgctacaatatataattctttgataaagctctacacaaaggtagtgtatcttgcagaggcacagaaaacgtacaagcttctcaaatcattaaatgcagacaccaacctttatgcgtcaaactgcatgattgacctctatagtgaccattgtatggtgaaggaagcacgtgagatttttgagaatttgaaggttacaggaaaggcaaatgaattttcacatgcaatgatggtgtgcttgtacaagaaaattgctcgctttgatgaagcccacaggatttctaagaaaatgcaagcttcaggatttctaactcaggcattaagctacaactctgtgatacaaatgtatgtgtctggtggaagaatggaagatgcccttaaaatatttcagaagatgttggcatcgaacacaccaccaaatgatgcaacattcaaggcactaaagattattttagtgaaacgaggagtttcaaataatgatattagaaggttagaattgctcagaaaaaatagaattcatgattgcttgcgccactggtacaggatgctatgcatggcggtaagatcaggtggtagttcttctcgacgtattagtgataattcagctctgaggacgcatatttttgacattggcaattccaagagtggcaaaagaaatacaagaaagcatgtaacttcataaatatttcgagtctaactggtttaacatcttcgatgttgacacaacacggtgatgatccatctactaaacagttgatggaaagcaccgtgttatcttcaaaagaaaaccccatgaccactgtttgactggtgctctaagaatgtggtgaaatttccaatggatcaggctagattaccgcagggatgcaggtcagttttgttgtatattccccaatctgtatgtaccacaatacatgggttcacacttttccaacatcagggtttaatgttattaactggaacatctatagattatctaaatacagcaaagattcagtaattttgacaatctccaacacagcgtatttcatttctaactgtattactaacctggaaatattttttttcctgtaatggcaggtctcttttgcgttttgttaatatgatgcccataatagtttttctattcatacttcatattgcttgtaaatgtt

SEQ ID NO: 67052 - DNA, 723 bp, Oryza sativa
tgctaggcttcttgaagcaacctctagccatgtcaacaccagtgtgactcttggcaaccacatgttggtgccaacgtctatcatgtatatacatataacatcgataccaatgtctttggcggcaagctatgggtctatttttaaagagtaaattgcatgttgggccacatatttttaccatggttgcaagttggactggggtaaacacacattatcactttggaccatctgtctttgccaattatttcaactcggacccgttcttcctccagcagtccagctccatctctctcttctctccctctaatggctctcttctctccatatggccaaagccaagcactgtcgatgaggtcgtcagttccggttggcaccattccgatgctcgatcttgagtctagtcggtgacaccactgtgctcaaccttcagcctgcaaaccacccgtcgccttgcatgacctcaagttagagcttgtccatgggcttggtgacatcccaagtacacagctaatgcccttggggggaatactactatgtcccccactacgatctccacaaaatcctcctcactgccgacatcgatcagtacaccttcaccaagccaaagccaagccagcccgagaagcaggtcgctcatgtccttggccaaggatgtacacggaaacttgctcttctcacacccccacctgaccactaaacaccctctccacagcaatgggggaa

SEQ ID NO: 67053 - DNA, 3004 bp, Oryza sativa
acttttcattttttatttttgcacaaattttttgaataagacgagtggtcaaacagtgtaagcaaaaacttaaaatctcttatattataggacgaagggagtatatgttacccatattactccatcaaaattcacctggtattgcaagttaataatcacagcagtcacaacctacaattgtggaaatcgttatttggtgagcatatgtgacattttgctacaaaggtaatttttcatgcgataaatttaacactgaacatcaaatcatatatttatattcgtaggccacaactaggctgcattatccaataaaagaaacaataacactctcaaccatcaaatactagtatatgagcaaagatgctgtacacatatgaaacttttggaatactacacagaaaccaaatgtgcggcttcattttaagcttatatattttgagtttttacttacaatgcttgaccattcgtcttatttaaatttattttacaaatataaaaaacaaaaagttatgcttaaagtactgtagataataaagtaagtcacaaataaaataaataataattttaaatttttttaataaaacgagtggttaaacattgaaagcaaaaactcaaaatcccttatattatgagatggagggagtacttattagtcaaaatttaaattttcaattttaaatttgaaattgattttaaagtttttttttatcaaagtttatttttagcatttacttttaattcgttaaaaacacgcatataaaagttttattcacaaatgactttttctttgcagatatgccgatgggcacccttatcatcgactcatcgtagtattagaatttattagagaaaacaaattgcggtaaaagaagggtaagatggacggcgtcagctatatttcccaagtctaaaacgtccagccgtcagctattacgcaatcaccaggagacggacggcgtttataaaccttcctccgtgcatagaatcgtcgtcccttccctccgagtgccgtacggccgctgccgccttctggaacattcgcttgcctccgccaaaaaaaaaaaaaaaaaatccctcctcccctctcccctcgagtggggcgcagccgcctcgctcgtcttccttcctcctccaccgccgcgcgtgcgcgagtgcgcagccgccatcgccgtgcgcttctctgcctcccgatctgcggtgcgaccggtgtgatcgcggagcggcggccgacgagaaggatttttttgagggaggggggcgagtggtgcgacgccgctgacctccttcaattccacctgccccaatctcggttgggaatcgaatcgaaaggtattcccatcccctcctgcttggctgagccatacggggctctgattgattcatatttgactcatattaagcatccagttttattctggatttttttttggcgcgtggtgtagtactactggagtagcaacttgtgtcccaaaataaaattgagggtttagccgccccctgctcattagatgcagtggccttatactttcatattgatatagcaagatagggtagtaattttttttcttccctgtcttgttgataacttcttggtaggtgccactatgatcttctgttataacatcatcatactatgaaattagtttgatggcataacgtgtttttttttcttatcaggaataagatggaagagaagagaatagctcggatttcggtcacttggagaggcagacagctcgatgtcgatgcagaccgagctgtacggtgaaggaattcgggcaacttttgcaggatttgactagtgttaacccagagacattgaagcttattgttccgcagtctacaaacaaaggctccaagctgatcacaccgttttccgaccctcattcagttttgacattgaaagaagctgctattagtgatgtaagatgcacaagagttgtacttgctcagcaatatgttgctacgttatggatattataatggagaatggaataatttatattcaatcattgtttgctacaggggaagcctattagaatgatgggtgtttttaatgatgaaatcgaggaagtatcggacaatggcaaaagaacagatctacggataattggatttgaggaggaagaacaacggctgaggcaacgaacatcaggcaggccccaagttccactcaaacttccacagggccaatacatcttctgtgattttcggacacttcacttacctgggattgaggttagttagcctctactccctacgtgctttctgaaatctataagaaacagttcatgtaggcatgtcaatccgccccttccatactccacatatcatttgtctcctcacggattatcataaaccttagcgcgcacattttcctctgaagtctgaactcttgcaatttcctgcttgaattaggatgcaagcagcgcacgaagtgttccatttgaacagtatgcacactataaattgtggattaaatagtttgaaggaattggaccattgtgcagtttgcactggtttctgtccaaaactttgtgaaaagacaacgttaaacaatgtggtgtgctcattttatttatcatagttaacaccttctcatttcatgacatgacttcactataataattataatgaaatcagtatatgtatgaaatgaatgggttcactatgacaattgtaatgaaatcagtatatgattcctgtaacttgctatagattatatatagtacattagatttgaacactagacattattttcatatatacctcattctttcgtaaaaaaaatacatgcatgctagtagaaaaacagatatacctgatttgtatgataacaaataggccaatcacaacatcttgaactatcgagttttgcttacgtgccttttgtttgatgccagttgaatcccccaccttcagaagctctgaaaagaatgcacatgctagcatgtgacccaggcataattgcgatcatgaacaaggtagcaataggggtgcagga

SEQ ID NO: 67054 - DNA, 3327 bp, Oryza sativa
cgttattttacagttatcctgttggccttttcagcatagatggcgagtgggaatcatgactgaaatggcaccagtagggtatgtaggcgtcagtccaaaatgcattctaggcttcaataaggttagtataactgtataagctttttactactgcacatatggatacttgtcacacaacaatttctgaggttatatcatcatgtcttcctcattgttaatacagaacatgggagaggaaatatcccttcgcctacgaactgatgacttgaaaggatttaggaaatatgaaagtatcaagagaactctactccatgaacttgtatgcctccttggttttctgctttcatgaaatggagatttcttatgcagatcttccgattgtcctctgtaatcatgcctattgtatattaaacttgcacttggtgatttcaggcacacatggtgcactccgagcatgatgcacattttttgctcttaataagcaggtgatttctttttcctagacaatcctttcatgattggctactgtctctttatgtttttgagttaatctgttctttaatacaatgtcaatttcagttgaatgatgaagcagcttccttggactggaccaagtcaagaggtcatgtgctgagtggtcgcaaaatcttcgattcctatgaagacgaatttgttctggagccagacagtgttgttgttggccacaaacttggaggaggatccagttcactggcaagtgctcgtgtgttgtctgggtctgctgcttataagcgttttttgaatgcatcagcggatttagagagttctaaagacagcgttactatacctggaaatgaaattcttgtgcctaacacaaaatttgagcctgatccagatgatgttggtcaagatttttctcaggacaacactaaggtggagccagacccagatgataatgatgacatgaacgtggatgtagggactggggcatcttggtcctcagtttctagatcatttacagaacaagataccatcagtcactcagagcctgaccctgatgatattcaccagcaaagcactgctggttgcctagaacctgaccctgatgattcctcaaatgttgatattcttagccaggagttgacgattgatgggaagcagaatggagaacctgatcctgacgataatggtactagcaaatttattcccgaacctgtaaacaagatggaagtagagactgaattgggaagtaacttcgcagttcagaattctgaacctgatcctgatgattcctcaaatgctattctgaataagaagctgggaactgacaggtctgatgaaactacatgcgaagctgttgtagaagaatgtgtaaacaagatggaagtggagactgaacagagcagaaactcgacaatgtcaaaatctgagcctgatcctgatgatcatgctgctaattcaaacatcagtgagctccagaggatcgaagaaccagtggcagccctctgtgcacgccttcagaaggccattgaaatgcttcgctcacaagcaacacctacagaggcaacttctgctcttcaaacactctttaagatcatcaagaatgtgatagagcacccacatgatatcaagtacaggagactgcgtaaggtatgcttggctgttcttatgctcttttattaggttcaattggtccactaaaaaaattcttacttactaatcctcatttttcaaatatgcagtccaatccacagttccaaaggagtgtggcgaactacaaaggtatctatttgctttatagactcccctctttttttttcttcaggtcttcaaaaatcaactgtaactaacttcctcatttttttcgcctccctgaaaacagctgcaatggaggtccttgaactgattggtttctgtgaggatgtcgtctcggatgagattggtcgtgcagagacttacttggtattgaaaaggaacgatcctggcttgctgtggcttgcaaaggcctctcttgaagtttccatggcctgaattgtttcaccaagcaatctcctattgcttctgtatacctgtaaatcattttcattactgttgtggggatgctcatatgctgctcttaggcaaatgatgtagtatggtcttcctacacgatgattgtttgtatatggaaacaccaaaatggtctatactgtctgtcaacacacttcatgatttctcatcaaatatacaaactatagataaattacctggcaaaatggacacatcttcccttttgtgtggactctgatagaaattgattccagatgctcacaaatgccagccaaccgtatccacgaataaagtctcgactagacggtgtattccattatcatcacaaagatgttaattttggaactgaagtatataaaaccaaatttaatcaccaaaggtctaatgtttgggaactgatttttttttaaaaaatcaaatcttaaatctttgccctttttgttctgtattgggcctttccaacctcgatcccaacaaattccgggctgtaaattcggtgggcttggtgtctaacaacagcagaaggcccacatgcgtcccatcgcaatatcccatcggccgctcgctttcgacgcgtagcggcagtaacacacactctctcccttccgatcgtcgccggcggccatcggcggcgctagggttcatcgggttacgcaggacaaactgcgtaggcgaggcgcgggggaatctcgcgatggaggcggccgtcgcttccaccggctccggcctgcgctgctcgcccaatccgatgcctaagcagcagcacgagcggcgaagtgctcgggtgggcttcgtctcccagccgcgacctcgcgctgtccgctgcgagcggtcgccccatccggatgctcgagcctacgcggcggtggcggtgggggtggtggcgaaggggcgtgaggttgggggcgtcggggtggagagaaggaggctcgcggtgttcgtttccggtgggggatccaacttccgggcgatccacgacgccgctctgggtggggaggtgaatggtgatgtggttgcgttggttaccgataaaccaggtgacgatgacgacgatgctttgcttccttgagctctttgggtggcgatgtgggtggaattgttgggatttattggggatttttgatgtggcttgcaggctgtggaggagcggagcatgcgaggggtaatgggataccggtggttgtgttcccgaagtcgaagtctgctccagagggggtttctattgatgagttgttgaatgctctgaggttgggttggttgctttgatctcaccttcaggctttgacattcgatgttcta

SEQ ID NO: 67055 - DNA, 1638 bp, Oryza sativa
ttttaaaagttctcttgcaaatttcagtatgcgagagggatagaagaaggggatggtgcaaatgacagccattcttagagaaccctctccgacagaaaggttcctgccaactcttcctccattttgtttttaggtactacatttttgtattgagtttgggttagatgattcttgaagcaattaaggttgtttcttgtgttgatctcccctctcaatttgctctatgttctgaggaagatgggcaggtggttaatataccgtcaagctgcgtttctttcatatatatgcagattgcggttgtggaaacctacatttttagagttcccgacttaagacgactatattttagagtcaccatgcgtgaatatacgcaaccatgaggtccatgactagagagaacaatgcagtttcattattgcagtagaacagcgacactgtgatgctcagctgcagttcctaatatccctcaacaccatgattgagtaaatcaatcacactcattagataatgaaacaggaagaagctaactagtcgcttatgtaaagcaaactcaatcaacccaaaccggattgcaagtacttgagttatgacttgcaattttattatgcattattgtctcaaagcaaaatatcttaggaattacttagcacagaacattagcaatatacgtccatacataaattattgggtcctggcaagcttgctagtgtcctagctacgctagactgctagatcataattatcgaggaaacgatagcatttcctcttccatggattgactacttgcttctgtggcaactccttcaattgacatgtatagtgctgaaatttgatttttactgggtctacttgattccctatttccccatggaaggggcccttttttgataatatgttttccagtgccatctctacttctctcattgaaggcgcgttctcctcctttcaatttagtacacagtgcagctacttcatggacttctccatcttcctcctccttgacttgaggatctattatgttaataaggtttccttctgagagcagcaaaataaaatgtgaaacaaggccatcaccatcgaacgtgtcaacaacaggtttctttcgagtaagcaactccacaagaagaactccaaaactaaaaacatcgctcttgtcagttagtcgaccaatataatagtacatgggatctaagtagccaattgttccttgaacagttgtagttatttcagatcgatctatcggggtgtactttgaagccccaaaatctgataccttcgctgttaaactatcatcaagaagtatattggaggacttaatatctctatgataaattggcattgaagaagctgagtgtagataggacaaagctctagcaacctcaagtgaaatccttaatcgatcatcccatgacagtgagattggaccatcgacatgaagatgatgataaagggccccatgtgaaatgaattcataaccaacaatggaacttctgtctcaaggcaacatcctaggagcttcaccacatttctatggttaatttgagaaagtattgcgacctcatttatgaattcacctatttctctttgaactataatctttgatttttttatggccacaacattcaagtctagaatccc

SEQ ID NO: 67056 - DNA, 2886 bp, Oryza sativa
actaccatagactcgctatataaaccgagtttgtattatcatgcaaagataaggatacataaatttggtaagatatacttcatccgtctaaaaaaaaaaccgaatctaggactggatgtgacacattctagtacaatgaatttggataaatgtgtcacatccagtacattggtttcttatgggacggagggagtatgctctttagtgaattgtcacctgtcaaagaattcttggatgtgatgcatcccccctttttaaagggatccccatatccattttgacatcgacaatgaaatgacccatgcgtatttatgcagattccatagcatgaatgcgccggtctgcacactcatcaatgtctacataaacaatacaacttactgaaagtacacacctagaaaggagatctaaaacaatgttgagaaatcaagagatatattagctagttgtgcgtttctctggtagtgtggattatatataaaattttgaagctattaatttcagttttttagactattaataaattaaattgtttttgttcttgagtgcttaaaacaaatttatataacttttaactaaaaaatggtgcaaaagtatgtaatgtaaattgcttgtgcgaatatatgggggttaccaattattgtactcaattatgtatcaatctaaggaagtaacttgttttgttatacatatgtcgttatgttgaaacactcgtatttatctacataccttcgcatccgtttggttgagtagcgttgccctttaagccatctcggcaccgacagttatatcctccttgcgtgttagtgcaatcgccaaaacatggatatatatcgggagaatgacactcatcgatgtctagatatgcaaaattgtattggtcaggagagggaaaagtctgatcgttttagataatgaagaaggaaaagtctaggttggaaaattaattgtgattagaactaaagttatctttgcaaaacgaccacaaaaccatacttggaagaaaacatataaggaaatgcacaaatctacccttttcaaaaagggacaatatccacatatatggggccacttctagcatcatcggtcactattaggaatttcttttgtacgttggtaattataaatcttatagttcatttgtgtaagagtatatatgaaaaataaaatcatttgatggttgattgcacatgatttttaatatgattctttatataaacaatgatccatgtgaatgcaaagtttaaggacccgtgttcataacgtatacctttgcatccatcaatgatgtatggattgccttgataaccataagagtacttgcaccgatacccgttgtttgcccaagcatcagtgtcttggcaagagctatgggcactgcgacactcgggggcagatgaatttctaggacaataacttgtcgaattactgattacccattccagcaaggctgggagcgcttgcggatctctgtcggaatcaaaaataatgagatcgacattggaattaatgaaattggtatagttgaatccctggtccaccatgtagatatttaaaaagtttgcatcaccgtgaatctggatgagataggatgagtagcctaaaatgatgtttgtttgacaacaacaaatgcccgagcacgcacttatcccgaaaattgctgatgggatccttgggcagatgacactgcaggaggcgatcgggttgtcccctcccagcccccagacgtcgacctggctatcgtggcccatcaacactaggctactccccgactccgacaggaagaacggcccgccatctgggaggccaccgccccatgtcccgtttgcgcttccacggccatcgtactccagattgattcggccgctgttgatgcgcacggttccattggggatggagatgtcgagcacctgcaccgtgccatcaccgaggaacagcctgggcgggtggtatgagtggtcgcaggtgaggttgaagccgactgtgtggtagcagccgggctccaccccgaacgggtactcgatgctgatgttaccgcagctggtggtgcagctcttgattttcttcgcggttggcaccgcgggttcttccgccgcagccaccatcgcggccagcagctgcagaatcagcaactgaacatgcactctcctgctgcccactaccaccctgaccatctctgtatatactccctccattttaaaatggttgacaccgttgactttttagtacgcgtttgaccattcgtcttattcaaaaaatttaagtaattatttattcttttaatatcatttgattcattgttaaatatagtttcatgtacatatatagttttacgtatctcacaagttttttttaataagacgaacggttaaacatgtgttaaaaagtcaacggtgtcaaatattttgaaacggagggagtatgttttatcgcaacagattatgtatcgaacgttctatcaatgctgatcctgatatggatttgctggtttgtaattaatctctggtttgtaattaatctccggtgtaactaactatatatacagatgtactctagacgactgaagtagtccctatcgtgcggccgtgcctaactaacgaaattaactactagtatgtagtaagatgaatggattgtgtcgtcagtcaatgacaatcatatatacgttccattctacacggaggtctcagataatatatagtataatgatgatataaaggaaatataaatttgttaattatacttgggtgcgtatgcatcgtgtatcacgcagtgtctcggcatgcagcttgctgcttttgcttttcagcgagtgggtcatgtcgtctcctttaattccctctgtatggtcctgtttagttggtgaaactctatatgggcctgggg

SEQ ID NO: 67057 - DNA, 1567 bp, Oryza sativa
catgaattaattaggctcaaaagatccgtctcgcgatttatatgcaaactgtccaattagtttttctttttatctatatttaatgctctatacatgtgtccaaagattcgatgtaatgtttttgggaaaagtttggggaactaaacagcccctatggtgagaaattagtccatgtgaaatttcccacatgtacaacagcagtatgccagtatatatggcttcgtaagctggcttgaaacaacattaattggccgtacaagaaccaaacaaattggcagtaacaaagcctctctgcgcccatcaatggcaacatgaagatacgtacgtactctctagtcaacagcgtgtagagacttacagtagcggtacgaggaaacaaaggcgcaaatgtctcttttcccttgaagaaatgatcaaatgaatcaaggcaagcaaactctatacgttttcatttcagggtttcaaagcttaatcatcgccttcattttctatatatgtttatatcaacttttcttttacaaaaagagagtactgaaatcaaccgggtcagacacgcgctgctataccaaaaggattccaaagaattgcttgtgtgttgacgacgctaggatctttgatggcgtcaacaagaccccgatagaggtcgcttaattggggtattgccatggaaaaatggtgcgcgtgacgaacggccggtcggaggcattgtaatcgaagagatcttggacgagctgtgaatccggctgatgttgccaggcacatttcatgtgtgataccggcttcaagggcaacaacatccttaaatataatgaacgggtgggttcgaaaggtagggtttttggatggccctaccactaggctggctgccttctttcggatgggaagcaggccgggcctgatgggcgagctgttggaaatttggtcataattcgacatattttaattcaaaataacaagataataaatatgatatttacaatgggatttgatccagtgatagtggtgaatgtaatcaacatgagcatgcttaatgtagaataagcatcaacaatcacataataacataatgttgacattgggatgaacattaacagtaaaacttctaattgaaatattgtaagaatgttataccccaagaattgtcctccgctggagtttgaggcagtattgcctccgttggtgttgacgggagcctccttctccttgtatccagtgttgccgttgtctccagtgttcgacatattggtgaaggtgaagtagatgttgacgaacagtgagtagtcgcgccttgcactccccaaaaacctgatcgcccgcccgtccgtgcaaacgtcgcagcagcgcgtggtttcggaggcctactctcccaaagcgtgtgcacacactcgtcgggatgggattaccgtagcagcaacagcgttggaaaatggatgaaagtgtgtctcactgttctcgcgggagatcaaatccattctcattttataagaggaatggaagatgaaaagtaagagtcatggaataggaagaggaatagagcaactaattgtcatcaactagccatgaatca

SEQ ID NO: 67058 - DNA, 4131 bp, Oryza sativa
atcagcctctagtttctttcctttgtttttttagtgcagcctctagtttcttactatttgtcatgcaaaaattatggcatggcataaacattccatcggaaagctacagactcggtttacagatgaacttgaaacagcacatctgcaaatggacgaaccaaaatccacccgacacatcccaaaattgagggaaactaccaaactgcaggatcaggatccaaaccgcttcaaatggaaaaatatattatacttgcttttttacgccatcgaccaggaaaaaaaaaaagaaacaccgtgcatgatgtctaacagggagaaccgctcgccgaagcaatcaggcatgccacaccacatggccacatttgtgcacagaaagtggatatgcgattattaagagtctacgacatccttatttccctcagctcatctaaactgaaaaatgcaggccagtgaagtcgggagtcgaacacgagccgcggaagccggaagtggagaaacgcgtcaatggcggaagccgcggagccacaaaacatttcggtgccagtgcgcctccgccgacgcgtcgcccacctcaccgctgctccaccgccggctgattccgagcgctcctctccggtgaggaggagacgaaccgtgaaaccaaccacggaggaagccaagagatcatccgacgaagctgtgcctcctcacctcaatcgatcagaaccttcctcaaccacacccagaaaaatctcctccccgaaaaaccgcaagcattccgcccaaaaatccctcccaaaaaaccggagccaaccgatcacccccaaaattcgccacgaacaacacggaaacgatcatcgagcacgcatacctcacgattcgagcagctcgcagcaggaaaccatcgggatgcgctcgctagggtttcgatcgccgcggagagacgaatccgaatcccctcctcctgcacaaaacccacaagccaaaaacccaaccacctctctctctctctctctctctctctctctcgcacagagatgaactgaacaccacgcacgctttgaacgaagtgggagagagagagaggagagagggtcacgtccaattcatgctcgcctctctctcctcctcacttaccgacccgcccacccaccacctcactgacagatgggccccacacccgtggggcccgggtggtcatgggctaagcgtagcctccatcgacgtggggaggagtcgcgggatcctccggtggggccgacctgtcagtgagggtggaacggctccggatgcatgggggtagggccgggcgacgtaggccgtaggataggccagccttccgggggcgtagagctcgcgtgggccgtcggatcgggatgggctctgacacgtgaggcggggaggctgcgttgcgggcaggtggccgtgccggtgaaaggaacggacggtggggattgggttggacgtgtttcgtggacggcgcggatggacccgtggaggaaggtgcagcgtcgggattctttttcctgtgtgacccccttttttgtcccgtggaaacgaggccgagctgaagcttttttttttttactgctcccttttgcccctttctctctcgcagtaaggggctgtttggcaggactcctctccaagaaaatagctccatctccaagtttttttttgccaaacacgagtagtggagtagctccggctcttgaatcgcagctccatctccaggaatattctggagctcctcaaggggtactccaccaaaacctggagtcatatgtcctcatggagatggtaaaaaattacccaccattgccattggttacaaaaaaaacgattcgcttctattccacagtaccgtcccgttcccgttcctcattcgtgaaaaaaatgtttccaccagagcgccgcccgagtctgcaggcaaatcgccaccgccgccaaccctagagccgccgccaccgagatggccggatccgcctctgtccaagatggatccgcctagaggaggaagtcccggccgccgagatgaccatgggcgccggactggagcatggctatgggcgcggcttccctcctcccgcaaccggccaggggcgcggctgcccgcctcctgctgccggccagtggcgcggccaggggcgcggctgcccgcctcccgctgccggagccgccctgcacccgcctcccgctgccggagcagccctggggcacggctgcccgcctcccgctgttggagccgtcctggggcacggcagccctgccgccggagccgccgtggggcgcggctgctcacccgccggcgccgcactggggcgcgggtcccagccgaccggcgctgcccagtagcaagctcgtcccccgcgtactggatgatagaagagcttttccccatttcaaaggttgtattggtgctcttgatgaaactcatatccgtgtgtcattgtcacctgatgagcaaattagatatattggaaaaactggaattcccactcaaaatgtgcttgccgtttgtgactttgacatgcgttttacttatgttgcaacgggtcaaccgggagctatgcatgacacaagtgttttatacaatgcattaagagtggatgaaaaattcttccctcatcctccacaaggtaccacacttgtattatgctctctatttgtgctaactgtgcatgtgttactaaaatgtatcaataatcatactatgctatcttttgtaggcaaatactatgttgttgacgcaggatatcctaatcgtcctggttatcttgctccatacaagggtgagagataccatttactagagtggcacagaggtatggaacccaatactccaatggaaaaattcaatcgtgtgcactcttccatccgcaatgttattgagcgatcatttggattactaaaaatgaagtggcaaattctgtacaagatgccgtgctaccccatgtacaagcaaaaaatgattgttgaggctgctatggtccttcataattacattcgtgagcatggaggtgaggatcctgattttgctaggtttgatcgtgaccctaattttattccaacaataccagaacggtacaacaaatacgcagttcctcgaacggcatctgatgagtcaactcccgaaagaagtacaggaactatggatctcttccgtgatgaactagccaccgctttatcaatttcttggcgctagatttgtaagacataagatgataatgtatctttgttggacttcaattatgaacctttgattaaaatgtggtaccttgtgcggattttgctatgtgcggattttgctcccaactcgtttctcaattgtggcagatttgcatgtgttccattaagatgtaaaataaatattacgataaaaaaattagctactcggaggtgcaattccctagtacagtagcagcattgccatgcgtgttgctttgcactctgactgtgcgctctccggtctactgtgtagctcgatcgtggccgttttggcgttttgctgcaacattacctctcgcagcaggattgaaataggtgcttgcatcgtcttgaaaaaagtctattttataattttttttttattttttattataaaaaaattagctattcgagctaattttgtaccgttcttaaaatagctacttgcatcgtcttgcaacaagtctattttgtaatatattttattttttattattgttatggctgtgagaaatattaaacatcactatatattagtaatcaacatccatacaagatccatgggcaaaacagtcctttcactcatcctcctaccaaatctggagctggaccatatgtattattacccaaacaggtgctagctccaggagctccacggtggagaagatttcctggagaggagctcatttttttgtagaggagctctcccaaacagcccctaaataactccgtcggcttccgcttgacagaaagagccaagcattttattcttcgcactcgcagtacacaatggcatattaactgaattgcaaaatatattcatttggagaataaactgttgcatttggcatgttgggaatgaacttaacaagcagaccaaattaacactaatgagtctgtcagaacatattttctaccacatctgtaaattggcacgacttacag

SEQ ID NO: 67059 - DNA, 6068 bp, Oryza sativa
aatgaactcatcgctgcccacatcttctgtatcttagacaaaatccactccttgagcagggtactcgttagtctggctccaccaagtgtcccgccgcttatcgtggcggcaagcctgcaacagcgtgcgacactgcttctcacagccccacactccaaccctgggctaagccatcgtacctcaacacgtgcatttgagccacatccctctaacgccgatatagccatctaacttgcaaggacaacaccctccaagcccgctgccaccctagaatcacttatttcgacggttgccatatggttccggagaggaaggttgaaaggaaggagatgatggatcccttcacgaggaagggtggcaggaggagcgtcgcgccgcatcagcttgggaaggggaggtggtgaggggtatagtgttcgggcaccgacaaaagggagggaagaggtatagagcaccgagaggcgttgccattggtggagaaaggcagagcgggctggagaagtcggtggcacggccactactaggagggaagaagcggatctcaagcgccgcaaccaccgctagaaggaggaggaggctcttgaatggcacagccaccgctaggagggaggagtgaggaccggcatcggcatcgctggtgctgtggtgtatgatacacaataggataacaagtgagaggctgggattttttttcctcgtatatttttccttttcggataaggggtggtggggactctatatttctatatgtttctttccgcatactacacgtgattttctctatggttcttttttcagatggaaacgggtgactactgatttctgctgtaccattgtctcgggataatactgatctctgttgtaccattctcttgggataaccaaaatcccttataatattggacaaaccaaagggtcatttatcccctgtagttgtggacagagggagtacttacataagcattttaaatttgcaatgcactcttcgcctaatcggtgcgagtaataaccaaagttaaccaacttagcacgagaggtgacgtgtcatccgaccaaccgctttggcctctaccgctagtacttctcttaccactccattcatcactgtttcggcctttcgagcaaaggcccagcttggaaaattatggttagacaaataggccgctgaacaagaaaaatgttcactttaggtctctcttctaataattagttttaaaagataagggatgttttatatccggttttatgattaacgaacacaatttaaactcgatgcttagctgagggatctaaaataaactttatctgccaaacaaccaacggtttgctaattgatggctaatcttgtggtatctgggccgggccattggctgatccaacgttggcccactaatcacactgcgccggcctcagcctcgccgccgccggcggccaccgaagatatcagccatgctccggcggtgaactgataagtagccaggttttggctcaaagatgaaaatgtgttccttgtctgtagcgtttttaccccccctgagaatattcttgaatcgccaaacaattttcattaatattaattagcattcgcactgtcaaaacgtttcaaggggcctacgtttaaccacacaccaatagtttttttttcgcaaacgcgcaaaatagatattacacatcagtatattagaagaaaatagagttgttgttacacaatgcagccgaccagactggtcgttgccagttacaaggaaaggatttcgaacccaaaaaagagtaaaaactaaaagctgttgcttctatctagcgggagggggtggcggaggaggaggagcttcctaatctccaaataggtccccaatgaagcggatggaccccagaactatcgagaccgatgaaacggaagaatcaaaaaccctggtgaaacgaaagaatcgaaaaccctaacgttccgctctttccaaagctacagtaaaccatgaggattagagagtcgaaaccttacgaagatgcgcaggaagactagccctagccgtcggccacccgaccattagtttttgtttttgtttttactaagggaccgcgagtgtgcaccgtagttatatcatctcgatatataattaaccaactttaatagaaaatcatatatattatcttaaaacaaaacagttttcgtttttagccgccggtttgtttctacagatcatgagcatgcatatcactgccgatgcagtataaaatagggttaatttaatccatgccactacaaatgtggtaaataaaaaaatgccactactattcgtgttatcgactgggtgccactgaaaatttttaaaattaaaatcatgccactcccgtcattatttccgtcctcctctctcacgccgccaacctcaccgtggttgccgccgacgaggtcgcgcgccgaacgcccatgggacgagggggctccgtgtaggacgttgccccgacctcgcagccctttgcaccaccttccacaccccacaaccgcagcgaggaggatgggcttccggcgagcactaggttccacaccgacggcaccgcggatgatgggcttccgccgctgctcctcccaatccccgtctcctcctccagctccgtcgccgccaaccccaccgacgagggctgtcgccgctactgctcccctcgatccccatctcctcctttagctcaagcgccgccgccgctcctcccgatccctgtctcctcctccagctccggtcggcgagggccgccgctacttctcctcccgcgcctcgcgtgcaccatgccaccgccaccgctactcccgctcccgctgctacttccactgctgctgctggtgacggtgaggatgctgacgtgaggaaggaggatggtaaaagtggcgggagtggcatggatccaattttaaaaattttcagtggcacttagccaataacgcgaatagtagtggtatttttttatttgccatatttagagtggcatggatcaaattaaccctataaaataccttgtgcaattcgcaacatgcatcggataaacaagtaatcatcgactaatcatacaagcatatgacggaaatactcccataaaacttaatcctaacacaatgcccctactatgtccaaagaataaaattatccagcaaccaacaatccatgcaaaaaaaaaaaagaattagaaaagtttcttagcatcaacacaggagcagcaatccagctgaggcagatgcagcaagagccaagaagtagccggcaatgccggcgccgcggcgcgacgacggcggcgacgacgagctcttcttctcgtccgccttcgccttggcgctcgacgacttcccggggagcgggctggcggcgtcggaggccggcttggcgtccggcgccggcgccggcgacggcgccatgggcgggtcggtcctgaagatctgcatcgggaggagcaccctgtccacctcgtagacggcgacggggcgggtggagtagacgctgctgctgatcttggggttggaccacatcgacccgacatggacggtgcccatgtcgtcggtgacgttgaccgtgtactcgccgccggcgagcgtgggcaccgggctggccgcgccgcccagcctgttgaactcggcgagggagtagtacctcggcagcgcgtggtacagcgccagcgacttgagctggtcggaggtgaggttcgccgtcgccgacctcgccagcgacgcgaacgccgcgtccttggggacgaacaccgtgatcccgtccttgctgccgttcgcctggctctggaacgtcctgagcacgtccgtcttctccaggaggtcgaggaacgtgtggaacggacccgccacgctcaggaggtcggcgaggtccacgtggcgcggcgccgccggggacggcgccggcgacggcgggaggctcacggccgccgcggcgggcggacccttgtgcttctgcgcgaacgccggtgagatggaggagcagcagagcaggatggtcaccatcatggctgctttggattccatcatcctcgaagtccctgatgtcacgcaagaacagtgaagtgaagcattcagcactgaattttttttgtcatgcgtttctggagcacaagtctgtaactgctgaatagaattactcttaatcttgtgaattctacagtgtttactgaacacatttagtagagtacttaagttcaaatcaacatacaagagatctgtaatgttgttctgtattctgaaatgccagaaaaccaacttcttgtgcttcagattactacagttcgtggtaattctgaacattgagaattttaaccaggctcattattgttcagatctttctagctcctagagcagagttttcagattactgaaatttagcacaaattaatggccctttccctgtcaccaagagagacaaatgcacaagatggggcactttcaagactcgatctagtccgaattgacaactgcattatactactacttcaactgttaggtgccaccaaccaaatcaggagaccacataatctaacacaagaacaaaaacagtactcctactactacatcctgcagatctcagcaccactggaagcatccaaatctctggaatttgggagccaagaacagttaagtgctaagctttgcattagcatttcccttcaacctgaaggaacataaacgcagagcaccaagaagagacgccaagctcaagagaggcgcaaagatctgttctttcctcgggccaagaactgcgaggaacagatccaaatgcgccctaaacaaatggctgcctccaagacgaccaacccatgaaacatcatactggaactcatggaaaccaaaaaattaagagaagagattctgagcatggcattgcagctgaaacaatgctgaggagactgacctgagctgctgagctgagcagggaagtgaaggcagtgaaggaatggaggagagtaggaggggagttaaggaggagagtggctatataaaatgtggggaaagtaaaaagataatgaaatcatgggtggcagctgttgatgaggattgagtagaggacagagagggctcactactgttttcaggctttcatctggagaaaataaaaagatagtaaatccaaaagaagaacagctaaataaaagctggccagataggagctgcccctttctgtcctggctctctgttgtttgttttctgggggagtaggagtagattgcatttgcttctggtggatgattagtgatggcattagcatccataaactgctggtacttttcagtggcattgcaatgcttacaagtaaggaagtttcttgcttttccaaaaaaaaaaaactgaattgtttgcttctttgatcatcctttgctttagtgtaaataacaaaagcaggagagctggaatgtggtgatccaaaaagggtgatgttgtaaagatgaacaatgcttgcttaacttattgctttatcaagttataaagatgatcaatgcaacaaaccacccagtgactcagtgagttcatgtgatgtactgacaaaagcactaatgtgcctcttttggccttctttataaaatctagatagcaggattcctcaaacttcctcaccagctcttttgtttggtcatcgtgttgtcagccgcagctaaaatttatctaattttaaacttgattgttatgtttttattgtaatttatttataagtaaaatgcaccaacggtctttaaactttccaggaggtttcacttaggtctacgaacttgcaaagcgcacatcgaagtctctaaacttggtttattgtatcatccagtaccaaagccgcgtttgaccgtggtcttgcctacatggcatgccacatggacgatgacatgtaattttttttatttttttctcactcctgtgcaaccgagccgccgccctctcctctcctctgtgggcgcgcgtgccaccgccatcgcacgccatgggcgccaccgctaccgcggtttcgccgagccaccatgtcggaggtgagcacgcaggggcaccctcccctcgggcgcagccggcgacacctccccccgcgtgcaccaagctcgcc

SEQ ID NO: 67060 - DNA, 5320 bp, Oryza sativa
aagctcgccctgccgccatcgagctcgcgcccgccctgctcgtggcatcgccgtcctttttttctttccgccgcacaccgccgatctctggccactcgtcgccacgggggcggcaacgtgaccagctgcctcccaaggccgaccgcgaacgcctccttgccgaggaggtcctctacctccactccctctggttctgcgccgcccttgctcccgcatcgaccggcggaggcacgagagagaaaaaaaaggaagaagggagaaaaaaataaaattattccatgtcatcgtacacgtggcatgccatgtaggcaagaccacggtcaaacgcggctttggaccgggatgatacaataagccaagtttagagacctcgatgtgcgctttgcaagttcgtggacctaactgaaacctcctgacaagtttaagaactgttgatacattttactctttattttttatagtggcttttaaactactaaggacacatataaaagttttatacataaataattttttgatcgttaataagtgttatgacataatataatctgttgtaggcgaaacatgtgctgaacagcaaagcactactgaattcattctatttgtttagggaaaggaagagtgtgacaaacacaccatcggcaattttcctgaaacagaccggacaccaccattaaaaaaatcgagggtagaagaaacctgctgctttttcagagttattgtctggagaattttagttctgaatagaaccttcagtcttctgaaggatgctcaactgcacatgcttaatacagccatataagtaacagcttatgcattgctgtataccactagaagtcatacaagcaaaatgtagtataagattaacatgtcttatgtctcctctctttcttgccttctcttctccttttcctttttttctttttttttttctttccacacgattgacagtgcatgacagtctgaaactctaaacattcctgaatctaaattctgaagttctgaactactacctctaactctaattcgacaagctccatgtaattaagctctaaactggatgtgattacgtgaggtcgcagcagattgtgtcggtggaggaccagctgcctgccctgacggtggctcgtatccggtgtagttaagtatagtacttaatcagacaaaatttgcagagtcattagctgtttccggcggtaggtgaggaaggcttgatcatgaaaggggacttagcatgcatttcttgagctgtcatgctcagctgggctctcaattctcaagcttaaaccaagcattactcctataacttactttgcaatcgacataatcaaatggcttggaaatgaggatcacatggtgtacaaaagcagaattagtgagaatgtaaagcccagcatgccgaaattaagcacaagttttttcttcatggacacaatcacatgctgtatcattccacattgtactcctactcaactcttgttttgctttcccttcagtttgaagaaaccagagcggcatctgtgttactgcactttaagactgccattaatgacccacagcaactttcaatttctttaacctctctcttaatcttggagtaggagtactagtactagtgttccaggttttgatgctctcttggaccacttgaagagcagagaccttggtccttgttcttggcctcttggggcctttcagtatgcctcctctgcttttcaccaactaccacaagagtacaaggtttacttgatctgcaaaatgcacacttctttatcttcatctttggtgttcttttccagattaagttttttacgtgggtgatattaacgtatgattgattgagttttaattattataaacttgaaaaatagattaatatgatattttagagcaattttcatatataaagttttcgcacgaaacacatcgtttagcagtttgaaaagcgtgccataaaaatctcaatcttcatccaacttttgttggagaagagaataggattggttgaatctcctgaagatatagatgaaggtaaagattaagtgttttacgtaaaacgatgtggtaatagcgtgtgattaattgagttttaatattacaaacttaaaaatggattaatctaatattttagaacacctttcacatataaagttttcgcacaaaacataccgtttagtagtttgaaaagtgtgccacgaatatgcaaaactttatcttactggaaatgaacaggacagtcctatcaaaattatcggtttgtgtgctacgaaaattatcggttctcctatcaaaatcacacagtttcggatgcattgcaactctatcaaaacttccagcaaattgaacaaattgtgaagcactgactgctcctaccacttcaggcttgtcgtaatagttgtagctcccatccatgtgatgcctgaagagcattcaaatgcgggtttgagacgtcccaagcataattaccggttcaattatttggccgctaatgaactagtagctctgtcccaaaatattgctgcatactaattggactattggttcatattcagattcattatactgtgatgtgtcacatccaatactatgtaacaacattttaaatcaggttagtactatttctgattttttttctctctctgtgtttttgctctcttccaagccatgccaaatcggcaatcagcggcgtccgtttcgtttgttgatcgcaacgtagtagtactacaactctagtacgtgtgggtacgacgagctaatcctgtgttgcttttggtactggactggacgccgtcatactggattggatgcgccgtagatgaggtaatgtgttgttcctcacggaccaagcaagagcaaccaactgagcaagagtgtgttctagacttggattggcccatttattggacaaagtttgcctatgggcctacgtcaatctggcccatctggatcaaagcaaaacctccacaaattcaggatgcgtctgccattataaagtccaaaattgtggtactgatggaaacttagagcaaagtataggacgtatgtggtaacttcaattttaagataaaaataagggtacgtttaaaataaagttaagttataacttttcctgacactactatagaaaacctaatagatgttgggaatctcacatagatatcggactctccaaccggtaacacgaagacggtacgatgaggggactcatcgcagccggattgggaatcggcatctatggggagttcatgactaaaaaagcatcgggcccgactcgattcatcaagacgagttgattgcttcgaaccaagatcaatattcagaaattgagcctcaaaatcatcgcaaatccaactgcaatgaatcagaatcatcccaaacattacaaacccataccattcatacaaaacaaaataacaaatcaatacatggaagcctaattgtcgtagcccaccaaaggccaaggccaccgccgccgccgcatctcactggaggctgaggtcgttaccgccgcccaccatcatcactgctcaaaaatccaataggccatgaccaaatctagtgggtggtgggagagatccgggagggggattttgggggataggacgaggtgtatctgtcgttgttgctcgaccgcaattaccaccattagatcgggtcggggaactatcgttgtcgagctcaccgtatcgcttcgatctcactgacctcgagcttgtggcaattagatctagcaaccctgaccttgtggggacgcagggccaaggggagggcaccgtgttgtggataggttgccacaaccatcgtgatgagggtgccactgatgaggcgcattcgtggtgagaccatgagagtggcgttgcccgagaggagggtgccaccaccgtggagaggtctccatcgccttgaggatggcgccgccgccgaggcgccgttgtggggaaggtgcctgccgctgaggagagaatcacgcgttgctgatgactcggtagagaaaagcgaggagaagctgaggagaaaagagcgaagagctgagagagagtgtggagagaaaagcgaggagatgccaaaaccggaaatgaggtgggtgatagataagtcagggcgaacggaccatggcttagctcagcttggtgatttaatgtttcgggctttttttttaaaaaaaacccaacacatataatatgacaaccttatatatacaggtttttaatacgaaccggcacatatagatacttatatgtgctggttttaaattttagccttatgtgagatgtcggatagacgggaaaagcttcatatgtgtcggttttaaatgaaccgatacatataagggtgtccctattaggggttttgtagttgtgcgatctttctttcttttttttaataaggaacaagggcatcttttctttcagaatttcccgtaattatttggttaatgtatatattttcatttagaaaagaaatccaaccatatgggccgaatcaaatggcggaatgcacaagcaagcaaccatgtacatacgcacattacagctgacagcgtacagcatgctcaatcgcgaacccctggtggttttctttcggcctaacataaaacgcagcggcagcccatcgttctcgttgcctcgtcggccgaaagttccatgcttgtcgccgggggcaacccggcaaagccaccgcatttcgctcccacgcggtcacactgccaaatgcaccgtgccgaccttgacacctctgccccgcttttttttgattcccaaccgccgtccaccacctccaaactccaaagccctttgctctagctatttctttttgtaataatgaaatataatctaggtcgttactcaaatagttacgatcaattattacaccaattcaatcgaacacaaacatatcttaacaagttataaaaaatacactcattattcttgcataatgacactcaaaaataaataaattatccatattttcttattattttaaactctcgagttaagctgttatgtgtttataactcgacatgatatcagagttcaatgtctcgagttcaaatcctgattgttttttaataaaagttacaacctatttatattcactaaaacctcgacatgatatcaggcttaaggattctcgcgtgagaaagaatgttggaatataagtgaattgcatgtcttttcacatccgcttaaatttctattcatggtagaggttttagtgacccacgcgtgaacaaaggcagtgtttgtcaaatgggaaagggaaataatttcccacccatttttaaatcctaaccattcattctcccttttccaattcaccc

SEQ ID NO: 67061 - DNA, 5228 bp, Oryza sativa
cgccccggcggcggcgcccgtagcatctctgatctctctcagcctttcaaaaaccatacgcgcgcacaaacgcgccatctctccatctcgccggcgtcgcctatagacgcggcgatcacgcttgcatctcactcacacaacaaaccacccccaagatcaagaacaacaacaacaacaacaacatttgtcaagatgagcgtggagatcgtggacgggagcacggtgcggagcttcgtggacgacgaggccgccttcaacgcgtcggtggacgggcgcttcgcggcgctggacgccgaccgcgacggcgtcctctcctacgccgacatgtccggggagctcatggcgctccgcgtgctggacacccacttcggcgtcgacgacggccacggcggcgccgacgacgggctctaccgcggcctcttcgcccgcttcgaccgcgacggcgacggcaaggtcggcctccacgagttccgcgccgagatgaaggaggtcatgctcgtcgtcgccaatggcctcggcttcctccccgtccagatggtcgtcgaggatggcagcttcctcaaggtggccgtcgacagggagctcgccaaggccgcctaattcaataacctagctagctaattaaccacattgaactagcccacgacgattaatttgagtactttgtttggtaaattttattgaatttggtgttaatttggatttgaactactgcattgttacaatcttacggagcactgctccctctgtttcatattataagtcgttgacttttttctgagtcaaatttatttaggtttaaccaaatttataaaaaaaatatattagcagtatctataacaccaagttaatttcactaaatacaacataaaatatatttcgataatatgtttgttttgtattagaaatattattatatttttctataaatttgattaaatttaaaaggtttgattctgaaaaaaatcgaagcaactacagtataaaatggagtaagtacttttgttatgaagaagaagaagaaagaaacagatcagtcgatcgatctatatatagttaaaattaagaggcattagggaatgatgattaatttaactgttcactgttgtatacatcgaggttcaagattaattaagtaaaagctgcagtaccttcacaaaattatactccttactccttagcatagagctgatcgatggagcgtataaaaatttaactttacatacagagaccaaattatatgcaataggattaatttgccgctgttccgttctgccaaactgcaggcagaaccatcgctgctgagaattgctttccttccttcgttcgttgtgcttcagatcctggacgggatgagcggcgtcgaattcgacaggtacgccgccgccgccgccacgccggagccgagcttcaccgggtagccgatgtccttgagcaccatctccactccactcagggcacccatcaattgcagctgcagagttatggagatcaatgagatgagtcagatgttgctgcaataattttcatctgcaaatcgatctgcagagttgtgtgtgtactgacctcgttgaggtggccgaggtggccgatcctgaacaccttgccggcgaccttgttgaggccgaggccgaggctgaggttgtaccgcttccaggcgtgcttcacgatctcggcgctgtcgatgtacggcggcacgacgacggcggtgacggtgtcgctgaaccactcctccttctgcgtgcagttcttgagcccccacgcctccacggccagcctatatatgcacatcacgccgtcagaatctcacgttcaaaagtttgaccgaatcttgttctaaacgtcaaaatgttcttcctcggtgaccgacctggtggcggtgccgaggcggttgtgcctcttgatgacgttctcgaggccttcctcgaagatgaggtcgagggcggtgcggaggccgtagaggagctggatggatggggtgtagggccagtaggtgcccatcttgtagaacttgaggtagtccttccagtcgaagaagacccgcaccgacttggccgtcttgctcgcctccagcgccttggggctcgcgcacacgatgcccagacccgtcggcagcgagagcgccttctgcgaacccgtcagcgccacgtccactccccactcatccatgcggaagtccaacgcacatatcgatgacaccccgtccaccagtagtagcgccgggtgcctgtgcttgtctgcgcgtatcgtcgtccatcgttgccatggatgagcatgagtaattcatcaagagaaagaagacaagaaagtgataaaaagctcaagatgttaccgaggattttgcggacggcggaaaggtcgttggtgactccagtggcggtctcgttgtggacgatgcagatggccttgatggagtgggaggggtcctggcggagcttgtagtcgagggcggcgaggtcggcgccgtagccccagtcgctctccaccacgtccacgttgaagttgaggcgttgctgctggtcgatccacagcaggctgaactgcccgatcaggaacgacacgatcttgtcccccggcgacagcgtgttcgtcagcgcgctctcccacgcccccgtccctgcaagcaagcaatcaatcaatcttcgggcgccaccatagataaaaggtgtaaatggttaacctacgatcccacttatagattaaaataaaccgtaaacccatttattgacctgtaagcgggtttgcgggttagccagttaaaacccttagctatggacgtggtcgatcgatgaagctaggtaggtaggttggttgggttaccggtggtggggaagaggaagggggtgccggtggtggtcttgaagatctgcttgacgtcctcgaggagggtcttggtgagggcgggcaccgccggcgagcggtagtcctcgttctgacggctcatggcgcggatcacctggtccgggatgttcaccggcccaggcacgaacaggtggttccgccccggcccatacacgtagtccgccatctccctgcccacacacacacacacaaaggcccatcaggcccaaacaaaaaataattattcgtcccacagcaataaaaactcctgcctaatataaccttctgaaagtgttctttgaaaaatgactagtgataatctcatcttactatcttagttgtactatatacggtttgttaattgttttgctctaattatccgactatataacatagcaaacatataattaatacatggctttagttagacataacagtacactactatctcgaaagaaaaacaaaggcaggagtacttgctagtactagttgtcactaataacgcagaagacgttatcaatttggacagtttcacttatccaaggaaaccattagtcctttcttccttttttttaattaaagaaacgactattagtgcgtgctctgatcctacttggcagattaactcgtgcttatccagaagaaatcaattcatgcggctactggctctctgttttgaaaattcaagttgctagctctagacaataacaaagcaaaatttctctgaacttagtctaagtttcaatttcttcttgcacatacaaaatccaaccatatggctaaactgaatttactcatacacctacgatcattgaagatctaatagaagacgctaatggagatggatgtgtgtaccttgttcagataaagcctcctcgatcttgtgctgatgattttttttttcgcacgtaatacgtgcgaaggaggaggcagggaggatggatagggtgctgaagaaggctatatagggagccatggtgtcctttcgtggggcccacacccgtccgacgtggcagataaggggccttgccggtgccttctgttcgtgaggccctcgtagctcgcctcatggagtggtgcttagctgctacttagctctgctctagctctagctgcagccatcactggcatagcatgctaacaaagcgcacggattttgacagtgtgtaacgactactcatacacagtaatctggcttcgtcaatcccatgtatatgtcctgtttatcgtcccaattttatcagatgtctgcttaatttccctgtatctgataaggtgttagctgcaccagaaattatttttcttttttcttttttgttgaaagctttgcatcagagataattagttaagcaagctgcagaggtgatcctactgtttgagtagaaattggagctagaaaggggagagaaataataataatccggtttcgctttgcttgctggctggctgaggcgatagagctgtatggcctgtgagttagtgagtgagtgagaaaaatgacaggtttggttgagtccaagcagagccaatctgcaagccaagggcgcaggagcgtccacgtcggatgttatcccctaccatctcgctttgcggtgtccgtggaaacccagcaattttttttccttctcccttcgtttttattttcagaggtgaggtcaagacaaaagatgatgttaaattgtatcgccatatgcttggagaaggttgagagggagaggatgacggcgaggccacaaacgaacagatgggaggaaggtgatagctagtgtaggtggaaatggaatcgagctgtaccaacgagattttatcgtgagaaaaatcgggtaattcactttttactttgatatttatcgctttcgtatgaactttctcctttaaaacctgaaaaaaaatcaggcgattcacttatacgctttgatgtttttcgcctttgtatgaactatgttgtgtctaggttggctttagcatgtccgttgatgcagtgacttgagtgaggctgtagctgtagctgaagccgagaaaagattgaattctgaaatatgaaccttttgctcgttattctgatgagttcacggtatctgttccatatgttacagaacctgggctgtgtatatccattgtggatgtagaggccgcattttaatctattttctaaagaaaatgttacataacctgaaaagtgggctactgggctttttttcttaattagacgcatagcgcatgttcagacatacgaagtctgaatactgatcatatgtactctcaaggaagaaccacatgcaagtgatacccaattgggtattaagttgtgtttacagctaaaaggcttaaagaaagaaaagttcaatttttatgccagaacgaaaatggagactttcaactgtagc

SEQ ID NO: 67062 - DNA, 1672 bp, Oryza sativa
tcgtctccgacgggtccattttcgcaggaggaaacatctgcatttctttgtggctcaatgattgcgtcgacaaatcctacgcccaaattccagaactggtcaccttggaacatgcaaaaaaagagcaagggagagagaaagaaacacagaaagaaccagaaagcaaacgggcggtatagcgcagagcgcacaggagaccgcggaccacgaagatctgcatgccatgcggatttacggatgtcctccttttcctacatatagacaacgtattagcagcactatcactgcacatgaacaaatccatcaagaattgaaacaggatcaagaactgaatcaggatcatgcctgatcatgcaggattcaccggactgaaaaagatggatttttttttgaatgcgacttaacgaaaaactctctaacttttctttcaatgatggaaatggtttatatttctggtctctgctaacggtcacgcgtcgaagaaaacctctcaacatgactatgtttacatacttctattaggcttccttgcaaacacatgattgaaaaaaaaatcatatgaagaaatgtaggattttggtaagaacacaagtgcaaaacagatgattgcaaaacatacatggaaaaaaatagaatgatcatttgaatagaccacgggaaaaatataagaatcagatgagacatatagacttgaatggaaattttccaaagagattagagctcttgctaaccctcttttaaaatctctatggaattgttcatttcatatgaatttcaaataagagatgtgattcaatcatttatttcaaaagcttccttagcattttgcctttgaaatccctgaaatttcgtatgtttttaccgggagtactgcaaatgaaaggggccgatttcagcagcaatgctgctggcctgctgcgcgcgcgcagcactgaaccgagcacacgcatcattatgatctcttctactacagatcaggagcacaacatcacaaatatattcagaactgataatccagcttctgctgctactatgatcaaaaggtgtttgtgctgttgttctactatgctcgcttggcatcggatgcctgccctgcggcccctgcctgcctctcgtcgcgagacagacaggcatgatggcgctgcaagctgcaagcttagggctggtttagtccccaaaaatttttcttaaaaaatatcacatcaaatcttttaacacatacataaaacattaaatatagattaaaaatactaattgcgcaattaggaggaaatcgcgagatgaatcttttaagcctaattagtactccctccattccaaattgatctacatatagtttttttaggttattcctaaatgatctacatatttgtgttcatttattaagtctactcgttatttgtgcattggagtaaatggacattgatgcatgcatccatgcacacaagtatttataacccacatgcaatatcttgatttgctattggctggaaaatattagggatggtgcatgtatcgagtttgttgctagagtaaatatagtatgagagagttattagcctttcttggtcttggtgtatctataaaatatgtagatcaatttagaattgagggagtacatgattagccataagtgctacaataacccacatgtgctaatgacggattaatt

SEQ ID NO: 67063 - DNA, 1863 bp, Oryza sativa
gtggttaaatttctagcaaatagggaatcaaaggtggtttttctgttagcaggactaattaggcttcaaaaaagccaggtcctcaaattattggtgttcatattcatttttgtatggatttttttttgccaaagtgagaaatttaattaacaagaccaccgtatcaacgagtatccactttctacgctaggtaaggtaacatgctattgtgatgaatttagctgcttcaaggaattaatgctaaacggcattatctttgatattaacttatcaatgcaatcggtactggaagagaggatatcctaggatttgtttagtgaatcaatttgagatgttgagtcttcaattgaagttattaactatagtacgaagcagcacattgtatatagaacaaccaggtgaagatccagaaaggaaaggttgaataaactatacaaaattatataacctttttaatagatgtatgacagaaaattttagcgggacttaaatagagacttccatggttaaaacgttggtagtgaggggtcggaggctcgagaccctgccgccccatggtagattcgccactgagcacaactactatctccaaatataggacatgataattttcgatcatttccagtaaaaccatggatcaagatccaatgaataggctgttaaagcaggagatactaccaatataaacgactcattcctcattatttctatattccctcacactatttattgtatgcttcaccactttacatggcttctttatcatgcgtaaaacataacctcataactagcaaccaactaattgtgtagttctcattttaccttagttcaatttaataaacaactgtaactaacccccttgtaacaatagctaggtgggcagagaataacctacaaaatccaacactttgaaaccaccaacactgaaggtcaaaactattgtttgtctaaccatcccataggttacccgaaaagaataagccaaaatcaaaatttgaattttagaacattaaaatagttttaaaactttaagttgaaagtaaatactttcaacttattttttttatattagcttttatgataaaaaatatataaattttttacatataattttttttattcattactaaaccgttacgacttataaatacttttgggtaattgatgagtccataacttttcccccctactccatcagagccattgtttggctgattttaagtataagcgaaacggtatatatgcaaataaaaactaatttgtaaataaaacttttatatacgtgttcttagcgatctaaaaggctaaaaaataaacttcgatgaaaaaccttaaaatcagcttcaaatttaaggttaaaaatttaaattttacctgataagtataagtataagcgaaaatataagcccgcataaaccggtaagcagggagtacttggaaagtcaggggtacagacgtaagaccacaataaaacgaggggctaaccatcaaaacaacccttcccccctctctctctctcacacggcctcatccatccatccccacctgagctcccaccggagaaaaccacaaaaccacccacccaaaaaaaccaaccccctccgcgatccccatttcaaaataaccccgccgcctccgccgccgccgccgacgaggaggggtcaccgatgttgtccgaccaggagctggcccggtacgtggagtcgttcgtgcgccaggcggcggccgtcccgggcgccgtggcggcggcggggggcatatcggcggagtccgtggcgcgccagctcggcccccagctcggcctcgacctcacccccaagggcccccttatccgcgacatcctcctcgccctcttctcccccc

SEQ ID NO: 67064 - DNA, 1244 bp, Oryza sativa
atctttaatgtccacgaacgcttgtggaatcacttctagtgtacttgagaaaatctttgaatactgccgtagggatgtcaaccataccagcataattaatgcctctgaacttgttggggggcaataatggatcccgtcattctcctcaaaatgattgccatgcaagcaacctcctttggcctagaaactaagaatcgtaacgataaagttcattgtgctaaacaaatggattttccatattatttcatctggaaactggaatttaacctccagatcatatttatcatgtttgtttactccacttgattaacttccaaatcatattatttgtgtttacttcatttagattgactttcaaaaaaggaacttctcttagatttgctatttggcatgtgcttgttcagacataatgtccaagaagcatcagtgtgtctttatggaagaatgttcctgatatgaaatccggtgtacagactatgagagagataaatgtgcccttatcttgctaaatgctagcatattttactgctcggtctattcattgaaccttttttttttccttggtcgtgtttacgaaccagtgcaagtactggagtaaagagaagaggtggtccaggtgggctaaacaaagtctgtggtgtttctcctgagctgcaagctattgttggtgaaccaaccatggctagaactgaggtttgttctgctggctcacctctctagtgaattatcttgtattaactattacatcatgtatgaaaccctgacgttgtgactcaactgcagatcgttaagcagctttgggcatacattcgcaggaacaacttgcaggacccaaacaataagagaaagattatctgcaatgatgagctgcgtctagtctttgagacagatagcactgatatgttcaagatgaacaagcttttagctaagcatattagaccacttgaggcaaaaagtaggtcttcttcactctccagctatgttctgcaaaataatcaagcttttgtttgtggaataagtgctcaaaattcttgcagaagattcaaatcgagattcaaagaagttgaagcctgtcgacagcgaacccatttctcctgctgaaactgatgttaaccagcttccaattatcttgtctgatgctcttgcgagcttttttgggactggagagaaagagatgccctcgtctgaggctgttaagcgtgtttgggaccacatcaaaagcaataatttagaggttagtgatt

SEQ ID NO: 67065 - DNA, 714 bp, Oryza sativa
gaaaaagacggtatcatagcatgggttcggtgtaggaatgaaacacctctcctatatgatgcccctaagtaccatatattggaatacaaaattaagctatgtgtaaaaatatctattatcttttctcatactggggtttcaaaaagacatttccctactgtctctttattcaaaacttatatacaactagccctttcgtccaatggacatggtcacctccatgattgtcccttttggctatgccattcctccatgacaaccttgatcataagctctacttgtgtaaagctcaacttttctcccacctttgcataggtgcaaaggttaatgatggcttattactttttttgcggggtatcgcgcgatgtggctgccaaaccagcattggtaggacaagtgcctttgagatgccctggccctagacacttgaatcaatggccaatgagccagagggggatgaggtgagccagggtaaaggcatatggtaggacagtggagtatcataagggcccggtagctttctgtttcatctacaccaacacccaaccatccgtaacttcctacttggagggccctaccgatgagcgagcgatgatagcccatgagggagtggtgaaggagaggatgggtgctctgtgctttgtctgggtggagacaagttggtccaagagggaccgttggtcgcgcgtaggtaggagtgtgggaggcactcat

SEQ ID NO: 67066 - DNA, 1024 bp, Oryza sativa
agcagtagcaccgatacccatcgtagtcagcagtagtaccgttgtaacctttgcagaagctgttggcgctgcaacattcgggggcagacgaaggtgcagaagcattggtcgatgccgagcacgctgatgaattgctgagtataagccagtttaacatggctgggagcgcttcaggagtattgctgatgcccttagtaaccatgttggtgtcgaaataaaacgacgcctgatctactatgtacacgaaaaaatttggttcattagggtcaggtcctgcacccgggtccaccacttggttggcgctaatgctgtagaccggtatgtgcatagcaatgcttgcctcacagcagccaattcctgagcaggagccattaccggagtcgagtgatagagggcacgacgtgatgcaggagttgacgagtgtatcgccccaatcgcggagggagacctgggcgttgcatcctaccaacgctataatgtttaaatccgacaggaagtaggatttacccacctcccaccgcatggtggtgctgttctctaaaacggcagacgcaaacaccatgcggctgctgttgatgcgcacggtgccgttggggatggagatctcgagcacctgatgcatggtgctgctttcttggcccaggaacagcctgggcggctgtacgagtggttgcaggtgagatcgaaccccgggtggtagcacccggcctccacgccgaacgggtactcgaagctcacgttgccgcagctggtggtgcagctgctgccgttccccgcgacaaacaacagcagctgcagcaggggggcggctagaaaagtgaatgctgctaatgctactgcatgtttctccatctttgattcttcgcagtgtgcctcaaacctgcttacaaagtgctacttataactaccttttatatgcgattgagatgattgagccagtacgtaccagctggcaatgtgcacaccggatgttcattcgtcgacgtccggtccatcgtaaccactaaagtgtgcattgagtttg

SEQ ID NO: 67067 - DNA, 5970 bp, Oryza sativa
ctacaagaaaaagttttttatgatctcttctgtttcttttcgtaatatatcatgattaacaggagtgtacctattttgatcagttctctctacaagctgcaccagttccactcttcagatcttgcatgtttcagtgccaatagaatcatcatctcaatctgtccttgcaggaatgataacacatcggactcatcaggcgatctgaactgagttattaatgaattattactactcagtcaccttgtattggtgcactgacaatgtataactgaatatccactataagtttagttaactgttctgcatattacatatcagtttggcagatccatagtgataactgaaaggatcacttggaactaggactactcctaacaaagctagtaatatttctattcgtagtgctaggatgtgtcgcatcccgtactatgtttattattatttttgggacggagggagtataagttattacacggacagtacaggactgcagggaagtgccaagttctcaagttttgttgaaatcgcacgagttgtggaggatcctactgatacagcttggaagttccttgcaattgcagatgttccaagagaaacttaaaaaaagaccaacaaaacaaaaaatcttatgagctggatgagaaacaagatggtcaacgaggaaagctcatagatgaccagaattcctcctccatactgagccgcctgcttgagttgtgataaccagcgtcaccaacagcaacgatgttggaatcgctctcttcagtcaatggagaattcaactgaactgcacgtcgacctctgatagtgtttacagcaccctgcaacccttcaagtttcacctcaacctgccgcattgtcggcctgtcttcaccctttaagtttaagcacataacagcaatttctgccacttctctggcttcttcttctccctgctccttagtgatttgactgtctactatttccaagagcctgtcctcactaactagcaagataaattgttcggttagattgaagccttctggtgatatgtaggaagttggccttcttcgtgttattagctccgcaagtatgacaccaaagctgtatacatcacttttctccgtaagtcggcttttacggtagtactctggatctaagtatccaaaagttccctggatagtagtagttacaatattttgatcaattgggatacctcgagaagctccgaagtcggatacttttgctatgaacctatcatcaagtagaatgttggtggtcttgatatctctgtggatgattgataccgaagcagctgaatgtagataagcaagagacctagctatttcaagtgctatcctcagccgttccttccatgggactgattgtgcagagttgacatgaagatattcatgaagtgttccatttggaatgaactcatagactaacaatggaacttctgtctcaagacaacatccaaaaagcttcactacattcctgtgatttacttgggaaagtatggcaacctcgttaataaatccatcaatttctctcttaatagcatatcttgacttcttgatagcaacaacacgttggtcagacaaaatccctttatagacggttccatggccaccaccaccaagctttcgagactcgtcaaaattgtttgtcgccttctcaagctcttctaagctgaagatcatcctttcagcgatatccttgtctacaagttgatgaagcaacaatcctcggttttgcttgaagaagaattccttcagttttttggcccttcgagacttgaactttcgccttacgacaattccagtaagaattagtaccacgatgattagactgccaccaagtcctattccaatgatgagtcctggatttgtaagaaaatgtaaattttaaatcgtttactccgttaaattgatctcaacaagaaacatagtaatgaacagtaccctcagacattgactgaactttctttctgttacctgaaaatttaagtttgcttgaaacacatccattttgtatatgggcgttaccagatgtgccacctggacagatacactcatatgatcctactgtatttatgcatttcccaaagcataggggtggatttggcagcatgcattcattaatatctgtgaaaaaggaaataaaaattaaattgtgcaaagtgatcacgcaataaggttaaatgtatctgagctgcattttactgtttaatctgggtatgtgcccttgcatgcttctaagttataacctctcaagtgtcgatcgaatagttctgaaaatttcttaactccaaaactgatacacgtatagagaaacaaaaggaacaaattaaacctatgaaaagtagaggcactatttatagccagttctgttgttacaacttgtagaaaacttgtagtcttgcacgcttgtggagtgatatgagacaataatctacgctctcaaatttttttataactctttaagtgacatcaaaaccatgagtgcacatactgacatatctgcagagagtatcataccttggcatccatttggcatgtaagggttaccatcatatcctgagcggcacttgcacgcatagcctctccctgcagggccatcaaaacactcactgttgtcactgagacacccaaaatcactcaacttcttagcttccacgcacgatgagttacccagcatccagttaaccacagtccggacacccacattccttgcagcatccggcgccccagcgatggcacccagccttgacaggacctcttgctgcagcagcatggcattgtctgccctcctccaccactcccccttcaccaccaccatgctcgcgttgaacggcaccgcccttggactagactgcagggagagaagcttgatcgtgtaggagttgtggtcttcaaccaccgatgcgttgcagcagccaatgccatagcatgtgccatccgttgccagtatggggtaacctgggcggcaattcgaaacgcagttgctgctgctagtagcattgtctcctgctgctgcaggagaactacctatgaagaagtggaaaccacaacccagggtgatgaaaacattcatgtctgccgatacccggaagagtttgtcatccaagtcgaggatccatttctggttgtagctgtctccccccaacatttgggtgatgccggtatcaaggtgcagaactctacgtgccagctttatcttgtgaacttcatatccagggccgttcatgaagagcttggggggatcataagctgggtcgcacactagtttgaagccctcgcggaagcaccgttcgtcgccaataccgaatgggtaaggtatggttgtgtttccgcatgtgtcagtgcaaccaggcaatgctatgttatatgaaagtatcaggggtattgctgctagaaactgcagcaagtgcagtgtggctatggcaaaaacatgcattttactgacatgaataggtgccctgatcagtgtggcttggtggtttggacttaggacacagttcatgtcacatatataggccttgacaaagcatttgcaggaactggtcttttgctaccttggaaaatttcttcaccggttatatattacactataaagatgttatcagattgcaccgataattgttgcgtatcaaatcagggtggttatatgtcactttatcaaccttaaaggacaggacggcaggtttaaaaagagtcaatctaggacatgaaaggaaccacaatacattggaaatttcatttcttttgagttttgcagtttggagctccccaaaaaacaaacctgaagaaagctcagacatatttatctacttctgtatccaaccacagaaggcaagactatgtccagtcaaactgctgacctcattagattgcagaaaattagattaattacattgaagtgttgaacatacgttaaaatggaaaatgaacggcagtgacaaggacggtccggccggcaggccaaacatgattaggaaacttgaaaacaatttccacccgttcaaacttcagatacgcatcaccattatgaactattttttgaacacaacatcgccatgatgaacttttgtttaccacaacatcaccattgtgaactagatttatagggtttgattctcaaacagacaaattttgcaacaaaaaaaaaaggagggagaagaagatgtcaaaatgtcatggcgtgaacagatcgaacggttaaatttaacaggtattgcacttcgtaggtatgtataatgcagaatcacctaggaattttacattagtaagattttacccaactatgccacagtggtactactaaaacctaacctaaatgcaacaatcacttagagcatgtacaatagcagactataaaccagctgcaaccatatacttcctccatcctaaaatgtttgacgccgttgacttttttaaaaatatttgaccgttcgtcttattcaaaaaatttaagtaattattaattctttttttatcatttgatttattgttaaatatacttttatgtatacatatagttttacacattttacaaaagtttttgaataagataaatggtcaaacatgtttaaaaaagtcaacggcgtggagggagtatatttttaggagataaatgaagaccaggaacggaaccgcggcgcggcggcgtgcatgggcggctccgatggaaccggtggccgctccggccgcgggctccggctcagccccacctgctacgcggaaacggaaacagcggcggcggggggagccatgagccatcgaggggaacgacgctcacaggggcgctgtcgcggttgcggacgttgaagcgagcggcggcggcgtagattccgtcggcgggggaatcgaatcgggcggaggtgccatgccgagcgccggctggttgtgcgccgacggcgtcacgatcggatcggcgcctccgccaacttcggtgtgactccgcgctctccatcgattttaaccaaggtttcgtaatcatccccccttgtatttaccatagcatgagcaatttgagcagccatcgactttgtgaactacctttgcatctagatttatttactcttccaactgaaacacaagtcaagattcctactcatagtcatcgaaagcatgcaaaagattaaatctacttttatagttttatttatttataatgtaacgaccacgtggttgaatgatgcaaatgccccttaatttttatcttgctactagctgttgttaattcttattttgaattggagtcctgtcgctttctctgaaaaatggggagtgctgtgctgtcctatttgggttgttagctgcagggaaaggaaggttgttcaacttaatcaaatcgtgttgatagtgcccgaattcctcgtagtttcatttggtaggttggatgcataagggtagagtagtggttaattagcttggggaatggagactacaagaagctcaagtgccatctgcctagtcagtggagattgagagagcatcagttcaacatatggagaggttcgcaagtatgagagttgtgttttcgctatctgtacttgcagttctgctgctacagctgctgttgggtgtagcaacggcggcagcagctaattgcagcacccactgtggcaacatcggaatctcctatccatttggagtagagcctggctgctaccacgagggcttcaacctcacctgcgatcgctcgcacaagccgcccaagctgttccttggtgatggctccgttgaagtgctcgagatctcgattcctagtggcacggtgcgcatcaacagcagcagtatcgttccagtatcaacatcaagtgctgttggaactggcagtgtcaacaagacagggaaataccacacatggggtggactgagaaagggcggcccgttcttcatctcgccgtacaagaacaagttcctggttctatcatgcagcaatgttcaagttcttcttcttggaggcgataattccactgtcaat

SEQ ID NO: 67068 - DNA, 1030 bp, Oryza sativa
aaagttaaaatggaaatcagttgaaaacagctcggtgcttcgataagtatacatctatgtggctattttcccagtctaattacatgcttcttcattatttggttagacattgacgaatgttcacactggaaactccactcatgctatggtacctgcgtaaatatgcccggaacatttcattgccgctgtcctgatgggacttacggcaatcccttgatggagggggatgcatcaagataaagaattcctctcaaggtgacaatcactccctaattaccttgtactcatgccatcaactctatatgtagattttttttagtaatgagactggtggtaatggcatctacatagctggcagttggtatccagtaattgatatttttttgaaaggaatgttcagtagtttttattaattctctgccaattaaacatgtctgttgctctgttctatcttcattacctgagtgcaaataattgcgcattccagttgtttttcgtttgtttctctgaagaactgttttattcattttacatgagctcttcaattatttgtttcacattctgctcttacacgtcgcagcacacactactatttttttaaataaaaataatagcctttgtatttagaagcagattgttctgcactttttcagtaaccatttgtttatgatcaccactaaaatgtgggaagctacatgattatgtgagcttgagtggttacttttaaaggaaaaacatagttgttcactttgaacaaataatacggcactgtggtgatatgttgaataaactaaaagtagactatgtgatttgttatgtaattttgttgtgttagttctgtacctaaaaaatcatgatgtgttgcatcaacagatcaactaaagtagactgtgattcaccgtatgcgcattgcaactaattttgttgtgtcaggtttgtacccgaaaaagcatgatattaatatttacaaggtttctaccactatttattatgttctttcttactatcctgcataggatctttactggaa

SEQ ID NO: 67069 - DNA, 1921 bp, Oryza sativa
  unsure (1)..(1921): unsure at all n locations
atatttaatatctctgtgaaatattggcattgatgcagctgaatgtagatatgaaagagctctaacaacttcaaaagctatccttaatcgatcatcccaaggtaatgatgatgacaccgtgccttcaatatggagatgatgttaaagggttacatttgaaatgaactcataaactaacaatggaacttctgtctcaaggcaacatccgaggagttttaccacatttctgtggttcacttgggaaagaattgcaacctcatttatgaattcatctatttctctttggtgtggcttgtaggttgtggaggagcggagcatgcgaggggtaatgggataccggtggttgtgttccctaattcgaagtctactccagaggggatttctactgatgagctgttgaatgctctgaggttggttgctttgatctcaccttcaggctttggcattcgatttctagtagctttgtagctcatctgttaggtaggtgttaaaataagtggatttgcagaaacaatggtagacacaaggcacacaacatctgagatttttcacacttgccttaagtcttgtttgaaaaatgcatacatgatacattgttgtgttgtttgctgataaaagttttctaatccattcacctgtcttatgtgtgcgggtactgttgttcgaagccgtcaaatgaagatgaattgataactattttaaagattttagtgtctacttattgaatgtgtgtcactaccttgttttgccagatgaactttgatatcagttttatgctctgggttgacgtttagtcaggaacctattggagtgtgttcttcatcagttgtacggtgtgcccactcagtcagtcagattagtttccattttgttattgcctagctgatatactgtaatgtaccactgttgatttttttcacgaatagccactgcatgttttatggtgtttgtagatttacttatatcctcttctacaagactggctcgcctactgcggagatttgttttggttacttgcaataggtctcaatattcggatcaatctatccttatttcttatgtgaaatagggaactcagggtagacttcattatacttgctggttacgtgaaacttataccggttgagctagttcaggaatatccaaaatccattttgaatattcacccttcactactcccagcatttggaggcaaaggttattatggtttgaaggtgcataaagcagtcatcgcatcaggggccaggtacttcacaatctctctatcacccatcacaagcaactgctgtgcagtttgcatatctactcaatgctatttccatggaaagcaatatcttggcaatcaatttgagctgatacctcacattgtagaagaaaattaaatcttgattattaacttaattggagaatgatctttgtttgtactctaactgttaagtgtcaactatacacaggtattctgggtgccaactgtcgccactttagtggtatgacgcactatagacaccagagaaggcactctacgcccaaaaagaggttagtatcctggtgcgtacgccatatgtatatctcccagacgcaanntntggctgccaanngagctctcttctatagagagtacacatatcnntntatagctccgcnntaagatnnttctttagaantgataccatgnngnctatgcacatanntttcacttaangcatgccaactgacanattgatgnnantacacgcttctttatggcttcatttatnntaccccttatttttcaggaacatcaggtttatgttgaggcagttgctgccctatgtgatgaccgaattgtgtggagagaagatggtgttccacttattagaagtcatacaaaccctgacgagtacacttaactcatagtactacctcaaggattgctgcgcag

SEQ ID NO: 67070 - DNA, 7467 bp, Oryza sativa
ctagccactaagaatgggttgaattagttagtaccacaaattttgacaatttaaccctttgcaaaaactatttttacaaatgaaccaccatcaaaacttatttcaaaaatgacccttttgttcagcggcaaatcgtgtggcgctgaacttagatacctcagtgccaaatagcacggcgctgaatgtatgttggcacgctgacttagcctcccatccgcggtggcacggcattcagcgacagttgacgtgacgctgaggtgtctaaattcaacgccacacgatttggcgctgaaaaaaatgatcatttttgaaataagttttggcggcggtttatttataaaattagtttttgcaaaaagttaaattgtcaaaatttgtgtagttagtacagtcttcagctgcgactgtgccactctagccatggctacagtgatgggcacgaaagaaaggggtcgatcgaggaagaactaagggatatggtgacaaaatatgtcaacaaaaccattgccaagtttactttcaaaaaagaacaaaatcattgccaagtaagatgtttaactagacgaaattcttttgtgtgcgtacgtgcgcttttagccttcttttcataatgtagtatagatttttcaaaggaggtgtaccgaggcgcaccacaatgccccaattatttatttttatcattgtgctaatgtaactctcgttccgcaattaaaagttcatccctgcataatcatgaaattagtttcttaatgtatcctttcttcaggtttgaccattggtctaatagtcagcggtggttcagtccttctacttctagggcttgctgctcccttcatagttcgcaaggtcaagctacaaagggtaaagaaaatgagggataaattctttatgcaaaaccatgggttattattacaacagttaatatcacgaaacacagacttcgccgaaagaatgatcattaccttacaagagcttgagattgctacaaacaattttgacaaatctcgtgaggttggtactggaggacatggggtcgtgtataaagggattatagatctacatgttgtggccatcaagaaatcaaagattgttgtgcaaagagaaatagatgaattcataaatgaagtcgcaattctttcccaagtgaaccatagaaatgtggtaaagctcctcggatgttgccttgagacagaagttccattattagtttatgagttcatttcaaatggaaccctttaccatcatcttcatgttgaaggatctatatcattaccttgggatgatagattaaggatagctcttgaagttgctagagctctttcatatctgcattcatcggcatcaatgccaatattttatagagatattaaatcttccaatatacttcttgatgacaacctaacagcaaaggtatccgactttagagcttcaagatatatctcaatcaatgaaacaggaataactactgcagttcaaggaacgattggctacttggatcctatgtactattatacgggacgacttacgagcaagagtgatgtttttagttttggtgttcttcttatggagctacttactcgaaagaaacccatcggtggtacatttgataatggcgatggtcttgtttcacatgttatctcacttctctcaaaaggtaatctttataatataatagattctcaagttaaagaagaggaagatggagaagtcctagaagtggcaacactagccacaacatgtactaagtttaaaggagaagagcggcctacgatgagagaagtagagatggcactggaaagcatagtttcaaagaaaagctccttctgtaacaagaacagtcaatcaagtagtagatccgatgaaaatcgaattttagctctttacatgtcgatcgaaggagttaccaaggacaaaacaattacaattacagaaagcagcacggaaggggaaataccattgtcgtcaaggttttctcgataatcattctctgtcctgaacgagaacgccttgcaagaaagccggaaacttagttacatcgatcctgttctgttctaaatgattgctaaagtaattttgctgtaaaacaataataatgcaacagaaaaattgtgtcgtatcagaactttgaagtacttgtggtttagttcatgttgattaagcatctgattcgatcagtttgctctaatggactgaaattgcagagtgccgtttgtgttttcattattcattgaattattctgctagcggctgcagagcccatcggctctgtaggcgttcatttttacagtttatctatcgcacccgcgaagaaagataatttcgttctttcttatagaataaaaagggaaaaaactcacttctacttattttttttaacatggatggaatgaaaactatgtcctatcaccctcgaagcggtgaaaataatgcttcggcccgagtgtccgaggctccggacgcctctccgctcggcccatttctctctagaaagtcgagtcctccatcttccctttaccattttttctccgctccatctccggagaattttcagaatttgccatccaatacgcactatctttaggatatgccatccaattcgtactacttttaaaatatgtcactgggacgtgaattttcttcactctatgccactccgtccgatgtcagtcctcgtcgtcgttcgtccgtctgctgccgctcgcatccccttctatccgtcggtgccccctcccctcccctcgggtccattcgccggcgctggccccgtctcgccgtccatcctccggcaccgcccgcgtccccgtccaccggtgccaccaacggcgacagttggactcggcagcagctcctcttcacagcatgtccactcgggggcgagggcgggtggagagttcgggggttggggcggggctggggtcgttccagcccaaccgctcccgatccaccccgttgccatccctattgacaagcttgtttctcatccagctcataaggttttttgttttgttggtcttttttataagtttctaatggaacatctgcaattgcaaggaacttccaagctgtattagtaggatcctccacaactcagcgcgatttcaacaaaacttgagaacttggcacttccctgcagtcctgtactgttcgtgtaataacttatacttcctccgtcccaaaaaaataaatctaatacggaatgtggcacattctagcactacgaagaaaaagattactagctttttaggagtagttcaaacgaaacaacatgtttgcctccctttgatccttgcagttatcaccatagatctgccaaactgatatgttctatgccgaacagttaactgaacttacaatggatattcagttatacattgtcagtgcaccaacacaaggtgactgaatagtaattcattagtaactaagttcagatcgccttatgagtccgatgtgtttatcattcctacaaggacagattcagacgatgattctagtggcagtgaaacatgcaggatatgaagagtggaactggtgcagattgtagagagaactgatcaagctaggtacgctcctgttaatcatgatatattatgaaaagaaacagaagagatcagaagggaactttttcttgtagagtatgcaatcttgctgatcaatttacagggatcactgatgtatctactgttgtaaagaacatgtgcaacaatggaaattcagaactattgctttcttagcgaaaaaagataagaaagatatgtctgacatgcaagaattctgatttctggaggtgttgcactgctctgaaaagtgcagaataccagtatatgactataagaattttgtagctgtctttgcctcaacaatatcaagtgctttgttgaggtaaacagtttcagaatagctttgttccttctagaaaaaaaaaatcccatgaaatgtttttcatgtctgctcaaggaaatgacagggaaaggtggaaaagaaaatgaatcactcctgcattttctaaacctgaatctcagccagataatttccatccaacggatgagacgagcaaaccaggggttcggagaacaattcaccgaccccaaccaaagataccccctacccatcagcacagccgccggtgaagttgccggcacttgtgtccatcttgaaatccaaaattttccctggaaaattttcggatggatccaagacacctgcagcagtttctctttgaaacacaagattttaaaaaatagaaatatataatgttactcctgacggctcattgaatcctacagaaaatgaatccacaagtttgttttctaaaataaatgtttcgtactatatagataaaattttaacaaacatgcacttagaatatgccaatttcattgaatagagagagaaacaatgtacaaaaatatgaaaactgtacaaaacagaaaaagaaaaaagaaagccggtaaatcatttatattttggaatgtggtcaatagcactatcggagaacatgggaattttgagaaaggagaagagaaacaataagatctacgtatcttcctgataaattttctttaaaatttctataaaataagctattcgataggaattttaaacaatttcgagagggacatttcttttctcgaaaaggaccctataggaattaatgtgttccaaagaattttaatcccctaaattttctttatttttttctttgttacaaaagagccctaagttccgaacacggtgaaatgaaactgaaacgaaggcaccactagccgacaccaccggcaggcagctcgcagccatctggcccatctccatctcaacctctcacggacacacggacgatcggtcgacggatggacaaaggaacagccacaaaaacaaccagttaatttccatctcaatccacgcaacattggtcactgatatatataccctctaaacggtttacatatcagccatacttaaagttagacaaaaaaaagtactacagtacagaggatatgtgttccatactcgaccatgcaatagtcacgagctgcctcttcgtcgtctagagacagacaaacagcttatcctacccgacactactagaaaaaaaaattcgtagacgatgtgcttttaacttttcaggcggtctttttttttttggcaccatatgtccgcctgcaatataggggcgaggggcaagatgactgtccgtctgggaagatatccattttaagagctccgcttatatctttgtaggcagcgtgttatctcgtccgcatgagaagattgacctatatagtattcttcctccccgagttgagctttgtagagtttacaggaagtttctctattcaaaaacaagcaaaatatagaaaggagattttgaacttgaaattttcgatgaaattttctacaataattagatcatacatttgcgcgacagcctcaagcacgcggatatggatcctctgcagtactacacatacagtagctgccactgacaggtggaccggtcccacatgtcagtggtagtagcgtcccacatgtcagtggcagctactacatatacagtactgcagacaatccccactgcaagcacgcacatacgcaagcatgcaaaatcgatcgatcgatcgatattaggtcgtcgccgacgatgacaggacactcccggtcgattggccgcgaccgtttgtcaatggaatatctctctttctttctttctttctcgacgagtccaatcacatcatgattcatgcatggccatcaacggcgtgcgtgcgatcgagccgatgcatgcgggcgcttgccggccgcggcggcgacggcgatgcgacaggccggatcgatcgctggtgttgctcgctttttcttccctttccggcgaggtcgatcgacaacgacgacatgaatgaatgattcgtgagtcaaatgtacggtggacgaccatgcaccaatcagcccggctagtgctagtgctagtgctatccccacacgaccactctctcgagttcccctagatagatcctgtttcttttttcttttcctgattcatggacgttttccatcctctttggttatgaaaatgcgccgttttagatattggcacggtctcaacatatatttaattttaacatgtcatttttaattttttatgtatctgtacagctcggaaatacaattttaactcctatcgtaaatatttgcacatataactggaagagcttacgatattaaaagaatgcgtgtttttttttcattttaaaagtttgactttagagatagtatgttttcatggtcataaccagactagcatagtacttcctccttccaaaaatctgagacctattttattctttggtttctctaaaaatctgagtcatatttggagtcactatgtgctaaattaaattgttgaccagaaaccaagaagccattttagtacttattggttgcatgttcattatttttgccacatggtgagtgagttaattgcttcttggttttgatgaaaaagaaataggtatcagatttttggaaggaatgagtagcatataatattatggtgatgtttaaaaaaccaccattatatctctattaatttaaagcccattcgctgctccccatatatatattagcacccaaccattgtcttcaccaaaaaaaaccaagcaattgattaataaaaaaaactggctgtattagttgctttcctcactcccagcccatttctaattatacaggcccgttgtaacatatcagtaagttactcgtattaattagtattaaaggcataaattaattttcctgttatgagtgcgtcttgttaaattaacatgtggtataattggaagaggttgtactgtacatggtgtttcatcataggtttgtagaatctcttgttaaataatacagcaatcatgtggagaaaatgtgtacttttgggtgcatatagtacaattagtactaagcaagatttgtccatcgcatactagctgtcggctgcgcatctctgccttcatttctcagtcaaatagctaatcatttggggaaagtagatttgttggaagcaaagaagccttttcttttatttcttctccttttatgcctgcctaatttcactggcctgaaagtgaagtcagttgtcatacggagtgacatgacaatagatagatttatttgaaggacttgaggtaggtagatgaaagaaagcctttgtttccatcctcccctattcagcatgaccgaggttccatcgcgatttttgacattatggtcctcatataaaacttattttataaaatatgctctaaaaactaatttagaaatgagtaaattgcgtattagatccccttatgagaccattgtggtagcctgaaccagggtaaagcaacattttcatattggactggttatatttaccaaatgattcactttggtcctggttcttctatacctagctagcgtcagcaccgtgctcgtgcc

SEQ ID NO: 67071 - DNA, 4976 bp, Oryza sativa
catgtgttgtcccttaataggttggacctcacctctgcttgcgacatccatggcagctggtaacgcagcatgggggacgagggtcggtaccagagccattagtaccaatctctaggcacgctaggttggcttggtccaccacatgtgttggggctcggtgacagggactccagctccatggcttcaggacccgaataagtttttcagaggtttgtttctaaaatggctaaagtattaaaagtgcaaaatgtactaatatataaaactttttgagtatgagtaaaacttaataaaagaatatggctaatttatcagtaaacaaatcaaccacaagtgcatttaggtaaaagaatagaacataggactctttggggggcatagctaaaacaaactcaaatgcacctccaagctaacatatattaggttcggatttcatattcctattttcagtaattacacagtaaatttctttgataataaaggtaccttctattctttacatcagctatagatccacgtatctactccctccatcccataatataaggcacaaccactttccttaaatgttccataatataagtcatgcatgcaagcatgcaattaactataacatcttctctattaaattataacttttttaaatcctccactctcatgttatctaatcctattggatgcatgcattttatttattaggatgatccaaactacaagatgataataattatttcttggtctttgggttaaggatggctgtgccttatattttggaatggagagagtatatcacacaaatatttatcaggtgattagatactctatgtatggatagacacatgagcctttttggagagcttctgggagttgcaaatttttctcaaatcaaaagttttcctcaacagttagcttttcgtccaaattatgatgatatagttgcataatctgataatgaattagaaaccagaaaacattttttcagcttatccagatcttactctataaattctcactaataatctaaagctccttaaaacatccccatgaagtcctagctatcgatatgatccaccgctatctccgactttaactatgacaaaatgcagatcaatggaacatatttggctaaaaaaaactcttaaaaagtgcaagtgtaaacactagtagatgctaccagcagctataggtcttaaaaattttcaaccccctaggtcgccaatttctcacattggcaggtaaacttttgcagtaagtaggtagccagcatcagatccaaaagtcaaaaccagcagctcaagaacacaggcagtatctcgtatatatggactaaacaaaggtgatgaagatagcgacgctaatgccgcgccttaattagtaattaatagtgatccacgtttcgtgctgcatattgctctaccctttgtatatttctcgtcatacgcttggtcggggagagtgtgaatcccgaggacggtaaattcttggattcgtgtccatttcttaaaatggattaattcctcgagcgatgttgccgtggcgctgtgaacggagcacacagcgctgtagccataggaattttacagaatttctacagtaactttgtaagagattgctggttaattttttccattataaaaattatccaatgtttctttttttttaacgactcgcacaagacggtgcgaagttcataaggagttaagggaagacgtttttttccatgcaagttagttgagtttccaaataattgattcatttacaatgaaaaacagacacatttaatgttatttgggaattcaaattagcaattcagttatttacatatgagtgcttaagtttttttcgtgggttcaaaggaagcatagataatatgatgatgtgttaggggtacatgacttcagtcatcagggttaacaactctactaatcaacgtataaagtttggtgtccacatatattacgcatatggtgagtaggctttcgataagaatttagtaaagctacagatacagtaggcgtgtgtttgaaggcgcacttataggtgtgtgtgtgtgtttgtgcatgagtatatatagtgtgcgtgtgcagccaagaaaaaataattcgaactaagatattattatctttatcccctaaaatggggagtactttgaaaacacatatgtagtggctgcaattgtctgtactactgcaaatttactatgcatagagaaaggtttgatacatgagggggaccataaaaagttaaggatattgaccttgtttatcctctaaagtcgaaaacactagcaaaacaaactctaaattgtaagtctggtaagctaattaagtggcttgaccagtcaaaaagagcttacaggggagtaacaggaaaagggaagctttgaacagttgtggtgtcaacaggttatggacaaggatgtgatgcaacataagagagaaaacaaatatttatgagaagtgtccttggtggtggttgttagggcacaaacaagtagatgtgtagaaggaggctagctgtacatcaccagcatattaaaccaaactacaagaaaaaaatgacaaaatgcaagtgtgtataaaaaccagtagaaataaatgacaaaacaatcaaatgtatataagctagctaaaaaaaactattagtagttctcaacaaccacttctcaatcatagaagctatgtcacaacagaacacaaagtgcatgactggtccattagtcaagagtgatcaagagtctcaaaaccacacgctaaaggcacctaaaagacaaaaaggctatgagcataacgtttgctcaatgattctttgcaatgacaggagatatcaattttgcattgcaaaattatatgcaggactaagtttcttgaagattttactctagactgacataatatggttactggaaactactgcatagagactagagagagaaaattcataatatatttcagtacttatgttagtaaacagtaactgcattgcactccagaaccagggaataatctagattctagagtagatagagacgtgtatgattcacatgtatgctcatggtctcatggatgattcttccttgaagaacattacaataacatctcaaatgcagaagcaaatgattaaattataaagctgtaatattgcacttgagctccataccaattaaaaggtgactttatacatatatatagtcatatatatgaaatcttcaggaccatctcaatttctggtgataagaccaatggccttacatcataatcaaacgagctaaaagacagtctcagcaagctaattaaagcagcaagaacggcaacaggtgccaaggagaggaaagcagaaaagaaaaagaaagaaaaaagagaggatttgaattaattcagagagagaaaaaatgcctggccttcctgcataccatcatatgatcagtaccatggaacggtttcttcttcaccaaaactcgatctcctccattttgttgagctaagctcgcatggcggcctccatgccttggctctgcagaagaactactgagagaagacgacggcggcggcggcggcggcggcgacgacgaggtcaccggaatggcctcccggagacgaggaggagcagggaagcatggtgaggaagggaaggcaggttgaaggagatggtggcattggcatcctcctcttccttcttcatatgtcccaatgaactggtgctacttgcacaaagcacaagcgtgtgggttagagagagagagagagagagtggagggagggaggtttctctctgcacctagatgtaaatgtatttttggttagaatactagaggtttttaagcacacacaactagcttaggctgtgttcgcatgcaccttttcccatcccctcttcttcgttttccgcgcgcacgcttttcaaactattaaacggtgtattttttgtaaaaagtttctatacgaaagttgcttaaaaaatcaaattaatcaattttttaaaaaaaattagctaatacttaattaattacgtgttaatggaccgctccgttttccgtgcacaggagttaggttcccatctcccccatccgaactcagccttagcagtagcatgagtttacacatcaggatcatctgtggccgcagtccatgtggacagctatcagctcatgttcactaaccataccataaaaaaaataaggttttatggagccctctactgtatctttttctaaaagggtgtaaaaactattggatgtttacctctgttacactttaccactatcaacaattcaagaagaaaaatgaaatctagatgaacaatactgcaatgttgttttttctaggtacaagagaaaaccccgctctatattattgttgtacaaacccagatactgtaatgttgtcatataaagtaaatgtgaatggatatataaaacatctaatgcgtcatatttccaaaatacaaagcagtggaagtataatttagcagattgctagagatatggaggttaatttgattggaggggacaaatataaaatgcataaaaattgtacataaggaacttttttatattatttagtaacgaacaagtgacaacttgcatgtgtatgtttgtctttcacataatacgaaaattataactactcgcaaaatggtttaaatctattgttatttgtcaaataaccaaagaagaaaacattgctacaactataagaaaagaaatcagttgcctttagactttagtaatttgtcagataaccagaccatacacaaatgcaatgactaccaatgagctcgctctaaccagaccatacacaaatgcaatgactaccaatgatgcagaaaatcaaagccttttaggagagataagggagaagattgttcccataaggagctgaccaagagaacgagttataaggctttggcttgctgatcaaagcagaagtgtaggggtccaaaagtgaaagaacaccgtccctcctctccaatctcac

SEQ ID NO: 67072 - DNA, 2042 bp, Oryza sativa
  unsure (1)..(2042): unsure at all n locations
tcatgaatttgaattgatatattaccacgtctgcattctgatctcgttggtgtctggtccccgtgtgtgcaatggctaaattattttgttgatatgccaaaacatgtcctaccaaaatacttttagtagttgaatagtgcacatgtggttttggtttgcaaccaaatcattggcattgccaatttccaatttgatagtttctagattgtactaaatgtttggttccaaattagttttgctgaccaacgaacctaggccgtgttctttgcaatactattccaacttcaataactcatttgtcacacgcacatttctcaaactatcaaacgtaatttgtttctatgaagttttataaaaatattgttttaaaaatcatattaatatgtatatatatatatatatataagttttttaattgatacttaattaatcgtgtcaataggttgttttgttttgcgtgttacgaggaaaggcttccaaccttaaccaaataacataaccctaaagataaagaccacaagtcttcattcgcttccagaaccttcttgcatctaatctgcgatgtgcagttgaaccttccaaaattcatcctgtaattaagttgaaccttcttgcatctaatttgcgattttttctattttgcaaagatgctattcgaatgacagttttagtgatatttttgtaatttttcagtggcagttttacaataacgatttaaagcagtggtaaatttataattgccccttacaagaattatagtattcactattcccatacagtactagaccatagagatgatggttttcttaatttaaaccgactccaagcctctccactcctccagaaccttccaaaatataaaaaccataaccaaccgactgacatgtgggcccgacgactcgtcaagtcgtccatctcccaactcccccgctggttcgagcccctggtagaacgttcgagaacccccatctcccccttatatatcgcccccttcttccccatctttctccaatcgaatcgcacacgccacgcgagctccctctcctaaagccctaaccctagcctccaagtcgtcgtcctccggaagcttccggcctccgccgccgccgcagcgccatggcctcggagacggagacgttcgccttccaggcggagatcaaccagctgctgtcgctcatcatcaacacgttctactccaacaaggagatcttcctccgcgagctcatctccaactcctccgatgtaagtgccctcggtttactggttcagatctgcacgcgcgcgcgttagaagggcttttttttggtccgattggtagatcggtttgttcacccaatctggttcgagctgactcgtgtgtgttgttatgtgtgtgggtgtgtgagggagtttgcactgcagcactggttactggttactgagacatcatcccaacataaatctgcgatgtggtgtttcacttccccattttttaaggattatgtcttcgatctccgacgttcaattacgatttctcagctgtatcacatctgtgngcatcatgctcgcaggtacttatattttgttagctctaataactctgtgcgatcattgcggctccttaatctttgttaacgagtccctgaattttgctgtctgattagcaatgttatagaacatacactgcaggcataggcagcattatctgtcgttgttctgctaattaatctcgtagcattattaacgagtgctctgataaagtcgcatctgaaaagtctcacatgactttgagtgttgatgtttaaatgttgtaaaacatatcccctataaacatagagggttgttattttgctagttatcatttatttgtcatttattttgctagttatgtcacattctaaattgataggagggtttgaccatatataagacaaaaacacccgactagtgctttattttgctgattcattgttaaaattgcctctatgaaacaaaaacacccaaccagtgctttactttgctgattcattgttaaaattgaccctatggaacaaaaacaccca

SEQ ID NO: 67073 - DNA, 8867 bp, Oryza sativa
aacattattaaattattgtcggatagtgaattggaattgctagctgctttcatacaaaaccggccacttatcttatgcttttgtgttctgcaggcgttggacaagatcaggttcgagagcttgacggacaagagcaagctggatgctcagccagagctgttcatccatattgttcctgacaaggcctccaacacactgtcgatcattgacagtggtattggtatgaccaagtcagatcttgtgaacaacctgggtaccattgccaggtcagggactaaggagtttatggaggcactggctgctggtgctgatgtgtccatgattggtcagttcggtgttggattctactctgcctaccttgttgccgagagagtagttgtgaccaccaagcacaacgatgacgagcagtatgtgtgggagtctcaggctggtgggtccttcactgtcacacgtgacacatctggggagcagcttgggaggggtactaagatcaccctctacctcaaggatgatcaggtactaacagaatttcattgaattcttgttcaatttgtgctgcttgtattgctgaatgcccttatagttcatgaatgtggcttgctattgataaatgcatcaactagtaattctgtcctcgtaggattattacgaatattgttggtacttgattttatagccacttttagaaagaacatgttgatgtgcctcaagttttcaccataggcatgcttgagccaggtgcttaatcggtctgtttaagacataaaaaatgtctctatgtaggggcatttggtgaattgattgaacagaatgaacatatttcacacactgttgacattgtgataatctagatagatgccttaacatttcgaactcctgctgtgaaaattatgttagtatgtttctgccttggatgttatgagtaatcatgttacacatgtacttaggatctataagcttattgttgagctcataaactgattgtgtatgcattttttttctttgggtctggttttgtgtcagtttgattgcgtgtggttgtctaatacttcctccgtttcacaatgtaagtcattctagcatttcccatattcatagtgatattaatgagtttagacatatctctctatctagattcattaacattaatatgaatataggaaatgttaaaatgacttacattgtgaaacggagggagtactatgaattaattagtaacaagtattactgttctactgttgtgaatttttagaatcacctgaactcctaagttgaactgtgaaatgtgctataaggtgtcctggctctaatgtgttcatttgttattgacaacttgctcatgcttcctgcagttggaataccttgaagagcgccgcctcaaggacctgatcaagaagcactctgagtttatcagctaccctatctctctatggactgagaagaccactgagaaggaaatttctgatgatgaagatgaggaagagaagaaggatgctgaggagggcaaggttgaggatgttgatgaagagaaggaagaaaaggagaagaaaaagaagaagatcaaggaggtttctcatgagtggtccctggtcaacaaacagaagcctatctggatgaggaagcctgaggagatcactaaggaggagtatgctgctttctacaagtccctgacaaacgactgggaggagcatcttgctgtcaagcacttctctgtggagggtcagctggaattcaaagctgttctctttgttcccaagagggcaccattcgacctctttgatacgaggaagaagctcaacaacatcaagctctacgtccgccgagtcttcatcatggacaactgtgaggagctgatccctgagtggctgagctttgtcaagggcattgttgactccgaggatcttcccctcaacatctcccgtgagatgctgcagcagaacaagattctcaaggtcatcaggaagaaccttgtcaagaagtgcgttgagctcttcttcgagattgctgagaacaaggaagactacaacaagttctatgaagccttctccaagaacctcaagctcggtatccacgaggactccaccaacagaaacaagattgccgagctcctgaggtaccactccaccaagagcggcgatgagctgaccagcctcaaggattacgtgacgaggatgaaggaaggccagaacgacatatactacatcaccggcgagagcaagaaggccgtggagaactcccccttcttggagaagctgaagaagaagggttacgaggtcctctacatggttgatgccatcgacgagtatgctgttggccagctcaaggagtttgagggcaagaagctcgtctctgccaccaaggagggactcaagcttgatgagagcgaggacgagaagaagcggaaggaggagctcaaggagaaattcgagggtctctgcaaggtcatcaaggaggtgctcggagacaaggtcgagaaggtggtggtctcggaccgtgtggtggactccccgtgctgcctcgtcaccggcgagtatggctggacggccaacatggagaggatcatgaaggcccaggcgctgagggactcgagcatggccgggtacatgtcgagcaagaagacgatggagatcaacccggagaacgccatcatggaggagctccgcaagcgcgccgacgccgacaagaacgacaagtccgtcaaggacctcgtcttgctcctcttcgagacggccctcctcacctccggcttcagcctcgacgaccccaacaccttcggcagcaggatccaccgcatgctcaagctcggcctgagcatcgacgaggacgagacggcggaggccgacaccgacatgccgccgctcgaggacgacgccggcgagagcaagatggaggaggtcgactaagcgggtttccttttttttcccctcgtcaaatccttcgcagcgaaagtacaccatggagcattggagctagcttatctgttttaccttttgaacatcgcgttgttgggtcggttcggtttattttgtgcgatttgctttacctttacctagcctgcaatgcatggggctagattgtgctatgggttctcgaactgcgtacgttaattatattgctaaatatgagtattatattagtgtcctcatgagttgtctattttttcctctgcaagttagatgtatcaattaattttgcgaatattcttctgcctcaattccaccttcgagcaccagctttgcaatttacagttacagaaacatatgattgcgtagtgtgaatgggagatcttgtcacgctgatcaaattgatcaacagcaacgggaggagttccttgcagcgaatgcccttggcaatttatactgtgctttgttggtggtttgctcgctctggtgtttgttggcgattgcccgttggcgtccaatccttgcagctgatttctttggtatccttggagcacctgatgaaaatttcttcagctcacgataacaattaaatatatctgttttctgttagcaataacaatcaactttttcttcagagcaaacaatcgactgtttcttcagagcagctcactccggattacctgacaaaaacacaattaggactagtaggtacctgacaaaaaccaaaaaacaacataacactcggtcctcgttcatattcacatcagctaaattttatacttcctcttcatcatattataaatcacatagtagaaaaaacatagtagcatctataacacaaaataaacatatcattacaattattcaatgttagatttaatgaaactatttttccataaaattggttaaatttaaaaagcttgactagaaaaaaaatcaaaacaaattacaatatgaaacagagagtaacaaacactgctaacagacgagtctcgaagaccatgaagtgggattatgtctacgcttatgcacgtatagcatattgtcattggatcttctataagggtcaaggaaacacgaccgctgaaaaaattctgatgatttaaataagttttgcctatgttttgatgctcaaggaaattgatggtcaaggaaacaagaccaactgaataaattctgatgaattttaagttttggcctgtaaagacagatgctgtgacataatccatctttggcgttatggcaatttcaatcagctctgaagcataacgagcatagtattttgctatctggggcttatgagttgtgatgttctaaccacatttccgataacttgtaagcattaagcaatatacccaccagtgccaccacttccattgctcaaaagcgtaaagtcaatatcaggcttctgcaagaatcttaaacctatcgtgtccatttcctgatgccagacctctgcacaacttgcctcgcctccagaacatcgaaccatttaccagcagcagcataaatgtcagaaatcaaaacatggcagccagactgctgggcgttgagattgaggctatggatctcactctgaactctttcagccacatcaaatctcttgtgcattcgacaggcacccagtagagcgccgaaaaccatgacatcgggtgccatcggcatgctccggatcaactcctctgcctcttcaagaagccctgctcggcctaacatgtcaaccatgcaaccatagtgcttcacctccggctgcactccgcaggtagacgccatgctctggaagcaccgtcgaccttcatccaccagcccaccgtgggaacaagctgtgagcacaccgacaaacgttatgtcgttcggcttttcacccgttctcttcatctgttcgaatgcgtctacggaatcccgagcattgccgttcattgccaacctggtgatgagcgcgttccaggccgagacgttctttcggtccagggagttgaaaattttgacagcaatgtcagttctcccgcacttggcatacatgtcaataagagcagcaccaagattgtactcgttgttgagcaccatcttgtgcttgtcgatgaaggcatggacccatcttccttcttccagtgctgttaaatttgcgcatgctgaaagcacactcaccatggtcacctcattcggctgtacattgctctcagtctgcattgcgcgaaacagctcaagggtatcctgatagcgtccagcctgagcataccctgaaatcatgcatgtccaggaaaccacatccttctctggcatgacatcgaacaactccctcgcgccatccatgtcgctgttcactgaataaccccggagcattgcattccatgacaccagattcctgactggcatctcatcgaacatcttcctcgctaacggcagcagcccgtggcgcgcgaatcctgtcaccatggagttccatgtcacgacattcctcccaatagctggcatccgatcgaacatctcccttgccacatccagctccccggccgcggcatagccccccaccatggtgctccaggacaccccattcctccgtggcatttcgtcgaacaccctcttggcactctccatctccccgcacttcacgtagccaccgatcaccgtgttccacgacaccacgtccgcgaccccggcgcacgacccgaacacctctcgcatcgacgccgcgtcccggagcgcgccgtacatcgcgaggagcgcgttgacgacgaagacattcgccaagaacccgtgccggacggtctgcgcttgcacctgcgcgtccgtgcgcgggaaggccgggagcttacccacccaaccgaggaggggcggcaaggtgaacctgtcagggacgagcccgcaccggaggagggaggagaaggcggcgaaggaaaggcgcggggacgcggaggaggcggaggcgcggatgaggatgttgtggaggaaggtggcggaggaggaggggaagagcgggaaatggacggcgcacagggcggcggcgaggtgggggtgggaagggaggagcgggacgatgcggcggaggtgggcggggctccggcggaggtcgccggagacgacgaggcggccgaggaggagcgggaggaggtgaggcggcggcgccatttttatcttctttttttttttctcgccgcgtggaggggagaaggctttatttgaatatttgaaagcttgtgattaacgtgagccgttggatgcgcatcggatggctgagatcagataaagctggagaaaaagaaacatttatcactagctactggtttttctatactactgtatgagtggaaaattgtacacattttatgtgcagaactttcattagtacagagttaggcttatcctaagtcaaacctatttaaatttgatcatgtttatatgaaaatatggtaacatctacaatatcaaattagtttcattaaatcatcaatatatatatatatatatatatatatatatatatatatatatatatatatatatatatatatatataaatttgatcatgtttatatgaaaatatggtaacatctacaatatcaaattagtttcattaaatcatcattatatatatatatatatagtaaatttgtttggcgctccatggtgcccgggcaccattgttgaaattgagtatatacctaattcaaatgggtatatatatagggtttttttaaatgatgctatatttttctataaacatgatcaatcttgaaaatatttgacttggtacaaacattaacacaatgtatatatctaagtaaactgcggctcatctggaagacgaggtattcagggagggatgtgcatgatagaaagcagagaatctgaatgctttgcactagagattcatgtcatgttgtctactatcaaattgagcaatggatgcactccgcctgacttcgaaccagaacccaaaacaaaagagagctggtatgttactatgttagctagatgttcataagccatgctccaatttctatgttcagctatccttgttctcagctgccaatcttcaaagcttgattgcctttgatttttacatttgccacgctagccagtgcgctcagaggctctgaatccaccatagttgatttcttgacaggatcaacaaggtcaagcctcttctgcagcttcctccttttgtatgtgaaagggtacctatgaccttcttcaacttctgtaactgactggctggcaggagtcttcagcttcaatccttctgggtaacgcattgtttcagactgctccaataggtgtttgtaagggccagcggtgtctgtaccaagggtcaacacctcagaaatactttcagcagttttcagaccatgcgtcatgtatccatttgtttgatgacaatcagtattccttgtaaatggatcaggagaactttcaggaattacggcattttgttgaccaaagttcttcaaaaggttcttctcgtggggtgcttcattgcaatattccggactatgtttggttgttgactgatggaaggaattcggcattcgagaatagtaaccccttttaagctcctctggaaccataatttgcactccaaacggactttcaactgagtgagggtaagtatcaagtgtgccttctctttggtagggacgcacatgtagatttctcaaagtactcttgcttgtgtttatgtggtagtaataagctgaattcatcgcaaaaccatgaacatccagtgcagaagcgcaaggtaagctggagacctgtattcccagttggtctgctagcatcggttctggtgtacgatgaattccttcattgtgatcaatgagggaagcacaatcggtctttattttcagcacacctttgggcaatctaatacatgtagtaagctcaccaggaacatgaaagacaggactcttcaatgagctcatttccattgatttgtctctgtagactattcccttgcgcttggctgaacaatgagtggttactgtcccatccatacgtttggttcgcttcaaaggtggaagggttgcatctttaacctcattggcaattgatagacttctattgaaaggagaaccgcttatgtcaacacctgtgaggggatcttcatgtcttctgtcattccaactgttaaccttaccctgaagaccagtactcgccccacatcgtcctcctaccttgtccatggatgcaaacttgaaaatcatgccatcatgatgggacttcagaaaatgataatatcttcgtctttcaaagatcatcagtaattctctagcctgggaaacttctggagaataaaacccaccattcaatctgtggaagaagctcttcactggactcccaaagaacaggtcactgccactaaacagctccttcattgttacaaagaaatcatgttggtccatgtctgggagataggctgctagacggaatctatcatcttctgttagacataagttccatgtctccaaagaaagaatatcattcaattcaggcaaatcataaagcccataagggacactacagatctgatctccagactttgcaagctcacaattgacctcttcatgttcatagtcatcggattcatgaataggaaatctctgaagcagcattttctcctcttgtgtaatgtcctcgtctccacagctgtaagcccgctcttctgtaggcgcacaacttgctaccttcacaatgcccattgatcgaaggaagaggtgcaatgctccgatcggtatcagagataatcatagagacgaaagtcaacagtgtgtccagcacaataccatactatccgacggaagatccctgtgaagaaaaaggaaaagaaaaacaaggaatatcagcatcacaattcatctataattcaatttgaagaccatatttcatgacctcatgcaccaagtaggctggaaggaaatacattgcagagccaagcctaaataattcctggaaatagaatgctat

SEQ ID NO: 67074 - DNA, 2250 bp, Oryza sativa
gcagttctcaggactgttaaatttctttttggcccgtggatcccgtgctaagatttgtgctgagatattttgctattggatctaaaccattttttcacaaactagtggcactagccagtttcaccattgcatgtttatggtagatttatttaagtttttaggaaaaaagggttcttacccagtttacccaaaaaactgtccaaaaattgattaaaccaatgactttcggtcaacgccaagctaaaataattgatctgttttcacaaaccgttcgccggcgatttcataaaaaaacgagcggttttcgcaaaaaaacaattgatattgtgagccctggcccggtcaatgatagttctttttttttacctcataatattcgttttgaaaaatacgatggcctatattaaatctaggactttggctcagatagatgggttccaccataaagaaacaaatcggtcgaactttaaattttgagagtttgaactagtggtaccaatatagttagcacatgattacaaactttgcatgtaaaattcggttttaccatgtgcagctgtggcgtgaaactcatttttgtaagaaatgcatatctttgtttctcttggccattccacgtgatcccatgtgttttcgattgtttttctacatcaagggtaacctttgttcagtaacatgtaatatattggatcttggagagcaaaatcaatttactctaagagctaattgaagcaatccaagataacttcgtagcaaatcaaagttatttaagaaagaagtggagacaattttatagcaaatagaagttatttcaagagcaaatcttagaactgattgttatttctcgatgaaaaactaaacatggaaagatatatgcactagtaattcaaataagagcatgtacattaaccgacagtagtacaatcacctctcctttagtgataagttagagaacggagattaagaaaataagtagaaatgattagtcactagttatacacgtgctcaatagaaaaaagaatgcaaggtaacaatgcagctaacaggtatgctttaaagatagttgcttactcttctcaaggccgtacatccatatgtataaagcgtaaatctaaaagacgtgaatattagagaaggacctaatatcaaataattagaaggggtgaggcttcgaacctaggttgtctagttcatcaccttgtggagctagccggaagaccctggacgtttttcgtgtaaagcgtaaatctgttcaaggtcttcaaaatttagggctcccaaatctataagtactagtactaattagttatccaatctaataaacactattgcaagtatgaaaaagcccaacaagctattctagcatccatgataaagtccaaacaacaagctaaattctctcattacctcgtttgatcaaaccaacatgcaccgcacactgcacttactcgccttcttggctcctctgattcccatcaccactacaaatttaccccttttttcaaacaattaacgctacataaggctaggcaatgggcacgaacagacgtcacaaatgaacatgctcccaaccgccgccacacttgctggtttttgtttggggcatttgcaaatttgccactggttttttcaattttgcaaggatgccactcgaatggcagttccagtggcattttttcaattatctagtgacagttttgcaataacgattcaaaacagtggtaaatttgcaattgcccctttttgtttctgacttctatgtgcctacgactatatgccgccagccatgacagtgtgcaccgtgcatgattatgactacccgccatcggccaccatggctttcaaattttaggacccaatatgtatattcgcaccgggggcctctgatttctagttatggccctgactcttctattgaccttgccctgacccaattcttcattgttggagagtggttttacatacttgcctttctatcctattaatgaccacatgtgtttccctattcactcatttatctcgcttcttttgttgcttgtccagctctcaaggcatgatcaatgccacacagttgccaagtcagttggagacaccttttttagcatggtgcttgacattggcataggcctttaggagactagcaagagaatggtggtggatagcaaatggtgcaaatgcatattgggcatcgattgggttggataaaaaggtaaaagcaaacattatcgcaaggtggttctggggtgcagg

SEQ ID NO: 67075 - DNA, 1014 bp, Oryza sativa
aaaataaaaattatattactccctccgtcccaaaatataagtatttttggacttcgacatagccttcgatatgctattttgaccagttaatatctataaagtgagacattttaaataaaaagagttgcatactatgatagtttgtttaatgataaaaatctagtaacaacaattttacatgattgatctttttttttgcattaattgtcaaaattagaaatgtttgccttgacaatattctaaaaatgcttatattttggaacggagggagtagttattaacaacaaataaaattggtttgtcaaactatgttaagagagaaataaatttagtagactctgtatgaaattgtagatgaaatatgatatcccgcactttgctgttctcgtcttgcaggaattgtgtagtaacaggacggtcatcgtgcagtaacaagacaactttctcacagtaacaacgttaaaaagtagtcatgatggatctagtttcgttaagcgtttttttatgaacatcatggtgcaaacggattagaaaaacaagatatgatgtgagagatattgctctataaagattgagatttacctctttttagttcttgtctcactggaacagcgtagtaacacgatggccaatgtatagtaacacgactgcttttcgcagtaccgacattaaaaagtagttacgatggttctagtttcgttaagaattttttttacgaacgccatgatgcaaacgggttagaaaaataaggcatggcatttacgttactgctatctaaagattgagatttaaaatattttagctctacaaaaaaattactacaatagtgccacccgttactctacatgttctctgttactgtaaatttcgtcatgttgttactgccaacattatagtaacaacctataaattttgtagtaacaaactataaattttgcagtaacgtatcatgttactacctttctgtgataatattactgccgaatcacagtaataaggtatgattcttgcagt

SEQ ID NO: 67076 - DNA, 2686 bp, Oryza sativa
ctgcaccccaaatttagtggtggagtcatacatctatctcatataagccaaaaaagcttctctaatatagcttttggcttaacagtgttagagtggcttagtggcttcaaaaaagccaaataaaaaagctgcttgtttgttttggcttagacttttcgacttataagttggcttataagtctaaacaaagagggccatactctctctctctctctgttttttttatttgacgcaccagttcaatctcaaagcgttttttttatttgacgccagcagttcagtcccacctcttctgcacacgaatttccattcttgccccccacagatgcctcattctcctttcgacttcagcgggtggcgatggcgtctagggactcactccatcgctccaccgccaccgccgacctcctcctcggcgacgcgcactgggaccgcttccaggaggccgtcctcgagctcaggcatgacgtcaccgaggcgcaggcggtgctgcggaggggcaacgccgcaaggcgaggctcgcggccgccgtcaggtcccaatgctgggccgaaggagctctgccgcctcgcctccgccactgcggctgccaccaagcacttgtcgccgcgcctcagctttggctccatcgccgaggaaatcgagatggccgccgcggcatccattgctgtgttcatgacaaccatgttcatgttgtggccatggcatcctcatgcaagaagacgccagcatttgtggcctttgcatagaaggcctcgccagagacgcggaggtatctcttgacaagtttgaggagttggatcaatgcatcgatgagtccaagagcagctacccaaggtgttcagtagtgttcttcagacggaatggaagcattgtattcttacaagaagattttcttccaacccacagatgattggagttgcttcttactgatgattggagtatcagattatcagtaaatcacattatactggcaatttgagtaaattgaaatattgtgacttggaagaaatttaagatgagatgagagattttaacagtatcgcctttaaaggcaacaaatggaattttgcaattccatcatcatagagaaaagaaaggagtacatgtcattctcagacacatcccacattccatcattccagcatctttacaactcatgcataaaaatagagtttttactccagcaaaaatatctcaaatcattcttaaagtggagtttgcccaaattgagttctgaaacatgaatggccttttaattcttcttcttctggccacattggaaggaattcactgtcattcttagacagttatatcatgatgacaaagcataattttactaagattgttcaaccataatttggttataccacctgaactatgagcaggcgaataaaagcaagaagatgcagaggccatcaatcacgtcgtcatattgcatgaaaagtcaacagccaattgttgaagaaatgctatgtgtaatcatccacatggtaacagagtgctgaatttggtctgaacttatctctgaatttcaccaaatgttctttctgaatttagtctcagctcgatctcctctctagaccatatgtttagcatccatgtcaaatgtgcactaatctgcagcatacacgagagagagagagagagagagagagagagagagagagagagagagatactgcgcacacattgttctcaggaacaatatcatctcaagattcacaaaccaggttcaggaacagtaccaacatcgttgacctgaaggctgaagcatggccgcccgggaaaccgaaggactcatccgaggaggcggggacggcgccgcggccaccgacgacaatctgcaactggcgtcgccttgctccatggccgcctgctccgccttgctccttggctgccatcccgcctcgctctatgtctgcttgccgccttgccctaccctgccttgccctgcttgatggctgtgtcgctgccgtcgtcagcctgctgtgtagcagttggagagtgctggtggagtgatagtccgccgccggactcatccgaggtgccaccggcagtgctcgtctcgccgccggcgcgcgtggaggaaacaccgtagcgcaaaggagataagaacgaagggcaaaagagtcaatttgcagcttccttaatttcctcaatcgtgtcggaaacatcaaataaaaaaacggagtatataatgaaaaataatgtgataatgtgaatgaaaatgattggatgttgattttgtaaaattcaatgaattatagatgatattgcaagcttgcataagttttgtatgtaattattgctagtggatgatgaggtggcatgtttgcatgttgagttttagaattagttatttataactttacagtaagatacgatacaggaatatgataggaatccaagtgtaaaatagatgattaaaaaacacaggaattttatatggataattgtttggatggatcaagggaaaaacatgggaatcttataataaaagcgagtgcaatgtaacatagcgtcacaaacagtgaagtaagcaatatcaatgaacactttgcttttatcatgctttgattggttgcttggcttgattttcctttttcccacgcgaagggatagaaaaaagaggttggtcgcagattgttctttttcctgtgatcttctagtgaacaatcttttt

SEQ ID NO: 67077 - DNA, 2110 bp, Oryza sativa
tcctcatcactgaccaacacttatgcccatcacaggtatgtcgtcaaaggttgaggatatggcgtagtgcaagacgctttacgtgtattatttagtactaccttcatcccaaattaattgtaattctaagttatttaacatatattaagctttgaaaaacccttattgaatggtttgtaggtaagaatgaaagggtaaaatagaaagaaatttagatgagaagtgatttatgagatcgtgttgatgcaaaaaaaaacacacactggcctaagagatttgctttactctagtgcaggttctaaatttgctttcgggtttagagcgtgccagttggtttgatcctgcaaccaacaagaaaaaaagaaaccaaagttaaatctataaacgatagccgatcggctggattgccgatgacgtttcgtcagatatcaagccgatgcaatataacttggatcggcaataaagtatatagtagataaagaactaaattcactttatcggctgcagatattaacaatgtataatctatacttcaaaatatgtttaaactacgtgatcagggtagatcggatgttgccgagacagtataaataacatatgtttaaaagtacttcaaggtaaagattaaataagttcatgtcagccaataggtaaatctagcgtgtgttggctattgctccaatacttctttatactaagatattattatagattaaatatattaaacaagaatgataacctaagtagatcaatatcaagcgtaatatatttcaccttagtgagatcttaatataaagggtagatttagcatatcaagtaaatataagtgaagaacaagatagctaaaccgggtaagataggctgaaactccgatgctatctctgttagcaatcatgaagcaagttagatattatggttctagatattacttaatagatcaaacttaactgatgcagcattaagcataaagagaaacataagatctgatcaacaaaccaatgaaagccttttcgagatggtggatatactatataatctaacccgacagagttatctaattctatcggctgatctcgatgatggaggctagtcgacaagaccagatagtaatgtcaatctagattatatagcatatatgataactcgacgatttacataaacaagattagagtgtcataaagatgtaagcactaatcccgagaacgcaagtcgccataacaagctttacctctcgtcagagatcgtaaccgatgcagcccaactcgaaagcaagaactcgtcgaaacaatgaaagtagaaaaaggtggcgatgcgccgaaagtgttgttgaactggtgttaatcgtttacaaggtgtcgggcacatatttatacccaaaatatacaatatgtccacatcgaacacgactccacttctattacaactctaaaatacgaacaagtactttaggcagactcttaccgaaaatctatgaagaaactactagaatatcctaattaatagatacaattgccttcttcggactcaatccatgcttggcaatatttgtggaacatttaaatcaatcccgacaatgattctaagatcactttgccaaaattggctacatcggcttctccctatccgattcggtattagccggtgcaaacgatccgatgcgtactctgtttccgagaataacgaactccttccaaatccgcttcggttttgactccaaatccaatctatgatatattaaatttggtcgttaacacatcgttagtactctattatgataattattttgagacaaatttaaatcctaaaaatacaattgttatgggacatatgtagtacttagttagtacttacaagtactgatggcataaagctttaaccatcatatttgtaataaatgatcatagccttcaatgaattaatgtttgtcttgtgattttttttccttttatatcaatataaaaccttacactctcttatattattcatttcaaataaccaaattgttcaaattgattgtatggaccagcaaatgatttacaagttgttatagttattttcaccacactattagaaaacattttttttttacaacgggccaaaatgatttttc

SEQ ID NO: 67078 - DNA, 2159 bp, Oryza sativa
  unsure (1)..(2159): unsure at all n locations
gtgtaatagtatgtagatgcaatagtttgaatagatggtaatatatacagacatcggaagagatcgatgatgcagagggtagcaagcggccgagaagttatgacgtcgtcgtcgtcgttctgctgtttagcagcctcgctactgatgctgttgctaccgttctttgccatggcagcagcagctgcaggcgggagcagcagcagcagcagctgcaggcgggatcagcatcgagtacccgttctgcgtggagcctggctgctaccacccaggcttcaacctcacctgcaaccactcctacagcccgcccaggctattcctcggcgacggcacggtgcaggtgctcgagatcgccatcccccaagccaccgtgcgcatcaacagcggccgcatggtgttcaattctactggcaatcatgccgtcaacagatcattattggatcaggtgggaaggccgtacttcgtggcagcttcaaacaggatagctttgctaagctgcaacgcccgggttgacgtccgcgcggctgggagaaacaacaacaaaactagtactaagttgctcagttcctgcactgccatctgcccaacagacgatggaggtggtgctaccactatcctcgatattggtccagagggtccatgctcagggattggctgctgtgaaacaagcatgctactagcaggaagctcgactgctgcctacagcatccaggtccagaacttgcaggagcaggccgtcgtgctaaatcgaacggatgatctggtgtacttggtagatgagagatttaactataccttggacatgtctttcggctacagcagtcctgaagagctcccagcacggctagactggtacataaatagttcatcagcgtgtccgttgcccgcgtccgcccccgaatgtcgcagcgcgcacagctattgcgacagtacttacgacaacaaggcgtacatctgccgctgctccgaaggttacgaaggaaatccctacgttcctgatggatgccatggtaattaattaatataagcccttgctgctttaatttcttcatgttcttcaacaatcaacttctaattaactgatactcctatatccgttcaaaatgaagaaaaaaaaacaactcctaactgatatatacgcccttgctgtttgctagatacggatgaatgcagttctggatactgcagttacggcgagtgcaggaacacaccaggatcgttcatttgcaactgccctcgtggctacgagggcaatccatcgccaaaagatggatgcaaaggtgaactanaactagctagctagttggattgcccacaaatctgtacaaggatagatttatttcaaagttttgcctctactttccttttgatcaaacttacaatgagacatttggttatttagtttctctcaattcttgtccattgcgacacgaatctattgaatatttgtttctatatctttataaatggagtatactccctccatacttataaaggaagtcgtttaggacaatgtttaagttaaatcttgggaatataaatcatgaataactctcaagttgtttagtttgaaaatataaaaattatatgaatagatttgttttgaaaaatactttcataaaagtatacatatatcacttttcaataaatatttttatagaaaatagaagtcaaagttgtgttttggagaccgtgtcgctgtccaaaacgacttcctttacaagtacggaagaagtatctaatagccagtatcacattacacacacaaccaagtgctattaatattaagggtaattttacaatccttgagaaagtaccaaaaggtatcgtattttttatataaaatttggtacttcaacatatggagtaccaaatttttttaataaatttaggtacctcaagatatattaactataaaatttctctatattaatatcactagagatgctaaatcattactctggttgtgtaaacctctatttctccatcctctcctcgtaacactagctctatattgaaataatcaaaaaaataaatctatccgctatttatcaatgcttctttctgacaaactttttgtacctaaagttttcacttttcaatactatagacaattgccttcatctttgtagtcatttactttggtggatagggctgcagga

SEQ ID NO: 67079 - DNA, 1285 bp, Oryza sativa
gttgtagcctttggtttgacatcaggctagactttcttgttgttgttgttgtgggatgcgtgagggttcttcttttgcaccaaattggcgctagaatttccctcgatatttttgccccagttgtcctttgctctcgccttctcctcaacacccaaagagccaatgagatcagtaacattaaactcttgcctcttgtgttttagagaaatagtaaagtccgaccaagaaggtggcaatttggcaataatgccacccgccacaaacttgtccggcaactcacagttgttgttctcaagttcctttgccagcatctgaatctcatgagcctgttccactacagaacggtcatcgaccatcttgtagtcatagaactgctccatgacatacagctcgctgccggcgtcggaaactctgaacttggcctcaagtgcatcccacatgtccttccctaaaggcatgtgaatgtacacgtccactatattgtcagcgagtacactgatcaatgctccacggaacaggcaatccgaagcctcgaacttagcctcctcctcaggagagagaggcggttcacttcgtttgccccgtgaaacatagaagcattgcatcgctgtcaaccatagtagtgcacgtgctttccatctcttataattagaaccatcaaaagcatgtggtttcagtgttgcagcaaagccaactactgaaaatgacctatcaggtttttggattgttggaaatttggtcataattcggcatattttaatccaaaataacaagataataaacatgatatttacaatgggatttgatccagtgatagtggtgaatgtaatcaacatgagcatgcttaatatagaataagcatcaacaatcacataataacacaatgttgacattgcgatgaacattaacagtaaaacttctaattgaaataatgtaagaaggttataccccaagaatggtcctccgctggagtttgaggcagtattgcctccgttggtattgacgggagcctccgtctccttgtatccagtgttgccgttgtctccagtgttcgacatattggtgaatgtgaagtagatgttgacgaacagtgagtagtcgcgccttgcgctccccaaaaacctgatcgcccgcccgtccgtgcaaacgtcgcagcagcgcgtggtttcggaggcctactctcccaacgcgtgtgcacacactcgtcgggatgggattaccgtagcaacaacaacattggaaaatggatgaaagtgtgtctgactgttctcgcgggagatcaaat

SEQ ID NO: 67080 - DNA, 1788 bp, Oryza sativa
ctctttcaatatactccctctattttaatatatgacgtagttgacttttttttatgatacgttaacaattctttttttagaaaaagttgtgtaattatcatttattttattgtgacttaatttttcatcaaatattctttaagcatgacttgaatatatatttttatatttacacaaaattttgaataagacaaatggtcaaatatttgttaaaatatcaacagtgtaatatattaaaaaaggaggtagtaccttatttcttaattccaaatttcagctatttttaaattgtattttctacatggactctattttttttccgattaatatgagaaattctaaaccatgagaacgaacgtggaggtttttttccctgttactttaataagttaatagattgaccggggatttattccacacctcagcaagtgtggaattaatcatttccaacaagtctccttctattttcgtgagatgagattaactgaacaaactaggctttaactatttataagtgaaaaccgactaacctttgctatcggttttgtccttgattggtggatgctatcaacttacattaagttttatatttattactttcttacagagttattacagtagaaagacttagtcatatttttactgtaaaaagtctaataacgtataccctctgtcttaccggccgacatagtggtaataagtgcgttcttattttagtctacccttctcttatttaatctaacttaatttgttctgttcgtctagatatcgatgaatgcaaatctccacacatctacccctgttacggcgactgcaaaaatacacgaggagggtatgattgccagtgccatcatggatacaagggaaacgcttcgatactgaatggatgtcaaggtacgcatatatactcccatcgtatcaaactacaattactttatgcctctccctattgacagagaagtacgtaatagacaggcagagtagcttcatagagaaatttaataattagattttttttgttaatttgttttaattgacacttgtttggcgaagtccatatatatcccggcccatcgttggggatagcctgccagacaaggccttgtagagttgcataataattttccaacatggcaacccataattttgatactaagctatttagtttcaattccgttgtattatgtaatgtaaataaaataaaatgaagttttactttcattttttttaatagattgtcccataattttccagcattgctacccgtccttccattatatatgcttactaatttatacttcttctgggcaaatttatttgacgttgatataacttagtttagttcattagacatcaaatatttcttaatagagagagtaattgataattttatttttcccgtggtatttgtctagatattaacgagtgtgcggaaccagaaaaatactcatgctatggtggactctgcataaatacgccaggagcttttgtttgccgctgccacgacggaagctacggtgatcccttcacaaaaggagggtgccgttcatctaaaggtgacattattgcacaactatactacgtaccggctatatattaatctatctatgtatgcctatgttaattagaaacttcgaagatgtttcacgttaaccgaagaaacagtgcacaactctaatcatccgccgaattaatgggtgaattaaaaagaaggaacccctacgagttacaagttgattatcagtaattttaaaattcaaaattatactaaaaatatactgacttgag

SEQ ID NO: 67081 - DNA, 3230 bp, Oryza sativa
cagatgatcaggctgcggctgctccggcggagactgtggctgaggccgaggcagaggccaaagaggcagagcctgcagccgccgaggaggccgagccggaggcggagacggcgccgccggcggcgatcgccgaggccgaggcaggtgaggcgaaagaaccggagccagaggcagaggcagaggcggcggccgctcccgtcgaagaagctgctgcggcgcccgtcgaggtggcggaggaggctgaggcggcgccaccggccgcacccgaggtggctgccgtcgaggccaccgagtgagctggcgaagatggcgagccggagatgaagctgatggctgccggcggcggcggcggcggcggcggcgtacgtgtgtgttgtgtaatgaattgggctccaataaaaatgtgtcaggttggctaccgggcccagtgtcagtaggtgctgacgtggcaggtcatcactggccctggagctcgtgcccgtgtatgttctcggtctgtgttgtggtttcatcgttaaaaatgctagtaataattttccgtatctttttttttgttaagattttctcttttttttttcatttttgatgtcacgaactcatgatacgagacatataagacacggtattgagggagctaaaatagacttattctaaaaaaggagcacggtgtgtctgctgtgccggcccgactgatctcaggccatgcctgatcatgcctgggccgggttgggccggcggcccatttggctatctatatggggatgagcttttaataatcacaatgcttgatgcagtacagataaacacatataagtagtcactactatgactgcaccggatccttatccatagaagtatgtgtgagtgaactacttggtggagagcttttgtttttctcatgtataattggcccgcagatggtactgccattgcaaattttaagcagtgcaaatctaattcgagtggaatttatgtagcaggcatataattaattgaacacattacgagtttgtttggaggatgtagtagtaatgtgcaaagcatttttcagttgactgttttttctatgtatgtacaacaataaatagattgttgcaaacagatcctaatattaacttcagtacttcatgtcatgttcaacatgtttaagaatactgaaagttgacaacatatttatcctagtgatgtgaacatattcaaacttaacaaaaagttggctggagtgctactgtgaagaacggaggttaacttttgatgctattaaagtgaattagaatctttcggtgcatatatctgatgtcgggaactttcagtgttatagaaccaatttcccctataataaatattcattctggtgatgtgaatataatatttttctcagtaaattattttcttgtcttaagtgttattgtgaatatatattaatcatgcatgatggagaatgatcatttacaactaacttatatgctatttttagaagaaaaaaaaacagtttttgtttgtggcattgcaaaaggctatttgtttagttgcataagttcctcaaagtactgtagattaaagttaatggcattttgtgtatactaatgtcaccatataaatgcatgggggaataggagcatgattgcttaatttcggaaagattgttttgaccatggttaaacttcagaaaattgctgcaagtagtttgtatggtcttccatgcaaactatattagataatgcttaatttcagttgttatagtttacctctctttggcgttatccacaagcagttgtcaattgctaaaatttcgaattgccacattacatgatgtgctatttctatattatggtcttacacaatttttttttaaattctcctgtgatggcagttggagaagatgaagataatggtgtaaatcatgtaatggaaggctgtaggatctttttgtaggggtgctgaaggatcaattatgcgtctgcaatgcatggcctatttacgaaaattttggtagtatttcttatgtatttactaaattcagcaataaactacacgtagacacctttttttataactttaccaaaaaaaaaattgtatggttgaaaatggcaacaatctgaatagccccgcagttctttcacagtgtctaaagtagtaagcatagactcctaggactgttgatattctaactatattaaataatgctatgtttcaactaatatggcaaaagtgatatttgatcttaattggaaattacagttattactccactaaatgtattttgtttgtacgataagatattaattggaaattaccgttattactccacggatctactaggttttattggaggcctacgtaagcccatagcatttttagatcaagaccaccattagctatactcctttaaaaataatccaatggtgttgacagtgaatatgtcaccccacctaccccgttgtaatttttacatattacgctttaaacctcttaatattacatacaactagatttaaatggatagccacattttcctatagggaaaaagtgggctacatatttcatggtaaatatgatttattgtagtaaatattgtgatattttttttcttttatatgtagcaaagcacatggatttagctagtatggtgaaactttgctagacctaatgggcttcgtttcctggccttgggccatggcctgggtggcctaaggccatgacttgaggcctactcccttgatagtagtttccgttgggattaaatccccaaaccggacctgatgaataacaactccctcaaccaaaaaaaaaaaacaaatttgagtttgagttaaactttattaaaaatattatttttttagttcaccggtttatcgaggagttttatgtttgagcatatgataccacgtgcaatgatatgtccgataaacatgctagcagagctgttaccatcgatcgatatttgaaatcggcgtgcccacttggccctgtggttgaatctgatggagatattaagtatgggcatgcgaaacgagaaacccttttaacatgtgatttaatgagtttaaacataaaattagatttatgtaatattgtaaaacaacttttatatagaaaattgtaaaacaacttttatattgtgccaaacggttttttccttttttggagcggagtttgcagagctgctccacaaatttgtagtacgggggtggagctgggtttttctgctccacagctccactccatcc

SEQ ID NO: 67082 - DNA, 1901 bp, Oryza sativa
ctaggggttgcaaggtctgaccgtttggacactggtctgaccacatattattgtccagtctgattgctcaaagattagcggtcaggccggcctggcagtaaagtttacaatcctttttgtaaatttagactaaaattgatctagtgctaaatttagctgtcaacagaaacattaaaaatttgagaatgttatgttgtcggctcctgagattgtaatctatttggagttgataattgagatacggacaattacataatcaaccactcaacacatatcatactcgctcaacctcgatatagaacacacgggtctttccatgcgtctaggagacgacaataccgtttgtttgtcttccattcaaccgacgcttcgagagaagagggttggggtacccaagtccctagatagctagggcagacatcatagaatgccatattggtgtccttggtagtaggagtcgtatctacgagacgaaaaccaatggtgagtatcttaggtggacgtattgaactaaaataagatttaaaattgacaaggaggtctcactttccacgtaagtgtatcgtgagggtgttcacaatacgggctacgcactcaagaggcccaagagaccaactatgctcaagatcgttgtaagtaacaagcttcacactacatcgctcgtgtacgcctggcaaaaccacgccacgctaggatccgccctccacaacacggcggtgtgcccatctctttacgtcgcatgctctccatgtagacagagaacgcgtgtctatctttaattccgtgttcttcgtttgactccgcatatggacgacatagcgttgaatatttttttttccttttttgcgccatgggtacggaacaacacgtcgattgcattgctaacgccctgaatgtcgtaaacgctcacgctactgtcgctgctactgctgctcgtaaacgccggaggcattttgcatggaacggcttggacatatctctggtcctggacttggtcagtgactgaggtgagacctgtatattttggcgttgaattagaaaggctatcgcacactgtatttgtcatggactcgttcagaaaacatgggcaccaaaatagtagtgccagcgctcacacggcaatactaataagtacccataataagcacagttgtagctttcagtgtcaaattttgatcaaccgtcttatttaaaatatttttatgattagtatttttattattattagatgataaaatataaataatactttatgcgtgacttaacttttaaaaatttttcataaattttttaaataagacgaacggtcaaaagttaggcacagaaacttatgattgtacttataatgggacggagggagtaataactagtgaactggcgcacacatataagttacgtcgcatcatgcgtccaacgaaaggtacaaacctatttagcacagctctagctttaactttaacttttctagagctgaagttcactaaaaaaagtttcagtttcacctaaaacgaaagcgaagttaggtaaaagcagtctcataaaataatttatactgttttacaaccatattctagacccaatttctataccaaaattttaaagttgaaaccctaccgagcatacctcgatcgatcatgggaccgtcacacggcttcggcgtcgaaatccgggagcaacagccggtgtttctgcaaattgcaactgttagctagagggaaattaatgattgcgacctgttggccaaactaataattccatgaggatcatgacaaggcctgcaactactgatagtaatagtaaatagcaatccctttcgtcatggacctacactactacacaaaatccttggacaaaaacacatttagattgcatacggagtattactggtcgtgtttagaaaa

SEQ ID NO: 67083 - DNA, 4917 bp, Oryza sativa
  unsure (1)..(4917): unsure at all n locations
cgtcggccgggcgccctcccctacaggatcccgctctcctcccctcaccttcctttcctccctagatccggcagaggggaggggcgtcagcggcggtgcggccgaagggaagcgcggaggccgccgccgggagcagcgtcctcggccgccgcggggaggccggatccgtcgctggccgctgtggggaggccagatccgtcaccggcaactgcagggaagacggcagcgggtctcgggcaaagtggcgacgacgatagtggtgacggcgacgacggtggtgacggcgtttttgatttttttttgattttttattttcccatgcaggcagtttaagcgcccgcgtgcgggtgtgtcacccgcacgtgaaaatcgtgattttcacagacacctcgttccagacgggtggaagatccacacgcaaaaaccgattccgaccacacgaaaaaaatcgttagtctactagtgttattccatttttagtctctcttgtttaccacaaaataaatttaatttaaattttagcaatcattataccaaattttataaaagtaagagataaatgcattgactgggagtagataaagtgagagataaggattcgatagagcagaagtagtgtatgtggaagtgtgaaatataaatttatttagaacagagtagtgtgtatatctctttataaagaaatactactagaagtatactagtatatctctttagagaagaactgctagtataatacttcctcattttttaatagatgacgccgttgactttttctaacatatttgaccattcgttttattcaaaaattttatgcaaatgtataatatataaatcacatttaaagtattataagtgataaaacaactcataacaaaataaattataattacgtaatatttttaataagatgaatgatcaaacatgtgagaaaaagtcaacagcgtcatctattaaaaaaccgaagatagtattgtttttctcatgctagaagccgaaacggtcgaccttgaccggcgacttgcacacgtacatactagagactgaccagatccaaagctcaaaacagagcccaagtcgaaggccaagtctgcatttcttggtgtaaaaaaaaagtctacatttcttctccacaacactaattttcttttgttcttttagataatatcttggagttttatataccctttgggtgtttggaggcatgcacgctgtgacacggacagatcgctgtcatctttttccctctcttgtttggaatctgccgtgcggacctggtcacattcgtggttcgttttgcccaatacaaacttgcaatgtcgcaatccgtcttgaccgctgaagaaaccgtttccttctttttatctcccttttttatcttttcgttgttgccatgatcattgtggagactgttttattgtgggcggtcaacattcggtccattttacaatattaaatacccatgcattgcaatcagcttatattaaaccctacaaaataaaataaaattattccctatctaatcatcctaatatatgtggtaaaattttgtacgtgcatgtcgagttacacggttgctgaacaattgatataaatatacatgttgtatgaaattcatatagtgaacgctcaaatataaacccacatgacagttggtggcagcagaaccaccactaccaccaatattttaaagtagtatagaaaattacaatatggatacaaaagtgtaaattccaagtggccactcgcattttaaagaaggtggttgcatccctttagacccgttccaaagtccgatctgaaatggattaaaacgagaaacataattagcatgtgattagttgagtattaactattaaaaatttggaatatatatatatatatatatatatatatatatatataaaataaagcaacttctacatagaaaattttcgcaagaaacatagcgctaaccagttttaaaagtatgctaatgaaaatttagaaaataacaacccgaagcgtagtttaggacgcgcacttcgtctgatcaaacatttattcattccaaagagatcaaacattcatgtattgtcataggtttcattttgccccttcaatgtatcttgacttattgtgctttaaggttaatgttgtaccacagtattttgtttttgcagtactgtaaggaagtgatagcaagcatttctctattaggtgtgatatattattatcgtacctcatattatttcccaaaaaagtatggtgtaacatattacttttccgtatgctgaatatattttaaatagagtgtcgctagctagatttcaatgatctaaatcctcaaaaatttgcttatcctaggatccatgtcaagatttgtgtccaacgacagcgtgatgatggtggtggcgactgcgacactatgtttagggtctatgtttggaggtgtgtattgcgtgaccgtgtccgcccactaggcaaagtccaattcttctttttaacaattcggcagtgcgatgttcatattgatagagcagaaaaatgtaaagttcagttccaatttctaattccaagacgttggcatgccctcctccctctcaagatagcctctaccttcggttcaaaaataatttcactttaatttgctcccttctaatatgaatgttattcattcaatatgttttatttatatcttacctactcacgtaaaattgatgttgctagatttatcgttaaacaaactatcataatatgcaactctttttatttattttttttatttttatagatattgttggtcaaagtagcatattaaaaattgtgtcgaagtcaaaagtacttatattttgggacgaatggagtatcatagtacaataaacttatattattatattatatctaatttattttttttaaaggacggatggagtattctggtttgctgccgtatctgccatggcgattgaggtgatcgatcagttcagacttcagagcctccgtatgattgactggatcactggatccactcctccacttttgcccgaatccgtcgcagctgattgcgaaacagaagcgcacatcgctttacaagtttacagctgcttggcactatctcagcttcgnaggatctataaatgatcagctttaggctgtgtttagttcagtgcaaagtttaaattttggttgaaattagagatgatgtgactgaaaagttaaaatgttgtgtgtatgataggttgatgtgatgaaaaaagactgaaatttgaatccaaactttaaatctaaatacagcctagttagttggttaatacaaagtcagaggtatatacgcgtgttttcacctgcccagatgcatggtttcttctcctgaaaaaaaattatattctagctctatctgcaggtcgaactagcatgaagcaatcaagagtaagttaaatcccgtttgtttaaaagtttgaatgatcatttgcagtactaaatgagcagaggaatggaagcatgtactactatataagtaaaggccaaaagacaagcgggaaattaaagaacaatagtactttataaacaaacaagcacctctctatcccaagacttgacaccatttaccaataaaaattatcatgacaatctaagttggggttatcaaattcttcgttatacatttaacaagcgcaagcaaatcctgccattttcttttcaacgttgatatgtgagcgctatgttggaagcgaatcatactacaactatgatttaattattttcggccattcccacaactctacgagacataaaacgaggcaaattaattgattattaattattacaaacatgaacacgggcggtctacttatgttttaatgaaacctctatagaaaagtttttgaaaaagaaaaggaacattcagtaatttaggaagcccgctaacgaaaaacggaaaagttgccactgctaatagcccaaacaaacggtgctagctgcaacataacagcttataagttgatcataagttggtcaaatactatttaaaggccagttcttttcgtttatgtttatgcttataaactaaaatttgaattttcaacctacaatttaaatgtgatcgtgaggtttttctcattatagtttatttttcaacctttactttcaaatcgctaataacatgtatataaaagttttatttacgaattatttttcgtttgttaatatgccgtttggacgatggagttcttaaaaatgaactgcatctcatatttaaaaataacagaggtagcacgcggtaaacgataaaataaataaagtactctctccgtcttaaaaagactgaatttttaggtttacatgtccaacgtttgaccgtccatcttatatgaaatttttttatgattagtattttcattattgttagatgataaaacatgaataatactttatgcatagcttatctttttaaattttttcataatttttttaaataagatgaacgggtcaaatgttagacacggaaatcgtttttttttttacgggggagtatactgatagctaggagtaacaaccaaacagttggagacaagcacgcggttcgagcgagcgtcgtctttgtggtgcaatttctcgggggacgccaagccccgctcggttcacgggcgtctcactgtgcggtgggcccatccccagccgtcccctcgcgggccaccactctctgatgctgacaggtgggtcccaccctctcgccctcttctcccctatatatacatatagtacaaaatccccgtgtgccaaactgccaatattctctctgccaaacaaaaaaaaaggaaaaaaaccaccgcttttcgcagtgcgcttcttctctctccctctctgctctgctcttcctgagctccgcnnnnnnnnnnnnnnnnnnnnnnnnnnnnnnnnnnnnnnnnnnnnnnn

SEQ ID NO: 67084 - DNA, 1595 bp, Oryza sativa
ttgttgggtgtatattcccatgtgcttttcatttttgaactcagaactggtacatggtggtcaatataattttgtatagattatcataccttatataaaatccagtgtagccatttgcgaggatttcgcaagttgcttctgtgtgcaagttggtttattatatcttttgacctttgacaggagtgaagcataagcaaagcatgtcccatttaagtcactttcctccttactttagtgtcccattcatagctaaatactagtggtttgccacctaagaaggtaatgaatgataaatcatagcataagcaaaatctgagtatacgtattggctgctcttagtttgtggtctattttatccatcatgcaaaagaattcgccacttctagtttctccatattagtttgttttgctgttcatggagatggcccagtatggtagttattgaaaatctgcctgttggcatagctagatgaagacaagaggttgctgctaggcatttataggttggatttttcagtcatctggttagcaagagattttatattatccatccaggatttcattaacataaactataatgtataaattgcttttgcttatatttgtgacttctcttcctcactgaagccattttcaatgttctctgtaaagcacacaagagatccttgtatcttgctgttctagttcaattaaactactgcggattcagtcttatatctatcttgcttgattttgttgcaggatccagcaaatcccaccatgatattgtgcgactcaaaacttaaacaactctttggatgtgaaagtctaactgccgtgagtgtttcggagttgctgtcacaacaccttttcaagcaacctaacaagctctaactggttagttatttcctttcagaacaacatcatgtattgagacttgcactggttagtgtttgctagatgacatccatccctgcttgcaactcctagttagtataggaagatgttgaacaatatcagaattttttaaagtaactggatctgctccttccctgtttgttccttgcaccgagttcgcaccttaattttattataatggctcttaggtgctggaaactactcaatctatttcatctatagcaaggtgttatcttgcatatcttatatgttaaggcagaagttgatggtgttttgttttgttttgcagatgaatcgtcttactggactctagttggtctaacaccctggtagtaggcgctgatgaaacaacagaaaatgctgaaagtgtttattctatgctttgtatccatcaaactgatttacttatgagaaaaaggctgtaggctaatctcttcacagtagcaaggaaaaagaatgatagttgttgcatattatgtagtcttgagtctcttggaagagtcacatgtggtaggctatcttgaatttctagcttgttaaatactgagtagaaagcagcaccgaagcaaagttaaagctgatgaactttgcttgatgtaaaaatcagcaagcataggtgcgttctatggtaagtagttgctttcacctttgttgcttgaaagcctcttacattgttagtgctcttgttaaaaggacac

SEQ ID NO: 67085 - DNA, 1270 bp, Oryza sativa
atgttatcattaacatcaatatgaatgtggaaaatgctaaaatgacttacattgtgaaacggagggagtacttcttagatataaaaaagtactaaagttcattctaaaataattggtatactacctcttaagaaccacatttatttttctaatttcgaaacagagcaatcactcacctaaaaagaaccccatttttttttctagagttgaatattgattccttttgttttgaagaaaaaaaaatatagcattggttccatatatatgtataaaaaccaatttagtactagatgtgacatattttaatacaacgaatatggacatatctctgtcctaggatgtgtcacgtccagttctgattcggtttttacgggacggagggagtagttaatttgtaccttgctcacttgtgaaacgtcaatggaggagattctaccgaagaagtagaggcactcgtcgccggcgagctcgagcaactccctgacgctcctgttctgcacggcggagttgagcttcaccagcctcctcaccgcccggaacccgtcatctccgccgccgccgtcgccgaacagggaattcacgcgcactcgccccctcacccccgccgccgccgcgctcttgctgctccgtgtcccggcacgcggcggcgccgccgatgggagaagaagaagacgaagatgacgacatggcgctgtcgtcgaagccgagagaagagctgcatccatggcgtctcggatgtttggattttcttggggatcgcgaggttgatcggttcgaggggtagctagctagatatatgatcgaattcctcgcgggtttggaattcgatccgtggactattccggcgaagaaagcaaaggatcggatggaatggaatggaatggaatgcgattgaaggagatgcccgcagtagaagaggttgcgaggttggcaaggcagggatgctcttccaaacttggcttgaggtccattgccctacaaatgctacatgccatttcatggctatagctgaaaatatgcttcagaaagcttcatctccaggtttaacatggcacatgacaatgtttattgtcatcactggttagtgcatagtgctattcagatggcttcgttcttttctttgattcccaactcgctcacctcgttttccgtgtgtacgcttttcaaactgctaaacaatgtgtttttttgccaaaatttttttctatacgaaatttgcttttagaaaattatatttatccacttttcaaaaatattagctaatactgaa

SEQ ID NO: 67086 - DNA, 1650 bp, Oryza sativa
actttaagatgctctgcccagagtgataattcttctttgcagcgcaggatcagccgttggactgacggctgaaggtcgcggaagacgacatcgtgtcggtgattccagagacgccataaccataagcagagtagatagaaggtcttgtagtgttttgaaggtatgtttggtggccgggctaaaagatgaatgttactcacttcggccacattgggtataactccgattgtcgtccaaaaagctgatgcgaaggggcacatgaagaagagatgattcgacgtttcgtcccctgtctagtagatggcacatactccctccgtccaaaaaaaaaaagtcaaaccctatgttttcgtgtccaactttgactgtccgtcttatatgaaatttttttataattcgtattttcattgttgttagatgataaaacatgattaatattttatgcgtgacttgtctttttaatatttttcataattttcaaataagacgaacggtcaaacgttgagcacggaaaccagggtttgtcttttttttttgggacggaggaagtagaggtgactgcaggattgtttttgtaaaaaggtttttggcagttggcaatcgatcctttgagagcaaccatgcaaagaattgaacctttggcggtgaagcattcttccagatgaaggtgtgaactggatccatttctgacggaggcaatagggcatggtatatccccctggcagtgagatcaccttgctgtgaaagcgtcgagaatctgaggtcctcctcctcagagagggaaatactccctccgtttcgaaaggtttgacgccgttgactttttaccacatgtttgaccattcgtcttattctaaaaatttaagtaattattaattcttttcctatcatttaattcattgctaaatatatttttatgtaggcatataattttacatatttcacaaaagtttttgaataagacgaatggtcaaacatgtgataaaaagtcaagggtgtcaaacatttcgaaacggagggagtaccttgcaatgtcattgtaagctgggatagctcctgtgaagcggctgtggaaagtcttggcgccagagtagaacagatggatcttcaggaaaccgacgccgcttggaacagatagtgcgagaagagagcagggtactgtagacggaagcatttgtctgggagccagcagtcattccaaaaggatgtgcgaagtccattgttgtcctgcgccctcgttaggatttccagctggggaatgagcttagatatctggctgtgtttagttcagcgcaaagtttaaattttagttgaaattagagatgatgtgactgaaaagttatgtgtgtatgacaggttgatgtgatggaaaaggactgaaatttggatccaaactttggatctaaacacagcctagatatagaatgccagtgaggtccaagcttgccgagttcgacgagagattttgaattcgaatttcttctgaccagagccaattggaccaggagtttacccggtagaggctgaaaaggcgcttgagtagtaatgcatcattttgcatctgaagatttttgatccccaggccaccgaattcctttgattgacagtgtacaaacgataatggaaattatctgagccatcaatcgcttt

SEQ ID NO: 67087 - DNA, 1134 bp, Oryza sativa
tatgcaaataaatcaatttccataggaaaaaaataaacaagactaatcaatttttggatccaatgtaaaatagtagtgcatcatgtaatcaatgtgagcttgtaggagtgtatgtacagctttgttctccaagattcccagcatagattagagactcgtttaatcatgctctaactcgtaaatttaacttcaaaagttagatatagagctttacttctctagatcattttataagagcatgccagcttattccgctttctttttatgtggagctgaaacgttttaatcgtactttagcttcagaagaaatgaagcttaagttggcctgagctgtgtcaaacaggcctagctagcaaaaaggccgatcagtttttgattagtgaatgggagcagtatttttgatccggtcacgcagggccacaaattaaagctggattaattgcttttaattaatcgcagtagttcatctcgaaaataattgaattagttgggaccattttggcctcgaaacccctctataaatagcccctccacctcaacacatcgcttcacacacgagatctcatcgatcagtcacagtgacgcagtgagcactagcttccactgctcgcatcgcttgtcatcatcatcagttcatcaccaatggccaccgtcgaggcaagtagctagctactgatcattcattcatattcattcatcctgtgacaagacgaggtttgcatttcgattcgatcgaaatcgatctcgtgattttgttgtgctgatgatgagatgaatgcatgcatggttgctttgcttaagagcaagtttaatagtaaaaccaactaccgactccaaatcatttgagtcaatttagtaaccaatttatgtactccatccgtcccataatgttgcaacctaagattggatgagacccatcctaagactacgaatctggacatgccatcctacgactatgaggcatgtccagattcatagtcctgagacccatcctaggttgtaacattataggacggagggagtaatagttacctataaacatatactactacacaattcatatttggctatacatatcacaacacacatgtatcttggagtttgtgctacagctggctataaatctatagtcca

SEQ ID NO: 67088 - DNA, 894 bp, Oryza sativa
tcaagatgatggattttatccaacagatagtgttacccccataagtaaaaaacaaaaaaaaatctataacagtaaccatgatccccaatttttaacaatgctaaccactgccgtcaacacgatcctgtttttgcagggttctacagggagcacggttcaggaaaatttcccaataaccaaaaaaaaatgatcatgaaggggattagcatgatctttgtacaggttacctcccaaaaacaaagaaccgctgcggcagattaaaccctattctccaaactaaaatcacaaattattccccccccccccaactaagtatcgaaaccacgtctttatcaaactctccaacaggcaggatgacatgcccacgggatgaaatcatgaaatctctaataacccttgaccccctcactcacctaggaaccaaccaaccacgcgacgattcggcggccacctttccgcgcctcgccccccacaagatcgcgttggggatcggatcggccggcctggggtggcgcgagggtggatcctgctgctgagggcgccgccgccgcctgggaggaaagggaggagaggaggaaggcgatgggagagaggaggaaagcctcgtcgtaggcggcggcgaaggaggaggcgtgccgtgcgtctcgcggggaagaagaagaaggggaaaaattatgcagtccttcaccgatctgtgggacccctctcctctggcggacacgtggcggaactagagagaattcaatattcaatcctactgtaatggtgaaacaaaatggtgaaacgggatgaggtttttcagatatactgggaacgagaaaaaaacaattatataataaataacataaaaatccatattgttccataaacgattggctgcgttctagaaaatat

SEQ ID NO: 67089 - DNA, 741 bp, Oryza sativa
cgcgcgcgcgcaggtccgggatgccgccgaccacatcgtccacagcttcgagggtacggcccctcggctcgcgttcgccctcgactccgacgaggagggcggtgacgacggtgcggacgacagcgacgacgaggccggcgacccgggcgcatcggagtgagcccccaggccctcgccaatcttaataacttttccttcttcttgcgaggccttcgagcccccttcttgtatagactgatttaatctgcaatcaagtaaagaggaaatttctgcgtcagttctgtttgttgtgtgtatgagacgaggatggtctgtgccgcggtccttctgtgtcttggcttgaacaagggctcgtgcccaggtcccagcctcaagcggcgcgggtcggggctagtgcctggggagatcctcgtgtcgagactggccaggccgagagcgcggtgaccgagggttatgatgacccgattgtgggcctttgccgattcccccccggagttcaccacgccccggggcacggctcggttctgggccccgtttggcgattttagccggcccgggccaccgagggcagggtcgagcacgagcgtgctaattcaagccaagattcttcaaaaggaaacgatggcacagacacagtcctcaggaaatcgaaaatgcttttattgaaatacggaagagaaaaaaggtaagtatatgcatgtggtagcccccggccaaccctgcacacccgggggggggggg

SEQ ID NO: 67090 - DNA, 2117 bp, Oryza sativa
tgtcctcgtcgcgctccacgaccaacgccgcgctgaccacctgtggggttgccgccaggtagagtagcaacggctcatctggctccggggcgaccaggactgggggagaactgaggtacgccttcaactgagtgaaggcccgctcagcctcctccgtctaggtaaacggcccggagcgtttgaggagcttaaataggggtagtgccttctctcccagcctcgatatgaaccgacttatggcggctatgcagccggtgacgcactgcacatccctaagcttgctggggggggcgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtctcttggttgcgcgtcttcacaaccaagtcatcaacataggcctcaacattgcgtcctatctggctacccaaacaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttccggggcctgccgccgcactttctgccggaccggccttgcgcccggccgcatggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcacccagggcaacctccttgaccgggacttcgtcgcacgtgaccatccgctgccttggggcggccgggacggaggtgctgagcctctcgtcgccacccgcaggcttggacgccgcggcgaggtggtccgcgcgctgctccatacaagcaagcgcgactttgaggtcgccatggacggtgatggggccaccggggcccggcatcttcatctggagataggcgtagtggaccgccgccatgaacttcaccaacgcgggcctccccaggaccgcgttgtagggcagactgagatccgccacatcgaagtccacccgttccgtgcggaagttggcggaaccaccgaaggtgaccgggaggtcgatatgacccagcggccaggtgtgccccggcgtcacaccgatgatcggctgggacggccggagcaccatccccggggccttgatggcatcaaaggctgcgggggagaggatgttgagagctgcacccccgtctatgaggacacgccccaacttcacattgcaaacggtgggggaaaccaccatcgcgatctgtcctccccgggcaacgcacggcgggtggtcggtctggtcgaaggtgaggggaacctctgaccaccgcgcccgccgcatcgcctcatgggtaggggccgcggccagaagctctcgcttcatggccttgaggcttcggcgagaagcatgagcgcacgctcccccatcgacggtggcgacggtggcctcaggctcctggaaccccaggtcatcgtcgccattgtcgatgtcttcggcggtggccttctgcttggcctcacctcgccggttgctggcgggagccgccggggtcttgccctcacggcgctcctgcctcttctcctcctcccacttcctcgtccgctcagccaaacttttgaccgcgcggcagtccgcgaggtcctggagggaggtgttgtgcacggtacaccacttgccggttgggcgctccctgtt

SEQ ID NO: 67091 - DNA, 4933 bp, Oryza sativa
ctgaccgagcggctgactcgggggcggccggactgccacgccagagccggaggagttccaggtccaggcctcctctttgcgagccacacggtccgcgagctcaaaaagctgcgcggtggtttggggctccttggaggcgatcttctcgagcatgcggttgtgccgcacgccccccctgaatgcgtagatcaccgcgtgtgcggggatgcatggtatggtgttgcggacttgacagaaccgctgaacgtacgagcgaagagactcatcgtcccttcgctgtaccgcatgcaagtccgcttcttcgcctgggcgcgaatatgtgccctgaaagttcgtggtgaactgctggcacaaatcctcccaagagtggaccgacgcgggtggcaagttcattagccatgaccctgtcgtcacccccggcggcctcgatcccggttgtgtagatctggagaaactcggcggggttgacgcttccgtcgtatttttcggtgatggtgggccggaaccttgggggccaacggacgttcctaaggctcgccacaaaggctcgacagccggcaccgccaaccggggacacggggggccggcccccgtgcccggaccgaagtggcgctccggacgaggaagcgccctccgttgcgtgggcggcgcgacgatcgtcgcgccggcgctcgatatcgagccgggcatccggccccccacgcacatcttcttgggtcggaggcgttgacgagggaatggcggacgaacagcgggtaacggccgccgctcaccgcgccctccgcctcgacgacatggagccggcggcggcagcgccagaggtcccggtggcggaggaccgcctgccggcgcctaggcgctgctgtgccgtcatgaccaaatcggccacgtcatccagccaacgtcgggctggagtctctggatcggggacgacgggcgggtgacgcaggagcgcgcccgcagcctggagcgcgccctggggcgtgccgccatcgccgtagacgaggcggcgacgcgccccgtctcgccgtcctcccccgttgcccgcgggcggcgaagtcgcggatccttcgacctccccgagcgcctccccccgcccaagatttcggcgagagggggatggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttagaaagacacgcgcgccccctacctggcgcgccagatgacggagcttggggctcctcaccgggagaccgcgcaggccctcctttgccggttcggccgggggcgctatgtgaggttcttcgccctcgatctaaggaatgtcagcgagaagaatcgcacaagacacgggcgacgtagacaggttcgggccgctgagaagcgtaacaccctactcctgtgttctgatggatctgtgtgtgaaggaatacagagagccggagagcgagagaccgttcaggctctagaacccctccctcctcttctcctttttctctttttttcctctctcttctctctctccttctcttaggcctgggcctcctttttatctggtcaggggtcaccacatgggcctcaagctgcctaagaaaagaaacattctttttacaatgagggctagtctacagccagaagtgacccctgacaagcacagcacacgccttctgctccgctcgtcagctctcccggtggacgcccgtttcaaccttcattcaatggccagcgactttcttgccatgcttgcgctgaagcctagaatggatctgaccgggactgacataccaactccaggagtcagcacgccagctccggctagagacgagagccaggaagctctcatcattccgacgggacggggcgaggcgtgcgacaggccgcctgttgccacctaacccgcgatctgaccagtctatgaccggtcacataccgcgactggtcacggaccggataagcatgcgctgcaccgcattgaatacggcgtggcgcgcttgtctaacccgctataaatgcggttaggtgagcgccgctgtgctcacctaacccacacacgtggcgccaacaccacagggggtcggggcgccccagccctcggggccgaaacgggagcggcccgacccctcggggagacagaaggaggggtggccacgtcaccctcgggcccaacccccccgagggggtcgggccacgtgggtgatcgcggctacccaagcctctagtcacgatacccccggccccatgtcaccgacactctattaagggaattcgttttattttttttccaaaaaaaatgtttcacctagtgtagtcacaatgtttcactatgtatggatcaaatgttgcagtgaactgaaatattctttcgctatttgctgaaatattgtttttataaaagatgaaacaacacccaatttaaacgattgaaacattttcgatctacttagtaaacaattccgatatacttagtgaaacatcgtgcaacatttaaacataattctataataagctaaaaaaaatttcgtcggaatatatccatgtgtggtcttgttttaaaattttaattacaatgaatttaatggtgcaatcggatcatgatttggatatataatttaggagaaaaaatagtttaaagtttgcttaaaaactttaaccaccctaacagttactagtatacatgcattctgtgcgagcaggctgaattagtttgcatgcatgcaggctgcgtctgcatgcgctgacggagactggggtgggcgtccgatttctcctaaaagatcggacgtccgatccgtagacgccccccccccccttaggtttcggttgacaatttcaagcacaagagggataaagtcctcgttttccacgctcacgttttctatactgctaaatgatgtattttttaaatagtctattgcttttaaataattatattatatatttttcaagtttaaaataattaatagtcattactcaataaatcataacctaatggtttacatggttttacagtctacttatttcccctccttgcaaacacacccagtctactttgacattttttttcctatttgtggctgtaaacttgtaactatgtttttttttctcgaataacgtaatctatgttattatttaatataatctacctgtttcaaataaaaagtataatgataatatcatttgaacgcattgcccacgatgcctggaagcatacttaggtgaatgatgatacaccgtacattgcatcttacatctgtttgttgctctaatatatagcttggcatcattgtaacacaaaacgctatctgatccaaatccttctctgctccacttgacttggtgtcaatatgtaaacgatacgtttacttgtacacatataatagcagtttctctgctccgctgatgtttccatggcagtagatcagtacaatgttttcatgattattatggacagaaaaaaaaactagtctcaactctaggtgtcgttctggcaaggcctatgagaaacctaagagaacttcggctggggacgcctagagcagataaggcattgtcggatcatgcagagacaaacgaccatataagatctggtcatataagagttctcaccgtgtgtattaaccaagccgtgtaatcggaaattgagttttccaacttcacggctgggggctagggtcagtactttttcaaccaaggcaggtcaagggtccaagagccttatcctctgagaacgattttctgatgacaaggctaggggctagggagagtgtatggctcaggtgactgatcgaagtcgcaaagtgagaaaacactcatacacaacatacccagagtaagaaaacttagatagattccttttctattttataagtatttcttacaagtcataaatacttcaaagtatattacatgcttccttaagatgtttttctacaggatacaaatactaccaggacggccaacgccaatccatggagcgaaaaaccttctcggcgagcggcgccatcgactgtgcaaggccgtcgatctccgcgggtgtcctccgagaacgcaagaacccttcacgcaggaactcgaggtacagctgcgggcggtgatctcggatgcaggccagcacatgtcctccggcgtagcggcttgcttgacgacacttctgcttcagggcctcgtcgatgcgcttgccaatcccttcgagctgtgcgcaggcccattcaactacgagatataaccagccgccgactcctcgggatctccgcggggaactcggagctccttgcaaaccctcgccatcgtcgtgcagcaactcttgagatacgagttgaaccacacctcgcgacctcggagagcctccacggcctggtccttcttcacctccaccatggttttctcgagttcggccacctcgagcttcgtcttccaatattggattcgacgatctcggtcagccaacatgttctcgaagtctgcccgccacggaaaggactgagtcaagctactcttctcttccgagaacacggctaattaagtcaatccaaacacaaggagtgaaggagaccaagacacaaaccttgggacatcattgccatattcgcctccgcggacgggctttgactgatctcctcccgcggcacgaacggctcgagcgtaagcgccggaacaatcaccggcatatcgggctgcccgtgctgctggatatcctcgatatcaacatctctacaatgacaacaaagtactcggaatcacatgctaaggaaacaagggaaacagctgtttagataagagcaatttggatccacaaatagttttacagcatgaagatatcctactcttcaaaaagggggaggacggactcccccaagtca

SEQ ID NO: 67092 - DNA, 4548 bp, Oryza sativa
catggcgccgacaaatattgctgctaccacacaagctgaggaaaacattgtgtacagaacttgtggaccaagttgctccagaagccgcaagaacaacaaactgacaaaaaaatttaccacctgcagcatttaagcatagcatgtcaagacgtcgatacgaatcatggtagaactacaatgaaccatggcaagtaaatagtgcgccctaccaaattattgttgcaaccctacacttatcatttaccattacataatcaaccatatcgaaatgtctaagttttttattatctaatttaaaaatctggccccattattcatttattattaacagcatacagtaccttttatcttatggcgattgggggaaacgattttgttacacagagaaagctgcagcttacagagtcaaatatacttctgaaattctgatcttcattaccataaccagggttggtaaaacagtgtggaaatgctattgaggacttagcagcttgaatattttgaattgatctaatatacctgttctagctcagcctgactaaacaacagctcaaattcttcaccaggtatttagcactaggctccttttatcattgaacaatgtgaacagctatggttacatactagcagtaacatatttttaaacatcctaatggaacaggaaacatgcatagacacataataccaaatattaacatattaaaccaaaaagtgaaaatcagcaacgaaatttccacgttgaatttcactgtttgatctaactgccagcattttgacatgcagtgtctattttttgaggatgaaaaatgaactcctatccaatgcacagacatgcagtgtctttttttttttgtgatggaaacataactccttacccaatgcacggacatgcacagagccatagccttggcccgtattttgtttgggaaaatctcaggcaaaagaagtcctggcactggacctgctcctaacgaaaatgtcaagacaaacctgaaaaagaagcactcaactataagaaactggtagacttaccataacatttgtacttaatgagccagtaaagtataattgtcaggaacaattaaagagttctgctaagagcagcataaaggtaaactgtctcataatttaactagttacaaattaaaccaaatggaaagccctattgttcatataaagaataactaaggatgcacaacaacgctgagggtgaagtcaggggaatcaaaatgaaacaactgcaaagcagaacaatatcatgtatgcaactgatatccccagtgccatttacatgtcagatcgatatattgacacagaattgttccaccatatgcaaccaaaaggttgcctgaacaagttcttggaagaatttatacgcaacaatgttttgtatcaggttgaataatttgtttccatccttcttataatctattacctctaatgaggtataagagaaatgatatcctttgggttgatgtgaaatggatggtctgaacaaatttagagcaccataaaaaaaatcctatttgtagatacaataagtagagaattttgcatatttttaagcctgatattggcacatttggcacaaaaatgtagcataaattggcttaaccaataggagcataaaacctcctgcttaaggtattcaactagtagtcacagctatttagtttagcctcctagacattaataactaaattcagataacttgaaagatagtagaatcaaagtaacggaagacataaaattctaaaacttacaatagcatgccaccaactgaaagatatacgcttgcagaaccaaggtggtgacgatttgctccaacagcctgaagtcccattgcaaaggcctatagcagtaaagatgtgcagtgagtaatgttcaacattatcttccaagttccaatcacagtgatagcttaccatgccaaggaagctccctgaaagaagtactttccttcctagtttgtccattagaagcatagctacaattgagcctggaagcaaacacatcaaacaaaatccatcaaccatcaatataacagaacagtagaacaacagaaaaaaagagaagatgctccaatgagcccacctgataaatttgctatccccatgcatatgttcgcaaagttagggggcacacccacacttctgacacagttgatgagaaatagaacacagaatttatgccggataactgttgtaaagcaaagagcgttgtgccaataaaaacaactgtagcaaaaagggacttgtaatgaacaaacttcaaggccaaacataaataaggttatagtttagcgcaaatacacaacagaatggaaaacacataacagcttgtaccattaaagttgcgaccataaaacaattccgaatacttcacattttctccatcatcgcctctttcagatcgggagagttctgccatagcagacttaacatgaagaggacctagaagtttttcaaattgtatctctgcttcagtcgttcttccacactgaataaaagataagactcgtcaataattttcaatgtatgtgctacaagttaaatataaatatgtcaatacaaattgccaatataaagaagtatgggagttgtataagtctgtgttgagaattggttttctcagaaaaaaaactaataaaatgttttgctcatatcagagctgtatttgcatggtgcacaatcagaaaacaggcacagtattgaggaaactaaagatcaacgatatttatccgaaaatctaatgtgtgctttctgaagcaaataccaatatgtgccaatggactactcttctatagatatcattcgtgttaccatctaagtaacaataggcaataagtttgtgtcaacccattattaattgtaagcacaaaaaacctcaggatgatggtagattgcaagttctaaccaacagattaattgtttgatttaatacgacagtgaccttcaaacattcatggaaaaatcagcatgtggtatttgcatatagtttaagagatcaaatgtcgtttccgacaaagtgactccaagatggtcctcaaatatgagtatctcattttacgactagcaaaggcacttaagatcaaatttgccgaagcacaattatagagaatcagacacctgaagggtgatttaagttggaagatcatagatagaaaataagcagcttcccccaagataaacacaccttatacagccactgggggctctcagcacagaactccattccaagagcttgtaaagttgctggaacagctgcaacccagaaacacaccctccacctgttaatagcaaaggataaagttagatgcatcagatttactaactacacaaaacatgtagagagctacagaagaaagcatctaaccatctatcaatatccttcacaggtgtaccaattaggagagatactacgattccaaggcaggttgcaatctgaacaaagctcccatatgtgcccctcactgaaggaggagaaacctggatccaagggattataagaaaaaggtacaaatgaataagattaatatttgatacagacaatcagagattgaggcataggtgcataacaccaattacatacctctgttatgtacagtgaagctactggtggacctaatcccatccctgttccaaccaaaaatcttccaagaagcataccctccagactattggtgagagcgctgcaaaatgtttcttcttcaggaaggttcaatgaaacagaatcataggaataactaagttcaggcatagttccttccggcagctctcaagtattaggtgctcatagatgtaagtattacacaattgcattttcggaaataacagtcttggtgcaactaccaaaacggatcctattaaataacatgcagaagataaaagtgctaaagattcaaaaaaaggttagcatcttaaatattatcattcaatgcacttaagtgaactttagtttgtggatgccatgtagcaatggcaatgtaaaagcacctcaaggtaatcagagcacatatggtttatgttgttattattcaacttatcagcaactctacagcaccaataaataaaccaagacttaacacccataagtgacttggtatgctatatccaaaacgtacactagctatcaattaataagagtgttgaattattgaaaggctagaacttttccctttttaaggataatcaatctaagtacatcatgagcgcaattaagaaagaatatttactattgagccatggttttctagaagatgcgtgtaattaattttcagtactcttcagtctattgtggctagtgaaagtcaatttatcgtaaagttcgattgctttcatgtttgcatgtgaagttacactagctccacagtcagtcgaagaaaccatataaatttacctaatggcgggatggcaaacctagtattctcaatatactactctctgcactgtgttaagaggaccacacattttattcatctcctacataactcggagattcaaaatcccatggaaggacgaatccatcaagctactacttgtcacacca

SEQ ID NO: 67093 - DNA, 1133 bp, Oryza sativa
atagtggacgcccatgcaaagtctccaaaccagaaatcccagtacgcaacgtgtggaggttaggctgtgcgcgcgctgcggccaccgtgacgcgtgttcgctaacaccccgggtccaccgccaccacgcccgaccttttggtggtggtgggtcggccgggtcgtaatcgcaacgaagaagaagatgcccacccccggtgaacggatcccgcacgcagcacgctcctcctcgcgacagtgttactctgtgctacagacatgtggggcctacggtatcagggtcccacgtcccagcgactgttagagtgtcggccggttctggtgcccggtcgttttctcctccgattttcgagcggctcacgttttttcgcggacgtcggggaagggtctggattttgtcattggaggtggtgggcccctattgacggcacggacgcgaccgaatgatgagtggggtgattgacttgatgacagaagcatgattactaatccccgtttcgtatcataagtcattttgattttctttttgcaaaattagttaggttagttaagtttatagaaaaaattaataatacgactacacctcatcaaattcaaattaaatgtattttgataatatgtttgttttgtattgaaaatattatatattttttctacaaacttattaaacttaaataagtttaactaataaaaagtcaaacaacttaccatataaaacggatagagtaatttccgagcggtctcacctactagaccattgctaatcaaataacgtgcggccttacaaaagagatcatgagccatcgtatggagcccataattgtggattaacatggggggaaactgttttaatcactcgggtggacgtccacccgtttgttgtatgtcatctaaatagttatgaaaaaatttgaaaaaaataacaagatatattaatatttaatatttcactccacaaacatgcaagttaaaattcgacttttacaaattataacaaaaataacaaacaaaactcaaattactatacgtatgtttgcagttaaatttgttatttttgttacaacttgtagaagttgaatttggacttgcacgtttgtggagtgatgtattacatattgatctatcttttcaaat

SEQ ID NO: 67094 - DNA, 847 bp, Oryza sativa
cggtctctaaccattaatgtgccaaattactttcttactagccatatttcctttattagactcaatgcaacaaaaattttcctaataaatgcgaagagtcgactctatgccgttgtcatgcgtagcaaccatctttctctttccttcttcctctctcttccacgtcaccaaatatgcttacataacaataaagagagatcgctaataaagaccattgtacatgccctaagttttgcggtttgaggacgcgaataaaactcggtccataggtgagggatgtcgaagaacatttcccaagctgttatggtgacgctattgcaatctgggccgggctggcacagcccacatatatctataactaatataaatatttatatttttccggtcgtcacatctaattttcatccatacacgatccgattcggttagcaatagccatggaaaaaaattgcaaaaaaaaaaaaaaatcggccgccgccgacgcctccaccaccgccggagggagaagagaggcggcggagggagcgccgctgccggatccgcccgcggtggccgccaccgccgacggatccaccctcggacgaagccgacgccgtcgacgccgccattgagagggcgacggggagagggagggagagggggagggagggacgaccatctccgtcgtctccgccgcacccgaccgtcgccgcgccgcccgcaccccgcaccccgccgtcgccgtcgcccacgccataccccacacctcgccgtcgcccgcgccgtgcccacgggagggagagggagcggtccaccgtcgccgctgcaccccgtcgtcgcccgcgccgtgccggtggggctgcaggaa

SEQ ID NO: 67095 - DNA, 1036 bp, Oryza sativa
tgggtgatgcagttcgacggctccctgtctcttcagggcgccggtgcgggggtcacgttgacctcgccgagcggagatgtcctcagatacctggtccgcctcgactttcgggcgaccaacaatatggcagagtacgagggactccttgcgggactcagagtggcagctggactggggatccgccgcctcctggtgttaggcgactcccagttggtcgttaaccaggtctgtaaggagtaccagtgctctgacccgcagatggacgcttacgtgcgccaggtgcggcgtatggagcgccatttcgatgagatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggggacggacgcgcctgaacggcccccgaggcccgtcggagtccaggcctcggggcccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatgtccatgaaggcgagtgcggagcccactccgcctcacgcaccttggttggcaaggcctttcgccagggtttctattggccgacggctctcaacgatgcggtcgacctggtccggcggtgcagggcgtgccagttccacgccaggcaaacccatcagccggcctaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccgg

SEQ ID NO: 67096 - DNA, 1445 bp, Oryza sativa
cccaaagcatgccgggccctacctcgttcgccaagcgaagggcctcgacctccccggcggacgagtccagcgcgccctgcagctcggcgatggtgtgtccggtggctgcgaggcgggcggctaggtcgccgtggcccgcagccgccccgccgctgtgcgctctcgtccagctccttcgcccgcgcctcgagctcagcggcccgctgatccagtgcggccctctcggcgcgggcgccttccagattgcggcgcgcctgctcctcccgcgctgcctcgcggaggaacaggctgtccaccagccgctgcgccgcggccttggcctcctcgagagctcgctcccactcagtgagcgcgtcctcgcggaggcggagtgcggactcctctacggcgcaggcggcctcgtgcgccgccagtgttgcctcccgggtggcgacggcggcctcgcggtccgccaggtctctctccttcgcatcgagggcgcgggcgcgctcctccagcgccgtggcgcgagcctcaagggcctcttcgcgctgccgggacgccgcctcgttctccgccgcccgccattcccgggcagcggcggcgtcaaggactccccgggcggcgtcgagcttctcctctagctccgccgcccgcctcccgtattggaggcggaggtcgtcccgcgcctcgtcgagcacggcggtggcgatgagggcagtctcccgctcctcctccacctccctggcgatctccgccaggtctctacgacgggcctcgagctgtgaggcgtgccggcggtgtgccttgcggcccgcctccaccatggcctccactgagcgccgcccctcctcgacgcgcgcccacgccgcgtcgagctccgcccgctccgcctgcaggacctccatctgggcacttaacccgtccagtaccgtgctgttcgcggcggccaaggcctgcaggaggggctccacgctcagtggggcagcggaaggcagagaggagagccgcctcggtgtgggtgccgcgcggctcggcccaccgatcgacgtgccggactcgggggcgtcccccgaagctggctcgtcccaagcgtcgcccgaggggtcgggcccgagcggcgcgcccgcggcctcgtcgtgggtggcctcggaagtcgtcgtcgcctcgggcggagtcgggtcgggggcttggcaggccgcctggcgtgcgcgcgccgcctctgcctcccggacggactccccggcccggcggagtctggcctcctcccgagcggcctcctcagcctgcggacccggacggcctcctgggctgcctcctcggcttcccggaggcggtccgcggcttctcgccggtcggcttcccgcctccgggcctccgcggtcgccgtctcctcggcctcagaccggccggatttggaatggcgggggagggcgcgacgggatctcgctgaggcagaagaaagg

SEQ ID NO: 67097 - DNA, 1708 bp, Oryza sativa
ctcggtccccctcatcttgcggagccgtttcttctttcgctccccctcgggctgcggcgtcggcacggcaccttccgggcgcctgctgctggcacgcaccgccacgcccccttggggaggagatgggggaggggtaccctcctgcttcctcttcccccgggcgtcggcagggcggctgccccccgggcccccgtcacggggcccagaagcacgaccccctcccggggtagattgttcccccctgcggctcccgcccgcgccatcgtggcctcggggggcccgctcccccgacgccccgaccacctgcatgatggtcaggatgttggcgcgctctggatcgcaacaaagggggaggaccccttgggggatgagggatgcctccacggagctgagattcagcacccgttggaccaccatcctgaagtcctcagggtcccagtcccatttgcgcccctggtgggtcctcatgtagtcctcgggcccggtgtactcccaggcgccccgggcgcgccgctggagcggcgcgatccggcgacgaaggaagtcgccaaacaccatggcccccgtgagcccctgggatcacagacccaccaggcggtcaagaacggcgtcgtagccgtctcccagatctaccgccgcccgccagctggaggcctgcgccgggggctggctcggaagtcggaggcgcgcttcgtcggcgaggggggtgtagaaccaatcgctcttccagtcgtcccactttttgcgaaggacgcagggaatgtagcggttcagcacctgcccccgcggctggaagtagcagccaccgactaccgttggcggcgacaccggctgtacggtgaagaaccaccagaacagccgaagaaatgggcgcaccccgataaacatctcgcacaggtgcgcgaagatggccaacgtcattatcgcgttgggggtgaggtgcgccatctggagatcataaaactccagaatatccatgaaaaaagtagagaatggcgggaccagccccgccattgcgaaagagaggaagaagacggaccgccccgggtagtgtggcgccgggcgtccctcgcccagcgcgaccacttcccggccggtggcagattccggcatgaatcggcgcggcagcccggcctgcctctcgctcacgatgcgggaaggcggcagcacgctaccgtcgagcggtgcggagccccgtgccatgacgccggcggaggaggagcttgagagcgagcgagtgcggcaagggtagggcacaggaaacgaaaagttagagcgcaagtggcaaaggcaaggggaagagtggcgagaggaaggaaacgaatcccttcgtcggcgtctttacacccttgccaacgctatgcccggctcctcgtttcccgcgcccactacctcgccccctcgtttctcgcgcccacgcctccactaaccccactcgcccgtttgcggcgcacgcggcagatgtgcggccgtggcggttgagatggggcagatcgtgcgcgcattaactgcgctcgccaaccgcaaaaagcgccatcatcatgtccccaggtgaaacaaaccggctcgtcccgattcgcgcgctgctcgagtaatgtagcggtcttgaagatgccgctcattattgtcggtcggtttttcccttgccgatgcgcgcgatttgcgaccgttgggtttctgcccgcctgtggagaccggccccacctgt

SEQ ID NO: 67098 - DNA, 1122 bp, Oryza sativa
aaataaaacgaaatcgcttaatagatggtttctgaaatatgtgggtgatttgttgcaatgcggcgcgtttcataatatcaaaatccactacaacatttaatccgtacatagtgaaacatcataagtacactagctgaaacattataaaactactggttgaaacatcaaaagagaccatatgcaacattaaaaaaatcaataaaaaaactaaaatatttttttcaaaatataatcatgtgtggtcttgttttaaagatttaattgtaacgaatttagtgctgcaatcagatcgtagattagataaatagtttacaagaaaaaaatcttttgaagaaataagagatgtgagcatatgggtaaaagattctttgaatgtaatgacagacacatgcatatcgatttttctccccttccgtcgaacgtccgacacccagcattatcctaaggggctccatatctttaaaatgcctacgagcaaatgtgcacagccacattgatcaactccgacacgcgtaaaaacagaagaacacatatcggcggatcggccatcatcttcgttcttatgatggaacaacaaaattatgtcattgaacaagtcggtgacccaaatctcacagttagcgctgccgattcaatcgataacccaacagataaaccatactatacgtctttcatagtttcattggtgaccatctggccgtggctggtgattttagtctatccggagtcgtcgcctacaatggaatttcacgtcgaaatcatgtacagcacagatgtaggagtactgctacatttttcaagaatgtgcgtgtcgttttgcaatgccgtggagaccagttcagcgaattagtcagcaagtgtaagtgattgtgaaaatgatggaactaatgtccgtacatatgagtacttgcatataattgttactccatctctgtttttctgctctaccatgatgatttaattttaaaatgaagtccttttttttagttacggcatgttcatttgccatgtgcaatttatgttagagaggtggtcaaagtagaatacttgttgatattaattagagtatagtacttgcttacaaaaattgtcgcaacgattctataggttctagtgatttag

SEQ ID NO: 67099 - DNA, 3632 bp, Oryza sativa
gggacgcgctgccgccgcggcgccttcggcgccgcgtgcggctgctgcggcggcggcgtctggcgcgactcccggcggcgcatgaaccctggaggcgagggctcccgcggggggcggcgtgcggcgggcgggggatcgcgccggcgctccagccggtcggccgcgccgtgctcctcctccggcccccgcggctgcagcttgaccacgaggctgctgaggaggggcgcgcgcggcggcgcggggtcggggcggcggcgcgggcgaggggaggaggagcgcgcgtcggcgtcgtcggagtcggaggcggaggcgtctctgcggcggggccgcatagctgtgtgggtgtcgggtggtcgtcgggacgacttggtccgagtcgcccgactatacatacggtggttgggtcaagccggtcaaccccgtgggttttcctcattttgaatggcctgtttgatttttatttttatttttttcgttttggagtattctgcttttggatttttgaattggaccaacaaacgaattcggttttagtttatgtggataaattaattcggcccgaaaatccaactcacgagcaaatgtatccctcctacttccgatgaaaaaaactcggcctaaagcagaattcagcccatttagtttctcacgaaaaagtaagcccactaataatacagtccacttaacagccgtgagaaaatccgtacatgaatttggcccactctgttcaattaaagctaatcagcccgcttaccaattcttgacgaagaattcggtccactagtgaaatccacgtaacatagttccatcaacaaataagtccacctgtcatccctcaactttacgagtacgtatgacattcttaatcctcaatactgggaatctcttcccctcaactgttcaaaaccatgcaaagtagatcccatggctgtaaagcatgggtggtttcgctaacatggcatcctggtcagcatgcagagaatacaaataacatgtggggcccacatgtaagtggcctagccacaggagatttcattgccaagccgcacccaacatattgcctcatgccggtgctcctcctgatcacccacaccgaggctgccgcggcatcgcgatgccctcaactcctcccacctcaatgtccgcactggccactacaccccactccccgctcaagcagcccatcgctaagcacctttgctacggtgtcataaacctcaacaagccatccaacctcttgtcgcacgaggtcatcacttggaacaagaacctcctccacatcgagaagactagccacaacgggacccttgaccctaaggtcaccggtaacctcatcgtatgcgtcaatcgtgctacccgcctcgtgaagtcctggttaggtgctagcaatgagtgcatctgtgttgcgtgcttccacgccattgtgcccgacaaaacgcatgtcgcgtgcgcttgaagagctcattggtgccatcttctatcgctcgccgctcatctccactagtccaccgtcaagtgccagctccgggttctagatcaccactttgtcatgttctagatctcttgcgatgcaggtactacgttcggatgctctgagcagttctggatcatagacggcgaccttgtctccttccgagcaagccactcccctggatgacagtggggatttttccccactagctgacgagggctatagggttagatgcatgcgtaggagggggtgttgaggggcacaactggcgacgcgaaagagggggtggctttgttggcacggggaggggacgacgtggatggggtggtcggtggcagcccattgatatggaggagacatggagaacaaatggggaagtgagggagagaggaggaagaaggagatgccactgacatgtggaccccacatatttttttttattctctccttgttgactaggatgtcacatcagcaaaactaccaatgcatattaccatgggacctactttacacagactacacagttttgaacacttgggcagtaaaagatttctagtattagggattagggatatcatatagactcgacgcaaagttaagcggcggaagtggacttatttccacgtattaccacacaagtggatttggcccacctattttagtctacgaattaggcccacgtaataatttggcccactaaagttggcccataccaccaaatagcccaccggaataggcctctgattcctcgccacctactagttcccccccttcccctcggcctccactctcctgctctctctgcccgcgtcgaccagcgcccaggtctccacctcccgcttccccgcgacgcgagagccaccggcgccgccgtcctcgcccgccgcatcctcgccggtgagcgcgcgcacgcgcatcctcctcctcaccattcctttcctcttcctgcctcaaactcagcttctccggtagatctgagagcttctctcctttttggcttaaacagcagctttgtttcgaacgaaatttgttcagctgaggctccatccatgccgcccgttaggtccgcaccagtggctcctcctccgcctccgccgccgccgcagcagaagaagccggcggtcccggtgtcgaggccgtggccgatgtccttcacaccgcacccaccaccaccaccgccaccgccgtgagaaatctccctctggaattgggattttgtggttttgcatgttggtttgtttctacttttggtataggagatcagtttaggtgctttgaattcttgtagcttgtggtgtgtgtgtccttttccgaaggaatggggtgatgctgaaatatgttctgtttaaacgtgttggttacattgaatctttaagtctcatgattcgaatgttattgtaagcagccagttgttcgactcatatgtgctaactctgtcttttttttttctaataagatttacctaactccgtgtcattttcattggtaagattgcccggcgttcattcctttatctaagaatgttagaaatgagtagttgagctcagatcgaccattagtgtctgatatggtgacatatgccaatgtctataaatgtgcatgcacataagcatgttggtgcttgtgaaaaaacaaatgtgattgtattggtaatgggttatcacactttgccctaagtgaggattgatgcctaagcatttctggggtgaagttcgatacatcgtgttgaaaatttggggatattttaagacctaacatagaccatgttatttcatgtgtctccattgtttcatgtgcttaatgaataaatctatcaaaatgcctaatggtaacttacatatgcgatcaagattgaaagaaatctatttctgagagctagatcttgctccactacaatacatggatgctcttccttttttgcctttcagaagagagttcttagccgttctgctcttttgctcttaacttatcctaaacaactgattcattgtctatttattttcgtttcagaactgtagtgaaataatgttaattgtagatcaactagttaattgataacaaattaccttgaacttttcatagagtaaatgcacttccaagttgaaatcaaattcattaatattttccaagaaatgtatgtgtttcttttgcattgatctag

SEQ ID NO: 67100 - DNA, 1068 bp, Oryza sativa
ccaaaacatgcatgagctgaatgaattttatatagatgaaatgaaacaaattcaccaacagctctgctttatttttttggtacacacctttcattatcttgcttcggttgtgacaaggacttaaaaatggccatgatagtgtccctctattccatttttattttgataaatgagtttgcaatgtaagtttcaatgtggtttactggtatggttttatgcataatctcatacacctacccctgattgctcaatacagtcagcatccagagctttcatgtcatattgacattattccctgctttttatagtttttcatttttattttgaattcacgcactttattttgtccttgaattgaatgtacatttctacgcaggcacaatgtaattatgctcttcatttcatttacactgcaatactaaaatatttgtttacatggtttaagtaaaatataaaataccaaagtgatcttggatttgtgggtaatgttttataattcttaatgttccattagtactaattaatccattcattttttttaatgtcctcttgtcccatcttttagcaggattctggaaattaaacactaaaaatgattctaactccaatgtttaggaataatttgttatttccccattaaaatgccaagtccattttttttttaccttgagctacatgtgtttatacagtcttatgtgactttcaggataattctgaagcaatacctccgataccaaagcacaataagggctgtcactgcaggaagtcagagtgcttaaaaaagtactgtgaatgcttccaagcaaacatcctatgctctaagaactgtagatgtcaggactgtaagaattttgaaggaagcgaagagcgaaaagctttagttcaaatgaaaaatgcatctgatagaaatcacattcaagaagcagctaactttgctctgaatggtgccactggatctttaggatacaaaaattctccagtgcgtaggaagaaatatcaagaaaattcccttggagaacaaattttgtcagaagcacaatttcaaccggtatgttctaattggtatgg

SEQ ID NO: 67101 - DNA, 1126 bp, Oryza sativa
aaaacggagctcgtatgcaaatttggcagccgtttgaagtcagcagtgtagcaagtggccgaatcggattccagcacttggaggacttgatcttgatatcatcttgttcattcatgatgtgagcaatggttgtatctgtagtagccatggtcacatcacatgtggtcaatcctccgttcatccccgtgccttcgtcggatggctccaacagtggcagcagttgtttatccctcgactacctcttgttcacggacatttgaggcacgtaacgatcactggcggtcaagctccccattccccatcccacttcgcttcgtccctgtcgtgtgaagctcgtccccgcattccaccggtggtgatagagggcagcagggccccaaatcagacgagtgacgagactcccatcaccgagttaggctgcttcttcatctgcagcttcctcctgctttctcagcctacgcactgcgatccctaagccttgcaaccatgggagagggaggcgtgaggcagggccgcgaggggaagaagcttggcgacagagtccatctcggtgtgatgggcgagttggagctagcgacgataaagaatgacactaacaggaggtcaccgcagaaagagatggggtgcatatgagggaggagcggggaggtcaacaagctccttccacctcctctggacgatgacgctaccatcttgatcctccgtccactaggcccatcgacgactgtgaccccgacgcctcctacccttcttcgactaagcgccgatggcaacatcagcctagcaacagttgtgtcacgcgcgacagagctagcgccctgtccccatccctccccgcagtcgtttgcctatctatctctctctctctctttgtcgagatagagggagttggagctataccaaacaggacctaaaagacaagagaggatgggatgtggacacattgatttttttttctcttgagatatatatgggtcctacctttttaaatttcgctttttttccttgactgaaatgtcatttaagtgccacttacatgacaggtcaacgtaaaagaccgggttaaatgtcacgtaggcaccatgtagggcaaaaccatttagggaggcaaattaatctagtttta

SEQ ID NO: 67102 - DNA, 4329 bp, Oryza sativa
agggttagggatttcaaaatgatctgagccgtccatcaaaataaacggctgagatcgatcgaggatttgggccgcaccacttgggcggcacgcgggccaacagtgaacagtccagcaagtgagaggaagagtatagggatataaattagactttgtttgcttttaggctgaagaagaaagtgggctgaaaaaggcccatagagataaaagaatttttatttaaataaatactaaaatgatatttgtattatcaaaattagcaattaaactacgtaaattccaagaaaatttcaatgagtgtaattaatgatatagaaaatttaataaaaattaaatccaaccataacattttatttctcacacttactttacttataaattaatttaattatatacctacctacttaaaaaatacccaaatattgcagaaaatttatatttcatttaattagaatttaatatgttctaattcaattttatcacttactttacttataaattaatttaattatatacctacctacttaaaaaatacccaaatattgcagaaaatttatatttcatttaattagaatttaatatgttctaattcaattttatcacttcctgctgttcgtcaacgggccgtgggggaccagctggggccaccgccattaccggcgcttctccgacctcctcgtctgcgagccgctgacgcgtcggtttcagggcatcgcccgcatgccgccgcctctgtggagcttggtcttctgcggcgcctacctgatcgacggcggcggcggggagcgcggcgtcggcatgtcgaactaccgggtgctctgcatgttcggcgagctggcgtgcgtcttctcgccggggaacgacggcggctggcgcttcgtcgacacgggcttgaagtacggcgacggcgaggacgtcgagttccccgaggacacccagttcgtcggccgcgccgccgggaagatctactggtgggcaccgggtgggctagtgcaggtgttcgacgaggccacggacaccttcttcctcatggagttcccgaagcacatgcggtgggagtaccacaagtccaacctccgggtgatcggcggcgtggacggcggcgggatacgcgtcgtccgcatgaccggcgaggacctggagatctacggcgagagcggcggcggggagtgggcggtggagaggagcgtccggctggccgaagccacccgcgggctgccggggcgtcaggaggtgttcttcaccgcggaggcgccggctgcgaggatcgtgaccgccggcggcgacgggttcgtgacgctggcgccggcggaagatgagacgtggctcttctccgtcgacctggagaccatggaggcggagcgcgaccacgagaggaacaagcacgtcggcgaggcgcacccgtgctcggcgccgccgctcgccgccgtcttccgtgcttgcggcgtaggtgacgctacgaggacggaaaaaagcggaagccgccttgaaactgacgacgaactttagagagtttattttgaggaactggtcgaactgacttgtgaagattcatgtaaaatccttgcgtttcaaagctattattagttttaggaaatattcttagttctaggaaatattcatagaactgatttttattggtgcacggtttattacacatataattatgagtggtttaagagcgctaatgaccgttcttagctctaggaaatattcttaaatatgtgattaattataacatgctacaaatctaactgcatcgttgattatgtagtaagagattattttggagcttttcaataattttgttgacaatgaaggactctcgcgtcgctctccccaggggcggccgggtcgtcgagccgcccctctccccccaccccaccccccttctccgcctcgccgtcgcccgagcggccgccggcaaagccgcgcggccgcaagggcggcggcggggcgctcctcgtctcctcgcgctcgggcggcctggggagccgcccggagtggtgacggcggtgaccgccagatccgcgccgtttcggccggatctggcgggatgggctggcggcatggacgggcgacggtggcggccgaggtaagtgcaccgggtggtgttgtgggtgatggcgacggcgttggggcggcggcgcggcggccggcggtggcgtgagcacgcaggcatcccgcggttgccgctggcgtcctccggcgccctctaggcgtcggccggcgttggtggtgaggggggcggccggatctggcttccttgctcagatccagcgcacactcgggtggggacggggtggtttggaatccagccgtcgtgcagatggtgtgaatattgcaggtaccctcggtgtgtaggtgacatttggtggctcccgtcatggatgctatggttgatgggtgctccaaggcaaaagccttgctccgctctcggtgctagcaacggcgacgcccttgggcgtcgttcaccttcttgaaggcgttgctactggagccctcgttcaactccacttcaagagtttcctccgggtgaaaactagattcgttataggatcggacgatgtcgccgttctgtcggcataacctttttgaaggcttcgttttaggagtttatctcttgttgaacgactctacttaggttcagtttgtcaatgtcggggtttttgtcggtttttctttaattaaaccgtgctgttgtaaggtttttgggtccggtttcccttataaaatggatcaactctcttcttctatagtgaattgtatgagctccctgcctgtcccctcgaaaaaaaataattttgttgacaataagattgattaacacaaaattaataaggacacattggcttactttgttcacgctttgctataagcataattgctacaatgataggttgctcatgagaacatctcgcccatttagttaaatggtcagtaagcattttttatccttttaatgacgaacttcacaagtttgaagctgcataaacataaataggacaaatgcaatatgagaattataaatgcatgttaacaacttagtaagttgaatatatacattacaaataattgcaaccacaaacagttaatgcaatagtgttatgcatgaaatcgttgataccggtcaagcatagttgatgatttatgagaggcttctaataccgagcctaaaaaagttcttcccagttaaaaagatgatggcagttcagaaatatagccttatagtctaattacatgtgtcaccaaaggaaggaaaatttattactgtcatactaactatacaagctgatcaattactctatatcctaccactgtacaaacagagatagtatattaatatagatattttagccctctgataacaaatgtaaggggatttgaaaccaaaatatgtacacacctgccatcaatcataagaacattcctacatgggatcctccttttgtagcctctatagagcttacaaacatgaccattccaataacatctgccacatatgaaaagtgtgttaatagaacttctattttgtcacaaattaatattgtttaggtggtgaattgaactacttaccaacataaatgtcattatggtaagtaaagtcagggccggttcaacaatttcgagggccctaggcgaacttgatactatgggctcttaacaagttaaggctaattttattacttctaatcagtggcggatccaggaattttttttaagcctgggtaagcctaacaatgaacaaaagtacatatatattggggcaattgcttatttgacctcgttttgaattgtaattgccgatttgaccctactttttgaactttgcttatttgaccctcattttcgagtacgaagctctggtctgaccctattccgtttgtgtgaggtgacggtgttaattttggggtaaatagtccattttgcccttgcttatttggccctgttatatcttgtttgtttgcttgtttgacctaaagtttggataatataaaaaaaaatctctttccccggcggcggcggcggcggcgcacccgcggaggaagacggaggccggcgcgcgctgggggggagagagcggcgccctgtgctcttcgccacagcgtcgtcgtcgtcgttgccgaccggtggcggcgagcgcagaagaagattgaggccgacgcgcgcggggagggagggagcggctccctgtgatcttcgccatggcgtcgtcgtcgtcgttgttgctgacccggcggcggtgcgcgcgcggaggaagacagaagccggcacgcagacggagggaggaaggcgctggagcttgccggcgtgcggagggcggacggc

SEQ ID NO: 67103 - DNA, 3576 bp, Oryza sativa
aaacttccactgaaacaacccaaccaaggaagtaactacacagtacaaaacattaaacattattacaaagcttcaggagtcctcaagcatcgagataatttttattagattcgcttttccagatagcctatcaacacgaagaatctgtacccagctgaaagatattacatttcagtggattccattccgatgacgggaaaggacacgctggtcaccttgattgcgaataggaaacagatcatcctcctgcctgtaaccatggccacggctattgcccaaattatgaggtcgcccatgggtgtcaaatggatgaacatagtctcggtcaggtccacctcttccaatggaggctttgttcaagggcctgtcccgaaagggtgaacggcttctctcccgtaagtctagtcccctgttcatgggcttgttacgcatgggtgaatgacttctgtcccgtacagcttgtccccagttacccctgggagaccccaaccgtggttctcttcggtcaagatatggtccatcgcgtggatgctcccggtgattatagccatcccagtcaaacttcccacgctgtcggtgtggaagttcatccccgaagttgatcctgtccctgtgcatagggtctgccattcgtcctggacgatcttgggacaactgcgtagaatagtccctatgatcatccggtcggaccataccccaaccacgcggtggtgatctatacctttgtttctcccttggcagatcacggccactcggtggaccaataaccctactcggtggcccttgtggtggagagttgaactggcgtctgtcaggactgtagctggacttgtacatggcaggtgcatagcgttccttgttgcagttgttacagtgagaccgccgagcaaaattaagatttccgcaactgaaataaaaaaaataatgagtaataaatttacaagaccatcagaagaatctatttcaacaaaggaaagaagaaacaaatatacattcagcatactcacgtgggattctgacatatccagtcaccttctcttggagacaagtttgggtcattcctgtgcacatattctccattaatgaagatgaaatcttttccaggagcaccaccatccctcctgtgtggtcttcctcttccattgggaggagaaacatattgtaacctttcacctcctttacttgccagctcatatccataacgtgaaccgtcattgaaattgctgctttctactccgcggccacgtggaggtatcatggaacctgagtgcgggtgatatcctgaaaggcgagcgacaaacattctacatgaacattagaagccacaaggagtaacagtcagcaagtaggacttgcatcatgcatgagttctgcaactcctgaaggtgaactgctttcagcaaaggccctcaagagtcaaaccagaaaaaaaatgcattgcagaaataagcctctgaaaataatttctgtcaagtaaacagcacagtaattgaaggtgaactcagcaccatatgatcctgatctcttgtctggtttataaagtagttaaaatatcaacaatgcagcaacccacatttgggctcgccagtcttgcagaattcacatgttcctaaagcctggttcatctctttatccaattcatatcatataggttaggcctcctggagcatgatctaatcctctgcaaggagttccacccttcaatttctacaatccgaagaaacagacggacattccagaaacaagtggtgtcctgagctattttccaacttaccaagcactccttccaccattatttcccccgaatctcaaatgttatttttagccatgcactacaagataaaccagagatctttggacaatagatgaactgaacatctccattctccatgtttccatggatctttttcttgtgtgccaatcgttttgtagtagtgtaagcagtcccaggtaactaggcatctcaatatccaattcacttataaccaagtccgcaataccaaataccttcattttcaacaacattttccttgggcagatgctttcttaagcaactaaaacaccctagtttatttctataaataaggtaatcaaggccttatctatgaggaagtagctataagaagtgaagagctcaaatcccataattctgtctattttgacaagaacttggatgaccaggcaacccagagtagtgattcctaacagaatacttgcattggaaccatttagcattgaacaaccaaaatatagcaaaccaagccattcaaatattgtcaagtgtccatctctcatccttcgttttctttcatgtttacacctccaatcttctcataacttgccaaatgcatgactcggtaaagacatttccaagtgagaagtggcatctgagcatagacagaacagctcagcagaaaaaggcagcaaatagaatacgaacccatcaaataataaatgttcaataagtaaatactaatgtcagaaagaaaaaaaaaaccaccttgacatgttatcacatacaagatatataaaaataaaccgccacagtatattatagtaattacaccagccatggaagccatggaaaaatatagataatacacacaacttatcaaagcagtgtcaggtgttagatatcaacattctagtttctgacaaatagcaaagtaactttgggcacaggaaaaacacatgtaaaagttcataccacttacactacatgatcatgtgacaaaaaactaaacttggtggaatatgtaacataactgaggataatagtagttacctcatgaagaagcaaacagcctttgcttaaacgtagctatgataaatttttatttatagttgctctatacaaatctttatctttacctatttacaaaaaaaaaaaaaatgtttccaacttcttctttttttcgtttgtccgtcttcgtgaatttttttctgtcaccatgaccgacatggattatttttcctctgtcattcgtacggaaatcaggcagcggtacaacacggtgaatccaaactattcgctagagcccaatgggctcatactctggtgctgcttgttgcatggcaggctgtgggcctgcctgcccaaggcaaggatgcagggatatggaataagtccactttgactccctcaaatataggatcaacctaatttgtatccctcaactgcaataccagatattttgaccctccaactattaaaattaaaactagtgcaaaatgactcttggtggttttgagggtggtttttgctaacgcgtctcctctcttagactcctctctctctttttttctctctactttccccacatagcggcctaaggcaaagcggtggcaggacagcctcgaggctcgaggcagagccgcggcggggtggcctcgaccctcctctgagtcctctcccctcttcctatgccatggcggccgccgaggaagccatgggcggcgagcgagcggatccaagcaggtcacgtcatctaccaccggaccacaccgctctcctgtggtgtcagcctaagccactggagcacgtcgcgcgcccttcctgtagggcgagctgtgcgg

SEQ ID NO: 67104 - DNA, 759 bp, Oryza sativa
gatggcgcgctctcctcgctaggagataattttgttcagttattttaaaattgtctttatccgttgcaacgcacgggtaatattggtagtaaagcacaaaaatcaaagtagaaatccaattatgtctattccacagtactgtgcttgctatgctctgggaacatgaatatcaaagtccaaactgtgtatgtcttttcatattttctaagctactatgcaaaatttgttttcggtagataaatttcagctttatttcacagagatagttattggttcaagagttcaaaaacacccctaataaagtccatacagcatagcacttcatacttggcatatagcatataaactttgttgtgctgtttggaccagattgccattagcttttcttttgctttgctttatatcttttctgtagacttcttctaagaagctccatatatcatatgtgtcagccctgattagctctatcatattcctttgatctattctttgctcctgtctcactcaatacacccatcaaggaacaagttatctctaataaatagaatgatatatttttattttatgagttccattaaagctactcaaatatctcgtttggacattatagtgccatttcgtaatcatacacttggtaattactgcacgcaagttaaaaagaaaaaaagaactagagttttttttttgggtcgttgttatgaattgaaatactcaggatactacaattttattttcagtaacttcaggggctgcaggaat

SEQ ID NO: 67105 - DNA, 1014 bp, Oryza sativa
ccaaacccgccctgactccctccctctaatctttcatagacatcattgatgatctccgaaaacgggggttgtcggtgtacgaagtcgctgccgacttcgtagataggcggattcaaccgctgcaggcccgcgcccatccggcctttgattactctaggccagaggacacgacccgggtctctcctcggggtatttttttctcgtatttctaattttgttccgagtgcatccgtttctcctgacttatcgagttctcgttctcgatttacaggtctggacagtgacaccgtggaacgccgtgtcggacaggtgatgatgagcgccccctcagcggcggacgacatccccgtctctctttgcgagaagaacccggccgaacgcatcgctgcaattaatgtgagtgtactcgatgattcctttacatctttcttctcgagatcgcgttgtgacttcaagttgtgcaggctctccctctgacggacgtcatcgggccactcgtggaccaccaggcggcagcgtcgttgaaggaaagcgtcgccaaggaggcgtctgacattgttgttgctgccaccacgagtggcagcaatgttccaaagaggggaaggaaattctccttcgtactcaggacccatcggaaagcgacgaactctgcggtaagcctctctctcgttctttagcgcgtagtcggaacgacttgacctcaccccatttcatcttactcaggactcggacgcgtcccctctgcctcagcgaaggcagaggttcgtgacgatcggcgagaagtaagtaaacgttcttgaagtcttttcattctcgaagttttgatcgcctagcctcatgaagagaaggcaaatattcgcaggatggcgcgggcgaaggtggcgcaaggcaggactgatgctgcttccagcgcgtcccctacggcaacctcgacaggattcgtggttaccgctaaggaccaggaggtgacgccgagtagccctgtcgtcagcctcgtgcctacccggagcctgt

SEQ ID NO: 67106 - DNA, 5250 bp, Oryza sativa
ttagaaaacttatcatgtttatagcctaaaagaaattaatttcgaattgcctgtgtaattcttcgtgttacacaatactttgagatgtaagatctggctgctctgcttgacggagatgagatagagttggaaatgagggcatcttgctaattgtattactccctctgttccataacataaggcacaactattttttaaaaatgtttcataatataatgcatacatgaatgcataccattaattagcacttctttcccactaaattattattattttagtcatccatcctcaatatcttaaattctattagatgcatacattatatttataattagggtgattcaaactataagatgataataattatttcttagtttttaaattgagggtggttgagccttatattttgaaatggagggagtattagtaaaaacagttttactaattagaagcaataacatattcttgcacaacgaattaatggcatgttcagattgtagccaaaataaacctcatcaaaattttggctatgtatttaccaaatttggcaacaaactaaacgtagacattttttttagcaattttaccaaaaaatgatatggttgaaaatgacatcaatctgaacagtccctaagtctcggatataaaagggatagacgccaagtcaacggaaaataagggggtgtttagatccaccggcaattttttttgtctcgtcacatcgaacgtttgaatacatgtacagagtattaaatattgataaaaaaaaaactaattacacagtttgcgtgtaaattgcgagacgaatcttttaaacctaattgcgccatgatctgacaatgtggtgctacagtaaatatttgctaatgacagattaattaggcttaataaattcatctcgcggtttacaggcggattatataatttgttttgttattagtctacgtttaatacttcaaatatatgtcagtatatcttatgtgtcccggcaaaaaaaattttcccgtggaactaaacacagcctaaatactagtaccttcattctccaaagaataatattctagacatcgatacaatccctcaatctctatcaggcatgttttatctctttttttcacaagctatggtgttcgtttctgctaaagatgaagatgaagctaggaaaaaaaaacaagaaagtcattagcgcaaaattaattgagttttaattgttataatcttgaataatagatttatctgatatttcaaaataacttctctagaaaaagttttcgtatggaacacatcatttagtactttaaaaaatgtgctaatggaaaacgagataaaatctaaatcttcacgagaagaacataaaatgtgaagaatgtaacctgtgaaggagttcttcaaagaaatctattaatattattgaggtttgaccgcacatatcttaggatttttttttcttttcagaataaaggtacaacaacttgatattgcacaatagacctttgcttacaccgaaatagctattcttacgactaacatctgactcaactagttgtttagacacatctgctattttcctgggtccatatggaaagaagccaagcgcaaggattagtggatgaggcgaggtcagatgctaaagtcatgctcgtgaatagtaataatcaaaatgaaggcagcatcagaaaatgaaggctttgtctgtgccattaaggcttgagcttagagcatctacatttgtaaaaaaaagaagaagaagctaacattaaacaataaatgttgcaacaattaatacaacatatttactattgtggaaccataagacgtgatcacaaggcaataaatatttttttattactagcacatatactcgtgcattgcaacgggacaaaaaaagaatgcttgaagattaagttttttacgcaaagcgaggtggtattaacgtatgattgattgagttttaattattacaaacttaaaaaataaattaatatgatattttaaagcaactttcatatagaaagttttcgcacgaaacgcaccatttagcagtttgaaaagcgtgccacgaaaatcttaatctttatccaactcttgtcggagaaaagaacgggacctgagttgagaagataaacatggttctcgacagatggagtgaggtgttggtatgaaagagatgagtgatcgttctaaaaaaatacctgagagtttcacatgcaaaggtgactacagatcggatgtctgatcttttagctaaaaatcggacgcccatctcaatctccgccaacacatgcagacacaccaggactaggtgcagcccactgcaagtatcggaagccatgcatccatactagaaaataaaagttaggttggtttaagtttctttgagcaaactttaaactttttttttcttaaattacttttctaattcatgattcgattgcaccactaaattcattgcaattaaaattttaaaacacgaccaaacatggctatgatccaatgaaaaaatatttagctttattcatgaatttttttaaatgttgcacctattacatttaaatgtttcagctagtattcataagatgtttcactatttaatttgcaaattttgcacctattatatttaaatctttcagctagtattcatacgatgtttcactatttgatttgcaaatgttgcacatggtgttcttggaatgttttagcaagtattttatatttttttaataattatagtttagtgttcatatgtgatataaaaatatttcaacaacatcatgttttataaatatattgtatctctgatatgattttttttgttttactcattaggactcagtgtttcatataagtggttgctagtgttgcagcccaaatttttaaatgttgtatttctaaacatcgtttgattttttatcaaaatataatcgtgtgaatacaatgatgtaatcatatgtagattggataattattttaggagaaaaaacatttaaaggcggagaaaagggtgtagatgagtaaaaaaaattatatgtggacatgtatgaatggacatgacatgacatgtgcaacatacactgtgaatgagaaaagaaaagatttggtgtttcatatatgatatatctggaaacgcgaaggatttggtgtttcaaagttaggtccaagctaactgtttagtacggatattaaaaaaaacaagaatcttgtcgatatgtaaaaagtgtgtagtattatacataattggaaacggtcttgtgcagcgtgctcatgcgaggcggtgtgcgaggcagccgcgagcgggcagtgcatgtggcatcgaatggactctggctgaatcagaggggaaactgttttgatccctcgaggggatgcccctcgttgtttgcatgttactcaaatagttataacttttttaaaaaaaataaaaaatgtattaacatgtgatatatcactccacaagcatgcaagtttaaattcaacttctatatctcgcaatgaaaaaaacaaattaaactacagctattaatgtaattcacagtcaaatttgtttttttcatttcgagatgtagaacaatataagttaaatttgaactcgtatgtttgtggaatgatatatcctatgctaatacatcttctcaattttttaaaattattttataactatttaagtgacatgtaaaaaaataagtggacatcctctctctcaatggatcaaaatccactcccgaatcagagtgggcgtgcacaaatcacggcgcccggcaaggaaaacaaatcgcgcgcggctgaaatggactcggacgcaatcgacggttgaacggcacgcgcgtcttggacgaaatcattgcgcgcatgccgcacacgggacgacgtacaaaatccctaacaaaaacatcttaaataatatttatagtagtagagattttagtatggaacatagatttatctcgagcgatggagttcacgagactgttatttttacttggtgggaccgacctacctttacttcatagcagaagattgagctagctatactgaccttattattgtattatattgtggtgtacatattttttaaaattatgatacaaatgaaaacacataatcgttataatctgttttaccaatcgaattacggttgttacatatcatatctctttcacctgcttcatttatttaataatataataatactatcccgtatcatttaaggtatatatagagttaaagcagtttaattcaaggcacctatcaattgggcgcctgactgttttaccaagtagatcggatatgttttactaaatagatcgaaaatattttagtctttcaaaaagctgaaacacaatcaaatcatctcataaaacattttgttacaacgtatgaaacaacggttttcaaaaaatcagacgttgtttcaccttatataaaaataatatttcagcaaatagcaaaataatgtttcaattcttaaaaaaattgaaacacggtcagatcgctagatgaaataatttagttcaacgtatacaacaaacgatttgaagccattgtagcacttaaattccatatacatcaacaaaccatgtgtccatcaagatagaaaatattaaacagtataaaaatccactgcaacatttcatcaatgcatagtgaaacattacgagtatacttgctgaaacattgttagtggaataaaaaaagaaatggattctcttaataggacgttttcgtaatatgtgggtgatttgttgcaacggcgcgtgtggtggtgcgtgtggtggggacggcgcggatgcgcgtcgccccgcgcgaaggggcgggcgcccgatttgaggcatttccgggtttaatttgtcaaacaccgaaatatctatccaagaaaatggttgcaccatcatccatcgcaacatccaacggaggctaactatatggccgagatcgaccggatcaatactcgatctgttcgatcgaattgggtcaccatctatcacttgctctaccaacgccgatttttactgcatgattcgacgcgaatagacgccgacgacttcacgtagacttcaacaataatccagattatttcagaatcatcatctatatatgttgtagtaacattgctcgattaatcaccgagctaattaagctgagagcccgagatcttaattaattcctagaagctccggtgcattggcgccatgatgatgatgtgcgcaggtggtgcggcggcgatcatctttatgacggcgctgtcgtcggcgg

SEQ ID NO: 67107 - DNA, 2054 bp, Oryza sativa
tggtagtctatcaaacctgacaaggttgtttctgcataacaatctcctgaatggaagcttgtctgaagagcattttgctgatttggtgagtctggagtggatagatttgtctctgaacaatctgtcaatggagatcaagccaagctggaagcctccttgcaaattggtctatgcttattttccagatgttcagatgggtccccatttccctgcatggatcaagcaccagccaagcatcaagtaccttgatatctcaaatgcaggaatagtggatgaattgccaccatggttctggaaatcctattcagatgcagtctacctgaacatatctgtaaatcagatcagtggagtgctgccaccttctctgaagttcatgaggtctgcgctcgcgatatatctcggatcgaacaacctcactggcagtgtgccattgttgccagagaaattgcttgtcctggatctctccaggaactccttgtcagggccatttccacaggaatttggtgccccagagctagttgagctagatgtctcctccaatatgataagtggaatagtgccagagactctttgccggtttccaaatttgttgcatctggatctttcaaataacaatcttacaggacacctcccaaggtgcaggaacatatcatcagatggccttgggctcatcactctcatcttgtacagaaacaattttaccggagaatttccggtgttcttgaagcactgcaaatccatgacatttcttgatctggctcaaaacatgttttcggggatcgttcctgagtggattgggaggaagttgccatctttgacacatctgagaatgaaatcaaacaggttcagtggtagcatcccaactcagctaacagagcttcctgatctgcagttcttggaccttgctgacaacaggctatcaggctccatacccccttctctagcaaatatgacaggaatgacacagaatcaccttcctcttgctctgaatcctcttacaggctacggcgcatcaggcaacgatcggatcgtggatagtctgccaatggtgacaaaggggcaagatcgtagctacaccagtggagtcatctacatggtgagccttgatttgtctgacaatgttcttgatggaagtatccctgatgagctgtcatctctaactgggctagtcaacctgaacctgtccatgaaccgtcttaccgggacaattcctcggaaaattggagctttacaaaagctggaatctctcgacttgtcgattaacgtgctttctggtgaaatcccttcaagtttgtcagatttaacttcattgagtcaactgaacttgtcctacaataatctatcaggaagaataccttcagggaaccagcttcaggctcttgctaatccagcgtacatctacattggcaatgctggactttgtggccctcctctgcaaaaaaattgttcatccgaaaagaacagaactagccagcctgatcttcacgaaggcaaaggtttatctgacacaatgtcgttttaccttggtcttgctttgggatttgttgttgggctttggatggtgttctgcagcttgctgtttgtgaagacatggaggattgtttactttcaagctatcaacaaggcatatgacactctgtatgtgtttatcggtgtcagatgggcaaaattcagggtagacaaaacaactactacatccgtcccaaaataagtgcagccgtggatatccgtgcccaacgtttgaccgtccgtcttatttgaaaaatttgtgaaaaaattaaaaatatttaatcacacataaagtactattcatattttatcatctaatagcaataaaaatactaatcataaaaaaatttcaaataagacgaacggttaaacgttgaacgtgaatagtgcaaaactacactttaagacggagggagtacaagctaggtagatcagtcaagagacaataatataggccacaaatgaaagtttaactgtgttatctctcatggtctgtttgtgtattattcattgctttctaacatttgaatacatcaaacttatca

SEQ ID NO: 67108 - DNA, 2456 bp, Oryza sativa
cagcttcacacgaatgcataataatataaaacttgaagttgtttggtattagacaatgatgtaacagaacttagcaataaacactcatttggaataccttatggtggaattccaagtgctaaagttaaacaccacgttataaagcaacataaatttattttgatatatacgccatgcagccctaccctacataaggattaaataaggttcatgtttagatatcagaagtgttctgataaaattttaagtccatatgttatatttgtgcacaaaccaaacatgcatctcaatccaagtatctaaatattgatacaactaaggcatacttcaagtgcatgctaattattagcatttagttacataagacgattatgcaagtgaacgtaaattgtcacctgctaataacataccacacaacttaagcttaagcaacagttgtttacctgaacttgggaaaacccatcccaaggatagaagcaatatcaagatcagaagctcggatcacaacattttcatccatgaccctgcatgcctcattaacaactgggaagaaaatcatctccaatatatcttgatcagataaagtaacaggctgcaagcaagataatgtctccatgtcagaaattttttccatcaccagctgggatagcatgggaatttttaaatgaaaaatccatgactcaggcagggaaggagggaaacctttccaccaggcattgtctttgcacatcttctgtactcgtcaatcacaacctgaacacttgggtcaggcttcggcttcccacccttctcataaaggtaataacctttaccattgctctttcctataaaatacagggaaatttcacatcaattttttgtttgactactgtttcttgtccaatccatcctatctgctacaaccaacagcatcgcaggagcaaaagcaggctaggaagcataccctgccgtccattctgtaccatcaaatccaccagattagagtccagattccttgttccaaaggcagccgcatagatatcctttactgccaatgccactccatatccagccagatcttgcagtctgcaggagtgcagagggaagagggggatttattagatataaaaacccttgggaatgatgattacagaaaaacaggtcaatcaacaacggaccagcactgcactgttcatttaaataatctaggtaaggcacacaacaatatctcactgttaattgttcatgcacagaaggtatgcaatttgaggtgattagatatttatgcacaaaggtataagtgacatgttgcattacaacaattaaaggaaatgtgacctccattgagttattgaggaggcatccaatcacatttcaaaagatgtagcttactaaagcccacaaaaataaattgaattggactaaaaaatgttcactataagctatatacaaataaataaggcataaaacgcaaaccatgaatttattcaaactacatatttcctatcttattttgtctatttaaacaaatttcaatacaaatactaatatttgtgatgataatctagtgcgacataaagatgtataaaaatagagttgaacacttactgaaaaggtcccattggcatgccaaagctgcttattactcgatcaattctgaaaacgtcgatcccaatactaactagaagatgagaaccctgtgtgtaagggaaaaatgtacgattgactgcgaagcctgtgcagttcccaaccacaacagggactttctttatcattttcccaactgtgatgagatcaagaatagcttgcggtgatgtcttctccgtccggacaatttcaagcaaaggcataatatgggcagggctggaaataacataacatgagcaattgaacatggtgtctcacagtaaacaagtacagtgtgattgtttgatataatgtccaaaccagaaaggctaaagagaacttattgttatttataaatgcctatatcctgcttctccgtacattctatgtgatgctcatacataagttactactgtacatatcccaaataaaaagttattgcaagtttgcaaaagctactagcttatgaagtcataggcatctgacttagaattaacttaagccatactgatctgccgcttgcctttcggggatacaatgatcagtttgacatggttaaaatgaaccaattattcatgcatttcaaggattgacttacctatattctgttatatctactgggtttcgcatgatatcatgattagccatgcttttgcagataaaagtgccataaacaacaatcaacaactcaacactgaattttcagtgaccttagataaactatcgtggggaaaattaaaagtgaacattcatctccctatatcctgcaccccccccccaccccccaccccgctccaaaaacaagagtacgatagagaactttcacgcagggtttgtaactttgtatgtca

SEQ ID NO: 67109 - DNA, 1124 bp, Oryza sativa
ttgtcatttgtcaatgagcccctcttgactagaccctcaagattagctgtcaaataattgctgctacttatcagtaatataacactgaaaaaacagataaagataatcctaaagcacaagcataacaaaaaaaaaaggtcagcattcagtataactctaaggaaatctcaaataaatactgagggcaaataatatcccaagaaacacagcagtaatttaacaaaaatgacctgctatcatcttctgtcccctttgcaggaattgaggatttacttccttaagcacaacggatgtattgctaacaagaagagctgttgcaattccagagcccatcaaaccaccaccaataacagcaacttttcttattttcctaggtttcaattgaacatcagtaacacctggcacctacacacaataaactataagtcataaaatggcaccaagaaatccataacagagaaaggtaaaacaaattttggcgtattaagtgttgtgactgcagaaacttgggttccatgcgttgtatatagattattccatctacgaacctacttgcatagcatccatataaatatcaaggtaatgtggtttaaaatctcatctccacaaacaaatagttgaaaaaacaggatcgagctatgcattagatttttgtgatagtgatacagctcaagaatttcgacatccacatttagtcattggagctcttttttcttcacctattcctttaaatgtttatgctgacatgagtaccaacatggcaaaatccactctaagatcatatagatctactaaaaaaacccgactgcaacaacttctggaagcaaccaagtccgcacagttttataggtatagggtttatacatagtcaatttcctagttcagaggatcaagtaaacttttgaaaagtttaggattgcaaaatggatttattccaatacaagaccaggtaatgtcattcaaaagaacaggtgctacagtctgtaactagacattggcaacatatctagaagatcaaaagaattagaagtatttgtaagaaagttaatgatttgatgcaaaatcaagacatcagtgacaaatgatgaagtgcatcataaaaagaaatgatattgtatgctcta

SEQ ID NO: 67110 - DNA, 2155 bp, Oryza sativa
ttttcgcaggaaggtgggtgggggtgaaacgattagcaggaggcctcaccggtgagcacgatggccttgacgtcgtcgcgatccatcgcctccgcgtacttctccttcaatccctggatgactgcagggagcagcaaaaacccccaatcggagcacacggaatcagaaacaaaacgagtaaaccaaaaaaaaaaagaagaagaaatcgaaattaagaaacgaggaggcctactgatgggatgcagcgcattgacgggcgggttgcagatggtgacgaccgcgacgccgtcggcgcccacctccatggtgacgcggatcgcccccgccatggatgacctagggttcttcgttcgttcgatctcgagagagagagggagagggggagaagaggagatggatggaaggtggaggaagtaatctctcggagtcgggagggggagcgtggggaggcaggagttggggtatttatccgggaggctctgaaagaggaagacgaaataggctagttagtagtagtagaagcggctgattgggaagaagttgatgtctctgagaggaagagtccaaatacccagtagcaactactaggaccacgtgttatgtattttaagccctaatcttttattattattcacgtcatcaatgatgtttatcacgattttcactactaatattgtactcataataattaggggtagtgaccaactatcgtaccaataaaaccgagccttatcatttattatgcaggtataatatgtacttatatcttataatattttgtcatcttttttattcgaatgtttttgttgaagtgtcatgatgaaacaagtccctaatgtaaaaaaacatagaaaataatgtagatcattttaacatattgttatcctatattactataaaattgatgttaactaaatctcaccatgtaaatgtgtcatatcatcactcactacaaattatgtaaatatcaatatgttaatatcatgccaatataacttttttttatttttagaactcaatatacaaacaatgtaaatcattatctccacattgtttaaatatatgtatctatcatttctataatttataacgttcgttcatctacatatcccatagtaaaagcacgggatatcaactggggtgatgaagtgttttgttgtactcccttgatcccttcaatcttttctatgacgttggttagctcaaacgagcaatatataaggaaatgaaggcgtattttgtttatttagttgatcgtgaagactgttagctaaaaacggtatttaatcaagccaatccgacctagctaatcacccgaataatgcatgtgactctccctatccaaccaaaatggcctttaaccatcggagaaacatttaggaagattaaaaaaatgaccctattgccaactctcctcatatgcttagcgtatgcaatgacgcaagacgcgcgtaattagacaccacccttcaattctcactatttaaccaggtacagcaaagaaaaaactttttaactccagcatcacagtacccattttttttctcctcgatttaacacaatatatgcatagtactgttccggaaaagacgacttttgctccatacggcaataattcaacggaattgtggaaaaaatacagagaatttcttttttaaaaaaagaaaaaaaaatactagcaggtacttcctccgttctataaaaaaacaaagtaagtattggatgcgacacatcataatactattaatttggatctatctctgttcagatttattgtactagaatatataacatttattctatattcgtttttcgtgggacagagacactatgtgcggtcagacagtcagactaccacgcaagcaaaagcaagtaacaaaaacgataagatgagatgagaagcgagagctcccgtgttttgtttcgtccggaaactcgaacgagccgtcacaggcacgcttcctccaatgcgatctcttctactactacgacctatcccccgccgtccaaagtggatcggacggcccatgttcgacgcaggccgagccaaatacgtaccacgcggtggtgttgcgtacggggcaccgctatatatgtctcctcgtatacgtcgtggcggtagcggtgcagccctggccgtcggatcggagccccc

SEQ ID NO: 67111 - DNA, 837 bp, Oryza sativa
aacattccaaaaagcattccaatttcaacacctgcaataatacggtccatttggatgtaccacagcactgaactcacatttccagtagctgtgtccagtgcatctgagcttcctctcggtgaggtcaagccatgatttactacgggtaatgtgaacgaaataaacatgcacggcaggaattcttgtagagttttacagatcaacagatagggtagtgctaacaagttaaacaattattgttggaacatatcattgtttgcatcatatccagcgcgttgccttcgagcaatcaggtttttctcaaactccttcaggtaatctaggagcaacacacaagtgaagagaaggaatccaccgaagtagttgctgccacctccaccacctccgccgccaccaccacctttgccgaaacggaatggaggaaaaccaccgctcccatcatccaattttggcccctgagtttttcctgaaagtcacaggacagaaagtgaaattaagcgattgcgttcctgccacctatagaataaaattcaattagaggcagatctacctttggggtcagatcgtttgacggttgcagttgaagatttccgctgagcactttgggtctgagtggcattgcatcttacgctctgttgtcaatagcgttcgcacaaaaaagcagtcaatgagaagatctgacagtgaagtatgcagataagcaagctagcattttccctttcatcagttttgaagttcagtaactggaggtaaagcatcatgaataattcagaacatatattaatcattgagattgaccatgtaccagggataatattgcttcttttagtactacta

SEQ ID NO: 67112 - DNA, 7271 bp, Oryza sativa
ttttattttaaaaatttttgcaaatataaaaggataagtcatacttacttttgataataaagtaaatcacaaacaaaataaataataattccatattttttttaataagacgaatgatcaaaagttatagacaaaaactcaaagagacaagtattttgagacggaggtagtactacatagataagtcctcccaactaggggtgcaggtgggtttgtccgcgaacccgcttataggcaaaattagtacataacccataggtttgaccagcgggttacctattaatttgatctataaatagatttatggatcgacccacttacatatctagatacagcaaaccagaccacgacgcgaaaacccatgaattatcatttatttgacctatgagtgaacttgctggtcggcccgcttgcatccctactcccaacatgtaaacgtgagggtaaaaagtcacgccaggaaaaaaaagggaaatgcagagagttccgaactccttaggggctgtttggatcggagactaaaattttaagtccatgtcacatcggatgtttggatactaattagaagtattaaatatagactaatgataaaaacccattccataactctggactaattcacgagaatctaatgtgcctaattaatccataattagccactgtaatgctacaataaacatgtgctaattatgaattaattaggtttaaaaaatttgtcttgcgaattagtttatacagttagttttataattaatttataatactctaaattagcgtccaaatattcgatggatccaaacaccaccttaatgaatcacaatgagaaaaatagtataagtagatcgaaagaagaaaatgaagaagaatagaaacggctagatccgggcggcctgtttggaggttgggggcgagtggatctaataaggcgacgaagctctgggactcatctccaggctccagctatataggtcttcgggggcgagaacggcactcatctcccggaagctactgccgcacaagcacagcctactcgcccgcccgccggagcatgcggaaggatgttgacgaccggctgcgttggttcgagaatgagcacgcatcaaaactagccaaatactccctctccaaaataagtgcagccttgagtttccgtgtataaatttgaccgtccgtcttatttgaatttttttttatgattactccctccggtcttgaatttgttatgttttggagctgggttgtttcgcttcaaaagcttgacgttttggcctccccacgctcactttagactagtatacccctacgcatgcttacaaaccgcattaatagatgttgatgcattgtaattaatatgggtaaaacaaaaaataaataccttaattaatcacttatttgtatctgaaatcatgtccaaaacatcaacaaatagagtaccgagggagtagtatttttattgttattatattataaaacatgaatagtacttgatgtgtgacttatgttttttagatttttcaaaaataattcaaataagacgaacggtcaaagttcgacacggaactcatggctgcgcttattttgggacggaggtagtattaggttttttaggatggaaccaaccaacctaaattaatatcctaaattaaactcatggctacccaatatttttcaccctgtcacatcaaacgttagaacacctgtatgaaagtattaaatataggctaaaaaataactaattgcacagatggcgactaatttgcgaggcgaattttttaagcctaattgctccatgatttaacaatgtggtgctacaataaacatttgctaatgacggattaactatgcttaataaattcatctcactatttactgacggattttgtaattagttttttattaatacctgaatacccccatgcgacaccctatataatctaatgtgacacactaaaactttacacccttagatctaaataccccttaattattcttctagtatgtgtattcatagcgataagcgtgcacgtgttatgagcgtctacgtttgtattgtggtactaaaaaaatcataatactaacatgttatgtacgggaaactctcaccaataattttctagtgtgtccataacgcactaattttctaaccttaaatcatcctggccgttctcaccgtgggacggcttgagcccacaatgcagttgtcctcggcggccaccacttacctatcttcgacaagcagtgctatttacactgggaccaaactgtatatgtaattttaatataattataaattttgatgtcatatttactttatgaaaaaaaaatcccgatgctacaaaatatttctgtcttaaaaactttgcacaaatcttttaaaagctactgttccatccatccaaatatttaaagctaaacatttttaactttaattgctaaaaatgaaaaaaaataaaatatatcaataacaataagaataatatcacaatttcattagatttattatttaacaaactactctacctgtcccaaaatataatatttaaaatctagacaggaatgtcaagattcgtaacactagcatatattatccaattctaaattattatattttagtacggagatagtatcataaattcataatagctctttgtatttatagcaatttatttttataaatattattcgttaaaataacatctcaaagatcctgctaaaataaaaaaaaatcttatattttaggatgaagtgatagcagaaaatttaaaattttaaacgatcaattaatttaagggaaatggtagtataatttggaaaaataatttgtaagtataatttggaaacggaggcaaagggtggacggctaaacccccaaacccccgaacagccaaacccttccccaccttgtaaccctcgtccaaccttggtgagaaaaaaaatggcggtctcagccgtcgccgcccgatctagggccatagcccgcgccgcctcctcctccctcctcgcccgcggcctcctccccacctcccgccgcgccacctgcatcaacaggtaccgcacgcgcgccaaccctcgccgcgctctgaaccaatcccccttttttcctcacgctgttagtgttacctgctgcgcctcgggtgggtttcgcaggttgcctttggtgtccgggggcctcctctccacgctgccgctccacagcgccgtcgcgtcggcgcggttacggtccgcgatcgcgcccgagtcacagagctggggtttagtcccccaaggtgaggttcttggtcactgcacgttctaagtgcattagtgtactttgggcccctgatttcaccatgtttacttcatccaggaacggaatcggttatggtttgtaactttccagtttagtttattgtaattgatgatgttagatgaacgtaaatgacgattttttttgttataaaaaattgaccaaaataggcatcagttttgttgcgatttgttggaaatctcggtctctttattctcatgggaggcagcttgtacatcttataattgcattgtgtttttagtactcggaaatgatatgagcttgtggtttgaaagaaagtctattgagattggtcactagacccgaagcacattgtggtgttatcaggttgctgctaggggaacttctatggttgctcatctgtttgtgaccaaggttatttgtactcgatattgttttgcatccatacacaatagggagctttatgggcatattgactttttatgcttttcatatgtactacctccatcccaacttatatgtactacctccatcctaacttgtccagctgcatagccagaaataaagtatttttgatatttttgggatgtaggtagtatgttttatacactaagcttgggttgactagtccaaattcctaaatgcaatgacttgagggttttgcttaaccccaaaggattcatagtatcgtagatggatattaagttgcaagttatagatccattgattgccgagtatataagcacagtataatagctttactgattggtgatttggtgcacgtggggctttacacatcatggaagttgatgccgtccagtatgtggctcatgcatccaactgattttttagaggaagtcactttgttgcaacactggtgttaatgctgcaagcagggtgctttcctaaccattcataagaagataaagcacttctgataaatcacaagacatagatgtaaaaactagtttcattgctcacatatttggatgtcctatgtttattgatagttatgagtgtatactggttgttatgttatcccaggtcaggtcaacaaaatcggtctgtttgcttttggacagcatttgctttcccttgcaggtttgcacaaacaataatgtgtgacactccctcctcttcttttgcagggaactccatgcctttatgagagcaaagcttaccttttccgttgtaactgcctaaacaaattgtgaatgctttgaattttcataatgttcatttcgctatcagaactatgaatgagcttacgagaacttatttttctgtggtaagaatggtttggtgggtaaaagtttggttgttttctgctatactagctatttttctgtgataagaatgcttatttgacttggctgatttggaattttggatacatttgttaccaagtgaacatatttctccatctattggctctacttcctgaggtgcagtttctggtgcaatgttctcaatcgatcatatggcggcagttcagtatcattatttctttttcagcggcaacaattattgaggcgattaatggggcatccgattcttgtgatctgtcatcttactgtttgggttggtaatggattctgatcatgagactgatggattcatggttttgttctgtgaacttgagtttcctgaaactatcaattttattttctttagtcttctggcttgttctgctctatatttgcatgcgagctaagtgtataatcttgtctagcagttgttctatttccctagagggaatggtgtacatgtctagaaaatagcaatatgacaagtttacaactacttgagttgagatttttacaacgataatatgtgggtttcaaattttcaactatatagtgtatgttcattggtggtgaattatattttgaagattttggttgttcaaaacaatatagtagatgaccaaattgagtaacaagaaaatgtagccctttttggggagcttctattgactgcaacttcttctaaaatcttttcctctggaaatctagcttttttagattatcattagctgcttcttataatatcgagctccccaaacatgccctgtatcacatgagatggctgttgcgcgaacgttcgcgggaaggagtttgcacgaatggacacgtgggctgggctcattctagaagagtgcatgcaagtctatctgatctgaaaaagtatgatgtatacatgttcctttctttcaagctggaaaaacatgcatgtttaagtatataaaataattttgcatgcgcatgtagtcataattataatttctacttattgagtgattttatcatataataaaatggtgcattttgtgtataatttttaaagtcctatattaacaaatatttaattgttgtagaaagtttcctaatagaatatttttcatgtataaagtttatgaatataaacattttccgtagaaagtttgtgaatggattttttttaatcttacattttttatttttttaatcccatgagttgattttttttaattaccgaagaaagtttcctaatagaatttttttgccatgtaaagtttatgaatataaagaattatttttgtacaaagtttataagcagagattattttaaaaacttttgaataggctttaatctgaatggcatgtttaaaatttaggatataaattattgaatataatgtgttgctattaaatactgaaaaaaattaccacgctaattatgctgggctttctacttttgtatgcatatggagctgaaatttcttaataacacctacgtatgctaatttcacggtactaactgatgagtgttaattacacgctaattaggtgacgggatccgtcggatcggagacattcgtgacaggcgaatgcttgcgagctagactcacccctcctattaagtatcaacttaggctgtgtttagttccttttaaagttaaaagtttatgttgaaattggtacgatataactgaaaagttgtgtgtgtatgatatgttgatgtgatgaaaaaaagttagaagtttagatctaaacacagccttatacatactcccaattaacattaagaactcgtctggaacatacgaatcttacaggagcttgacttgtccttttgcagcatttgctaccatgaattgcggtaggcttcaagggaaacagattacttactttggaaggttcattcggcgtctttggggcctcgtttgtaatgttgcaattttacgtgaattttgaagggaaaaaactgtttcccatgaaagtcacgtagaatttcttattagttcaaaagtatggtctctgaagtttttcctacgctggatgataatttgtatgaagtaaaaaaaataatttgagcaaataggtatgctgtagcggtaggtgagaatgaactagaactatcaagggcggtctacacaacttatgatggaaaatccacccgacattgtacaaatactagatcattagatttactttgagatttgttccatctccttctagtcagcctccccccctcccctctcccctcaagacatcgatgtcgaggtgccctgccccatcgtcttctctgtctgacggcgaggagccctcggatccgctacctctagtttgttgcttctaaattagtcactctgatttgcccttgccaccaaagtatacgacatagttggagggacaagatcttataagttggttctacccttgttaaactagtaaggtggtactccctgcgtttcagactataagtagttttgactttaattaaaatcaaactttttcaaatttaatcaaatttgtagaaaataataataatatttttaatcccaagataaatatattataaaaatatattcaattacagatttaatgaaactaatttgatgttgtaaatattactatatttgtctacaagcttaatcaaatttgaagtagcttaatttgaccaaagtcaaaacaagttataatttgaaattggagggagtattaaatatgagcacacatct

SEQ ID NO: 67113 - DNA, 2567 bp, Oryza sativa
  unsure (1)..(2567): unsure at all n locations
ggggcggcatgggcggggccgtcatggcggcggcgcgaggccgtggaggagaggggaggacaggcccgcgcgcggaggacaacatgccgccgacgacggggaggttcagggaacgaggaggggtggggatctcaaacaacgcagggagggcaggcgctggacgagaggcgaaacgcaagcgcgggaatctggaaaggctggaaattcggggagatgccagagtaacggtagtggtggcaatgccagcaggaaggggaagaagaaagccaagggtggtgagaacgaagtcaagctgagagtcgagctggacatgtgctcgaagaggggagacgtgattggagccatcaacctgtatgattctgcggtgaaggaagggatcaaaatggggcagcatcactacagcgtgctcctttacctgtgttcttctgcggcgcttgggtttgtgcaaccggcgaaaagtggcaatgccggtagtgggattgctagtattgggcagttacattcatcgtctactcaagcgtgggaaatttggagggagacgatgtacaatctgaaggccactctgaagatcaggagggaaacaagaccgatttgtttgcttcggatgatgggacggagaaaccgagtcgaattccagtgagtgatgagctgagggagtatgcaagaactcgagggtttgagatatttgagaagatgcgctcggaggaagagaaagttcccatgaatgagtctgctctgactgcagtggctcgtatggcgatgtccatgggcaacggtgacatggcctttgatgttgtgaagcaaatgaaggatcaaggtattgcgccaaagttgcggtcatatggtcctgctttgacggcattctgcaatagcggcaatgttgagaaagcatttgaggtggaagcacatatgttggagtctggtgtcagacctgaagagcctgagttggagacacttctcaaggctagtgtggccgcacaacaaggagacaaggtttattatttgttgcataagttcaggactactgtcagacaagcatcttcaaccacagctaaactacttgaggattggtttcagagcccaacagcatctaaagtggggaagagaaaatgggattcaggtgctataacaaaagctattgagaacaatggtgggggttggcatgggttaggatggttaggaagggggaaatggaccatatcacactcgcacatcgacaggaatggtgcatgccttgcttgtggagaaaaattgactattatagatcttgatccaaaagaaacagaagattttgccacattggtggcaaaattagctatcaaaagagagaggagatcaaactttgataactttcaagtcatctatctctgaacaccgtaaatgctatttttactaggctgtgcatttaccaatacatgtcatcaatattatgccttgattaaattacactaaatatttccgtaagtgtagattgaagccaaggtttacagcatgaaaggatacaaaattagatgggttttcaatattgagtaaattatgtatgctcagaattatatccaattgtaaactaaatataaatataacaattctccatctcattttgtatatttaatgaatactgtgcattattttattaagcagtgtgcaaactagaaaatttcatatgccacaatatcttagtttctctttattgcaattaatttttagccaacttgcagcctctttgttggaaaaagaattatcatctttaaatcataaatagttcttacagcgtgtgaatcatgatcaatagagctttccagtggtgtgtgtagtccatatcctttctcttaattaaccatttagcttgactttttcgctgtatttttctatattcagaaatggttggaaaagcatggcccttttgatgcagttgtggatggtgccaacgttggcctttttagccataagcatatttccttgagtaaggcatgtatattgtgataaatattttcttcttcttgtataacatatatctaaaatactaggcctctatctttttttaactggacagattaatattgttgctgatgttatacggcaaagatttcaatcaagaaagctccctttgatagttgtgcataaccgacatctcactggagagcgcatgcaaaagccttctaatcgtaagttggtggaaaagtggaagctttctaatgctatttatgcaacccctactggctcaaatgatgattggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 67114 - DNA, 865 bp, Oryza sativa
gtccacccgagtgattagaatccatctccttgacatgggaaatattcgttccgaatcgtcattaaaccaaaaaaattttctcaagttttctatttgtttccaaatcgtgtttccaaattttctcacatacgactttgtgcacatcctcacctagaaggaagcaaaacgctcttagggttccatgccatggcaaaagaaaggcagagcggtagtggcggcttgagaacaaggagaaaaagcatggaagccaaaagatactcctaccgacatcgatgacctcctatagtgcgtcctcctccgcttcatcacctcgtcaccttcgcctgcacgcgcttctgctgcctcatcgctaatgcctgtccgcccgccgtccttggccactactacatcctcgactggctggaaagacactcacatgttgataacaatccggcctaggtggggttgaccgaggcccaacaaattaaggtaatccggactccaacagttcttaggcacacccactcgaggaaaggcccaatctccctaaaaagaccagtccaataagtgaagggtggctctcccttttaaggtagcttcctcctcctaagctaagcagggtggggttattcataagctcacacggtcgccgcccgacttttgcatctttgccagcgggtaatagtggaggatgtcctcatcattcccacccccttaacaagggcccagctctgataccacttgatgaaccctgagctccacttgagacactcaaggctgttgttggcccgatctttcggtgagttgatgataactacgatttgggagaaacattgacgacccgactacaaccgtactagacgttgttgtgttgcgccttagcgat

SEQ ID NO: 67115 - DNA, 769 bp, Oryza sativa
ggtcgaagattatatttcttgcggttttattcctccgccttccgagtttcttcttcttgtcttgaacttctatggtctttctttgcttcacttgaacctcaactccatcgcattctttagcatcttttctcatctttgcgaggcctacattggggtagatgttggcgggtgttaaatgtcaattctataccgccaacatttgcataaagatcagataataaaacatccaacatagtgataggtgcttaatctcacatattccacaagtgttggtgtatatttgtatgcagatgataaaccccggtgttgggagaaaaatcggactaaagtgaggagaattatgcatccttacaaggaggggttgtgaactttatcaaaacattagtgaatcaacccaaaactccgagaaatggacagaggagagcccagggagtccaccgactgaaggtgtcacgccctgaagtttcccccttttcttgctaaaaaaattggttaaataaattgctcgaagaaattgtttaattaacctagagttgaatccctaattaatcaatgcaattaataatcggaaatggcgtggtggaatttttcttgagttccccatgttgcaatatattaacaggatttttagtggaattttcagagccttggaaataattttaaccaattaaaaatgagcaagtgcaatatttaaccctcaggaaatcctttttccatttctcctttttcttttctttctttttctttgttgggccggggctgcaggaat

SEQ ID NO: 67116 - DNA, 4036 bp, Oryza sativa
aaagtgtgttgcagaataattaatccggttgcaacttaccacttcctccgtttcaggttataagatgttttaaattttgttaaagtcaaactactctaagtttaactaattttatagaaaaaaatagtaatatttacaatagcagcactactttcttttataaaattagttaaatttataatagtttaacttttactaaagttaaaatgttttataatctgaagcggaagggagtactaattaattctagattggatacatatatatcgtcgccgtctcttcgatcgatcatctcaatctgaacatgatatatgtactgtgtcgatctagctttatcgtcttttctttccatgctgactttttgcaagtggtttgactctcaagtgagagattaatttaaccatctcgatctcgatcatgcctgatctgtattaaaggtagatctgtgtttggtagtaacggttctagctagtactactccagctagctatacagctaattgccacacgtgtttagcagtatgaacggcttggataaattccgtggccgaaagaaattaggtcatgtccaattaatgatgtgatataccacctccgtatcgtaatataagggatattcactatttcttgtgacgtttaatcacttgtcttattcaaaaaatttgtacaaatataaaaaataaaaagttgtacttaaagtactttggataataagtcacaaataaaataaataataattctattttttaataaggcaaatggtcaaacaataccagtaaaatgtcaaaatcccttagggggtaaagggagtttttttttcttttgaagactgatatatatgatgtgatataccgaccgacacttcacacacggcaggggtgcgtctccttgaattttcatggagctagcccggatatatcgacgaaacagccgtcagaaaactttctttgcagctgcgagacgatatctttcagacaagatcgaagagacgatatctttcagagatttcttcaaaagaaaaaaaaaactcactctgaagttgtacagtccgtaccaaaatataatattcttctgttttgtatttgtaagggaatgtctagatacatatatagtcagaagttgctatttctaccacttaaactttgttttgaaatgaagctatttctctagttatcgtctcatctcaatcaattataattattctttatttaatttctttagctaatttatcttctcaactaatcgtgatttcctacgatcatttttatgtagtttcttattaatactcatgcgttcagctctaaaaatacttacggtttacgatgaagagaactaaaattatgtatgccaaattgttgcgaggtgagtatagctcaactgattaggtttggtgaaatctcagcccacatggattcaagttttagacttgacacgagtgatcgtatttatgtctaattatttttttaatgatataaacgatgtatctttgggcgacgaggcgttcgtgtttcttaaagaaaatgtatgccaaattgccaaacagctagatcttggtcgtaaattacttataaggttttccctttttctgtacttgcccgtcaatcaatccagcataaagctaagggtgatcatgtgcaggtcaatgcttatgtctgtgtcatcagatcaccatgctttatctctcatggagatctcaacatgcctaatgtatcacacacaaacatacagatccactgccaccaatacatcatacatgcatgtcagatcgatcgagatggttcgacgttgaaaacgtgtgatcatccactggataattaaccattaattattttctgactaattccattatttctgatcgatctccatggccaaactaattaaagctcgttggcttttcgatcgatgaaattccagccaagattagatagattgatagataatcacggcgcaattaaacagttggatcgtagtggatgccagtgaaacgcaacgacgcatgtatgtgcatggtcgtatatacgtggccgtaatcccgcccatttctagtgcgcgtgatcgacccttgtgtgtgttagtggagtgcacgcccacgaccccaccttttcgcgccaaaaagaccaatgattctacacctaagcctaacctagctagtagtctactaccagctatagtactctctctaactaaaaatatcctagctaatactccctccgccaaaaataaaaaaccaacctcatactatgatataacatatatagtataacgaatattcagattcgttgtcacatcctatatccctaaatacggaattggttttttttagaatggatgaagtatatgatagaactatgattctcgatatgtcccatattcgtactagatagacaatagcggaaaactctttattcattaaggagatttcgctctcatttttaaggtaaatccaattgtcataaataattttttattttaaacataacatggtagatcaatataaatgagaaatatcaacttttttttgtccaagttgaatttacatgtgtcgacgtttgatgtcacgactacggtatttgcatagtatggggatcgttggtattaggatatatgcaagattgaggtaaatgagatgggaacgaggatttttatacaggttcgggcccctgaattgtcaggtaataaccctactcctgttggccgaagccggtcgttgcttttattcaccataatcacaccagtacaatatttggggtagcctatctaactgttgtcgacttggcggtatgaagtgctgactcgtagtcgacgccagggtagccttcctcctcgaatccgcatccagcgagatcaaagacagcgctatgtctctcctgacagtatccgtagacatcgtaggggactagccatgcttatctctgaagtcgatatccggcgtcttgtcttggtgcatgttagcttatatgttgatcttgtgtcttgatctattgtttcgtcccccctctcctcctagggggtcttgtatttatacccatacgtgttcccttttccaagtagaactagggaaaccaatatggatacaatccgagtaatccttgtcgtttctatgtagaactctatttatctttccttatccggaactccttctatacccgaaggttgtttccgtataaaacatggtatgtggtgagtcctgtcgagatttagccaactactattaggtatgtggtatccatagccctgataacatgtttgtacaataaatatattacatattgatttattctatcttctttttttagaaaaaattctggataacgcggcatacatagaacatggagatatcctctctctcaaggaatgaaaatccacatccctacgtagagattgaaaatccgcatccctacatattgcttgctggtaataaaccctaaacaattactctaagtacacattggtagtgtcagtgggatctagtgattgtgtgctcgtttgacctccatttgatgtgacccttcttctacctcgcgacctctcatctatcgatctttgcatacatatatatctacctcacccatggctgcttcctggccacagcaacccacacattccttgtacttcttccgctatataaaggggcgagcaaccaatctgaattaatctgtgtagctcgtcgtcactgcccatagtactctggcttagctagctagcttcttcttcttcctctagcttggattggattggattggtggctggccggcgatgaggacggcggcggcgaaggcgcggtgctcggtgcctttcatcctggcggcgctggccgccctctcctgcgtcttcctcgtccacggtttgtacggcttgatcgagctcttcggctcgccggaactctcgccggaggccatgctcctcatctttgccctgtgttttctcctccttgcagcggcggcggcggcggcggcggcggcggtgaccacaaccaccaccagcgtcgtcggctaccggagggcgctgcttcccagggaggcggcggcggtggtgat

SEQ ID NO: 67117 - DNA, 3071 bp, Oryza sativa
agattcgtgcaaggaagctatctatctaccgttgattcatggggtggagatgcatacgcctacttgtacaatactacacatgcagcaaacgcgtgtgttgagtttatcacacaattaattaattttgcacacagtattagtagtaccgcatgtataactagtagtattacatgtaacactcgtatacatatcaaattaaacattatcttaatgtgatcctgctcaaaaattgtcaagggcatgcaaagggatgctatttaacttttttttcaacaaaaaaatacaccctccatttcatctcaaagtaagtctacttttatatatgaatctcaatatgactgcgttcctcagcaggtgaaagattgaagatttatctcgtttttcatgcgcacgcttcccgaactattaaacggtgtttttcttaaaaaaatataggaaaattgctttaaaaaatcatataaatatttttttaaaatttaaaattgttaatactaatttaatcatgcactaatgactcaccttattttgtatacctctccattcttctcttttcccttttcctcaaacacaaagatgtccggatccattggttggttgtttttaagcataagcgaaacaacatatttgcaaatgaaaacaaaatcttaaaatcaactttgaatttaagtttaaaattttaaattttggctgataagaataagcgaaaagataggccagtcaaaaccaggggtacttaggggttgtttggatgctatactaagtttgccaccattcaccatattttttatgccacacttgcctaaattgtggcttacaaaaagtgagccacaacttagctagcaaaattggattgtgccacgctttggtgagttgatgacatgtgggacccaaacagatgagaaggaatcttgccacaagtgtggctatgaactaaacaatagactaacttggtcaaacttgactaacatgaggtgtggcaagttggcaatctttggtaaactttgggagcaaaccaaacatccttttacacagtgaccttgttcctaactgcaccgatgggctgatgatgcatattgaaggcccagccaactactgggctcatcatggatttggggaaggcccacctaaatggcatatgccctacgtgggtttacgggtggagaaagttcaaatttggttcctcattataggttgagtttaaatcatatctctcaaccgcaaaactggatacaattagcatgttcggtaagactttgctgtagcgttttaagttgtgttgtacaacgtagccgttcggctacacaaacacatagttacaggaagttgttgcttgctgctggatagttataactcctgtagctactggctggttggctgcagcgtagccacaatgctgctgtagctaagccgtccgaacaaagccaatataggagtatcttttatctttcaaaaccagtacaaatatagttccaagatgctttagacggtgatttttagctgacgtgacatccacgtgatgtttgatttggttttcatttgacatgacgtctacgtgacgcctacttgacataataagtaggaaaaaaaagtaggacctgcatgtcagttacagtaaatataatcatttttttcattcctctctatcctctctccctcatccttttagtccatatgccgtctatatctttttgtcatggcagcaggaaagattgccaactatggagctcgcttgtccccccccccctcgtgcatccgccttggacactactcgtggcgctcctgctctgtcccttagatagatcaacttaagacttttttttttgaaaactataaagtgaatccagcacataagtataatttgagtgaatctaaataagttccaaatagccaatcgcctactttacagaaacaaataaatctcaatttcagtaataaaatgtgatgatcgagaaaacctagatatcctgcatgtataagagggataatctcgcgccataccaaccataaaacaatcgaataagctataatcgtataatccaatgcttatatttcgggacggaaggattacagtacaatctcatgctctgtaaactgcaatcaatcagccattaaaatctcatgctctgtaaactgcatatcaagaaatttcagcaaccccgtgttgaattgaagacggggcaccactgctcctctcgccctcccctgctacacttcccgtttccctgggaggcggaggaggaggggagagacacacgcacgccgacgccgtcgcccaccaccccctgccgccgcgccgcgcggccatggggctccacgcgatcctcctcctcctcctcctccggatctccgcctccgcagccgcctccaggccgccgctcgacaccctcggcatcccgccgcaaggttccatcttgttctttttctccccccccggatctgcctgtatctctctttcttggtgcttgatgcggttcttgatttggtgcctgtgggggcgggggtggctggctgcactgcactgcagacgaggcgtacttcaggggcggcgtgatcaggtgcagggacggatcggggaggttcgccagggacaagctcaacgacgacttctgcgactgccccgacggcaccgacgagccaggttgcttccttgctctcgcctgaaaaagattatccctttttttttgccttagctttttgcggaggtgttctggttttaggttctcgtgtttgtgctagtagctcgaatctacttactgtaggcaatctaagagagctgtttaatcgaattgtgtttactttttgccttggcgcagggacatcggcgtgcccggaggggaagttctactgccagaatgctgggcattctcccatcacgatcttctcgtcgcgagtgaatgatggtatctgtggtaagaggattataatcggtggccattctctgtatcattcaaatgtaaacacagtaaatgtacacaaaatcaattgtaaggctagagattagggtgcttttgttccgtaaacatagtgcttgagggaattcccgctatattttttaaaagcggatccacagt

SEQ ID NO: 67118 - DNA, 4531 bp, Oryza sativa
taattctccctctatttcatattataaaatattttaagcttttttaatcaaattttattaagtttgacaaagattataaaaaaaataaagcaacatttagaaaactaatttgatatcgtaaatatttgctaagtttctaaaacaaaattttgacttcaaaaaagttaaaacatattacaatataaaaacggagatatcgaaattaactacgagctgatcagcttaagtataattacctgccggttacgagcgaaaagaacaagattacgggcagcttcatcgacggcggctgaggccgagagaagcagcggccgtagctgctacccgaggcggcggcgccgccgctcccgcggctcgtgggcggcgaggtggcggtgcgagggaggtggtcgtaggcggcgcgggtggcgtcgctgtggaggacggtgtaggcgtcgtacacccggcggaagcggccgccggcggcggcgcgggcggcggcgtcggaggccgcgtggcggtcggggtggtgcagcggcgcgaggcggtagaacgcggccttcacctcggccttgctggcgccgcgctcgatccccagcgtccggtagtagtcgccgtcgccgccgggcgccattgatcgatgtcgacgacgaagacgaagctgcaagaggtgtcgggctagctagcttctcttcgcgcgcgatgcagtaatttaggatccaaaaaactgtatacgaagcgattcaatttagatcacaattaatagggcgcttgtagccttttgatttcgcctgcgagtccgaatagaaactgagtctgagttcgagtaatacatttcgatagaattcgatcggatttgtgtttataggtcagtcaaatccgactctcttttgccggaagaagcccctatttttacacgcgcgtaattcaaacgttcgatcaacttcttgatcgactctaattaggaggtgtttcgctctatcaactccttcaccagttattaatctattcatttcccagccgtttttttcacattttgatcagcttctttaacaactgattttttacaatttgtccctttctaaaagcttatttacaaatacacctaaaaacttatttgtgcctacgtctaaaccccacgttggcgtacggcctggatttctctgtcgcgtgtgagattcacgagagttcatatagtggaatccaatttctggatttgaatttttttttacttaggtcaaatctattaccgagtttgaattttaattaattaaactcttactgtttgctgacaattaattgaacatgctctcggccttgatcagtattcgttacggtagatacagatctgatcaaacttcaaaagtcgcaaacaaagttgaaaaggaaacaaacactttggaagtaataatctcaaaccattacccccaactattacagtaaatcactcgcaataatcaaatctgatttccagttctgcattaccaccaaatactccaaattcaacggatgcagttcaagtatgtttcccatttgcaagtagtattctgattttgggggtgcataacagcataagcaaacgatagaatacctctatgtacaggcaactacaacacaagtcagcacaacctttgcattgccagaaaaccggctagctgacttcagatggattaataatcagatctgtatacagcaaacccgttacagtggttagggaacaacacaattttctctcgcaagtgtaggaaagtttcatccgcaatcttatactatactctaaagacccacgagtttccggtgcacgtgttcatggagagagtgttcgtcgccgtcatggtgatggaatacgtatgtcaaaaccccaacgaggcacaggaccgagccgacaaggatcttgtcgtaacgttccacccagtggaacttaatctggctagcaccgtagaatgagagggccaccaaggatgtcatcactgtgatggtactgcaagtggggaaaatacaatcaaacagaagaattggtaaagattttgataaatatctgatctattcacatgccaattaacacaaagcacacaagggaaatcttgaatcacaaaaacactcaattcagctattctagtattcagcaatcttactgatcatacattgcactgcacaaggtatttttataacgttcaatccagctattcttgtgttcaagatgactgaccggaatgcccaatagagtgcacaacatagagatggacctatagttcacaactgaggtgttgctaagacccacccttgaaggttcataacagtggcagggacgcagggtctcaggagattcaaagggttataatgtaagtggttcttaagaatctattaatcttgtcaggcacaccgttgaagactaaatatttatcaaataccaccatttgtttccatacatgtaaagcagtcagtttgtgggaacatttcacatcaactaaagggtaaattgagacataacttatcttaagatattacacctcatataggttacagaatgccatattgagcaaattcattgtgaattaaatattaaaacatttgtagaatccatagttataaacacaacattagctagttggtaaacgaggaaaaagaaacatcccaaaaggaaaggtggcacatggaagtataggagtatttatctttctactttaccacaacatacagtctactaagaaggatatatttcgatgttcattttgtcccaactcaatgtgcttttgtatatctatggtagcctggtaggtgataccttgatgatttgacccaatgaaaaaaagggttttcaatacaaggagattcctataagcctagagtgtgatactcctaagtcctaacaagagcttagaaaaacttctcaacaagacaatcccattattttagtggaaggataaactattattgttccctctttcataatgtgttgcggctataaaaaaaagtatagcaatttattgttcggtagaaaacaagcaatgcaactgaaaacagtggaaaggggtacccacctaaagaggagcacaatgatcgcaaggatcatcatggaggatgaattgccaacagcaagaaacactggaagagttgttgcacagggtgataatgcaggtacaagtacaagacctgcaactgccatcttctccattggatgattatgagcatggccatggccaccttttcccagtgcaaacagcaggatataacttccaccaagaacaatcagcaacagtgatgcaagtttatgcactgtttcctcgcctgctatagtatttgccatagtaacagcagttatcccaagaagagcagtggaaacaacatgaaggacgcctccaaatgcagctgcggaagttaggatattttattagtagtgatatatagaataagaacatggaaaagtaatatgagtattcatcactaatttatgtagaaaatactagggggtagggtacagtatgaaattacaaaatacaagtaactttctaaacgcgtatcatagctgaggctaacagcacaatagtaacacatgaacaaggaatcaaacagaaataaaaggtttattttataagatttagaaattagaacttttttaataaaaaattatacagtaagctttggaggtttgcagacaataaatacaacataggatggaaaaataactacaaagttaggagtctggtcattcaaatgcactttttgttatccaagtgataatgcacagttgaacagaaaaaagaagtgattgtgcgtagtttactgaaatcacaacaatcgtgcaagattaagggataacaggttggtaagctgcaaatattattacaagattaattagaaaagtaagcctgataaaggaacaccaatgccaatgatcaatctacacaaatataaacagcaatagacctcaatcaaaaattttctgtgtgttctgatttaaaaaaatatccccatacttgcgatgaaatacacatatccctgtaattatgacaaaataacatattcacagcataacaaaacagaaagatgcaatattgattcagtttgcattattgttcccaggaattaatcattgatcaacatcccaactaggatattgtgtaactccaagttggatcaatcaaatagttgcaggcttgcagtctataaatcgaactccatgcactcacatacggtacacatcttgcaatcatataataatagcgaagcagcaccgaacttagatgtattcaacccatgtagtcacacaaagtgaaagttgtattgcctgaactaccgttatgtacgaaacaaaaggcgcatggccctgaagttggaaaacatgataactacacattgttgacagaaatacatcccatggaacagagatccccactgaaaagatcacagtagaggactcagaagtttacctatcaaactatgagcagactactcgattgtccaccaattcgtcagtaacagctcaagattttcgggcgaaacttactaatcggtgcatgaaacccacagcatcaagcagttagccacaatc

SEQ ID NO: 67119 - DNA, 1037 bp, Oryza sativa
gagtgcagcagcgacaccgtcgcgatgcccccgatcgtcgacgcctcctccgccgtccactggaggccgcccagtccgaacccgcctcctcctccgccgccgccgccgtccatggcctgatcccgcctcgcgtcgctggcggcggtggggtgtgggagagagatctgggaggagaagcagaagaggagaggagagagaaggcgagcaagtgggagagggcgaagcgggctgcggtggggcccacctcacctcggcttatggcaaattaatcccagttaattacccgtttgctgtggaagtggaactgtggaaacctgtcgatcgtctccatggaaaagaaaatttttgatatttctgactttttatttataggcccgtgctttacaacggatctgtgaaaggactttagaggttcatcctaactctcctctcataaactacatcatattttgctagaaacacggtacaaatacatgcgctcacaatacgcacacataagcactttcagaagactaggctagtaatcttgagattcaaaagaagtcgccacaagcatctattgctggaaagataattagccataaatactagcactcatgtcaaatctaaagaataattagttataaatacgaacacccatgtcaaatctagaacttgaacccggataaactggttcaaccacatagaatctaatcacttgagctacgctcacttcatcaccttaattgtttgtagtatctggatcatttatcgatggcgtgggataccatccggtttaaacatattaggttgattagttttttataatgggcctgttcggctgttatgtttagcagttgtgctgttgcacaaagaaaacaatgtggctgttggctacaacacaatgaaaatgagtgcagccgaacagagccgatataataggttttttaaaatcaatttttataggaaggaagtggcttttaggaggaagtgggggagagaaagaaaaggagcatgactatctcttttaaacagtagaggccagttaaaatttaaat

SEQ ID NO: 67120 - DNA, 1177 bp, Oryza sativa
tgtgaagtattgagctatgaaactgaagtaatgttttgctcgaagtgctgctttatgcttaaactcaagtgcgccagaaaacagttgcatagccacacagtgataacttgaaatgttaacatatggtatttttagcaaccccaagtatgaactagagttttacaagtgcaagtgaatactgagtataatagagaaaagatcccaacggggagaaattcttagtaacattaggcaataacttatcgcacaaacatggcgactctgattattcagggataacataaaatgatttatatttaactgaaggacattgaaactgcaacagaacattgtaatggcgatgtatcagttgtgccatcaggtagtttccgtgaccccacatgattcagctgaagctgaagaaagactttcatgaaaatttaggccagtagcacctgcatcattttgaatataacatggcttatatgcctcataataattgaatacttgacactatcacactatcacagttttaacattttgctatacttttagctaaatgatccaaaatctctgcttgatattttattattttcttacctcttatgtataatccatttcaggtcatgcctaatttaggaaatggtgtaaaaaccaataatgacttacctttagtctcagacaagcttttgattgtcaaaggtattcctttttgtcccaacaatagtaagaaaaatgatttacaaggcatcagcagaccggatggaagaatagaaatcgattccatgactgaggatgttaagactgagcctgatggatctgtccctgagaagatactcaagaagccagataagattctgccatgtccacgctgcaatagcatggaaacaaagttctgctacttcaacaactacaatgttcaccagcccaggcacttctgcaggaactgccaaagatattggaccgctggtggagctatgaggaatgtcccagttggtgctggaagacgcagaaataagcatgtgtcaaaatactgtcaggcgatgatgacgtgcaataatactgtagctcctggagatgtttctgatgtggttcaccatcaggttattacacatggatcttctctccttccagcaacactgaaggaaaatgaaacacctacagaattcatatcagaagtaccaccatgtaagtcttc

SEQ ID NO: 67121 - DNA, 1076 bp, Oryza sativa
aatgaagtggataaaagttcgttaaagaatagtaagcgtggatcaaataattctgaacaataagtaaggtgaaaaagatggagcaaatattcccacgagatcatggctgatcaaggtcgtcgggtcgcaggtccagtggtggggtcaaagctgtccgtaccacggtacaataaagacaagcacggccaaagccgggtttcacattaccctttgcaggcttttcacattaaccctttccagctaatttgatttcatcacgtaggaggataacactgtccacgtcaccccctgcctgcgcttttatttgtggccacgcacgagtcgagccactagcgacgtgaacgaaagccataccacattaaaggcgttcacactacatcattacgtggtgccatcatcaccacggtggggttattacggcagctcaaattagcggatgaatcaagacacagtggtttagaactaattaagcatatcattaaactcgttaactaaatgaaggcaatgatgagcaacaaacagaaaggagtaataattacaccatgagaaaaagagagcgagagagagaggctgatttggtttctagtgctacgctacttggctacgacatcatcatcagcttggctaaggggaggacaacccgcagccgtccgatcctcgcatcggacggaccaaaaaaaaccctgaaattttatgggagaaaaaaaaagagaggagaaatcgaggtcagaatcagatcatcccccagctctccaatgtcgggaaggccgacgcgccgatcaactcctccagctcttgcagcagcagcgacgacgccgccgcctcgtccgccgccgccggcggctgcggcggcgtggaggccattgtggtggtgggcgtcttgtcgttcttccgccccggctgtggctgcggcggcggcggcggaggtgaagcgcggtcgagcaggaacgcggacgtgtccagagtcgggagcacgcacgcgagcgctgcggcggcgtgcggggccgccggggccgacgacgcggaggcggaggggtaggcggtgtgggcgccggggacggggaagccggtgatct

SEQ ID NO: 67122 - DNA, 2335 bp, Oryza sativa
gtgtgcgtgtgcgcgtggcgcgggttgtcatgcgcggcgtgtggagtgtgaaggagagctggagagaaaccgcgtggagtgccgcgcggtgccacgcacgcatatgcctctgggcggctgctggctgctggctgctggtgaagccggccgttactaccgtgggacccagctatcctccctcttggctgccacatcgccgcatccgcatgtgccctgtgctcctcctcctcctctccttgcacaggaagccacgccgttttatttatttttacctgagcacacaacacaaggtgggagtacaactgtggcatgtgtcggtcaactgggcagtcaactcttcttgcggcccaagccatgccacgctggttacattgttaatcatgtactactagtagtaatattcaacaaataatatatgttccattagaactatataaccgcaaaaaaaaactcctctaaatttggtttaagttaatagagaaatattagtaacatctataataggagattagttttattaaatgtgacattggttatagtttgataaacatgtttgttttgtgttagggatattattatattttatttataaatttgatcaaactttaaaagattgactttgaaaaaaaaagttaaattggattataatataaaacaaagggaatagtagccaatattatattatataagtccacaactactacatgttttattttaggacaactacgttgtgttcgttacggtaggttgggaacaaatctcctccgcacggaaaacagagcgatacattagcacgtgattaattaaatatttactattttttaaaaaaagatcaatatgatttttttaaacaactttcgtatagaaattttttgtaaaaaaatacaccgtttagcagtttgaaacatacgaaaaacaagaagggggagttgggaacacagagttccgaacacagcttaagtacatgttcctttttaattctctccctccgtacttgttagtcaaggaacatagtactaaagctctttcaataacaccataatttgcattttctccaaaatagaccattatgttatgccacaatcctttcattccatagaaaaacaacgtagggagtgtgatgtttcttatttcccttctcttgtttccaatttttttgctcacatgatgcagagggcagaagagaagagaaaggtggggaaaaagaaaaaaaaagaaaatagtcaatgcccgtgtgtcatgtcacgtaggattctggtggtgtcacggcgattatcagagtcattaccgtaggatcctagtcaggtatattatccttggaatgttaaaagtttattttagaaagaacaatatgttagctagcagacctcattctttttatcctataaaaaaatacatataaaagcaaccatgagaagaaggaaaaaaaaagcaacgtgcaccgccagatcatcaaaaggactgtactctctctatgtcccataatataagagattttgagtttttatttgtattgtttgaacatacatcttattgaaaaaatttgtgtaaatataaaaaacgagaagttgtgcttaaatactttgaataataaaataaataaaaaataataattctaacttttttaattaaacgagtggtcaacccgtacaagaaaaactcaaaatgggagtagtaacgatgggggacgcgtcaggcaggcaagtgtgaacacaaattgattgtgcaatgggcgtcgacccagaccgaaacggtttgatcacctggttgttgttgcttcaaggggaagggaagaaagtcgcgggctcgcggcggcggtggtggtcgtggggtgggtcaagcagctgtcgcctgtcagtctgtcagtcagagaggcaggcgacaaaccgagaagccgcgttgtcagaggctcgacccgctgcgggccccaccggcccaccgagaaatcccgtgatcgattgattgcgattttgcgattgcgacagtttggctgcgccttcgtgcggatggcaaggggggctggaggctgccaggtgggacccacgcgccccagccgcggattagcctgctgctggcctccacctcgccgcccggacacctcttcgcctcctcgcaaccgtcggatcttacggatggacggactagatcgacccggccaccgctctacctcgacggatagcaattgactagtagcagcggatgacgctgacgcggctgcggctgagcttcatacttttgtttcttcagttgtagtactatagcagaaaagaaagggccaaaggggtgcgtggcgaactagacaaacgtgtttgcgcttctatctgattctatcata

SEQ ID NO: 67123 - DNA, 3795 bp, Oryza sativa
tcaacccaatcgataaaatctacaattcataacattttcaactcgacgtcgaaaactttcaattcatactttagaaattttcaactatatactgaaactttatatccgaatttttgaaaagtttcaaatcataacctcaaaagttttaacttacataacaaacttccaaatttagaaaactcaaattttcaaccgaggggagctcacttatatcccattcccgtagctttccccacaacactgatatctcgctgggaggagaaaggagaatcgagtctccccaaagaagaagagacataaggtctatgagagcggcggctcacatgttgcgtcgtgtggaagttggtagcgaggtgccgaggtccgttcgacgccatcaatgtctcgccaaggatgagcaggaaggggaacttagaatcgctcaagaggaagaaaaggggggcagggtgtgcaaggtgctgggggaggaggaagaaatgaacctcgcttggtagtgtcgaggggagctaggagcggcatctcatctatggtggaacgaaacatcaaggttggggggcgaaaccaagggaatcagatggaggggtaaccgatcgagtgaacggataagtggataaagtgttcgccagttcggttgctagcacatttgcgccaaagtaggaattctagaaaataaattcattttactcctaactatttcgctgagcttttaacccgtaaatatttttttggttcatttcacaccctcaactataaaaagcactccatcttacttcatataaaaacgatcaatcttactccctaacaatattttgtctgtgtctatatatatgtcatattatgctccgaaatttgatgggttagtagatgcattataacatatacctcttaacatttttgagaatttctattattgtcgtttgcatatgttgaaagtacataggctgatctaaatatcaaggttttaaatttaaagtaaatagcaatagaaatatttgggaactttgatagggtgtcatttatgtcttaaaaattttagcttaaaataggactgatacaaagagaaacaaaaggtgataaataatattcagtactaaagtgaactatttttagtagtttagggtaaaattaggaaaaaaaatattgtagcggttaattcaaatgaaatagtttaggggataattaaatggactttttttgtacgtatatatacatgtttgtacataattgagtacaaattggaccattattaataccatctctgtcctcaaataaattcatctttagccattggaacacaaattaatgtggagtaaaaagaccaaagtatcctcgattaatagaaaattatagtattgatgggtagctaaggggtattgaacgagtaaaattgatttgcggactgcacacacgtatagataaaggaatgtacttattttaggataaatagtagaggttaaagataaactagtttggggacagagggatttatataccttagctttgcttttctctctacacatcaggtgagtagacaacatatcctatatgcacaagttcacagtacacactccgtatacaccaactaacaaatttcactaaaaattcaaaacaaacaactatgcgttacttctaatagtattatacctacatgcatatcatcttaaaattcattatattttatattttaaaaatacaaaatccttacacatatatactcttaaaactgtaggttttttgttgttttatagctaaaatataataaatttgaagttgatactttatatatgcacaactattatatttacttttttttaaaaaaaaattagtgacatttgttagctggtgtgaatggagtgtgtaccataagcttgtatatacgtaggattccaagatatgtcccggtcatttatatgtaacacaaaataaataattgatgcctatttggcacatgcatgcttaacacgtgacaacgaccatagtacctaacagtaatataacaaatgaccacaaaccatattcaccttaaaataaacgttatcaaactataaatatccatgtgttctaggcatgcaaacccatcgtcaattaatattgctttggtacgagatagataccaccaacgctcgtgctacttataaatgatctaaatatagttttcaagtcattaatatatgcgtaattcaagtatataatacactaaatatataaaaggacaaatattaaagagtaaagtatgttcaacctcgagaaaacgtactagcttcaacatcgttcacgtcatgcatcaagatcgatttactcaaaaaatcgggacatatgtacaaagtgatcatttttcacaacagaacacagcttagcgttctctcagagtcatcgtcctcgaggccatgcgtacgtgtggagcaccatagcctcctcgtcgtcttcctcatccgcgcggccgtggcgcacaagcacctcatctccaacaaaacttggataaaattttgaatacttgtggcacaatttttaaactgctaaatggtacatttcgtgcgaaaactttctatatgaaaattgctctaaaatatcaaattaatctatttttcaagtttgtaataattaaaactcaatcaatcatacgttaatatcacatcgttttgcgtaaaacacttaatatttatctttatcttcatcttcaggagaaaaacaccaccatagtcgttgagtccccatcgacctcgttgtcgctgttctcgagcacacgccccatccttgctgagcacgagcgtgagaagcgggtagctagatcggcgtacccaccgggttatccatttatttataccacaagtaaattcgcggatctgttcgcttgcatttctatctaagcttgacaattaatgaagagaaaaaaaagaaaaagaagggaacataaggaaggaaggaggaaagaaaagaatacgatgacgatggaatagttttaattttataaaatttcagaagcattagacctatatcgtaaatagtaatgatgaacttttgaaatagaaaatgtgagggtatgtacaatgtatttattagcgatctctctttattgtcatgcaagcatattcggtgacgtggaagagagaggaagaaggaaagagaaagatggttgctacgcatgacaacggcgtagagtcaactcttagcatttattaatggaaaatttgttgcatgagagtggagaaaaggaaagaagtataattaaaaaaatatttagtgcattaatggtttagaaatctcattgtctctactattgtaggaggatagtctctagtgacataattagtatagagagctcatattagactcacatttgtacatgctctaataaaagaaaaatggctagtaagaaaatattttggtacattaatggttagagactgtactgtcttaactattgtaacgtgatagtctctaattaacgtagtacctttgtacttgccctaatgatatagattaaatttatcctagtaattaaccgtatgtgggaccatgcaggcatgtggatgtgtcatcgatcgaccgacggtcggcgacacgctaacgttgaccgatcggatattcggattacgagtagccctatgaagtctgaacttattattatataaacttcgttaatttaataacttattagttgcttaaatgtattaataaattaatcgacgatatatagggccgtacacatatgcatgcagcacgcggagtatgtacagtgttccgtgtgtacctgacctacagtaacagtgaagaatataataaaaattctgggag

SEQ ID NO: 67124 - DNA, 6742 bp, Oryza sativa
aaagattagtatcacaaattagttgcgatctgtgcaattagtttttttagcctatatttaatacttcatgcatgtattcaaacgttcgatgtgaaaggatgtaaaatttttggtgggatctaaacatgccctatggccgagtttagttccaaactttttcttcaaatttctaatttttcatcacatcaaaactttcctacacacaaacttccaacttttccgtcacatcgttccaatttcaaccaaacttttaattttagcgtgaactaaatacatcctatgttaatatgttgatttttttaggacggagggaatacaccaatcaaagtcaccttttaacagtctgcgagtaggaagtcaaatagaggagcagcatagtaccgaacagtcaacatgtcgttggttgtgtcgatctgcatgcatgtgcatggcaatggccggccgttgatcgacagaacgtgatggggacggcttcgttgggtggctgatcggtccaggccgtacgtagtactctctctattttttaataaatgacacagttaattttttcttatatatttaaccattcgtcttatttaaaaattttatacaaatgtataagatataaatcacacttaaagtactatgagtgataaaacaactcataacaaaataagttataattacataaattttttaaataagacgaatgattaaacacgtgagaaaaagttaacggcgtcatctgttactccagaaaacaggatgtagtaactactccgtacgtacccttaccgaggcgactgattgattgactgtccacggccgacgtcatgcttgcgtcagcgtcacgtcacgggcaaccccaacggaacggaacggcggcactcccaattgatgccgaccgaacacaccgatccacgtacggtacgtacggacgctatatatggccttttggtgtgtgtggtacgtaacacctgatcaactccaatgttcgttcatcaacatcatctatggtcggattcaccatttataaaaggagggaggaaatggagaagagggagaggaggaagagtaggggaatgtgagttttctctccaatcttatcctagattcatccctggatacaacatctcatgtataaataatttatcagtgagcatggaaagtctgaaccaagctggattattactttcgctatcccaaaaatataatataagattgaacattttctcatatctcataatacaatgcgttcacatatgcatatattaattagtgtatcttcctcctctaaatttggtttatttaaaatcctctaccatcaagccctctaatcacattgcgtgcatatatcgaggtgatacaatctagttaattaaattatttcttcatttttgagtttgtggtggttatgccttatattttaggatggaggatgccattgttctagaccggcaataagaaaagggtgtagtgtacaaggtctaaaagtgaatgagtaaagaggtcaatggtttagacaggttcatgccctctacttctatttggggattgaattcgtcgggtgttgtattgatctaatgatcaatttgtggttatgtccttgtagggcttcatgcccatctaatattagttgggaggcagagttacaaagagaaaaacttagccagacacgcactactacaataacgatttttccgtgcagtggaaactcattttcgcgtgcggtggtttcacccgtctggaacccaacgtctgcgaaaatcacaattttttcgtgcaggtgaggcacccgcacgggaaaataaaaaattgaaacaaaaaaaaagaaaaaaaaccaaaaccctaaccgtaatccagccgccgccgtcgcccccgcggtcgctggcaacggatccagacgctgggagaccgctgccaccactgccgtcgtcgtcgcctgctcctgacgccggatccgccgcccgctcccgtcaccggctgaagacgcccctcccctccaccggatctgcaaggcaagggaagggaggggagggaggggccgcgcactgtcgttgtcgcacgatccgggggggggggggtgaacatgcatagatgtaacctagaggaggggttgaataggcttgccagaaaactcaaaaacaaatcgcagcggtaaaattctacaggcccagaacctccaggtgtagaacaccagaacttcctatctgctcaaaaagttcggaacttccggtgttcttataccggaacttccgggcaacagacaaattcaggaatcactaacaggaacttagccaaaattcacgagatgaatcacaggtaaacagagaggtagcaatatcacagacacatgcacagattcatcacagaagggacaaagaggattttttttcccgaagttcggatctcacgatcctactcttcgttgaggtgctccaaagagccgggtctcgattaaccccttgcctcatttgtgcaaaaatctcagaggaaatccacagccttcaaccccaacacctttaggtcattttctagaatttgagtgaccactaagatccaacccaaccttcttctagaaaacaccacactaggaaaacctctaggacttcagcacaagattctttactcacttacctcgtttccttgcggaggtgaggaataccttcacaaactttcccgggacatgcacaattgaaaggaagctcgcgaacaacacctaaccgtctaggagattatctccaagagtaataagcaccgagatgtcagcccacaagataccccaagtgctcacaccaatcctaaccttcaaaccttctccaaatcttctccttcaccctcaaaatctcactctctctcaagaatggctcaagatcaggtggaggaagcaaataaactcttgggagaggctagcaacggctatggaatggaaaagcaaaagtgaaatggccaaagagtgaactggggacggctaggtgatgccatccagctgttactcacatttttgaactggaaacaggttcggaacttcctgtcctccagaagttccggacaacacttaggaaattttcacccttcaatggtccggaacttccgggtccataggaccggaactttcggccgtcctgatctgtcctggatagggctattctcaaaaatagctctaaaaaatttttgacacttggatctcactaagagcacttgatgtatcccagaaccacacctggaacccctcttaatagtacggtttttcctaaaactcgattacaagaaataaactatcatatgcacacctcgagttccaattctgctcgaatatatgttgtgggggtctcccaagcatctcttgaccacacaatgccatcttgggactaaaacacctaagtattactcaataaaactcattagtcccttaaccctattattattaatcaccaaaacccgctagggggataaatgcaacttcatggggcagctgccagatccgggctaggggcggtcgcccgccgccgcgcgcacatcaagcagcgagcacatcccctcctcgtcaagggggcagcaagcagacagatcaagcagcaacacatccaaatccaaacaagcaagaaagatcgagcagcaagaaacacgagcactcaacgtcatcaagaaagtgcgccatcgcattgatccggtcttccccttgcgcaccgtcaccaatgcatgcttaaccctcgctgcccctggctccacaccccgccaccccccggctctccgcccggagcaggggggggggagggtgtcgcccgccaccgccaccacgagctcaccaccgtgtgcacgccgctcacggttgccgagcccgccgctcccccccaccagatccgggcggcttgggaggagggggaggagatgggagatggagatggagatgggcgagggagatgggagagggaggagtgggcgtgcggccggattaaatggtgggcacctattttcgcgtgcgggccacttaacatgtccgcacgcgaaaataaggctattttcgcgtgcggacgtgttaagtggcctgcacacgaaaattgatttttgtgtgcaggtaactgctcggcgccggtcccctgattatcatgtgtggtttctcttacggggcccgcctgaaaacaaaagtgtcccatgtccaggaaaatgttttgtgtagtagtgacggcatcaattttctaatctattatatgttagtattcagccgaagctctataccctactttaggatacaaggcaatacggcaacgaagtcttactctattacataatacatggattcggtccacctcctaccgctagtcggataggcaggccaagtgggtatgcggtacccatgatgtccacaaagggagtagcaataactaaggatgtaagtaactaatccgtgaatccacttatatcaaaataaacggattattctgatctataagggaatttgcaggttagccagtaataacactggtaatgtcaaaccaagacaacccaatgttaattgttttccttttgacactgaacagagttaattgttgactggacatgtgagagcgagaaaaaaagtgccgagagcccaaggctcactacaaaaccccctgtttgattcaaattaccaaataatctatactcgtttcactaaaatatcaataaaactcattagtcaagtgttagatttaattaggtaattgatccatttaaatcaattaaattctaagttttattatgctaggagatatgtgtattcatcttctcatgagttatcaatggttaagatgaagaattttttgagaattaatccaatgattaattaatcgaatggttgtttcatggtggtgtagtgaaggatgattgatggcttggtgatgacaatcagtttctatctttctctttacattacatgagtcctttccccttcatcttcctttttctcctataaaagaagatggatttgatctcccgcgtgtgagaatacacacattttcatccatttgcacttctgttgctgctacaatgatcacatcccgacgagtgtgtgcacacgcgctgggagagcaggcctccggaacccccaccttccagatcttgcaccgagaagaggaagcgaatcaagtttttgggagagcattgtgcaactgctcgcttgtgcttgagtacgactacgtcgactacttcttcttcatcatggctgatgacaagaacaggaacaacgacgggaacaacaacagttctctttccgctaccgttgcaaccactgctccatcaccatgtgttattatcctcttctttcctttttctttattctgtttattacgcaaatgaattagacatgcttgtttatatgatttacacctatagcatatctattttgcatattcctatggttgagaataatatttctatggtttttgcttacattgtcatgatttgcaatctttatttttggattaaatattatggtgaattgcttatatttccaacatcaagtacatgtagatagagagataactagatgatacccctggcgtaatttatagtagtcaacttaaataaactggaagtggttaactgtttttaagtaggaaaaaaaagcagagaaatgctaaaagcacacagcataatccaaatggaattagttgaatgaatctaagtaatagtcaaactgtacattctactttaaataaaaagtaaagcactaactttaatcggtttctgatgtggacgttattgcaaatgagcttcatggagccaaatagcaaatgcactcactagttgcagcacactgaaaatcaagtaaacaaaaactaatttttatcaaatctgattcttgtttatcagatagggcatgtttgatgaaacctccatcacaatcacaaaagaatatcaacgtttgaagcttgatgctttagtaagaaaaagcacagcaaacagaacatatgggttagatgaaagcaaatatccaaattcacactatacaatatatgtaggtataatgcaccttaatgatataataaacctatttgatcatgaaaggaatattatttcaaaattcattcgacctcatatttccacttattcttatacttctaagattaagttcgaattttaaaacttttgatttttgcggtttctttccaccaaggtttattttatagttttgcatttgaatcgctaaggccacatatataaaagtatgtcaaaaaatatttttttaattacaaataagcatatacataggcgagatgaaacaaattctagtacactttgaaaagtttgaccggaatttgatcaaagcatgatatatgaaagcatagtgcggaatctatacaaaccgccgtcataatagatataaatcgctatacatcctaatccaataagggactgggcctcgtatatatttgcattcgcatacacgattttagaatgattagttaaatgcccactctttgctatatataaaaactattacaatatgccataaataaaatatgtttttcattaaatatgttatcagttgtttaaaccaaatattagaatgctcttaacatcaaaggtcaattcggaaaaaaaaatgttgtaaaggcatataatctgtaaataaccaacttggtgacagattcagtgccatccactgtaacctttctaaaatactagtatataatagattgcattcatggcagtggcaatccaaacaaacactgcttgggctaagcatgatgtaacacataagtctaaagcatactaaata

SEQ ID NO: 67125 - DNA, 3804 bp, Oryza sativa
acaattaaacaaaataaatatgacagtatatatctaaatctagacatcgaaaagaactttcatttgatggatttatgtcacctagatagaaaatacatatgcaaaaaaagaaagaaaataagataaaaaagtatatcaagtttgatataaaaagaaatgaaaattaggccagacaatacgaacgagataatcgtgcattatatttccttaactaacatcatttttatatatgggcatcctatacctcatcctatacctctacccattcatccacacactatgtgtatgcttttaacatcacaacactatgtgtatgcttctaaaaacacaacgagagagcttagataaataatgtctatgcttttaacatcacaacactatgtgtatgcttctaaaaacacaacgagagagcttagataaataatgtctttctcaattcacaagttaagaaaatatagaattcctctacccatgcatccacacactatgtgtatgctttacccattcatccacacactatgtgtatgcttttaacatcacaacactatgtgtatgcttctaaaaacacaacgagagagcttagataaataatgtctttctcaattcacaagttaagaaaatatagaattcctaacatttctcatatatatacatgattatgtaaatataatcaaaacaaatgtcaatgtctaagctgattctttatagaatatgtatgaaaaaaatatttctaacaaaaaatacgtgtcaaacactatacataacacaaacctaaattcaggactcaacatctaagacaacaatggtcatcttcagcatattttaatttatgcttaacgaacaggaaaagcagcgatttaaatcaataaccgtcgtagtcattgtttgtttttttaaacacttttacaaaaaaagaaaataaaaaaattaaacacctaataatcagtgtacttacataaataaaattattttaaaatgtataacataaagagtaaagttggcatctctaaattatatcatatagtaaagttggcatcttcaaattcagaagtttcctaaaaatataattatatccttgttatatatttttttaccatggccaaaagaatactcatgatagaaatggacacctttataatattattatatcctctgtacatgtatgtttttaccatatatcctcgtgaacatatatgtttgatatgtatgttttaccatgactaaaagattacttatggtagaaacatggctaaaagagtacttataaaatataattatatccttatgagcatatatatttttatcataatcacaatatatacagaatagtttttctatatatatatatatatatatatatatatatatatatatatagaaaaactattctgtaccccctaaccgcgccatcccctcaatcccaccacctggcgccagccccaccacccggcgcccaaaaccgaaaagaaaaccgatgaaaagaaaagaaaaacgctctcccacccggatccagaaccctcgcctctccctcacgcgccgctctccctcttcctcacgcgctgctctccgccgcctccccctcacgcgctgctctccctcagcggcgacggagcctccccgtctggactacctctcccctctcctctccgcgcccccacccccctccccgggctccctcccttccttcctcccctagcgcggccgcagataggcggcagcggtggctggggccgaccctcccttccccagccaccttcctccccctctccactaggcgcgacggcagtgggagcggagcctcttctcttaatatgcagcctatattgtgcatgactctgattttaatttccatggacatttctagtaacaaatatcttaatttgcagtgacaaccttcttgctctgtagtaacacatctttttttctaccttttccatgcagataagaagagtggcaagattttgacaataacaaaggttgtggttagagacggtgatgaaaatctggagatttcccttaatcgtactcaaacccaagtaactgaaccaaatcttctgttgtttttttatggaggaggatggaacacactttcggcaggaattcctctaccatcggttgaacaacaacaaaccgttattgcctgcgattcttgagaaatttaggccgtagattgacaccaagtagtattgtagttttctttttgccttcccactttgtatggaaaatacatgtactcagtggctcttagacagtaacaaacatttattttggcagtaacatatgatcaagtgttggcagtaacactagtagtacttgtacttggctctcagattatatttttgctagatcggtagtaacatgctgttcttttttttccttttttttggtttctctgatgcaacagatatgtgttttttagcggtaacagctatgtaatttcggtagtaacaagtatgtactttcgtagtaacatagtactgttggcagaaacagccgttctagcagcttatctagcagttctggttttctgaatgcaaaacaaatgttatcagaatatatgtgtcacatttttctcagtcatatcggcagattttttctcagtcatatcggtagtaatattgttcttttgttctttttttcgatttctccgatgcaaaagatacgtgtttttttttttgcagtaacagctatgtatttttcggctgtaacaagtgtgtatttagctgtaacagctacgtaatttcggcagcaacaagtatgtatttttgatagcccacaaaagtagctttccgtagagtccaacgtgggctgaaagaatctagcagtaatgctgctaattatttgtagtaacttctatgtatgtctgacagtaacatacctgattttgtatttattttggtaccacaaatgtaacagtacgcccgtgtttataattaccaaggttgacgagaggacataatgacattgcagcaatcggcattacgtcgtgtatctattgttcacaacagcaatacaattttatattgttcttactttcctgcagtaacagattagtatttttgcagtaacatatatgtatcatggcagtaaacatactggtaacatgtcatttcaactggaatcatgataaaacattacaatatagcagtactagaagcatgttatatagcagtgatgtgctgccctaactgggcatcgtgatgaaggaaaacattttagcaaccaatatgcttaaagacagtcacagttatatactatggcagtaacatattacaaatgtcctacaagtcagaagcaatgtatctatcacttgtacacttattcttcttcctctttttcttcgtcataatcatctattgcttggcggttgattgtttttttgtcttttgcttctactaggacatgttctagcattgtgtccttgaattttgtgacagacgctgcaccttttgctatggtctttcggctgcttgctctcagcttgtttcgacaccggttgttctttgtctttcttcctcccctttgttattgtaaccgctcccctttgttattgaaaccgctaattatttgtagtaactcatatgcaatatcttagacagccgacagttatttcatacgcgatacatacaccaatgagcagtaaaaaaatacttgcagtaaccagtcagcagtaacatggagattcctagggaaaaagctctcttgaacaagttcacatgtaataaatcagacagtaaaatagtacaggaaatgtagtaacaaaacagttaaaatgtagtaacaaaatggtgattcctaaggcaa

SEQ ID NO: 67126 - DNA, 1333 bp, Oryza sativa
gttgtgctgatccgttacattgctggcttttctcgagggaatcattgtggaaaaagcaattgccaagttcataaataataggacagcataggatgttcatgtatgtctgaccgagatcaaaatagaaccaaacctgcaaatgttgccgagtacagataaaatgaataccgttgaaattgcatgcccatttatgacctacgaaagaagaggatttagtctttatgaccatttctgttgtgtcaaacatgaattcacttggtgtggattcaacggttccataaaaaagtattatcgttgctgttccataagaaaaaggatcaaatctttatgaccattgatgttccaatggttcttcgtaaaaaggaagctcatcaattcagtttgtattttaacgactgctgagacagttaaaccagcaagatagcaactaccaaaataaattagagtagctattgttggtaccagccagatctggtactatacatagattttgagcaaggtgacgggaagaacaaaatgccatgtattgggtcaaaatctgtcaaataacgcaccctgatgttggagactcatgtcattccacacactacttttttgcagcagttctgtgtattctactgctggaagtattttagtatttgaaatgtaacagcattttagagtttgagatgttagctcatgttgacaactctgtactgcagtgtactgctgactggagcagcttttcttgatggaagtattttagaaatctggaagatgaataattctggggtaagtatacaccttgttagcttatcattttatttggagcaccctgcataacgtttcttcaatacttctttttttccttgcatctatgtgaattatttcgcagctcattcaattgaccctctacacttttgaacttagtgatgtattgatcaaacacccactggctattgaattgagtggctactttgcacattgttgtccataaggatgtgataggctgatagcagatttttaggcatgcaattagtttgttcatttcatcggtaattatgaaatttgagctgaataaaagcaagtaaggagggagttaattggaaactttcactagtgtactctgaaaggtctagaaaaaaatggagataaatgtgtttaccaagtaaaagcggcatcacttcgatgacttgttcatatataaaatttcaaacagcagaaacagctttgctttttcccctattggttgtttactattgaaccttgcaacttgcaaggagccaaggactgaatgattaggacacttaattaaaatctatggcatttagatttgatttctaaaacctttcat

SEQ ID NO: 67127 - DNA, 2313 bp, Oryza sativa
tgataaattttgtaggaatccactcctgctgactcagaaggtttatcaagagaggagttaggtcgtctggtagcttccagatggactggagaaaaggttgatgaggtcagtaaagatgataaaaatgagcatgaagctgagcatgatatgccagaacattcagaagaaacacatgaagatgaatcagatgtaccagaatctgctgaagacagctatgctggttaccattcagaagttgaggatgacagacataaatatgatgatgaagacttctcacatgaatcagatgatgaatatgtcgatgatcatgatgagcatgttgcgtcatacaagtctgatgatgatcagaaaggtgatgaccattcaggtatatggttcatgtaacctgcccactatctctcttctttgactcctttctgtatttggttatcgatttttcttttttcttttgttctgtcagatttcactgcctctgggcaagcatcatggctggataaaattcagcaaactgtacagaatgttttacgaacattcaactttttcaagacccctgtggatttatctggtaggttgtgtattctacctgctatgatccttcaaaaatcatgtgagatgctgtgtcacttattgatctcctttttagaggcttctcgtgttcggaaggagtatgatgatgcaagctcaaagctgtccaagattcagtctaggatatccactctgacagataagctaaaacacgactttggtaagtcagttgaaagtttgtttacttggtgattgaatgcacaagtcactcgtatattcttgttagctatataatggccttgcaagtttatatatggcagcgcttgccaccattgaattactgcctaagccatccagttttttttacttttaatattgatggttcttagcaaaaatcacccagttagcatgatttgacttgtcccagaatggtaacttgtgcattgaaaaacctgtcttcaaactggaaaataaatactcaagtcgtaggagcatttgcaggaatgtgcactttcaagtcacctctcatgcaggcaaggcatgttgagggtgttcttcctttctcctatttttctatcgttaccatatccaatttcagcagtaacgcctttgtggtggacactagacagcagtgtgtttcattaatagctgtaaagaaaagcttgattatatttttaccattgagcttcattactgtggaaaaatgcatttttaagaattatatgagttgataggtattctagatgttgacttcatcagagttatgtctagttcatatattatttgataggcctataatattgaaattaattgaaggaatacattcttattaggtaaggagaaggagttctattacttttatgatcagtgctttgagagcaaggagggcaagtacgtatattagtcatccaacctcacatgcgctctctctctctctctctcgtaaatatttccatggtttactttattaccattctatattttgttaattcctcgtttattgttattcttattgataggtatgtttacaaggtatgtccattcaagaaagcttcgcaggttgaaggacatagtaccaccagcctggggtatgtttgttagcctcctttcaggtgtactaagttttcattattattgctctgcagatgtctagttcagtttttcctaataatgggttataccactttgcaaagagtcgtagagttcagaataactctcctgctcagttttagctagcaggccacctagctttacatactgcaaaaggttgtatatgagctgattgaatgcaatgttttgttttcttgtttgctttatggctccaaaattccaactctgtgcatgcatcatacaagtacagaaccattatgttaagcaatactttattactctcagaatagtgattttgcagttgttttgtgcgataacataatttttttctgctgtcaggcgctgggacaaatttgaagaatcctacagagtaatgcaattttcaaatggagacagatgctggaatggccctgaccgaagtctaaaggtgcttctccttttcatgccttcgtgcccgttatcttaagatggattgtctgtttctgtttgcaggtcttgaaacttaataaaatatggcttgccttatgatacaggttaggcttcgatgcgggctgaacaatgaacttaatggtgtcgatgagcctagtagatgcgagtatgttgatttctctacatacaccttccaccttttcctgaaaatgcacattactctttaacttacatgcctacttcatgtga

SEQ ID NO: 67128 - DNA, 713 bp, Oryza sativa
cttacaaatttatggccctagtgcagatatgtgctcatcacaataactgggttcaaagtgataattaacttggttttgcctatagcccaggtgtttgacatggacttacagcaaacacatttaactctctacagttggtgattaaccaataaaaagagctccattcatcaaatatattcaaccaatatattacagtattggctccacaaactagcttactataataggatatgcaagcatgtctataaacacaaggaaaagtcaagacatgcacttggagagttgtaacatatctccaagaggtaagcctgataaactaagtactgaaatttcgctcatgtggggtaatgccacaaatcatttggagttggcacgttgcatcccaaaatattccaaattattatttttattttgaataaatattaactgtatgctaagaataggaataggaagataactagcaagatacaactcaaagttagcattcacaccagcaaaccaataagataagacaaaagaatgacgtcactaaacaccataaagcaaagtgcataaaacacttgtgaaaatcgttattgaataagttatgctaccaactgttgatgactatatgacattgcagttgaataaagttttgtaggtataattttccagagatgtaaacatcatggatcaggtagcacactagcactgtagcagacatccactcctag

SEQ ID NO: 67129 - DNA, 4285 bp, Oryza sativa
gttgggggaaatcgcgagacgaatcttctgagcctaattagtccatgattagccacataagtgctacagtaatccacatgtgctaatgacagattttaggctcaaaagatttatctcgcggtttccaggcaagttatgaaattagttttttctttcgtgtccgaaaacccctttcgatattcggtcaaacgtccgatgtgatacccaaaaattttaatttcgcgaactatacaaagccaaattttccgtgtcacagggcttgaatgccccaaggatggaggactcagcgccggcactgtaggcccattgcacaactaccgtatgctgaagtctacgagggtgtttagatcaggggtgtaaagttttggcacgtcatatcgggtattatataatatatcgtatggggtgttcgggaactaataaaaataattacataatccgttggtaaaccacgagatgaatttattaagcctaattaatttatcattagcaaatgtcattagcaaatgtttactgtagcaccacattgtcaaatcatggagcaattaggcttaaaagtttcatctcgcaaattagtcgcaatctatgcaaattagttattttttagcctatatttaatactttatacgggtattcaaacgttcgatgtggttcgatgtgacagagtataaaatttttgtgtgggaactaaatagggcctgtagtgagagcgtaaactggggagtgatgtgccaatacagtgacactcacaaagacgttaaaatccccaatttatccattgttcagatgtttacttgttttagatttttactggttcttcctgtacaagtgcagtattgagaaggtattttcttaaatggaattatatgtaaagagtgagctaagcaatagtgctggaaaaattctgtgcttttattttaattaattattaagacgtactttatatgaatagtttgtactttcatacttgttgtaaggtaccgaattttacaggaaatatgggaagtttgaaaccaatcaagaatagtaacctgaatagtgtcaaaccaaggaaaccagaacagaaacccaactagctatattaacctataatacatcttaagagcaagtggaaaatcagacaatctaaacaatctgaactctgaagaagactaaagaacaagattaatcaacaaataccgtgggcaagactgaagaactgccttccataggtccataggcaaaaggcgccgtcgagctccaaaactctggacagcacctccaaaagaaaaatgctgtacacaacattagtccggggctataatgaaccgaaatatggagagccgcaaaaaaagacgttagctgaataaaaacctgtattgaagctcaaggagcaaatttaccgtctcctcacttccaatttgagcattgacagcaacaggaagcacaaccatttacaactttttttctattcttctaacctgttaacaaatgaattatattttgagcgatggctgctttcgccctaacaacttagggaaacagcgatcacaggctttcacatgaatattgctgtacaagcaaaaagagatggaattaacactaaggtataaaaagagaagaagaagaagaagaagaagaagaagaagaagaagaagaagaagaagaagaagaagaagaagaagaagaagaagaagaagaagaagaagaatctcctgcactcgccagtctagtacacgacaaggtaagagatcaacaactgcattttgccaccacgtgcagcaggagaacccttcatctttcagccaatccaaaccaaactgagttaaaccataactttccccccacgggaatggtggttcctaaaacgaagctaagctaaagtatttacagcacatgagtgcaccaccttaaagctggtagctggtcctgaacagctgtcatgcctgaatgttcttcacacggaaatcatgcctgaatgttgtaagatttttagtgaatttatctctgttctttggttccaagttcctagcaacatcagacatcagcttctcgaagcattgcgaaaggcgttgttgctggtctacaggctgcaaacaagacgtacattagttcttcaataatgattactaatgctgttattggcagacatatgttaacaaaacttaggtacatcacaagctggacatacagttctaatcaaaagatgtactagtagaatttaatatttttactgaaaagaaacttgtctcctaacacctgcacgctgatgactggaaacattgttgataacttgacactagaaagcttcaagcagaggaaaaaaaagggttaattggatccatgccactgcaaatatgccaattcgaaaaaatgccactactattgagcatatcggctacgtgccactagaatttggggaaattggaaccatgccacttccatccagttttctgtcaacctccgtcatctctctccctcttcctttcttcacttctccaccatggacaccggcgagcactccacctcgaactcgctggtccttgccactgcagctagccagtgatccccccccccctccatctctcgctgctccaccagcagccgccgcgacccgtccgttcctcgtcgtgccttgccggcggacgcagcaccctcaccgccgtcgtcgagggaattagcagccggggagcttctccgccatggacgccggcgagcccaggagggcgacggctgaggggaatcggcagccggggagccgatggtgaagtgcggagggacgagcggcacgggggaaggagatgaaagcgagcgctccgggaggaggtcggtggcggtggcagcgagggttggccacagcgatgcggcggtgggcggggtgacgaccggcacgggggcggtggccggggaccttgccgggggagcagacgacgacgatgcaggcgcagtctggctcgccggctccgagacgaggcgctcgacaacgacgacgacgacgcaggcgcatcccagcaggccggctccgagacaaggtgcttgacgaatggtgccatgacggtctcctcgtcgagccccttggcttggtgctgcggatcgccttgggcgggcgcaacgggctcgtcggcctcgccgcccgcgccgccgcagctggtgcggccacatcacccatcgtcgcgagatcggtgagggtgaatcgcaaatcttccggctccgagacgatggcgacaacacctaccgcatctacggtggtggagagagaaggggaaagagaagagaggggagggagatggggcccacgtgcagttgggggctaacagggatttttgacggaaaatgtgaacggttccagtttctccaattttcagtggcacatagccgaatgctgaatagtagtgacattttttcaaattggcatatttgcagtggcatggatccaattaacccaaaaataaaactagaaagacaggactgcatagtggaatatcagaccagagagttcactgacctgtgatgctaatatctgtgctctcaaattactaaacatctgcacaaagaaaaacaactgattagaaaagatctaaagaccctcgcaaaaaaaaaaagaaaaaaaacaaagacaatacaaactggaaaaaagagtgcaaaagaaatgctaaggaacatgatttaaaagttttaaaaagacaagcacctgttcactgatcattatcagactcagtattggcctactaagactccattgattacccgcatcctcaaagatgatgatctcaaaaagcgtcttcagtatctgtcacagaaaaaaaacaaaatgtaattacatccagacctttctgcatatggtagagaagattattaacacaaacctgaggaaataaagtggggaactctccaatatgccgagcaagatttagtgcagctggtgaaggagggccatcagcagctgtgatattgttgaaataaaaggccgccaagctatcaatggcagaggcacactgccaaaaggaagcaacaatttacagattagtccaaacagaaagcactaaagaacaatgatggattccaatgtgatgaacatagttaagggcccttaggcttaatgaaccaagcagtgctgaggtagctgcataagggaaggagataaaaaagagactaaaagcttgtgtgtattgcttccttaataaacctctacaacccaaacctttacgatataccccgtatcgaagaacatggaaatgattaaacagtaaccataggcagatgttgttcccattactattcatgtgcacagtactgcaggctagag

SEQ ID NO: 67130 - DNA, 986 bp, Oryza sativa
ttatttgtctatgatcaagccagtaaaagcacaattgttggaaaacatagcactaaacctgtacgcatgttaccagtgggcaaaaattgccaggagatcacctaaataaataaactaagctcgcatgcagggtacctgctggtaaaatgccaaggagactacaaacaaaatgttgaaaaaaaatatgcaaagttcaaacacaactggagtacagttctaggggttggagaatgctcttaaaaaaatgtttgaaaatgtctggcataaaaataaaaaataacagcagcatcccatgttccaaagaaaaagtttcctgatagaactctggagcccactgttggcggtactcatttcatgttttctcctggtaattttactgtgtatattttcaaataaaaaaatgacagcgctgttatgacagaatatacaaatctttctagacaggctaagatactaggatctgatcaatttgtatattctgtcataacagcgttgtctaactggaccaagtgcgtaaatgcagggttctcagttagattagaagattggcactaaaatcactcagtccagttcctgaggcacaagtaattacctctgcttaattgatatacataacattcaattcactttcattgcgatataatgagaactttacatcttcaatgctataaaacttagaatgaatatatttgagatcttaataaccatattaataaaagcaatagcactacacagcaaaacaatagtaaatcactaaagttgcaaggaatacctttttgaatgccaatatgtcagacaatggaactgagaggctcatctttaaagatatatcaagggcatcagcaagtgctctgtcaccatacagctcaaatacaccaaaattgacatagtttccacataaagctgcaatggttccagtcagaataacagcaaaagaaaaaaaatacaaatctttagtctgcaatgggagataaggttcccagaag

SEQ ID NO: 67131 - DNA, 2537 bp, Oryza sativa
acttctgagaggttcttcaattcgctctaatttcattcatgcatgaccgaatggctattttctttttaaactaagtttcagatcatggaaaatagaattgtttttcttgtggatgaaaggtgcaaccagctttgtgtctttttctggatctaggtggcccatttgttggaggatcatttcgatcggctttggcttgtggtggtgaagagctgtagatcgatgcggatgtgtactggttactgatgtgaagttctcctattaatgacgtgacatttaagagataaacttatcgctttggcttatttatgctgagcattgaacacttctcgttaataaatttcctggggcattttctatttttcttgatctgtaatactccacccattttaaaatgtagctatttctaaaatttaaacatgtctaaaaaaatatagctattcctaggtcaatgctattatgtcaattataatcctatgaatccaaaaagccttattcgcgaacgtgcacacaattgctagcgaacacttcctgcctgtataacaacaataggttagggttaaggggtggaggggggctaagggggctgggctgtcggaacgtgcctacggcttgcgaacacgctcgcccattagacccaccctatgaaccacctcgcacccactaacctacatattccttcatgtcttttgtgttttaaagaaggcattgtggtatttttacctttattccttactccctcgaaaaacctagaaatagacattttgggatagaaggattatgcactacaccctccatcttttaattgtagttttagtcttagaattcgtccttaaaaatgtgtggttttagagtggtccactatacctctttaatgctactactaatagtaatctttttttctcatttgtagttattgaatcactacaaatcatttatttcggttttagagtagttgtttggaagaaagggatttgctctgtgcatttgattggagaagtacagaatcaccacttgttttctctcttgtccatacgggaaaatttccatgaagttttgatgtagcttcgttttcgatgaaatggtaggaaaagaagagaaaataaatataaaccttaggaatactattcacgaattcctttgttccaaacggcgcaacagtaaactcctccaagaggttgccctttctccatctcctccatcttcccatatgagcttttacttgttgaataaattaagagcttacataagctgattgtcaaataattaaaacaaatcatgagtatattaagaattgatgcactagaccttggattaaaaccacatgactcttgacagttgccttagcactgtcaagtactccatccgtattagaataaatttattttttggcacatcacatttattctaaaataagttaatttttaagtaaccattataccggagcttataaaaatacaagataaatacataagggtatcctaatatatttttgtattgatatatatatatatatatatatatatatatatatatatatatatgtgtgtgtgtgtgtgtgtgtgtgtgtgtgtgtgtgtgtgtgtgtgtgtgtgtgtgtgtgtgtgtgtgtgtgtgtgtgtgtgtgtgcgtgtgtgtgtgatggattaaaaaataaatttattttagtacggaaatcgtactttactagcatccataacatcatcttgtctcaccattaaaagaaaacagcattatgctgtccccgggcctcgcataattgcgttgctcctcccctcctccctcgaaaaccaaaaaaaaaaaataccaccacgaaattatttctccttttcgttttcggaaaaagtacgaattaccccctgaaccacaaaaccgaacattttacaccttcaactatttttaccgagcaaataaccccctgaatcaatccggagtagttttacgcctacgtgtcagtcagtctagtcagtaattatttattaaaaaagtcggtggggaccacctgccagattctctctcctctctatctctttcccctctctctatctcgccgcgttgtgccgaagaactcctacatgcgctcgcccgtcggccatcggtggagctcaggggatgctgctgaagcacgcggcggcggccagcccgtcgagctcgccagccgggcctccacctccttgtcggcataacatcgcagcaagtcgctacgcggtagcggaagtactcccgcacggcggagctcgggcggcggcggcaagcccgtcaagctcgccggccgggcgtcctcctcctcgtcggcacagcagcacgttgtcggccgaagcactcctgcatgcgctcgcctggcggccaacggtggaactcgggcgaaagaggatgcaacgacggcggagccggagctcgcgcgcaggcagtgacgagcccgctgccgctgtcgtgctttctcacactttgtcagccacgcccggaaaatcctaacaacctacttctagctgccaacaaacactcagaagattggatcaaatcagtacacggaggaagac

SEQ ID NO: 67132 - DNA, 3939 bp, Oryza sativa
cccactgacttttttaataaaaagtattgctgactagactgccacgtaggcgtaaaatcacttcggattaatttagaaggttatttgtccggtaaaactagttgagagtgtaaaatgtccgattttgtgatttaggggttaattcgatcgcacgatagttcaagtgggtaattcttattttttcctttcgttctcccccgcgatcgagcgacggcgaatccaatccaggacaaaggcacacccacgtgcggatgcctcgccatgccatgccggcgtggggcccactccgccagcgactgcgggtgggcccggataaaggtggggcccacgggtgggggcccgggggtggcacgtgggcgtgctggtgtggtggtggtggtggggccgaaaagctgacggcggcgaggcgactttcccgggctctccgttggccgtcgctgtcgctttatcctcgcttttgggtgtgggccccactcgctgaacgtgaaatggacgcgcagatcagatgtgggcaacgccaaaatatgccacggccacacgtaacccttacacaaatctcctgctctttttttaaaattttttttgaaaggttggttttttcaaaaacttattacgaaactagattgtaagaaaagcttcattaaatactatttttcggttgaagttttttttttgcacaatctagtttcacagtaagttttttttaaaaataaccaatttgtcaaaaagagggggggacacaactctaagcatagtagtggcggagctaaaacgaaatataggtattactatgcttgaagtgcacatatggtgaaaataaataaataaataaaattagcttgggttgttcgacatcccctagatacatatagctccgctcccgatattaggctcttgctccaaatattaggtgtagcataaaaagaaaaagaatactccaaatataggtgaggagtatatgcagaaattggaagacacgggcaaggttcacagtaccaacgaaaaccgatcgaattccgcaaaattttgacgtttcgacacggctcggaatcaagtttcgatttcgaaggttaaacagtagatttagtcaaaattcatcaaaaaccgtgataccgatggagctcaaaatttagtggtcaaccggtaatgtaaaccatggacacgggaaaatatgtcgcagtcgcatacggcaattttccgtattggtgtatttttatgtttgtcgctactactactatattatccatttgcactgcatttcaaagttgggcatcgctttaccacaagcgctcagattgtatacatactaatatatgctactcttagaaaattaagggcttatttagttggtgaaatgaaaatttttgggtgtcacgtcggatgtttgaccagatgtcgaaaggggtcttcggacacgaatgaaaaaactaatttcataacttgtctggaaaccacgagacgaatcttttgagcctaattaaaccatcattagcacatgtaggttactgtagcacttatggctaatcatggactaattaggctcataatattcgtctcgcgatttacatgtaaactgtgcaattagttttttctttttatctatatttaatgctccatacatgtgtctaaagattcgatgtgatgtttttacgaaaagtttttggagaactaaacagggcttaagtaaaactagtcatgtagtctctccttttgcaggacttttgatctagtttaagaacttttgtatatgatttgttagttagcttagcttttaagaaggttttgatatgagttaatgtatttacaaaatattgattggtctaatcaactatagatttagctaaattatgctatatttcttttaaaaaaaggattcactagaagcctcctgtgttttttccctcatagtctttgcccgtatcatgtaattcccatatgtttagccttaccgtttaatccaatgaacattgtttattaaaattctttatccaacagttttcgatgacatgaagtatttaggggctgttcagattgatgtcattttcaaccgtaccatttattgtaaaattatcaaaaaattaactacatttagtttattgtcaggctttgagaaatatataagaaattctgccaaaattttgataatattatcaacttgtcaaaattttaacattgccaaaatttggtaagatttattttagctataatctgaacaaccttagagtatcataatttaaagtgcaatatgaattgaaaaatggaaccccattgaattttgaaagtagcacaattttttttaattgctagagaggctggaagggcaagtcgaggagcaacgcaaacgcaagtgttctcaaaaaattaaaaacgcaaacgcaattagttcgagtagggcccacctacctgccaaaaagttcatgctctgaaattgcctcgtcaaaagcatccccgtgacgtggatccgccagcggctcacgtgaccggctgcagcaggtcgctgcccgttgtcaattcgggcctggttttcgaaaggacaacacaaaattcgggaaaattcgagttcataaatttataatatgattttataatttataacaaattggtattgtaaaattgtaagttcacgacacctataattacgtgtcagatcccttatgatttcatatacttagagcaagtttaacagtttagccaacttctagctctaaatcatttataaccaatgcaatagctaattcatacaatactccctctggttctatattaattgacgttttggacaagattgaggttaaacttttataactttgaccatcaataactttaaaaatatttagtttaaagaaactagaaaaacatatatagatttgtctttcaaaacactataataaaaataaacatgcatttatttattgtatatattataatagaaaaataaggtcaaagttatatcttatagaacgtgtcattgtccaaagcgtcaattaaaataaaactggagggagtagatgcttactacactattaataactggtcacacctatcatacatgtattacgtcttggagtccgtgctacagctgattataaatctgtaacccactgctcttctctctattcatttatctctttaaaatatgtttatagctagcttataatctgctactatacctgctctaatataacacctaatggttaagatttattgtctccatttaaaaatataaacgcttttagctgtgcagtgagtactgagggagtaacatttccctattacctggaaaagaccctcatgcatacacataatcacgcgcctacatcacacacacattaaaccttatgatttgaatgcaaggcatcctataattctatccactagtagtattcaaacttctaaattagactaaagcgaaatctgttttactattcatctgtcagaaaatgtattttataggttgtttagtatatattaaggttaagggaaaatatttctttactcgtctcagtggttaaaatttaggtaaattttgtaacaagatattgtggctgcgcggttttagatccgcgcaaagtgatttttaaagaaaggtaatctttaaagttagatatttgctggtgaacaccgtatccattaaaacaataattttcaggtgaggaagagagagtaatcacgtgaaacgtcaaaaattctcatgggcccacatgtcagctctcctatcactcttcctaaagaacttaacggaaagccgctaacgaaatctgttaggtgatggcatttctatgacaaattaccttgtacgataatattttataaaattcacgcttatcgatgatattttgtgaaatcgggtgtttgtcaatgacattatttgtattttctcaaaagagaaaaaaaatctttttagagttgaccggtgcagccggtctccctcccataccc

SEQ ID NO: 67133 - DNA, 1086 bp, Oryza sativa
cgagttgggctcttgggcctccattctctaccaaaatccaattccaaaggcccatagctcatatgccctggctcgtgagcggctcgcgagtcagctcgattcgttaggaaaatcaaacgagccgaaccgagccgagcttggtcacgagcagagctagctaacgagccacgagcttcctccatccccgagcttcctccaccccctagtactactactatagtgtcattactccgaacacaacgcgagcggccgcctcctcctccgcccagtgacatgccacccgccgccgccgccgccgctggcatcatccccgctcgtcgccgtcgtcgtgctgcgcccgaggaggaggaggaggagccggtgccggtgccggtgccggtggtggcagcgcggacgagatcggggcgccgctatggccgcgcttaggcagggcgacgaccccgccatcaagctcttcggccgcaccatccccctcctcctcgacccccccgccgccgccgccgccgccgccgacgaggtgagccatcgatttcatccaatgccaatagggaagtagtcggagagaggaatctttatctaactccctccccgctttggacgagatgcgacgcgcctcgctttctctctctctttctctcttttcctggctgctttttggggtatcgatgctttgggtttgctcttctagttcgtgtcggctaattaggagattgagaaatgagtttaaaaaagggattaattctttgccgccatggtgttcgatgcaaattctcaagcacattcttcttgttttttctctctccaaagaattcaaataccgccatggtgttcgatgcacggctctcaatacactttttggcaaatactaaattgacaacttttgcttagatccattttgtaaaaagtactccaaaacagcaaaacttttactacccccgtcccaaaataagtgcagccatgagtttcagcgccctactttgatcatccgtcttattttaaatttttttataattagcaattttgtagttataagatgataaaacataaatactaatttactcgtgaattatgtttttaattcttttc

SEQ ID NO: 67134 - DNA, 751 bp, Oryza sativa
atactgtaacatatataaccaattactcgtttctctatttgtcgtgaagcttggagtcacagcaacgcatgtggttgttgatggtgttttggtgtttcttacagttatcatgagaatgctaccaatagaagctgtgaatttgcacttaaaaataggctgaaattgaatttatttaacgaaaatatctaaacaatgtccccctatgaacttaacctttggtaaccagcccactttaagagagttatatttcatattgtattatgtgcagcatgtaaaccacatactgtccccataaaccaaatctgtttctgtattgcgacactacgtatcacaggatgctctccaatttgttctttactttcattaacctgttttagctgctcttataaccattcacagcttcacaaatttgtgaatgatgacttgggtgcattctttgcagagatatcgagtattaagtaagcaaagacttggtcgtgctattcttatctttgtgcaaaatttcagaaggtcatatgtaggagatcaagccatgcattcttcaaaggttagaagaaaccgaataataggacataactattataatttttctttttatcttgatgtacctttttatgtaaatccccatcaagttttacttctttgctgcagcagttgtatgcaagattatctgagcttcttggattgaatgaccatttagttttactcaatgccattgttgggaaaatagctactaatctaaagtgctatg

SEQ ID NO: 67135 - DNA, 1114 bp, Oryza sativa
ctttatattcatttttaatttttccagaatttggtattaccaaaaatatttggtaagttgctaacgctatcaaggttttaaggactggttaaatatgatgatcaattctctaggtatgataaatatttagtaacaaactaaataatatcatatatttatcaattttactaaataatggtatggtataaaataacatgattctgaataggccctaccaattacaatcgccgttcgaaaatttaggtcatgtttttttagagaaaagtaagtgaatgaattaatttagatatctcaggatgaaattttcatgtattggaaaacggtgccttaggagggaagtagtagtaaacggaattatttgcttaccttagctatgtttttttttatttacgttttgcagttaagtcctactagtgtcgagttttctatgccagcgacgtcacattgattttcgtagcaactccgtacgagggcatcggtgctcctgaaaatattggttttatactctgtaaaagacgaaaaatttgcgaaaaagaacatatctccaaattacatggaaatatccacgagtttcaaaaaattcaaattcctataacaacaataagaaatcagcgtcctacaaggtaagttcaataatacatatcactctttgttctctctataatagccggctgaagtctaccatctgcatgtcatataataaaattttaaacaaatataaatcacaaagtgtttgctaaaatgttatcatcacattttatgactgattatagtcaagatctaatggctagttataagttttccattaaatttgcactagcattttctatttacatctatttacgtcaacttaacttacattgtaaatacattaaaattacatatataacttagggacttacgatgtatgtacgtgttaactatattttatgaaaaatacgacggaataaatataggtagtcccaatcacaaaatcaactcattaaactatttgccttccaaaattttcaacacgaagaacatgattatatagccattatgtcaatgtctctaccaacgcacggaaataataggttcttgcaggaggtccactatgcgaaaaaaaaaaagcgac

SEQ ID NO: 67136 - DNA, 1314 bp, Oryza sativa
tatcaaacacgatacaacttgttatatactcccaccatctgagaaaagaatgcaattgtacagtattcaaaacatgaattagcagggaagcaaaatggcttagatatctccccttaaatggggatggtaggaagtgaaagggtgattgtgatcaggggtcataatttcagattgaaatttccaaaattttggttctatcggaccccccctcccccggcgatacgatatagtttcggccattttcttttcattttttcatgaatttgataatattttattcaaattttattcaaaaaatcgtaaaatttcggaccaaaatttcagaaattttggccacccttgatacaaatcagcaaaccaaaacattaaaccctaattgtgatacgattaagaaaagtaaataactagtattttttatacattagagcatctgcgcttcttatttgattactaagggtctgtttagttggcaaaaaatttcgtcccttcatgtcacatcgaatatacggatacacatttaaagtattaaacgtagtctaataacaaaacaaattacagattccgctaggaaactgcgagatgaaattattaagcataattaatccatcattagcaaatatttaatgtagcaccacattgtcaaatcatggtgtaattaggcttaaaagattcatctcgcaatttgctggcgaactgtgtaattggttttttttctacatttaaatatttaatactctatgcatgtgtccaaacattcgatgtgacagcgaaaaaattttgtttggaactaaacatgccctaagattgaacaaaagtttgtttctttcgttgaccgtaacgtttgacattaattgtggaaccatgtaaaaaaaaatctctaatcacatgcccacatccttccttgcgcggccagccaactacggcagaccatttttttcatcgctaagttcaactaattgactctttctttgtggtagattttttttataggcaacagttggttgtcatagcgtgttgtgtttttttttaatatatggttcaattttacttatacattcgagatgcttttataagaaaagttctagtatgtattggacagatgaattattgaacttctaatatttattcatgacaggctaaaatgtattagtagttaattttatttgactttttagactaagtgcagttacttgaagggtgcggttgcctgtgcacgcacgaatgcttcggcggtgagtaccaccatctatttcactcgtccacttatcattgttgttatgtgactgtctgaatggaccaaaatgacatgattgt

SEQ ID NO: 67137 - DNA, 2644 bp, Oryza sativa
acaacatcctgatgcaaaatgctagaatctggtctggctttattgaaaggaagaaactgtataccccttggtatacgaacaggtaccttttgagcatttcctgatatgccagcaaggtttttaaggatggaatgatgtttgataggaacagaggttgcaggttcaccactgtatactgttgaagttttctgacgacttgtttgctcttggcaatttgctttttcaggtactgatgacgcattagatttctttgcatctggtgtggacggaccttctgcagttggtatctgacaacgagtgcaaagcttgcttaattcacagcatttgctaatattaaaatttaaccaggctataacaccaataattaaataagagtgaatgatttgttaaattacgtaccacatgagaaaatttgcatttatcacctctgatgcacattccattttccataaaattgtggcaagggtactttgacaactcatgatcataagggcaatcatctcctttcaaacaagaaccacgtgcataatgcgtgcagggctgtcaaggcaaaaaaaaaatcaggataaaattcgcaaaacctcaaaaggacagatacaacaggaagtttagtaccaatacttggatcaagatttgggtacacttcagtttatgatttagcactatactgatacgtattcataacatgtgcagtgcgaacctgttctgtgcatgctttaaagttcaaattcaatattgatgtcacattttcatctaaaaaataggtggtatgcataggtgcgtacaaaatgagctcatgcttgcgtgtgggcagaccacatagaatatatccacacatattaaacagcatacatgcatcttattataatacattatgattactgcaagcatgtgataaacttctatgaaatggataccttagattttgtcaaaggtgtcgtatcatgggagaacttgcacaaattgccctgcaataaaaaaataagaaatattaggtactacatccgtttaaggttataagactttctagcattgcccacattcatataaatgttaatgaatctaggcacacatatatgtctagattcattaacatatatataaatgcgggcaatgctagaaagtcttataatatgaaacagaggaagtattttattaaagtaaatcctgtgaaaagcatttttacagtctttgtaacatatttatatagaaaacataacacatatacaaagaataaagtggacatgttacatgatgaaaacaatatgattatataaacagtgttcatcatggtctaagctctcaggcagcacaccagcgcctaatcagcaaatagacagacctaggcagggctaatcgttaccaggtgctatctagtggacactgaatcaaaatatgcatcctatgctactgatatggctaatcactaaattacacaaatataatcagtgtgtccagaaaatcgctacaatatgtttcaaggccagggcatgtgctgtgcagtttacaacagcaaagaatataattttttgtcgatccaaaagtgaagcagatgatgactaccatctgtctgatctgagagacagactcacctgctggcacttcccatgcaagtagaagtggcaaaccttcaccactttaggctttataactggttgaagtttcagtcttttcaccccttcggcttcccgttgcaatgctctcttaattcgattagttctctgcatattaatagcattgaaagcaaatcttaatactttctataggtaacaaactatactgaatgcacacgttcaaaacaagtgtatactatagcaaccaaatggtcactgagatcagaacataccgtcttcttagctattctctcctctgtcaaggtgacgcttcttgtgtttccatgtttgagagcctgcaatattaatatagaacagactgaaaatccatacttacgtagctaagaagaaaatcttaacacagacgaatcaattgtattgtatattgttcttaaaaatcttgcattgtaaattgactgtgattaacttgaagttacaaagaaagtcatgaagtgtgaacactcgaactgcattcattgtactcaagcaaggtatgtatgcgatgattaaaaaaagctactgaattcagttaatatgaaacatcaaacaagaattaatcaaaattgtgcataaacaatgaagcaacaaaacagcgtatgggtaccaaaaaaagagagaatatggcaagcttgtacgcatttgtggttgacaaagaagctataccttatcatcaggcaaaggtgtctcattccaatcgagaacttcatcataactgactgcttgcgccctggcaacatgcatttgagaatcacccttgctattacatagcatgttccgtgcagtgtcgccatttcctttttgaggtatcaaatgcaaattgctctttaagtcatggccacatgacccatcctcctctatccttctgctatcaaaatcctcttccaattccacatcatcttgaagctctgaattgccagaatcatctgcatctaaattctgcgtgtcgccctcaatctctccttcctcaaaaccaccaccaccatccagtgacccatgatctaaactgcacacagatctgtcattgccaatcc

SEQ ID NO: 67138 - DNA, 1586 bp, Oryza sativa
  unsure (1)..(1586): unsure at all n locations
acaagttgttcatcatcgcatcgagttgcaattgctcattgtcattaccaaccatttcaatcaccaattcactatcctccccgtctaagcaagcctgcatcgacctcaaagcctcgtcatcccccatcagtccagccccagcccccaactcatcgccatcggcatcagcctccccggaagtgcctccggcgaaaacaacctcttctacaccctccacccgctcgaccccagcgactctaccctcctccgtcccctgcggcaccacgccgggatcggtggtagggttcacggcggcgtccggggacgccgaagtcgaaggcgtctcgtgcggagcatggtttcccagagccacctccacctctaagttcttcccccgatcgcctcccacgtctgcaggaggcggcgaatccccatggggaagcccgccggagccgccgggagggatggcggcggcggcggcaggctcgacctccgcgtcggggcgtgccgcgtgccgcggagggtgcaggtggaggcagtgcgagaagagccgggagagcgcgcggtaggaggcgctgtcgagatgggctctccggcgagagaggacatcggtggtgggcggcgcggcggcgagggaggcaggagccgccgcgggcgggacgggcgagggttcctccatggcggaagggactggatgagtgggtcggagctagggtttagggttcgcagctgtgagctgtgcgtcgcctcgccgcggctgctcgtcggcggcggcggcggcgacgtggcggcgagacgagaggaggaaaacccatcgcagggaaaggcagaggcggcggcaaacgagggcgcggccagaagcccagaatataggcctagtaattgggcctaatgggccttgctacagctggttgagtaaaggaaaaagaccacttagactctcttaatagttcaccgaatctaattcgtgacccttaactagaaaaccgggtaggacgactccccgaattattgaaaccagtgcaatttgactcctctagcggttttggagggcggtttcgctaacgtggcactgacgtagctttacaattaaaaaaatatctgtgggaccaatctatcattcacacacaaaatatattgtgggacccactgacatctggagcccacgtgtcatcctttccctttcttcttcctcctccctctctctctctcccttctctctctcttctctcccccttcggacgcacgcgaggagcgggagccagatcggcgacggcggcggccacgggctggtacggggacggatcgcgcgcgcggcggtgacgagngacgtaagggacatcggcagtcaggacgcacgngttgggcgctggccagggctgaacggcgcggcgtccatccgaccttgctccgcgatcatccaaggcgcggacccagccgactggctacccactctaccttaaagtcccagagctgcagcctctgctctcccccattggtcgtcgccgccggagcagtagcagcagcgccgcacgacggctgcaaggaagaacgagaggccggcgaccgcagccggagcggcggcgaacctctgcagcaggcagggg

SEQ ID NO: 67139 - DNA, 7168 bp, Oryza sativa
ttaggcagctccacaactctactccagactcaactcctgaagttatatttaggagttggagctgtaacaaacagggcccttccttatcgctctctctcaccctttcttttctaaataaaaatagataggcagccccctgtcgtcatgtagtcgatcttgggcaaattgctttcgaattccgatatataaacgtggaaatatttgcaaggcatgggggccctggtcaaccaggagctcggcggctcgcgcacggtgcaagttcaacagcagcagcagcagccggcgttggacttccaggagaacatcctcctcctcgtcggcgacctcaacgcgcgcgaatgccggccaaagaggaaaccatcgtgtacgaggcggatccggacgcactcaccgtggaccttgtcgacgatccgttggttaaagagttccgtgacaagttagtggatgaggtcctcaccatcgatgccggagatatggaggcactattcgaggaacaccaggagaatccggagctggagaggacgctgatgctgatctctcagtccgaccaagacgctgatgccgccgatggcgacaccccatgagactcttattacctttctttgacgtgatttgtctcggactttcattttttcggcccagcatgtgttgggctgtgattgtttcttttctttgacctttgtcaagttttctttcagccttagtaactcttctatttttttttctagatcacagccgaattccttccttggataccctacacgtactactactactacttctgcggccgtggataaggcggcggagacggaccaccacctggccacacgtgcctgcaggcgctgcgtcttgataattctgccaacggagaaaacccatgaggaggagtttatatttataggacgtgactaatactcgtagagactatactctatactgtattaactatagaccagggtttcccaaaccgccggggccggggttaccgcgcaccggcagtaagcacggttaccgcgcggtaaccgcggtaaccgtgtaaaaccgtacaaaaccgtgcaaaatttataaaaaaaattaaattattttttaaatttatttgaatttaaggatgttatcgcggtatttatattactatacccccgcggtaagcctggtaaccgcggtaaccgtgtggttaccggcggtaggggaaaccttgctagagactcatttcaaaccttgttgcctaactagtacaccaaatgtatacatgtgtacaaatttaatatttcagaaaagattatatgtacaaaatatatctattataaagtttctatgcgtaaacttttctacgtataaatatttatttttctagaccggagtaacacgctgataaattcattctaaatttaaacgtacaggtttcataggtacaaaaattacatttaaattactcgtacagggtatctgaaatttgtataagtatagatcggtgtaaaaatatgtatataatctctatattcttttaaaaaagtagtggtggtgataatgaatttgccaccccacctacctacttctattatgaattctgcaaattatctcttcaacttgctaatatttaaaacaatcaaaatctggatataaagccacatataaatcaaatggatagccacatgccacacattttctatagcaaaacgatgggtaacatgtttcatgggaattttttttgtttattttattttatagcaaatatgcccatgtgtttcaacgggagatggctcttttggttgaccatatcgtccatgtagaatgtagcatcgttagtttttactcttggttaaaaagacaataggcaattatgttcttaactctgttttcgttctatgattttgtccttgcttattaactaaaggtcaagtttgcctccatttcattaagatgacttagcggtgttgtaaatttagccctattattttctgaagaatttatgattttggtcttgatttgacaaaagtgtgttttgacacgattttttcccaacctgaattttcatattctgatcagctaattattaaattttcatattctgatacatgactactcattcatatttaaaatatatatatgaaaatagtactctgataagctagagtactataatttgatagtactccgaatatgagtgagtgtcggatcgccattgcagtgatcaaccttctcaccgttggccatgcacaacatgcagctgaattttcccttcagcgtgtgctagcatgtgtggtggactcgctccgcgctgacgaaccttgtcttgaggcacacccacacttgtttcgccgtcttcttctttgccacccgcatgaagagatcctttggaagcgcatggagcaagtgcgacctcaccttcttgtcaaatgccctaatcttccatcatcgcctgcagccctgcacccggatcacctagctggtataggtggttgcagtgaccagtgagctgcgggtagaggaaagcgctccccgtgctacgccgtgccgcgtctgccgtcgtgacgatagacatagctctgttatctttttttgaaacctaaggcggaacttagttccacttttatatttagaagaagagaattggcccagtctataaggaaaatcgggcccaaaaaccatacaactgcacggttaattacaaacccaccgctacacaactaacaatgacggcggagcccaatcgcaggacgtcgccacaaagctaaacacaaaagcgacacaacagcttccacatcgcagaagaggtgttatcgttgccgagctagccgccccagcgacccagcagcgccaaagcgaaagtcgccaaagccactgaagacgaaagtcgccaaagcgaaaagcggctccggcatccaacaatagacatcagccaagccaccgaggagccacttccttcacacggccagcaccagaactccttggaagagactgcaacatgtcatcgttgctaagcgtcgctgcaccccatcagcgagcagcttcgacttcatcagcagaaacaaccgaagagcatgtcgcccaccacaaaaaagaagcagacccaagaaggcgaagcctcaccgaacacaagatatgaaagcttttgaaccgaaaaggaccatcaacagtcatcgatgcattggaacttctccgaagcgacgcccctaaggaggatacgacgtgtgacgccgccgccgctcgtccaaaaatcggaacaaggttttcacctggagagatttgtgaggatatgaaagagtgccatgacaacgcctccaaggagggaaacgacacccacgggcgcgccattgtcgaaccggccaaaagcacggtaaggctttcgccagcatcttcacaacacccacacaagcacccccacatcgatggccgcagaatagttcatgacgtctcagaagcaatcataccttgattgtaaccaacggcaaagacgggcccttggccatcctcgaaatgccatccatccgccgcaaacttctacagcaagccggagcctccgccctccccatagcattccccatgaccagaaaagggtccggccaaggggggaaaccaaagagagggagaacactcggccgacaatgaggaagtcaccgtcacggacatcaagcaccattcctgcttcacgccagcacaagccgtcgtcccgccatttccacatccgcacatcgctgcccatcaacaacaacgagacccaccaccggcagaagccccctgccgagtaggaggctggctgccagcgagccgccgccgcgcttgccgtccacacgcagccgtcccaccgaccagctgccatctggcgtggaggcgacgaatctagccgcggacggccagatccagccaggtacaggggatgaccagctagggcgcgccgccgcagcattaccgaagccaacaccgacgcttgacagacgccgacgacaacgccgcgaccatgacgggagcgagccgccactgccgtcgcccgtccaccgcgacgccgcccctgcctgccggtttccgcgcctccccggcgccgaccactctcccccagcccggattggagaggcgacgcgagggagcgccgttgccgctgctccacctttcccgccgcctgcatctcccttccccgcctccttgggtgccgccgtcgtcccgggaggaggccggaccgccggatttggcgagggacgccaaatctggcgtcgtcgccgccgcccccgttccgcacccagccgccttcgcccagctgttccgcacccggtcgcctctgcgcgcctagcccgacgccccgacgccgacgccgatgccaccgcaccgtcgccgcccccaactggtcggggtcgtgggcaccgacccgcgccctcgagggagaaggaaggccccaccgccgacttcctcgcagccgcgcggtttccggcagtctgctcgggcggcggcgaggtggaggagggagcaaggcggcggtggggagaaagacggcggtggtcgccacccgtgtcgcccctgcccctggaacgacacgggggcagttctcatagctctgttatcgatcactggttgcctagaacctcaatcgaacaccttgcgggcagggactctagttgctcggcaatgccaaagaacaaagaacttaatttgtgacctatctttgtgactttgtgtgtcttctattgaatggaacaagttgggatacaatttgtgaggaatgtttcctttctttttgtagcaaagtctaaaaacagaatccggccagcacacatgcgtacactagcgcgattaacccaaacaattttgctatatatttgtcgataaattttctcctaaaaatttgacaaatataattacagtataatcgtagtgtaattacattgtaactacaatgtaacttatatgtaactttcaaaaatctctccgtaacatgttatttgggtaaaatggaggtcgtgggaacaaatcctttcacatatgtgtgtgctgtgattttttttctttctcaccagaacaaatctggtaatagatctaacgattcaaaattacatgaaatttacatacaagttacactattgttacatgcaagttgcagtgtaattacatataagttacaatataattacactataattatactataattacatctatcaaatttttagaaaaaaatttgtcgacaaatagaaatagatataggtgttctcaatccgaaaattcggaacgccacgcgcacacacgccctgatcgcgctcccggcatctagctggctccaatccgttgcacggccgttggcacccaccgagccctgacaccgccgccggcgaaacagcaagacgacacgcatgatcaggtccggtcagctaacgaaatgctgccagacgacacgcatgaggccttcgcgccgtacgaagcatgcatggtttctgttttctgtaaaaaaataaataaataaaagtcttctgcattttcctggtatatattccgatccgttccctggtttcttaacagtgtatccgactcggacttgttgatcgatcgtcttttttctcgacgtgcgcacgcacgtacacagaccgaatcggattatttgtgggcgagcagtgtctatatatttgctccggtggccgaagcgagcgagccgacaagccacagatcgatctctagctcgatttttcaacgagaacccctcgctgatcgaccgcacgccgcgcgcagtcgtcgtcgtacgtcgtcgtactcgatcgtcttcgacgacggcaatggccgacccgacgccgccgccaccgtgcgccgcgtgcgcgcaccaggggcggcccagctgcccggcgggctgcccgctggcgccctacttcccggccgaccggccggagcgcttcgagtacgctaacctcctctacggcgtggacggcatcctccgccgcctggaggcggccgggccggacccggggacccggcgcgccaccatggcgtccatcgtcttcgtgtcggacgcgagggccgccgaccccgtgcacggcgcctacggcgtgatacggaacctccagcaggagctcgccagcgtcaaggccgagatcgccgccatccggcagaagcagcagcaagcccagccgccgccgccgccggaggacggccactaactaagcctacgcaccgccatccgcatttatatatgcatgctgtggagacggttcaattagattatgtttttcttagtaactcattagattgctgcaatattaattatctgaattcagagtttagctccatgtttcggaaataactaggattagcacccccacacgttgccgtgcagtgggtgcgacggtatttccaaaggatgtcaaattactcctctatttactgtatgtcatatatgattatatttgtatttaaaagtgtcttataataatattattatgttgaagggcgtgtagaaaactttgcacacttctctgtctttatctctatatctaactctacgtgtggcgtttcggttcagaccagaagttccagattcagaccggaagtttcagattatttacttccctgcaaagtatgaatttcaaggaacgcctattcacctcctagatctatatctatatctatatctataataactaatataaatattcggatttttccggtcgtcgcatctcttttcgtccgtattttcgtccgtccgtcgtatttcaatctcaatcccaatccgactatgttagcgatggaaaaattgcaaaaaaaaaaaaaacaattcatcacagattcacaccaacggattctcaatcccacccacggattcgcagccaattcatcacagattaaaatccacaagaaaggagaaaaacgaaaagacgaaaaaccgcaaaaaagggcgccgccgctgggaaaccaggccaccaccacctcccctggatccaggacgccggatctgggataccgagccgccgccgcctgccaccgtcgagccctcccgcggccccatggcaagggagaggaggcgaggggcggagaggcgctgccgcccgttgccacccgcggaaggagagctccgggctcaagacgtcgactggagaggaggaggtgcggggtcgcaggtagagggagaaggagagaggaggcggagagaaagagtcgccggaggcggagaggcggagagaacgagagagaggag

SEQ ID NO: 67140 - DNA, 1287 bp, Oryza sativa
  unsure (1)..(1287): unsure at all n locations
atctggtggcagaaggaggtgtctgctaggttttcttttgttactgcctgctagtaaaaaatgacagaaaatgattacatatgaatagaaacatagatagaaagatttaaatcacttgtccagcatgtgcaattttgcaggaggcaatatagcacagtgttttttagccaatgtaagttggaggagtatctggctgatttaattgtatatcttctattacccggcgaaaacagaatagacatgttaatgggtagtgtaagttgaaaaaatgtgatgaggcaaactttgtacctgttccattcctcagaaatggaacgcttttgctaggagatgcatggtcaaatgtgcttgctctggttaattgacctgatggatcaaggggccttttgttcgctgatgagctgttggatggggtcttcactggacatctaataaggccttgtctgttcagtatcataacacacgctttagactgtgatggcatccagaaaagaatcgtttctccagtttctaatccagttgcctctacaaattatttccatcatgtcgtcatgtacagtgtgctagctacttccttgattttgatctttatcttcaagccatgggaagtttttaacttcagattatctccacgctgcatcttatatgctgtcgcaagtgtgattggcacaggatgtagaaagaaaatatcatatccgcactggtgctaacagcatattgtacatagaaagttttgtttgactttgagcttaccaagtagctttgatttgttgcattcagcctcattgatgcgaaaactgcggaagacatgattgtggctacaatatatatacacatgtagttagatgtatttgataaataaaaaaagttatgagaggctcagctagttattagagtttttattataatttttttattttcaaacagggtgagtattttgggatatgtagaaatgcaatgaagtatgtgatctataacttgatgtatgtaagtatttatgtgatgtaaatcttagttgtagctggaaagatatatatggtaagaacataatgtgctgggttaagtggctatactacggtaagatataagataattatgatgcaagaataggactaaatagctgtgaaaaagcttaataatttacagttgatgtaagtatttttttcnagtatagtagctaaaggatttatgtgaaagagtattaattatttattgtaatttcgtgtaatggtattgttctacatgtattgaaaaagggaaatttttatattagaaatattaggaact

SEQ ID NO: 67141 - DNA, 742 bp, Oryza sativa
caatctaatcctctcgatatgttaccaataattaatttctcagtctatcaaaaaaaataattagtttctcagtgttagtggtgaatgcgtacgtggcaaacatcgtcagataagagggatcatcaatcaatatcaaggaaacctccggccaggcgcataacacaacacgcaagtacgcaacataccaatattgaaaatttcaaactcaaaatcttccattgcacacaaattaaaaccaaatacaaaatcacgcacatgataaattaacagtacgactaactaggggcaaatctctttatttatttattactcacgcaaaacatattgtatggtacctgattaataattataataagcatctgtgatacatgcatatctatctaagagattttacggtcctcgagaaggtacggagggataccaaattttatatttccgatactatataaggtacgaagatttgtaaaaaatactcaagaactataaaatttctctatataattaaatttcctaattaataaccacttggaattgagcatgatggaatcatctcaattaattaaccgtcttcttggtcggtgtgcggccttgtagaggactgggcatgttgtgcaacgggttcgatccggtgggaaccagacgctccgtcacggccaccgtgggctcgtcggcggcggccggaggagtcggcgcgccgttgtgcacggggctcggcccgctgctggggacatcgtgcctcatc

SEQ ID NO: 67142 - DNA, 4202 bp, Oryza sativa
  unsure (1)..(4202): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaagcgatagcaggtccgactttcatattgaaagcatgtcatcgttgttaagcttgcaaaagcaaagcacctccgacttcaccacaaacttgtatcgttgttgtcgagctcatcatagaaacgaccaagcagctccgacttcccacggcggacatcagccaaaaccatcatattaccacttcctgcttattgctagcaccagcacacctagaaagagactgcaccgtgttaccgttgctgaggttcatcgcgcctcaacaataaagcaacttcgacaccaccttgcaaactgaaacaaaggcattggctgccagccgcaagcaagaagcggatccaggaaagcgaaggcctcgccgaacatttcgggcctatttagcgttggtgtggaagtagaaatccctagagctaacgccaactccacgaccagagatgcgcatgaaaaggttctccaaacggtacccacagcagggacgcgacgtgaatcgtcgctgccgttcacctggaaactggggcaaggctttcacctggagcacaatggtgaaagaataagagggaacacaccataacgatgtctccaaggagagggacggtgccaaagggtgtccccatcgtcaagccggccaaaaggcacggcaagactttcgcctacagttccctgtccgctcctacacacctaaccaatccgcacacacgactgttgcaagaatgccgcactagccctgactaaccgaccctccggcgagcaagaacctcggagctccccgcgggcacggcctcaccgaaggcgcaactatcaaaccacctccaccacacaccaacacgcacggtccccgagagccgccgacctcaccaacgccgttcccagccgtgagggcgatctgggtaccggcgccacatgaccaccacggctccttgcccgacaaccgccagcctcaccgtcggccgcaccggccagccgcgccatcgcccgcgtcttctgccgccattagctcgctgaccagatccggcggcgacgggtcggttccagccgcaagggaggggccgagtggggggggggttggatccggtggcggcgaggcgggggagaggaggggagggttcgcccgcacctggctacgacgataggtgcattgtgatggttcaatttgaagattgccgacgccctagtaatttactattaatgcaatctggagataacctacaataaactaaactctgaattcaggggctacttgctactaatgctgaaacaagagactactttaacgacgcactagtaatctatttccaaaacataggagccaaactgtatttccaaaacctaggagccacactgttaatgcaatctggacataaacctacaataaactaaactctgatgaattcagaggctaataattgtagcagcacgtctgaatttaagattttcttcgttggcacaaggccggcgaagcatcaagcatctgatctgatcaaagcgcggccctcctcaggccgctccgtcgacgtcgccgcagcatccatggcagaagtagttaagggctcgagctcgatcgagtgcgtcgggtggcggcggcggcggctgggcgtattggcggtgccgcgcgagcgcgctctgcgcggttgcgagttcggccttcaggcagtcgagctcccgctcgaggtccatcaccacgccgtgggcgccgcgcacggggtcgtcggcccgcgcgtcggcctcgtaggcgacggacaccgcggcgtcgcgccgtttccccgggtccccgccggccgccagcaggaagccgacgacgttgccgacgccgaagaggcggaacgcgttccggaatagccggccgtccgctggctggtccccggccgccgggaagcagcgcgccagcgggcatcccgtcgggcacgcgcgccccaggtgggcgcacgcggcgcacgccgccggtgggtcgtcgtcgtcggccactgcgaccggcgagatgtcggcgacgaacgggcgccaaggttgggccatggagatcggcggcgagacgagagctgggtctccgtcggattggtaagttggggcaccggaacggagagttcgcggcgaaatatgcggccgcgtgcacctgcatgcgtcgggatatatatacagataacacaggacgtgcttgaggtgaatttgggccaaattaaatggagaaatttaatgggatcgatttttttttttacacatacaaggccgcacccgttatttgtataacttagctatatagaatttttttaaaaaaatggtaaattgattgggacaggattaataagtccattctggtgaaattaagatacatatgttatcttgatttggatatttttcaaactactaaatgatatattttgtgtgaaaattatatatatgtattaaagttgatttaaaatataaaataaatctaatttttaagtttatagtaattaaaactaaattaatgttaatggttttcttgttttttgtgccctagcttaatctttgtctaatcaacttcaaacggggtaaacatgaaggataaattcagtctacaatgaaaggaacaaaaataataaaaccaagcaacaaaaataataatagtactgtgcatgcacacaaatagaatttattttttaatgtcgattaaatttttatttgttgtttttatgtagattaaatttatattaatttgcatgtttgtataatagtgattttggatctgtcataatttatatcagcattgcgtaatgttgatgtggatcggagtagagttagcgcaaaactctcacaaccctaataccctaaaataaaacaaaaatccgtacaacatcaaaattctgcctctatattttacgctacataagacttgccattaacctgagtcaagttattcactgtttcagtgtttcatccccaatcggccggtacttttacatattttcccattataaagggtaattataagctgtgtttccttgatggcgtcaacaacggtcagcactcctccactgctccacaaggagtcaagcaacgcaaggaccgcaacctgcattcggtgaatactgatcagcaatatatgtcggccttattcattattattatttgttcaactttttttttaaaaaaatatttttttcaaaaaactttgttctactgtattttaaccacttattttaagctatttattaattatattatatatcaatatttagtttatgatatacttaataatctaaaccaaacatgttgtcaataacaaagtataaagaataaagaaaaatgtggaactatgcgggaattaacacacaactttggtgcgacaagccaacaaataaaaaaatgaaggtacaaaactaaacattagagatatgaaaccattttttttcttgaataatttggacaccactgcataacaattatcattacaaattttcctaaaagaaagggatcagaggcggctgtggcaattcggctggctaaaccgatcgagtagactggtgtttgctaattacgcgtgggtctacaaaagtaacttaaaatttcaccacaattattgtttagaacatagattttgagcatatatatgaaaataataaatttgatttgttaaaataaaaaaattttacttattttggatttatgtaaaaggattttaggtggtcaagcttgttgacttaaaaaaaagtctaaagacgaccgcttttatgactagcaagagagcaagtgtgttactaataaaggatattctcgtttgaaaatatagactttgacataagagatgacccgtgaactatccggtgactacttttttttctccaaaacatagattcggtccggcgactactctttttttgtcagaaca

SEQ ID NO: 67143 - DNA, 878 bp, Oryza sativa
tacataaagtatagggactaaaaatagacatataaatgtaacagtctaaagaatagggaccttaaatagacttattttagctatttatataccccagcccaaagaagagggaggtaaaatagactttttgtagctgtacatatgtcacagcccaataggagggaggaaatttagacttattctgaggaaaagcacgacggcccatcgtgccttcgggccggctcggcaaggcccgaggcgtgttgggccgtgcctgggccgtgagtgcggcacgtgggctggcacggcacggcccggtgcgtcggtcgggccgtgccggcccgacaagcctcggcccaggcacggccgggcctgggccgtgccgtgccgtgccgggcggcccacatggccaactatacgtataggctcattcttgaatgaagtctctttattatcttattatggctaaagtatcgtgaatgcccgaattataaatcggggcagcctaggctggggcgcccgatcaattcggagtaaaatcgggcgctgacgttagcgtccgatttacgtgcaaaactattttaaactgatttttctcttaaattacttatcaaaatcataatccgattgtaccattaaattcgttataattaaatcttcaaaacaagaccatatatggatatattccgatgaaaaaaaatattagcttattattgaattattttttagtgttgtacgatgttccactagttatatcggaattgtttcactaagtagatcgaaaatatttcactcgtttaaatcaggtgttgtttcaccttatataaaaacaatgtttcggcaaatagcgaaagaatgtttcagttcactgcaacatttgatccacacatagtgaaaca

SEQ ID NO: 67144 - DNA, 1859 bp, Oryza sativa
accaaccgaataacagttccataaatcaaacggcttcaaagttcaaactaatataattatcgtgtaaaaaaatgcatacataccagctttccttgtctgagctgtaaaaaacaataatacattccttgatcttcaccacaaagtttgtgtctgtattcaaagcaaagtgtaaaaaaaagaatgtattgtgcacaacttgtgctaaatgaaagagagaacttttttttagagggagcttgcacaagcagtactaaacctgatagtatatacttaaataataatacctgtattttttaatttatttctttataaaatgtcacataggattccatccacttgataacatggtgcatttctatcaaattaatttatccgagataaaaaaaataaaagcaaaacaaataccgccgcccacccaacatacatacgtgtacgtaagccaagcttaattagccttccgtgtcttccaaacccctataattaattaagaaaaaaaacccaaagattcgccaggagcctagtgcgaaaagttaaccgctaattaattaaaaagttaatcctgattaatttatcttaatgcttgatctctcaggcaaactagcagctaggccggattagagattagattaggaactttttggagctatcatgtcgccggccggttgcatcagtgtggggcccacgcgtcatcccctcaatggtgataactaatgggattaattagccatggaaaataaatattaattaatcttaaccaatggtgattagcgtgaggaggagctgcctaatcaggggccactggagcagagtggagcaggggttaacactggtgattagcagagatagagagagagagagagctgtggtcgctgtctgattctgctgtattatattcccctgatggcatccggacaagcgtcaagaggggacggacataccatgtgccacctcatcctcgtgatccatgggcataattgctaggtgcacacggcggggttctggttccggcctcgatgggtggctgacgggtggggccgtctcacaaaccgtgtgcggccaacgtgtcggctttgcggaattcttgctagtatttcttttttttttcaaaaaaagtttttattcaacacgcaaggaaaaaaacgatatagagatatgattgttgtaaacagctcaaacacgctggctacatgaaaccctagcggtctgagtttatacccgacagtcccataaacccttagttagcatacggactcgaacatgtgatctccccttcccgaattcaagtggttttaaccgctgggatgtcatttgacttgtgaatagtatctcatatgtcattttccccttgtaaattgagctttcgtacttaggtctcaggtagtaagtatttcccgaatatatttatcctatatcccaaaataactgatcactttattacttatgagtcaattatgagaaaaggtaaatgacctagatgccctatactaatagagatgtcactagtgggctgtagttgagggtataataaatatatataatttttaaattagaggttggaagaaattttggattggcaaacaatattcacttatttagggataatttttgaattttgaaatttgagatggattgacaaatagtactacttgttttcccgttgaaactggtagggtaaatactaacagtttgtgtcataaaactgctacaccttcacatgatgtcttgtcagaggttttgtttaaatctctcaccctttttgtggaacaataaaaaagcattactcctgaagcaatggaacactcccaaatcccaattcaccttttgatcagaagcacatgtacatgtacatttgtacacag

SEQ ID NO: 67145 - DNA, 2894 bp, Oryza sativa
cgtcctatcgtttggttcagaattgcttgtgaaactatccgtggaggccgtggggcacaagtgcagaagataaggggccccagttatgagctggaacgtgtgatcgttgcttgctacatctcaaacatggtttggatctgtccgtgcctagttgctgtcaaaatcccgggtgttgttgcatcggttcagagttacatttcacatgatcgctgggagggctcacatggccgtttcatcagtccgggcttgccatgcgaagcaatcacctgaactacatgtccctctctactgctgctatcacatgcccaagtgacagcgactgtctactatctcactaaacagtcaaatctttttgctcctgatgaaaatgaattgatcttagcaaccgtccgttcattccgatggccttttcattagaggtagttaagatggaactgtcagttttttttttacctggttttaccaccgtatatgagagagtcgtggctgtgttggcttgttatctcggtggtcagttgctcgaatatttgtgtcagtggtgaaagcaaccgactagaaaagacctgaacgacctgtatgcgttgggtgacactggagatggataagcaagttccttggcatgtcaattcaggcgaaaacggaaggccccaaagaaatggagctgtggagggtagctacttggtcgctttccttgatattatcattgtgtctgcgttggagataaagcaaatccttgagtatttatccggcccgaactgtgcaactagatataatagaaaaaaaggaagggtaaattttgcaaaactatagatatctcaaatcaaactattgtaaatttataaggcgttgtatgtatatcacaaagttatcatagatttttaccaaatttgttatgaaactatacatttataagatgaagtattgcaaaactatagtttcaatgattaaattatcttgaaattatagactttagagtttaaacccttagcattaatgttttgatttatttaccttggtactaatgttttgttggagcaacaaaagatatagttttgttacaaatttagtgtcaaatatgtattttgtgatactctgtcaagtgtatatataattttacaatagtttaaaattttataaaatttagttccatctattttttataaaatttactctactcaaaactgaaattgaagaatatggataaaaaaagaaagaaatttactctcatttgttttagtttttttcttaaaaaaacgctttttcctattagtacgcgcaataaatggaaatcaatcaagaataaatactcaacctcactaaattctccacatgtgtgtaatattcgtcggtatctctctaaagtgaaaacaataacatctttatgcgtaatagcatctaccttatttttttttcatggtagttagtgactagcaaattgaaaatcacacaggatatgaagaagttaaaaaaaaaaagttcaaataccccctaagcttgaaaacccaaattaacccaaaggaaaacaaaacgagtgaaaaagaataaaataggaaattactgcccatttccaccgctgactgtcctactaccctgaagcctcttccgatcacctccgccggatttgagcacgccggccggcgaggcccgcctcatcaccgccagggcggcggcgctcccctctctgccttctcgccgtcgaggtattgagaactatggcccctgcaacctacaatcctccggcatcagcaggtcagttttttttatcattcaagaatctctctcgctcccctaacaatggcgaacgtcaagtaagcaaaatgcatttctttttctccctctttttctctctttctttttttccatttgtttacatgctggtggccagtaattgcaattcaactctgccctcgacaaaatatgcaacactgacaaccgaattcatttcaccggacaaaggaaaataaatatctccattctgtagctcacatgcatgcttggcttcaaaaacagtttcagttcaagaaaacctgcttcacacaataaatcccttggctcctttcaagattgctgctagtgtgtgtgtgtggcaggttacccttttgtcatcttgagcagcagatgtcagagaagatttctgctgtttttattcagtcaacgatttgactcattaaaacagaccaatgcatgttaggatgatcatagcaaaagctctcttcttgtcctagttcttttggaaaagggaaatgacttgttgagtcatttctgcctttgctcaccatttatattcatgatgaatctctgcctcagcttccttcttgttttgtcctccttcagaatcatgacatttgacactttctgctttctagctatattatgaattgtcatttctttcacacaaaagaacaaggaaaaaagaagaagaagatatggtatgcctccactcaaaatgaaaaaggctagaaattaggaaacaatgagcttgcgtccttcttcctggatataaattgtttcatatgacatgatttgtctgctgagtgctgacctgaacttcgcggcattatctagtactacaagcttttggacctaaccacttatcagaaaattccagagtccatttatgtcttgatcagttctacttcaataactatatggtatgtgcaaactttttctcttttttgacctttttctgctgacctgtttttgtctcatgggaccaaaccaaactgaatattcagaatgttttcattctagttttcaaaaaagagctgaattttgactgcgcctacattcgttgatcggcgatcgctgtcccgacaccgttttatttcttgtctttctcacttgcactgcacttgaattaatcctccacaggggctggctgacaaacacagatc

SEQ ID NO: 67146 - DNA, 1647 bp, Oryza sativa
tattggtaaattaatatgataagctcctaatgaatctcttggggcttataataataagcatgtactccctccgtcctaaaatataagtgattttagatggatttaatacatcttagtatgataaatctggacaagctccaggatatgtcacatccatttaaaatcccttatattttaggatggaggagtaactgtcaccctattttttaaaatatttaatttatccctagaccacttgtttaagctaatattatgtttattttttaaaatatttaatttatctgtgtaatcagctaggttatctgtaaaaataatctatgcttagatctcctcatcctagaaagcattgctactatggcgcatgtatcgtaagcgaaattaatcttaaccccactttctactactatataaactctcttcgttttaaaatagttatccacatggggattcataatttatcccaaaatagttgttacaactactacttctctcatcaatcactttccacttaaatttctcctcattctactcacttttcttccaccattttcaaccataggcatttaatatggggtttttctttctcaaaccttaacctatgctagcctaaaacaacaactatttcatcaatccacgtatgatgtttgtcacattggacaatcctaaaaccggtagttaacatcaggacgggaagaagatgtgaggcgtggagaagaggacgagccaagctagtgatctcagcagccggcacggagaagacaagccaggtgatctcacacagcctgagacgattgctccctgcaggcggcagcgactgctttgtcactgaccgtttgcactcctcttccaagtgtgtgtgtgtgtgttttgaagggtgaaacaacatattctccgcagcagggatgcgacaaagaaccgcctgttaacctggccccgtttgctctctggccactttggcttgtaggatattatgatcttacttcctccgtctcaaaatgaagccatttatgaggttggcacgagtattaagaaagtaggtgagaatgattggagaaagtgtgcgattggttgaaaagagaaagtatgtgaagaagaatggttgtgattggttgagaggaggaggtaggtgaagaaatagcttcattttaggacaagacactgtgctagaaatagctatattttgggacggagggagtatatgagagcagtttaggtacaatgggggatgcatgcacctaaggaatgctatatggctttcgagtttgaagtgaacgaagaacatgaatattgtttccgaaagagtgcagcactacttaaaaaaagcttttccctagcggccatttcatatttttgctggcggctagtcactactacgaaaaccatttttcgtggcggccattttagatttttgctggcggaatttacagccgccacaaaacaaaggccagtgaagatcaaaatcttcgctagcggttattgaccgccagcaaaaatagatttttgctagcggtcatcttaagccaatcgccagcaaaaatctattttcactggcgttggcttaggacggccggctgagttatatcagccgccatcgaaaaaggatttggggaacaaaaaaaaccggtgcgcagctgcccagccgccagt

SEQ ID NO: 67147 - DNA, 2904 bp, Oryza sativa
tgcctgaaggttgtcgctgcactctgcaacggccaccgcacccgtcgccgctgctaccacaactgcaacccgctgctgccgccgccgaggtcatcgctgcactccgtcgcggttgccgaaccccgccgcaaccgcaacccaccaccactgtcaaggtcgtcgtccccatccagattcggcgagaacaaggctagatccgagccgacagcggtggcggcagctcgatctcaccggtagagaggggggagagctcaagatcgagcaccgtcacatggatctcgacaccgctgatctcgtcgccttgtgcagggagggagcccactacggccctcccgcggcctagcagcggtcatgtcgtcgtcgcggcggcggatccgaccttccccgtcatggtggcggtggctctagcctccctcgtcgacgtggcggtggatctggccacccccgtcatcacgactgccggattcggcctcgagctcatagcggagaggcggtggcggctatggcagccggcggtggtggaggagtgagagggagaaggagagaccgcgagggagaagggagaggcgaataaactgaggtgggggcggtaggtgggctaggtgcagtgggtttatatattcgcctcaatttttttttcagcggtcctctttacctaccgccagcgaaaatgcgattttctagcggacacttaagaagtccgcctcaaaaaatagagttgtttttttatggtggacctcttagcattcccaccaacgaaaatcggttttcgctagcggtccgtaacccccaccccttgttatatttttgctggcggtttttgcgtatggccgctagcgaaaattatagggtaacaccatgaaaaattgtttttctagtagtgtatgctgtgcgttcggctcttgcagctgggaactaatccctgaggcatgtaaaacggagcaactcattagcgcctgattaattaactattattttttagagtaaatttcagaaaactacaacaatagcgacatgtttcagtttgctacaacattagcgacatgtttcagtttgctacaataataacgtggattatcacaaaactgtaacttttacgttatatgctgctacagtacatataggtgacaactgtagcagcatataacataaaagttgcagttttgtgataatttaccatgatattgttgtagcaaactgaaacatgttgctaatgttgcagcaaactgataattttgtcactttagttatagttttctgaaatttaatctatttttttaagaaaagatagattaatatgcttttttaaacattttttatagatttttttaaataccatttagtagtttcgaaagtgtgcgcgtgaaaaacgagagaggtgagattagaaaagtatagagaagaacacaaccaaatacagagaatggaaaagcttaacacatgctcatcattcacatagtataaaaattgaccaactcctatgttacacatactattattatgtgtaaattgtacttttgcctatcttttattatcaaaatacgtttcaatttagaccgctcttaatccaatattttactttgaaccagctatcttttcatttgttgcactttgtaccacctccaccgtgttatctagacatgtttgtgttctcctctagcgaaggtattgcatgctgcagatgggtgggggagttcgccagtgtgtcagagccgatatgccacttgaggtcattagggtgttagagaaatcgtatggggtgatctaaaactctaaatcataagaaagataaagttagctagttcaaattaaaaatattggattaagatgggtccaaagtgaaaccatatcaataaaaaggtggcccggagttcaattcaatctattgttattgacctaatgacctccctatgcacctagctgcatactccctccgtactcgtaaaggaaatcgtttagcacagcgacacggtctccaaaacataattttaacttcttgtttctataaaaatatttattgaaaagtgatatatgtatatttttatgaaagtatttttcaagacaaatctattcatataatttttacattttcaaactcaataaattaagagttattcatgatttatatttccaaggtttgacttcaaaattgttctaaacgactttctttacgagtgcggaggaagtactcctatatggtttcaaatattttcactggctactatttatattttagctttgactgttatccttttttgaaaagaatattgatgtgtacttaaaaagtagggtgccatattagcaatgtgtgttgtcccgtaaatacaaccatacaacttttattaataataaattaacatattacaaactgttaatggtcatgttaaaaattgatggtcagacaatggttacaagtaaataagaagattggactgacttgggtgcacacaatttcatttggtaaatggtgatgaatgccgaagctatatatagtcttctttgatgaaaaatgctcactccgtttcaaaaaatgtataaagttattgactttcgcataacgtttgaccatttattttattaaaaatttagtataaatacgtaaaagtataagtttaaggttatattttatttgatgataaaataagtcataatgaaataaatgatatttatataaattatttagtaagatgaatggctaaacattgtgtgaaaagctaacaacatcatacattttaggcaaaatttgctacaggacacccaaaaattgtgtaattagctgtgagacaccggaaaatcatgacactgctcatgaacactacgaaagttgtgaaattggctgtaggacaccagagccaatattttttaatttccgagacaaaagaggtcagagaaattactaaaaga

SEQ ID NO: 67148 - DNA, 4180 bp, Oryza sativa
aactatcataatatgtaactctttttatttaaaacatcttacttttataaatattgttggttaaagtagcatctcgaagaccgtatcagaataaaaacatcttacttttatagatattttggaacggagggagtagtaggtgtgatgtttgaccggtggtctagcaagtacgcaacgtccacgatgaatttataacgcgtactccctccgtccaaaaaaagacaaaccctggattttcgtgtccaatgtttgactctccgtcttatataaaatttttttataattagtatttttattgttgttagataataaaatataattaatacttgacttgtctttttaatttttttttataattttttaaaataagaaacccaggggttgtcttttttttattattttttttacggagggagcacgtgtaagctctgtggcgtgaaagtacgtgcctgccctgcctacggacacgagctacatgtacgtacgtacgttaattcgtaccacactcgtgcactgttggatgcgtcgcgcggccggcatatatatcgctaattaataaagcgtgataaatatgttttgtcatatcgtacaacaggtcacacatgtaggagagggagagagctagccatttcagagaagttattcacaagccgcgcaagaaaaatcgaattaatttatactgtatatgtttttgaagagacaaatatgaatttggatttatgtgggaagtaacgtacatggcacatgcatgttaattatcagataacgatttgaaataaatcctccttaaatataattgattagagaaatgaaattaaatgacgtccaaaagtccgcctctaatattttacttatcagatatacgtttcaaaaagatatgtgccttagcatgcatggatgatttggttttaaaaggaaatggctaaacgtaccaaatttacagaactctattacataccttggtattccaattgcgattgatagattgacagttgctgattttagtatacctcccaataagatagagaaaagattggccacttggaaatgtggacacctatcctatggtgggaaagcaatattgattaattcctgtgtgagtagtatccctttgtatatgatgggagtctatcttatgcctgagagtgtgcaccagaaaatggactcaattagagctaggttcttttgggaaggtttagagaggaagaaaaaaataccacatgatgaaatgggaggccctttgcaggcccaaagactttgggggcttggctttatcaatacaagaataatgaatgttgtactgctttgcaaatggatcttcaaacttgaatctggggtggaggatccctgctgtgatttactccggaaaaaatatatgtctaatggtggggggttttatcaatcaaggactgaggggggttcacaattctggagagggctgcatgaggtgaagaattggatgaaattgggaaggtcttataagattggaaatggtaaagctgttagtttctaggatgatacttggctgggagatgtgcctttaaaaactcaattccctatcatctatagcatttgtgccgatacgaaaaagactgtttaccagatgtgtcctaattgagagtggacaattaacataaggaggaatttagggggaagagagatgacagaatggaatgatttacatactttattggatgagattcagctgaactcagataatgatactatgtgttggaagttgaccaaatatggtatctataaaacaaaatctctatacagagagctagcctttgggggtgttagagatgtcattatgcaagatttgtggagaactcccatacccttgaaaataaaaatcttcttttggctcatgttgagagggagaattcaagcggcttcccaactaaaaaagatgaaatggaagggcagtccttattgtaaactatgtggagagttggaggatgtcaatcactttatgtttaattgcccaatttcgaagttcatgtggtgttgctttagagatgcgtttgggtgggctggtatacccagaacaagaggggagctccttgataagcttaagatgcaaagttgcgatgaaaataggattctactttctctttttgcagcaggggcctgggccatttggctcattagaaatgattgggtgtttaataataaactgatctctaatgcaacccatttgccttacaaagctgtctcttttcatctccagcggagaaaactagcactagtgaagactcgaagctctttggatacctcgcgggacttactacttgccagcatcagaaggatagcaagctcaaatgcctgaaaagtgtagtagcgccgtgacttcgtgatttgctttgctgggtttggtagtcttggtagggagctttccagatgtttggtaattttccctggcttgtttttgggctgagccagcagccatgatgcttatgttcgcctagctggttgtttcccagccgattatcttatgttacttttgtattctgaactcttatagctttgaatgaaagatgggctttgcctttttctaaaaaaaaaatagctacgtacatcaaatggaagctatagctactagcggtacccatttaaaagaaggaaaagtttctacacgtactaatttcttatactaattaatcttttaacaactcatccctaacaatactctcaagaaacacccaggggttttccggctagctccacaaggtgatgggctaattggtctgggttcaaagccacacctcttctatttatttgatattaatttcttccctaatattcacttttttttatctaacaatactcttattctgaactgtttttagagggtaccaaaatggagacgggattatgggaataagaatggcaaccattgtaacaccctaggtaaccacgtacccagagtgccacaccaaaatacactcaaaactactaactcctaaaattattagaaatttcggcagagtctctcctatagatacggacatccatgataggcagttataagataaactaataataatattattcccacagtgctatctattcatataatccatagaaagaaactaatagatatccaaatgaatattacaagacaaaaccaggatatagtttaagtgtcattatggacctaagcaatataatttgatagtgtgtagatagatgtgtatataagggtgctactttccgcccatacatactgatctcaatgtgtacttaaaaccaaataaacacaagagtgagtacataaatacttagcaagtacaatatggaactagaaaacacatatacacatcattggcaataaagcctgaacataaaactttctttctttgaaaagaaacacggtttcaaacaccatgttaaagaaaattaatagttcccatcccgaacagacatgaattgaaatagtagttcccatcctggacaactgtgaatacatcctagcatttgccggcaaagccgagtaagcttgatcaacaattacctataggaacatgaatataaaaccagatagcatatccatgactcacatggaacatgaataattgaaactagaaacaaaaaagcaaattgaaactaaattgcacatccatggcaagcatggaaattgagttatttaaccagaaccagaatccagaatattgaaacaagaataacgtcattgtgaacataagataaacctgaaatataaatatcatgaacaataatctgaacatatgcaatcacatataacatagaaatatattgaaaataaataggtggagcaaacaatccaagaaacacataatttgttcgtcatacacttgcctttaacctcgacggcaacccgacgaaaccccctccacaccagatctctccacacctgtggagtaaagctacaagtaaaacctctattgaggaatccttgagactatctatacatgtacaaaacatcatgaaagatcaaaaccaaaatttatctgtcaaccgggacggtacctacataaaactacctatactacctatacaatgttatatacatatttcacaaagcgcctaacaaaaagtagcaaccgatatcactttagacatctaaacaaaattctctacaactttcatgtgggtgaaaaatcagattaagcctatgtaagtcccatataaaggaaaa

SEQ ID NO: 67149 - DNA, 5192 bp, Oryza sativa
ttttttttttccattttattttcttttttttatatgtaggtatataaagagactagaacttttcttttcttttttttatctgtaggtatataaagagactagaaaggagatcaaacggtccacgtcgattcaatcgacgaaacttcgtttggactctgattactgcaaacttatagtctacttcgtactactcaacgagctatacgcatccacgtttccttattgcctattccaacaatggtttaaaggttgaacttttgcacacttgttttaatatttcctgaaatacaataattcaaaactcttttgcgcatttgttttaatatttcctgaaatacactaattcaaaactcggggtattacgattcaatcaacggaactttgtttggactctgattactgcaaacttatagtgtacttcgcactactcgacgagctatacgcatccacatttcctcattgcctattccaacaatggtttaaaagttgaacttttgcgcatttgttttaatatttcctgaaatacactaattcaaaactcggggtattacaggaacaagccccctcttagcgcacgtatgtacatacagtgccggcactatatccatacgcaactgcgagggtcggctataatagcgtttgtaacagccctccctccagtcggcactatatccatacgcaactgcgagggaaataaaaaactcggctataatagcgtttgtaacagccctccctctagaaattcaaaactcgggctataatagcgtttgtaacagccctccctccagtcggcactatatccatacgcaactgcgagggaaataaaaaactcggctataatagcgtttgtaacagccctccctctagaaattcaaaactcggggtattacaggaacaagccccctcttagtgcacatctgtacacacagtgccgacactatatccatacgtgcaactgcataacagccctccctccagaacccggcactatatccatacgtgcaactgcataacagccctccctccagaaccgcgtagccagcccagggctggctcacttacgcataccaccccacttacatttttatcctcgtttcatataaaacggttaacccgggagtgatacggttggaaggaaaataccttataaattggtttcaccctttctaaagtagcaaggtggtactaaatatgcacatacaactctcacgggccacacatgtctcatcctaattgggccaggatgtcacaaccatatccaagcatatatgatatggttgttaagagaaatattatttggaaaaaagaagagcatattcaccattgtcacttcctatcataccaaaaatttggtgttatcaaatttcagtacggtgacaacctaaacatgatcttacccaattgcagaactttcctctaataaaaacgctattaaattttaggatgcatcaaactaaatatatctaactttaccaaaatttggcaacaccaaaaattaacattgttaaaatttggtaaggttaatttgggaacaaagcgaataagcctgaaatgttatttgccatttggaaccataatctcgtctcaactcatatatattaattgtttgatatatataaccctttgttatttgtttggcattatatatagatctgcacaagaaaacaaaaaaaaaacataaggatatatccacagaaaatatccagaattaaacaaaagaaaagggacataatgggtacataataattaagcagaaggttctccaacatccccactataatctgttttccactgatgagaaatgtctgtcgtgtgtcctatacgtacatatcaaagctacctaccaaccactgttactatagctagccagtactatatctactcccataattaagcatagaggccccatttgtagcgatgtgatttagcgatcctaccaatatcatgcgtatatatgcacacgtgccaattagctgcaaattggacaattactactcccttatctgtttccaaatatatatatatttgactattcctattattgaaaaaatacaaatgtaaaacatatatcgtatataaaatacctttaataataataatgtcatagtaaaataaataacatttacatagtgttttcaataaaaataaatggtcaaacagtatgtttgaaagttaaacaagcttatatgtatttgaaaactgaggtagtagtatcactactatagaattggtcatcttgatgctgataatgaagatgttttgggttgattttctacatgtatgatgattcactacttcaacttgtttgaggtcagtctaatatctgacagggtggtgcactcatatgtgaagtgtgctaattactactcgtcacaattgtctatcatcattaatgggtgttgacttgtcataggaatgaggtattctcatcggtgaccattgatctgttatgtactccctcagtctaaaaaaagacaaaccctggtttccgtgtccaacatttgacaatccgtcttatttgaaaaatttatgaaaaaaattaaaaagacaagtcacgcataaaatattaatcatattttatcatctaacaataataaaaatatgaattataaaaaaatcatataagacggacagtcaaaattggacacggaaacccagggtttgcttttttttttgagacggagggagtaaccaatagccatcataaatgtgggttatgactcgttatcatgaatgctaattccctttagtgtatatagaagaggtacacatgtatgcgcacttaaagcatggcttgcatctacgtttacataagagcattcccaatagctcatctgtcacacacgcaatcttgaaaatagcataccgaaggagaaaaatgggctctagtagatacgtcatcgctacttccaaatttgacgtttctctctccacaccatcttgtaaccgcctaaaaacagatcaaacttccgcccccatccgaatcaatggactcatccactgccgtcaacactatcccgtgtaacctcgactcctcatttttcatggcgatgaccaatgaggacaaacctagtcggccactccgccacccgcgctacccatagtgatgcagactgtctcccgatataatacaattgttacagtagaggataccgatagagtgaccgtggatatcacggtagctttctaagaaacgtggtgaggagcgccggcctagggacagtagtgggggtgggatggaatggggaggggaagggaggagagctagccagccgcccagcggggatatggtacacacacgcaagcgtacgtgcacgcggtgactgcaggaacatgtccaggatattcccgggcgtgtcggcaacagaccatgtacagtatgtactgcacgcatgcttgtgcagttactaccggactggtggtaaatccttcgtcccgccaaattcctgctgtaaatgtactggcatattgcatatatatacgtaatatattcatatataggtgacttcgcacatattttgctggaagtgaatgtttttcactgtgcattttcaaagactatatgtccgagcaagaataatgtagcaaaactataattttttttctattaattatagtatgaaatgcccaaattaacgattcaagaaaaaaaaaagacccccacctattctactaataactatttccttcatcccaaaatataaatatttttagcatagtaaagtcaaaacatttttaattttgactattaatagaaaaaaaatcaatcatgtaaaattcatgttactagatttattattaaacaaactatcataatatgtaactctttttatttaaaacatcttacttttatatatattattagtcaaagtaacatttcggagaccatgtcagagtccaaaattgcttatattttgggacggagggagtagctagtaacatatataccactgatcaaacccatatatataaataaagatatctagcctataagtgtgatcgaggataacatattagattgttggataatgattacgtatatgttacccaggtaaatgcgtggtgggaggaggggattgagatcctcttccttcacagacaccatacctttgttactgacagataggttcagggttcatcgggtccatatataagtgataaagttaaatgtatttgaaggtaaaggagcctgatccgggaggaggggggcagaaggaggacgactttcgcttgcatgtgatctggacaacgcgctcctctgacatgcacgcagtatatagtagtcctgcgcgcagaacggctgaggtgtgtgttgatcagttcagtggagtacgtacgttgtgcacaagtcgcatgcacgagcaagcaaacgaacgtaaaacataatggtagtatggtactactactagctatagctgacagcgctgcatgcttcacacagatggagtcatatagatataagatgttgcacatgtatacactactggagatacaatctttgctgggttagctaaaaaccacattagtcccggttcctgtaaccggttgaaaagccaacgtcacttttataatctttagtcccggttagtgttatcaatcaggactaaagatcatttttagtcctacaggttcaaaaaacgtccagccccttattatctttagccctggttagtattggtattatcaaccaggattaaaattcaatgcttcatatataatccctcgcatttatcctctccttctggatcacaaacatttcatcctcattttttaacttcctcctctcttttctcctctctcgactctctctttcctctctcttatcctctccttttctttttcttgcagcagcagcagcctggaggagggggcagcctgctcaggcctacgtgcagcgggcggcggcctgtgcaggagccagccccggttgatttagttgttagattttgttgatttatctatgaatttgttgatttatgatgtcttttaatatgtaaatttgtgatatgaattatgaatgtggatgtggacaattttgtgatgtttatgtgaatgttgatgattttattgttgagtttggttagaaatcaatatataaaaaacaataaaaaaagactaaagatgacatcgtcagccacgtggcgctatcatctttagagataaccgggagtaagatatgcatctttatttct

SEQ ID NO: 67150 - DNA, 3828 bp, Oryza sativa
aatatggacagtgctagaaagtcttataacctgaaacgggggtagtaattagttccaaaacataaaactgataccaaaatacataagaaatagtgcacaatgatgtaagaaaagagagtaaattatgatttaggggatatatattcttgctaaagttttactttttcctccctccattttacaatgtaagtcattctagcattttccacattcatattgatgttaatgaatctagacatatttacatcaatatgaatgtggaaaatgatagaatgacttacattgtgaaacgtatatgtctagattcattaacattaatatgaatgtggaaaatgctagaatgacttacattgtgaaacggaggaagtaccactcttgaaatgttttttctttcactttggactagctacataaatattttttcacttgggactagtagctacgtattgttgccagtgttgcactttgtaccttatgtccaagtggcccatatataagtgagacacggacaccagagatggttagtctcattgatatattggtcatcggtttaaagtttaactttttgttgaaaatacctagtccaaagtaaaatagatacttttaaggtggtttgaagtgaaactttaatatggcaaagtgtaatttaattttaaagaagatgtgctaaaaaactgttgacatttttttcccaaaacattcagtttgtggactgttagatcgcgtggagattcatgcaagggaatgaacaattctttttacatcgccatgggtggaactaccactatgacatgctgtggcgcatgccatagctaaccttcttcgcgaatacccccacccccaacttcccagaggtgtttttttatcatcgccaggagcggacctaccactttggcatgctgtggcgcatgcgatagctaaccttcttcgcgaatacccccacccccagcttcccagatgaaccatcgcttcaatgaggtatttcgtgactgcaatgtgggcatttttacgttttttctttgattggaatgaagggggtgttcagattccggggtgtaaacttttggcgtgtcatatcaggtgttatatagggtgtcgcatgggatgctcaggtattaataaaaaaactaattacagaatccatcagtaaaccacgagacgaatttattaagcctaattaatccgtcattagcaaatatttaccgtagcaccacattgttaaatcatggagcaattaggcttaaaagattcatctcgcaaattagacgcaatctgtgcaattagttatttttttagtctatatttaatacatcgtgcaggtgttcaaacgttcgatgtgacagggtgaaaaattttggtgtgggatctaaatagggccaaaatgctttgaatcaactcgtttgtcttcgccatagctatatttttatcctgggtccgccactatacatcgctatgccggctggagagtgagagcccgcaacctcttgggtgaacgaaaattgcgttagccagcaaccaggtttttgttgatcttatagtagttacatacaaattataagtatgcaattacattctaactatgcatttaaagtttttcgacaaaaaaatgtcggatgtcatataagtactccaaaagaattcacagctacaagctacatagaaaacgcatctacacacaccacacctactgaccaacacaaacacgcacgagtacgtgcctttcaactgagtttaaagctttcacaagcaacccaataatggtaataatacaaaggttgctttaacttaatcccttgtgttagtttggtgtctccagaggaatgctctaattcgatttatgcaaaaaagaacccaacacttcgagcaagaacacctggaatcggagcatgtcatatatgccatcgatcaggaccttagtactacatggcacgacacgatggacatgacatgacacgacacgttgggtagactgtcccgaataatgcatttccatgtgatcgacgcaactacaataattccatcattccacgtccacgacgcactcatgcgccgaggaaaactgtcggtcggagcgccatcagcaatccagtcattatgtttcaacaaggaaggcataatttagctcacacttcagaaaaaaagaaagaagaaaggcacaattagctcactggtctggtcatgtccattctactatgattgctctcctagactccatccattgcattttacaaaactgatgagataatacacaacatatgtcaggtcaggttagcggctcaccctaaataaaggcaggcaagttggcatgtatgtaacctaatatcgctggcattagccagcttggtgctccacctgagtacctgatagaaagaactctagggtaccaaacagctgaagttctctttttgtgtggttagcagctcctagatcattcagtctgatggtgaaagcatcttggatcgatccgcaaaccatacttgcaacaccaacaatctgtggacagaatatttgaatgaatactagctgcaaaacaattttcggtatggtgtgcatcagatgcatgcaagtcacctgcagacacctcagcggaattcatcatgaaaatagtcttcgtcgtcgctaaggaagacgctgccataaaatgcatacgggttctcaatcatctcatccaaagttagtcttccatcatgatctttgtcagcctgcaatttttggattagccaattgaacatgtcatcctcggggaacaagagacacatcatgcatcagaggaaagcacataatacattgagatttttcacaggcaaacttttggacaaccttgtgcaaacaggaaccacgacagattatcgagtttttttttaactttttaatatatttgacaattgaactctaccgaaacattatttacatatctaaacctttagcttcttcattctcattagtgtggcagcacaatgctgaagcatgggttaaaaaccttggtgtggcaaagatttggtcatgccgctcatagagtcatactgatgtggtaaatcagggttgatatggcatgaaaagagtcggtacagtaccttatatatctccactattcatggagtagcaacatttgccctccacgtgtgacaaaaggtgtatttttcaaaataggttgtttttgaaattttaaataagaaggctcaaaataaaaaaaaatctcagattatctgtgattttttctatgcataaaaaactagatttattgaattctggatgatactataaaatgaaaagcaaatgatttgcggtggacgggcaacttatacacctatttaatagggtattcttatgtcccactatactgagattagatagttacagcctgtattaggttttgacaatatcaaatcaggacatgtcaaacctattaaagactaaaagttcatctactgctatgttcaggaaaactatagaaagctgtagacatgcatgacaaagggaaaatagatttcaagatatcaaagaacaatagaaaaaatgtagaaattccaggaaaacaatgagaatcaaacctctgaaatagcatgggcagcttgttgtctagcataataacgttctgaaagatggagcttatcaagaacaggttctagttcgtgctctgaaataaacctacataggcaaagagtttatcttaaaaatataaaatgaaaatacttcagtaaataattatatcagaggaagtcattaattaaagctccacttccatacccatcactgtctttgtcaagtttggaaaaccgctccttagctactgtattgttcccaatatgggaaatatctgcgttctcg

SEQ ID NO: 67151 - DNA, 2408 bp, Oryza sativa
atagctggctttctgggccttttcttgaccttaaagcaatgctttcggaacgtctctccacttggatcgagtgttattattattaacaataatattaaaggccttgatgccagcattcacttgttcaatgaaccaaattaaccacttcattttgaagtgttatatcatctacataaacatgatcatgttaaattttagttccttcagttttttattccctccttttcatattataagacgttttgagtttgtcctaagtcaatttcttcaagtttgaccaagtttatagaaaagcataacatctacaacaccaaactagtttcattaaatccaccatcgaatatacttttaagtatatttgttttgtgctgaaaatgttgctgcatttttctataagcttgattaaacttgaagaagttttacttagaacaaacccaaaatgactaataatatggaacagagtgagcattatgtttacgggtggtaatgggcttggcccatgggtcctttcacagcccaattttctaggctaaaatgttgggccctttaccacccttaattctgttaggtgtcatacatcaggaattcaggattacttgcaaagtggcaagttctaccttgtattaaaatgcagctgtcatgtgtgtgagcactgagcagcaaccatgaaactatagcagcagctttgttggttgtcatctaatctcctatttgcaaatcttatttagcaacctggagggatatgatattatctggttgagaatgtctatctccaattgttaatttgttaagacaagctctaaatacacggacctttcttatgtaataaaagatggagcaaatctaagtcccaaccccctttgtccgtcccattatctagtctctactctattcccttctttagcgaaaccagctccacctgctttgtatgtatcctggtgtttacttcatcatgatctaaggatccttacagtggaacagtaaggagtcaagggtatactaacaaagtggaaagttctacctgtcaatagtagcttccaagttttaaatgtgaacagctctggaactgttcttagaatcagagagcaattatagtgttttgaacactaaggaagtaaggatttctgatcagatactcagacctcaaacaaaagggcttcaaattgaggttatgtacgttactgagtttctggaatgttatccaagcaaacagtactacgaaaagaaacggtcatcgggttgaagaattaagcaccttatttcttgtttgcagagcaaattgataatttggggattctctgaatcgctgggattaaggaagctgaagttggagcacaaccattcaaacattagcattaatggcacactaaataatcaaaataaaaaaaatgatcttcaaatagaattcaaatgaatgcatactcattaaactcggttttattaaggaaaccatggccatctgcatccgaagcattgaaatgctcctctttccaccatgggaaccccagcgaattaacctctcctgcaaatcattaattaaaacacttactccaaattgtctcatggattcgcttccagccttattgaactcgttttgaactcctggacagataaaaaaaccaaaacaaaaattgccacattaccactcgattcgttgtgctgagcccggaagtccccgtaggagacaaccccgtcgccattcttgtcgtagagctccatctcccgagcggagcggtggagctggtcggctctggactgctcgaggttccacctggtgagctcgtcgagggaggcgaagccgtcgcgcggggcgaggtcgatcttggggaagagcgcgcggatgcggtcgccgaggttgaaccgctcgtcgtcgttgatgaagtcctcgtcctccctgaggaactcctcccattccctcatgtgctcgtccgcctcccctccgccgccgtcgccgtgcaggatgcggtagtgctcgcgctcccactccttgtcctccagccgccgctccagctccgcgatctccgggtcgaagggcgccgcgtggtggtggttctgctgcttctgcggagccccgtttcctccggtgggtgcccccgcgccggccccggagagggaggggttcctggggtggagcttgaggcggcggtggaggctgcggccccggtgcgggatgctgggtgagtaggaggtgaggaggagcaggatgacgagcgcgaaggtgacgtagaggaggagggcggagaatggggacctccgccccgccgtggccgacggcggcggcggcatcgccggcgagatgggggtggagatcggaagtggggtcgggggctgagagatgtggggttgcgggttgtgtgggtcggcgattttggactagtgcgactgtgcgagggcaaggagtgacgtgg

SEQ ID NO: 67152 - DNA, 1518 bp, Oryza sativa
ctcttgcgggcacgtatcactgttgccaccgcaaacgctaaaacaaaaatgttcgatttttagtctattagattgactttgagattcgtgttcatggaacataaaaaataaaaaaaaagctacgcacgatacaagaacgattttgctatatctcactcgaaagattttttcttatctctcactcgattttctcactcaaatttacagtgcattttattgtaagttacagtgtaatttatgaaacttaccctgtaacttttgtaagttacactgtaatttttgaatcttcgcatgtaaattttaaattttgtattggatttagtctttttcttgaggatatggtaatttagtgtccataatgtgtttcttaattgctttttgctttttattatatctatcggattttaatccaaagattaaaaatctgtgtgatacgatcataaaaatctttcgaaagatgtataggtactcccatacaagaatcgaccccgggaccttcgatctgggcccaactacttaaagaaagtttatttgctcagttgggataaaattagtttttctctctcaataattttaagcatctttctattttctattttcagaaatagcattagtaccattttaattatttattactgcttaataatttaattccaactaaattgaattaactaaaaatttgatttttctcatgatatggatttatttttcgactaaaaatataattatttatttgtcatgatataaatttagactaaaattaaataatattaatatgaaaatttctaaactataagagtgctcatttttttattactttactaagttaataacattaattttttccgttgcaacgcactattgaataataatttattatgagctactatatttctctctatcatttgagactttttttaacgagcaaaagtaccaaagcagtgtgaaaataacttcgcttaaaaacaaatatttttagttcaatacaccgtagcaaagcacgggcattttgctagtaatactaagatcctttcaacgcgtattgtctccttagcatcaataatactagaggctggggcgcgccaatggcgcgccgcctgtagacaggtcgatggaaagatgcgatgcacacgttctcttaactaagaaaagctaaaaagcatatggtaaaaagaaacaacaaatagtaccatagtagctgtagtataacaagccagctgtttgtacataaagtggttaattgttcactcagcttatggataacaaaaggagctgaggacaatgataagcagttataggtcacgtgcttacagagcaagtgaagttagatagaccgcaagcaaaggataatagagaattatagtagttgttccagtgtagataatagcagcgactactgaagatgcaggtaactttcacagagcatctatggtgagcgtgaggtgacttgtcctaaaaagtggaagatgcagattgtgtaagttgatgctgttggctgctgcaaagctaaccaccctg

SEQ ID NO: 67153 - DNA, 3303 bp, Oryza sativa
  unsure (1)..(3303): unsure at all n locations
aggtggtgttcgccggcgtcggtacgccggtgagaggtggcggcgaggtctcccggctaggcggcggcagatctggcgtcgccgtcgccggatctggcaagccctccgattttcggcggtggaggaggctgctgcgacgtgtgggcggcgacggctcgcgcagcggcgcgtgggcggagtcggtgctggcggcggccgctggctccggtggtcgaaggccagcgctgacggtggccgccgtctccggtggtcggcaaggtcggggctggccggggtctccatcccgccactactctcttcctcctccctctccacaaccaccctcttcttcccccccctcccctcattcccttattctctcttgtgatgtccctctcctctctgtgccgtcggcacaagcgaagcagaagtggaggtttccttcctcccttcctctcgccatcgctgctaccagttgatctctgctgccagttgtccaattgctctgctgctcgccccagcgctcctctctctctgcgctggtggtatcttggaggtggttgccgtagtcgtgaggttttgtcccgcgaaaccaggagttcctcgccggagacatggttgacaccgaggtcctgggttcccctgactccaactctcagctcctcttcaggccggccaggtctcctcccctccgtgatgcttctcccttctgttggccgtcttccagacctggccgtggagtctttcggtggttgaggagaagtgttcgtccttgaaggtggtccagtccgtctgaagtcagggctcttatgcctcgccagtgcttcatgtgccctgtgactatgtggacctatcttagtgccgagtttggagcggtgtgtttttcctcttcggtgctgagcttttgtgttaaggcggagtcgaagctgctgcatcgggtcagccgatgagctaggcaacgacaactcttaacacttttgctttggcttcttggaggtcctacaccttttgagggagtcctaggcgaaagccctgtctggtcttccaggatcggcgacatcgacgcctgcgggtgccgtttcctccttggaggtgttgtcttgtggactctttctccctttgggtgaaaacccagtccagttatgggcgggcgtgggcagcggcttctgtcgttgttcacctccttggaggcttcgtcttgaaggtcttgctcctctctcggttacttctgtggttcatagttttgtcacgggttttttttgtgtcttctgtgtaaggttttgccggttttcccttagcaaaccgtgcagttgtatggttttctggcccggtttcccttataaacagggtcaactctcttcttctaatatatccggtagatctcctaccgtctactgtttcaaaaagatagtttgattgacttgaggaagggtgtgacgctcgatgatctaaaaacatatattcggtatagagaaaatggggaatgaaaagaatagaaagagagcgaaatagtgtggtgatagtaaaggcatgtggtttggagatgagatctctaaaccctgcgaagtgagagtagcaagcgggggaagaaggatcgatggagcagcggtcaccgtcgatggcgttcctcgttggcgtcgcttttgtggctaaattcgtacacttgccctttacttggggctgcaaaccaagattgtctgcttgcagaagaattagtgaataaatccatatacacaaactatgtagaatacaccttcagatttcaagtgcattttgagaagaatcacacaattaatccatgtatatatgtgtaatcttattaaaagaggcaagaagcaggctgcttggactgccaatgattgtagtctgagcataggcagtaagaaaacatcaatttaatgggactgtaggtagcaagtaatacaccacaaattacatattaactgaaacctcggttatgttatggccaaactgaaaacataatacagcggctagaagtaagagtagaattgagtggaaaatttacccatatcatgaaatccaagggatgtacgcaaattgtctctctctgaattgatactaacaaaaaggtgtcaaaacagggaagaagcccatgagtaccagagcacttagtaagcccaattacaccaacatcgcaatgatctccaactgtccaaggctgaaaaagaaaagatatcacattatatgttaaaaaccaccaccatcaccaccacaaacaagtgagaactgtgtgccttgaaaaggaaaattacaacattacttgattaccaatagtcaggaaaaaaatatgtatttcaagggagagaaacactaacaacgtccatgaccaacaaaagcctcncanttaccatnnntctgtgggtaaccttggatnnaagcctcaagcaatggagcaaagtcaccatccatgctgaacatactgcattttatcaacaagaagatcatctgagttggttacgctagccattgataccaaaataagtgatttttgaatgaagaaatttacttggaaatataacttgtctatgtgcgaaaaaaagaatattttccattgattaatgggacctgctagtgtaatcacaaacatagtttataactaaatcaattagtgcttaacattatgacatgtatgttacgactgggaagtgaaaaaaatacccatggatttttttttaagtcttacacttactggaggatgcgaagcaagcagagtttaatctcaatgacctccgattgtccaaggctgaaaaagataagagattacattatatggtataaaaacccctaagagcacaattcacattttcaggttaatcaagctaagccattaaatgaagcaaaaccaagcatcagcgcgcacctataacataaacacagatatacctcaaggatgcccgttgggataaaaatttggacgggtaaaacatcacaaaggagatcaaatggcagctacaattaggattgccaataaattaatactcacatgggaaatgagcaatgaaactacacccgcagtgatccagttgagcaccgtgaaattatttaggttacatgcagatgaaactgcagagcatgaaaacaaaaaatgaaaattaaatagcatatacaacatctgtaggaagttcaaaatatcatataacagcaaagaatcagctatagtacatgcagccaaagaagcaagctatagaaggggcatgatttaaaataatggtgttagtattagtacctaatggcacaacggttatcatgtaagtaaatcaatattcctgtcatgcttctgcttgcctctcacctgcaaccttt

SEQ ID NO: 67154 - DNA, 1133 bp, Oryza sativa
ggagggctggccttctatttataggcctcagacgtcggttgtgaaggtcggttgtagaggagaagatggagttggtcttggtggcggcgacgtggagaaggaaggcgacggcgccggctgtggcttgtgattggttggagatgtcggtttgctccagaggctgacgtcggcggcgtgaggtggcagatgacgtcggcggcgatgccttagcggcgacgacaggacgttggcggcgattgcttggcgtcgaaggcaatatggcggcggcggtagctgagttgtgcacggcggcagtagcgggcgcatggcggcgcctggaagcgcccacggaggaggaaggggcggctcggctgggctgggccgaagaggaagatgggccaaaaggaagagataaagggattttagcccaattaaatttagaaatcaattctaaattttgtaggttatttgtatgatagaaattggatgagattagtatttggaaggaatctgaatagggaattttgaaaggaaattatatttggatataatttccaaaagagatattttctagtttgagtgcaatattttgagagatagaatataacggaatttatttgatgcactcaaatgagagggagaggaaataaatggaggaagatagataggatttttagcctcaaaatatatggcatgggtttcaaagaattgtctgaggctaataggatatttggatagaatttgaatttaaagaagatttggatgacaaggatataatatattatcttagcacaagagcaattattcacaatgtttgtaataatattattcttgtgccgagaaggaaatcaagccacagaaattagatcaccggctagatcaaaaggaagaatttggatcaagaatcaaaggatatgtttaaggtcaaaggatgggctaacaaataatcccgataaaattagaattactttggtttaggttcaatggcaaaattgggaaggtttcttggatcataatccataaaaaatagtaagggttttgaaactaaatttgaataaaagaattttagtcgaaggaaggttttaaattaaaaccaaatcaagaaatacctcatttaaccaatatatttttaaatgaaaaacacaaaagaaatt

SEQ ID NO: 67155 - DNA, 950 bp, Oryza sativa
acaacagcaacaagaggaagcgcagcctcccgggcaacccaggtgcgttcttgtatagctagctcctcgatcgatccgggctccgttaattttctcggcaattaagcgaaagcaattgatcgaacctatatatagacccggaagcggaggtggtggcgctgtcgccggcgacgctgatggcgacgaacaggttcgtgtgcgagatctgcgggaaggggttccagagggaccagaacctgcagctgcaccggcgggggcacaacctgccgtggaagctgaagcagcgggggagcaaggaggcggtgaggaagaaggtgtacatctgcccggaggccagctgcgtccaccacgacccctcccgcgccctcggcgacctcaccggcatcaagaagcacttcttccgcaagcacggcgagaagaagtggaagtgcgacaagtgctccaagaagtacgccgtccactccgactggaaggcccactccaagatctgcggcacccgcgagtacaagtgcgattgcggcaccatcttctccaggtccttcttcttcctccctcctcctccatcttgcttgcttccatccatccatggcgatcgattgcagcacttgcactcctactgccttctgctcagatatacctgccttggctggcttgccgtgctcctttctcattgccactttgccagtaatccagtgttctcgctgccgcctgcgctttcagttggcacagtgacgagtaggaatcgaagcagcctataagatgagcgtttgttagtgttaacacacctgtaatcatccaataattagggcagcgatagatataccggttgttgattaaccagcaacaaccatgtgcccatccctgccgcgagcatctagccgaaaagatttgtgaacagtggcaactagtacgtagcttagctagctgctcgctgcagcagcgaaacaaaa

SEQ ID NO: 67156 - DNA, 847 bp, Oryza sativa
tggagaggctggatgacccaggcgactgtgccatcgctcaaaggatggcttgatggctccaaaggcttcttttagaggacgaggacgttcatgaggtgatgaagatggaagagcgtacagtcgcccccggcatggtcccctaaacagaagtttcttcgtggccagatccttaagattaaaatatttagagtaaagctccatgtaagcagaattatcagagacaagtctattggcagaaacaagattcttatttgcattgggaacatataggatattgcgaagatgaatatcacgatttggggttctaacagtagaatgaccaatatgactaatttccatacctgcaccgcttgcggtgtgaacttgatcttgccccttgtagcgatcgcgaaccgtgagcttgtccagttcgccagtcacatggtccgtcgcactcgtgtcgacgtaccaatttgtatcaatcccataagatgttgccgatcctgcatatttttcatcgggaacaaaatcttcatcatagcgataccagcagttgattaccgtgtgtcccctcttgtaacagagttgacatttaggtctgttgtcgacgcctcccggtggtcgtgcgccgccattgttgccgcgtcccctgccgcggttagcgccattgttgttgccgccacggccgcggccgccgttgccggtgttgccgccgcgttgttgtcctccaccaccgccacgtcctcggttcgccaaattgacagaagagtctccaccgtgacgaagcgcgagacgctgctcaaagctgagcagctgagagtaggcttctcccagcgtcatggtgtccttgccaacgatggtggagatg

SEQ ID NO: 67157 - DNA, 5051 bp, Oryza sativa
caaattctggattgttaacaggacttctttctctcccttgtcgcctgctgtcgtcgtgatcagggcgttgggagttttggtggcaccggtgagatgcccctcaaggcgagctcctcgtacagccgccatgacctgcgctttccatagcgcatggtttgatttggagagtttctccgagatcgcgttcccgccgagaggattcccggccgccgtcttcgacgaactcgccatgagttggattagatgcgattttgtggatggataggctctgataccatgtgaaaatcagaggtgcagaagcgttgaacctcgttagaggccgcacctttgttaatatatggtgataacaaccatcaccgtggtttttacatccatatagcatgcagtctgttttgatggatagaagaggctaacaacctaacaaactctatcttatccaatctaacagatctcacacgcatgtatacaatatagtttcacaccggcaaccggaccgcagcgtcgtgttcctctgctttggtagcaccggcacgggcaaccactccaaaaagcagctcaaggagattgccgtcgggctagagaaatccggccaccggtttctgtgggtagtgcgcgcccccatcgtcgtcaataacgatccggagaaaccatacgaccctcgggccgatccggacctcgaagcgctcctcccggcggggttcttggagcgaaccagtggccagggcgccgtagtcaagcaatgggcgccgcaggtggacgtgctccatcaccgggcgactggcgcgttcgtgacgcactctggatggaactcggtgctggaggggatcaccgcgggtgtgccaatgctgtgctggccgctctactctgagcagaagatgaacaaggttctcatggtggaggacatgggcatcgctgtggagatggtcgggtggcagcagggccttgtcacggcagaggaggtcgaggccaaggtgaggctggtcatggaatccgaggcaggcaaccaactcagggcgcgggtcacgacgcacaaggaagccgcagccgttgcatggggcgacggcggatcgtcgcgcgcggcgtttgccgagttcctgttggatgcagacagccgacagtctcactagggcacctatggatctggcacatctaccttcaattcaaacatactatgtatctttgttattgttatatgagtccgataaactttaaaataagtattttatcattgacacgtgatgtgataaaccatgaattcacgtatcaacatgataaaggcacggtggcttttaagtcagaggatctcaatccaacatctatttgtcttttaattttttgtgttgtctaaaatactataaaaaaattatcgtttaatttaataagttagatcgatatatgtgatatatcactatacaaataagaaaaaataaaattaatttatacaattaaaaaacaaacaaatttgactcccaatttaacgcatagttccagtaaaaattgttttttttctaacgtgcagatccaattttagcttataggtttagaccccgtttagttcctaaatttttttcccaaaaatatcacatcgaatctttgaacacatgcatgaagcattaaatatagataaataaaaaactaattatataattaggggggaaatcgtgagacgaatcttttgagcctaattaatccatgattagccataagtgctacagtaacgcacatacgctaatgacggattaattaggctcaagagattcgtcttgcggtttccaggcgtgttatgaaattatttttttcatacgtgtccgaaaagcccttccgacgttcggtcaaacatccgatgtgacacccaaaaatttttctttacgcgaactattatgcagtggcatatcatatattcatctatcttcatacacacgatataaacaagaagatatcctctggtaggttaaaaattcatcactatagtactttctcagtcctaaaatatagctatttttagcacagtaccttgtcccaaaatgaagctatttttccaactacctcctctcaaccaatcacaatcattctccttcacctactttttcttttcaaccaattacacaccttctctaatcattctcacatacttttttaaataccagtaccaaccttaaaaatacctacattttaaaacggaggaattatttatcaccctatccatctacatgtgccctccgtcccagaataaccgtttcaggaattgtcacttcagttcagattttttgtccctaacccagcaggccagttagtactcacacgtgaacgttcctgctcgctgttcgtaatacggtagatgcgttttttttttaatctccaggatcagaaatgataccaccagtctcagaagatagtacatgtagatgagttaaatttccccccaaaaaaagttaaatttgttattttatatttattactcatatattaaatttgaatttaaatgtttatggaatgacatatattatattgatatatcatgtcagttttttaaatatatatataataactatttgaatactacctctgtctcaaaaagtagttttgcactacttatataccacatttgaccgtccgttttatttgaaaaaaatatgattcgtatttttgttgttattagataataaaacatgcatagtactttatgtgtgactaatttcttttaaattttttatattttttagataagacgggcggtcaaacgttgaacacagaaatccacaactacaattaatatgggacggaggtagtaccatatacttcctccgtccaaaaaaaataatctagtattagtattagatgtgatatttttaagtacaacgaatttagacaaaagtctgtctagattcattgttgtattagaaaatgtccaatccaactaatttaacttatacaagttgatacaaaaataacatatttaactttgtatttaatgtgaattttcacattcaaaattattattttgtttatacactatgaatttaatgtggattttcacattcaaatttattattttggtttctaattgtatagatggaatttgaacttgctcgtgtatagtcagtcatatatcacatatgaatctatcttattaatttttttaaaaaaaataatgactttttaatcgacatgcacaaaacgagtaatgtctcatatgaaaaaaaaatccagcaccatctacacgtaaccctcaatcctcccaatacaatataacgaagccaatcccaacaaggcgacatggggcatgtaacggccggggctacaaaccgtgtaaaaaatgaagggattatcttaaaaaaaactgctgcaagttaatggctccgaatagtttttttttgtcttttttgttttcgttggatatacttccgtatcggtttccaaaaattgtcttaattattccctccatatttattttgagatagaggttgtagctcggttcggatccgttttgtagcaagttacccggccggtattcaactgctcgctgtttgtagtaatacgggaagatgtgattttctttttaatctccaggataaaaatgatacagcggtcgagctttggttggaggaaggactacagcctacagggaaaacgccgtttgcctttgtccattgaatgcttttgttgtggtcggtcaccttcgatcggatgcatttctgattctttcttcttggaaaagaagggctaaagattgtcctacggggctcggtgctgtagtatgggacaaaggcagaggatgtgaacccgtatgactttatttctaactctgtatcacgatcaccggactaattgactttcccgactaataataaactctatcacgatctctatctgattcgtcgtgtccttattttactcctgtagacatcaccactgacggcggttcctaaaaacaatcaggcttgtgaatctcgaggcctaccggccaattaatttaatcacatctgttagttggtggcggcacagacgaacgactagaagccatcgatgtgtatcctgccttgcctgcgtgtgatgatcatactgtgatcccatcttgtgcagtactccatccgtttcacaatataatcattttagcattttacactttcatattgatgttaatgaatctagatatatatatttatctagatttattaatgtcaatatgaatatgaaaaagctagaatgacttacattgtgaaacgaaggaagtagtatacgccagacgtgagctctcttccttcctcgtctaccagtttactgaactgctgactttagtgaaagagtagtcctcataattcctccaaaactttataaagccaacgtgaaatttgtgttggttatgcaggtcacattggggcgtgtcaacgttgctcaccatggcttaccatacaacccctctatatatacttgtggctgtccgatttgagggcatttgtttccgtcttttttacatcccgtttgatcggaagttcggaacagcagcgagccatgacgacaaagacctttgtgctgttcccgtcgctgggcgtcggccacctgaaccccatggtggagctagccaagcacctgcgccgccgcggcctcggcgtcatcgtcgcggtgatcgatccgcccaacaacgacgccatgtcggccgacgcgatggcgcgcctcgccgcgggcaacccttccgtcacgttccgcatcctgccggcgccggccagcccggaccccggcgcgcaccatgtcaagcgcaacctcgacacgctccggctcgccaaccccgtgctccgcgagttcctccgctcgctgcccgccgtcgacgcactcctgctcgacatgttctgcgtcgacgcgctcgacgtcgcggccgagctcgccatccccgcctacttcttctttccctccccggccagcgtcctcgccgtcttttcccacctcccgtattactaccgcaacgcgccgtcgttgagggagatggataaggcggcgctcatccgatttcccggcattccgccgatccgcaacgtcgacatgctggcgacggt

SEQ ID NO: 67158 - DNA, 6626 bp, Oryza sativa
gagcagtccacatcaccggagccggacctggagcggctgcttccggcggggttcttggagaggacgaagggcagaggcatggtggtcaagaactgggtgccacaggcggaggtggtgcagcacgaggcggtaggcgcgttcgtgacgcactgcgggtggaactcgacgctggaggcgatcatgtcggcgctgccgatgatatgctggccgctgtacgcggagcaggcgatgaacaaggtgatcatggtggaggaaatgaagatcgccgtgtcgcttgacgggtacgaggaaggagggttggtgaaggccgaggaagtggaggctaaggtgaggctggtgatggaggccgaggaagggaggaagctcagggagaggctggtggagacgagggacatggcgttagatgccatcaaggaggctgggtcttctgaagtggcatttgatgagttcatgagagatttggagaagagcagcttggagaatggagttcgcagctgatcaagcagagtatgggtcatgactgcattagtgtaccaatggcgtcagttaccacatgaaatgtttgcgatttttgttaagttagaagcaaagttgtccgcatagcgatgtttttttcgtcctccgatgacggacgcaattgtctcccgtgtccaaaagttgcagtgtcaaccatttctgtataagcaaattaaaataatgcatagtcttcaaacctgaccaatactagcgaccaattattcagagccacacaaacaacatgaacccactagactggaaatcactggctctagtcaaatgcaaattctctaagctaactgaaatgcgaaattaaaaaataaggaatactagaagaagagtatagagtccatatagaaatacaatttaaaaaatagaaaataggaaataaaaaaaggaatattagaagaagagtatagaatccctacaggaatttagaattgaataaatttcagaataaaaataataaaattaaaagtagagcttagagtccatatagaaataaaatttgcaaataactaatattcaaaattaaaaaaataatatgggaagaagagtttataattcatataggaatataatttagacatactgaaattcgaaatttaaaaaataaagaatattgaaagatgagtttagagtccacatagaaatacaattagagatcattgaattcagaattaaaaataaataatattagaagaagagcctagagtctatgtagaaatataatttacaaataacaaaaattcagaattaaaaaataagaaatattaaaaagacgagtctacagtccatatagaaatacaatttagaaataactaaaatttaatattaaaaataattaataactatcacgtatatacagtacaacatgaatattacacattgatagtttggtaaagttagtacaaaatttaaaattatgttatcattttaatatattttaataaaaaaagaaaatataataatgctagcctcgcaatttgcgcaaacctctatactagttcttattaattttttaactcatccctaattatatggatctggtccgttacaccgtacagaataaaaactttcttttcttcgtcattgctcacgaaaacggccgtgacgtgagctacctggtctctccttcctcacgtagacttctacaaagcccatgtgaaatttgtgtcgatcatgcaactcaccgtgaaacgtttcaatgttgctcgccatggccttctttgccaagaaatgggttaccattcaacgccgctcgcactatttagcttgtgggttgcgagattatattggtaagccaatttgagagcatttgctacgtttttatgcatactgtttgatcggaacaactcgtagccatgacgacaaagacgtttgtcatgtacccgtcgctgggcgtcggccacctgaaccccatggtggagctagccaagcacctgcgccgccgcggcctcggtgtcgtcgtcgcggtgattgacccgcccaacaacgacgccgtgtcggccgacgcgatggcgcgcctcgccgcggccaacccttccatcacgtttcgcctcctgccggcaccggacagtcctgacgtcggcgcgcacccgatcaagcgcagccacgacacgctcaagctcgccaaccccgtgctccgggagttcctccgctcgctgcccgccgtcgacgcactcctgctcgacatgttctgcgtcgacgcgctcgacgtcgcggccgagctcgccatccccgcgtacttcttcttcccatcccaggccagcgcccttgccgtctttctccacctcccgtattactaccccaatctgccgacatttatggagatgggcaaggcggcgctcctccgctttcccgggatgccgccgatccgcaccgtcgacatgccggcgatgttgcgggacaaggatagcgaggcgaccaaggttaggttgtatcaattcaagcggatgacggaagcgaagggcgtgctggtgaacagcttcgactggctgcagcccaaggccctgaaagcgctcgccgccggcgtctgcgttcccgacaagcccacgccgagggtctactgcatcgggccactggtcgacgccggcaggaaatcaaggatcggcggcgagaggcacgcgtgcctcgcgtggctggacgcccagccgcggcggagcgtcgtgttcctctgcttcggcagccagggcgcgttcccggaggcgcagctgttggagatagctcgtgggctggagagctccggccaccgattcctgtggaccgtgaggagcccaccggaggagcagtccacatcaccggagccggacctggagcgactgcttccggcggggttcttggagaggacgaaggacagaggcatggtggtcaagaactgggtgccacaggcggaggtggtgcagcacgaggcggtcggcgcgttcgtgacgcactgcgggtggaactcgacgctggaggcgatcatgtcggcgctgccgatgatatgttggccgctgtacgcggagcaggcgatgaacaaggtgatcatggtggaggagatgaagatcgccgtgtcgcttgacgggtacgaggaaggagggttggtgaaggctgaggaagtggaggcgaaggtgaggctggtgatggagaccgaggaagggaggaagctcagggagaaactggtggagacgagggacatggcgttggatgccatcacggaaggtggatcttctgaaatggcatttgataagttcatgagagatttggaggagagcagcttggagaatggagttcgtagctgattaagcagagtaaggctcacgattgcattagtgtatcaatggcgtcagttaccatgaaatgtttgcgatttttgctacggaattgctattaagttcagaagcacagtagtgcgcatagtgatgttcttttcatcctccaatgacggatgccattgtctctcgtgtccaaaagttgcagtgtcaaccatttctgtataagaagattaaaataatgcagtcttcaaacctgaccaatactaacgaccaattattcagagccacacaaacaacatgaacccactagcgtggaaatcactggctctagtcaaatgcaaattctctacgctaattgttagtcatccaaaatagtcctgagtaggctagagaatagagatagcgcaggatggacagtgacaacttacaagaggatggaaccatcactgaaattcaggtgcctgggaataccaaagaaggtaaaaatcatgtcttctttttttttttttttgaaacgaaaaaaaaaatcatgtcttcctctctggccatacttgtcaattaggaaatctggaagtaacagaccgctagcaccagatgctgcgtggtttaaccttattgaacgaaacctaaacaagtttctgctagtccataatgggtgtaagttgaaactgaagcactgaatctgctaacctgactaactgtgacaacctgcaataaaacaccaaatcggacagagcataattcagagcaaaagtgtcacctctcagcagcaatcttgtcgagtcgccgatcaggcacaagggatcatccctgatcatcttcgacgcttcatcatttgcagcgctgcaaatcatccacgaaatcagagaacgccgtgcacgacggcccgccgtctgccagcgcctccgcggccatctccttcgccattgccagccttcctctgagcttcttgccttcgtcggagtccatcaccagcctcaccttcttctccacttcctctgccttgacgagctcctcgtcgtagccgtccatcaccaccccgagctgcatcccgtccaccacgagcaccttgttcagcctctgctcggcgtactgcggccagcacagcatcggaactccggccgtcgccgcctccaggatggagttccacccgcagtgcgtcacgaacgcggcggtcgcggcgtgccggagcacctccacctgcggcgcccacgacatcaccaccattcccctctccctcgtcctctccaagaacttctccgggagcagagcacccaggtctggctcagaacgcggcagggagaacttggccgggtcctccggtggtgggctccgtaccacccagaggaaacggtggccggaattctctagcccacgagcaatctccttcagctgctccgccgagacggcgcccatgctgccgaagctgacgaacacgacgctccgctccggctgcgcgtcaagccacgcgaggcatgcgtggcgctctcctttcgccgcgtcctcgcccttcacgatcagtggcccgatgcagtacaccggcggcgtggggcggtcgggcacgcacgcgccgtccccgagcgccgtcacggccttcgcctccagccattcgtaggtgttgatcagcatgccccgcgcctccggcatgcggcggtagtgatagaccagcgaagcaccgatcacgtccgcgcagtcgagcacgttgtgcggcatgtccgacgccgggatcggagggacgccgggaaagtggaggagcgccttccccatgtccttcaagtcgccctccgtggtggcgaagtagtgggggaggtggaggaacgcggcgaggacccccgcggaggaggtgaagtagaagtacgccgggacgccgaccgccgcggcggcgtcgagggcgtcgacgcagaagaggtccagcacgacggcggcgacgggcgggagggagcggaggaaggtcagaaggattggcacggtgaggcggatcacgtcgagcagctgctggaagccgtcagggtccggctcggggtagtccggaggcgggaggttgtggaaggagatggaagggttggcggcggcgatgcgcgccaccgcgggggccgacgaggcggcgacgtcggcggtggaagccggaggggtcgggacagcgatgatgactgcgaatccacggccgaggaagagcttggcgagctccaccatgggggcgagatggccggcgccaaggatggtgtgcagcaccacggtctgactctgttttgaattgggctccattagagcgagccggcgacacggtgagtctatgcgagtgttaagggaggtgccttctcgcgaaccacttgaggggagagtttaagcctcggttgctcgtataatttctacaaaacttcaatgctcagcctacaggtttgaaactcgcactgtgcgctgctatataacggaatcccgttttcaaacgggatgatcccgagcaggtatcaggtgtgatacctatcagatatcagatgattctacacaataggatgatcccgagtacgtatggtgtgatacctatcaggtatcagacgattctacacacgtttcaggtgatacttgcaagtatcatgtgatacttatcaggtatcatgcgatttctaccacgtatcgcgtgatactcgcgaggtatcatgtgaaacctgtcaggtatcagacgatttcaatcacgtatcgcgtgatactcacgaggtatcatgcgatacctgtcgtgtatcagacgatttctatcacgtattgcgtgatactcgcgaggtatcatgtgatacttgtcaggtatcagacgatttctaccatgtatcgcgtgatacttgcgaggtatcggatgatacctaccaagtatcaggtgattcctactggatatagctgggcatcctgttgggggaggagcacctcgacacgcgcggtcagtaccctgcagccgtccctcgtaaacgaggacggcggcggtggcggcagcgggggacgggcgcggcggcggcggcggcggtggcggcggcggcagaggcggaggcgaggggggacagtcgcggcagcggcgggggacgacgacggcagcgagtgagcaggaatcgcgttgtggaggaggagctatcccgttcggggacgggataccgtcccctagcattcccgatgatttaagcttacaagagtactactccgtggattctacagaaaaggggatacacatcgctcattgctgacctcaattttcattcctgccaaattgctgtcagttatcgtgtattctccagcccaagagtgtccatgagtgtacagttgtacatagggagtgaattttcatccctggaggggatatccactcgttgt

SEQ ID NO: 67159 - DNA, 2081 bp, Oryza sativa
aggtggagaacgcggcgaggtcgccggcggaggaggtgtagtagaagtacgccgggacgccggccgccgtggcggcgtcgagtgcgtcgacgcagaacaggtcgagcacgagagccgcgaccgaggggagggagcggaggaaggcgaggaggggtggcacggtgagacgcatcgtgtcgagcatctgcaggaaggcgtcgggatccgggtcggggtactcgggcggcgggaggtggtggaaggagatggaagggttggcggccgccatgcggtcgaccgcgggggcggacgaggagaagaagtcggcggtggaggccggcggggtcggcacggcgatgacgacggcgaggccgcggcggagaaggagcttcgcgagttcaaccatggggatgaggtggcccacgccgaggcaggcgtgcagcaccaccatcggattggggtctgcctccatcggcgccggagattcggcggccggcggcggagagagtgacagactgacagtgcgagtggaggggaatccgtgggcgagagaatttcggcgtcctgtgtttcgtctctccaccactagtagtggcgactgacgacgtagcgtactccatttgggttgcggcggaattgcctactgctccgtggtagcggatgtatggcccatcagcccatatagtgaaacatgacccgggctagatgcctagattgcgtcctgttgctcacgttccacccaatggcccatgtgtgaccttccttagcttctagcaacttttgctgaaagcctgaaaggaatgaaactgcagaggtgaagaatatgattagaggtttggaataagttcatttatggtctcttaacttgacaacgagttcgatttcgtccctgaaccgaaataccagatacaacgggttcctcaactatcaaaatcagtgcaaataaggcctcacgacggtttgaatagcgttttcacttttcagctgccgtgatgcctacgtggatggtttgaattgtcctcgtcttacgtggcagtgagccggtgatatggcactggaagcaaaatataaaaattaagaattaaaacaaaaatataggccccacatgttagtaaaaaaaaaaagtgggacccacatgttagtaggtcccaccctcttctcatctgcagtggatgacggcacgtcaacaccttttctcgtctccctcccagccatctctcttccctccttctccttgagctccctcacttgccgacaaccgctgccggcgacatgcgtccaactcctccccgactttctccctatcttttggcccctaaacgagtccaactcctcgccctcgcgccacaggtgcgcccctctaacttgccatcgccatccccgtccctcggtcaactccacctagggctgtcaaaaaagctcgaggctcgtgagctgctcgaactcggctcgctcaaggctcgactcgagctcgactcgtcgacgcgagcttcacgagccgagctcgaattgtttgacgagcctgtctttactttctttttcttttggcagtgagtaatagcataccgagtagtactaccagtagtattcatttatcatgtcaacatcacctagctgcttgcagagtggagtagtactcctactagttagtagtgctaggagtagtactactgcatgtctgtcattacgagcgccatcgtcaccaaaatccaacagtccatccaagcaaccaatgcgactaagctcgatagcaggctcgagctcgagcgagctcgagccgaacccatctatgagctcgaggcataaactaggctcggctcgagctcgactcgaatatgtaccaagctcgagcttagatgggtaagctcgctcgagctcggctcgttgacagccctaactccacccccgccccggcgcttcggccgcaggcaaggaaaggcaagggatcacgagccacaagttgcatttcttccaccacttgttcagtgaccctgcaatcgaggtttcaaggtagaagagaagggaggcaaacaaccagtggtagagaaatgcgaagatccggtggaatgcggggatgtggagaagacatatgatatttctcc

SEQ ID NO: 67160 - DNA, 11582 bp, Oryza sativa
gaagtcagaactcacaaagacccccggaccaatcacagtccgtgaaaattacacggctatggactcagcagcaaacgtagtcatcatctcaagcttccacgagtcaagcgtacgtgtcaaatccggcgcatgacagtgtcgcagccacgacagtggacttgctcggccacatgtataaatcgaagaccaagaccaggaacagcggagcaggttcgagctaggtggtgtgatccattcagacaagtaactaacaaaaacggtcgtgtccgttcgtgacatttgctatagctagctagctccagctcccatggcgacggcggcggagaacaagaacgagccggcgcggccattcgcggtgccatccccgtcggtccacccggcggcgaccggcgtgggggaggaggaggaggcgcaggcggcgacggggtggcggtccatgcagtacctccggaagcggcggcgcgcgctctgctgctgcggctgctgcgtgaccaccctggtcgtcgtcggcctcgtcatcctcgtcctcgcgctcaccgtgttcagggtgaaggacccccgcatcaccatgaacggcgtgtgggtgacggccatcagcaccggccccggcaccggcgccggcatcgggagcaccgtggcgaccaacgcgacgctcaccgccgacgtctcggtcaagaaccccaacgccgcgtcgctccggttctcccggagcgagacggacgtgtactacaaggggaagacggtgagcgtggcgtacgtccccgccggcagcgtcggcgccgaccggacggtgcggatgaacatcacgctcgacctgctcgccgaccgcctcgcgtcggtgctcaacggcacggggctgatactcgggcaggagtacgacctgaccacctacacggcgatgagggcgagggtcagcgtgctggggatcatcaagaagagcctcgacgttcggatgaactgctcggtcatcttggacgtcgccggcatcgccggcgtgctgctgcccggggacggggccaagtcgggcgtgcagactaggagcgtggattgcgttgcaatcgtgagctgatcagcggttttcttgtgtgagtactgcattgtcattacagcacctcattacatatgaatatgtatttttctggatgtatattctgctactctcgtatgtatgtttttctggatatatattatgctactttcgtgtgttcacagatcgaattctctctaggaaataatacccaatagcattattatatgcctgtgtttgatggattgggtagacccgatttgggtagcagtctcacagccctgagttacatgaactttatagatgcagacgcactaccatgtttactgacgatgcataaggattaattagctaaaaggatgtaaagaaacctttgcaacgccagtaaaatggtgatttgaatagactgcatgaaaatgaaacaccatatacctctgccagcaagataggagtgcattgtcaaccacaacagcctcagagtatgtataaaacagacaggaaaataaccaattaaaggtgatatacagtagatagcattctgatagcattccaggtttcctctgtagataccagctatagaaaaaaaaaactagcttcttaccagcacagatggccgtgctactgtgctagaagcctagaaatgaacgaccaagggaatgtaactaatgaaactggacaatacataaaacttatcaatttacataaaacaaaaattatcacaaaagtttcaagaatcacatacattacattaggggggaaaagcaaaacaaaaggtaatgtggctaaaaaaataattcagaacttgaactaccgattgtccctaacgattttagctattgacttgggtaaggtcccgtgccaaagaaaattgttaggtacaaccatacagtaattagaaaataataacagcacagcacacaaactgcatgtatcaaacatgaaagaaaaagatcaacctagactatcacagtcagtgaattggaatttagaggtgtagctggcaggtactcatacaagtgcattgagtttagcacacaaaacattctaatcagtgaggtattcgtaactacatcaagtaaaatgaaaaaaaaatttccaagtttttgctgctcaaagttcaggcataactagccaacagataccaaggcatgtgcagagcatgataacatgttccacattagctcttgttgttcaaccccatatgaagttatgaacacatacacaccccctcaagattccatgaatgaaagtggggtcataatagagtccctccaagttccaactcacataaccatcttcagatggcgtcaaaatctgcaagctgtctaacctcacagtgcaaatagaataacaaggaaatgacaagttaaaatagtgcacccaaacagaatgtcaccatgagaacagcacagtgctagatgggaaattcagactaaaacaaaataactctgacatcgactattcataacagtataagggttattattcaataggtagttgtctaaatatgaaactagtgggtagtcacaactttccagttaacatgaaaaaaccttcttactctgcaattaaagaatcctgaatgacatagcacacattctcacatttagggacatacaagttcattacagctgttactagcttaattcatggaaaacagcggtatatatacctccatagaaacaaagaacattaacaccgaacatgaactaaactagtaaacacaaatcaaatgaccaaagtggggaagtatgaccatttcacccaataaggataacagttcagaattcaagctaacttaaaaaacaggatgaactgatctggagaagcaaccggcataacagttatctcaaatgttattacttatacctccctgaaaagttcaaaataactgatcctgttgaggaaaacacaattgcctaacaaggcaagtgatctacaaaagcgaataaatgttctctgctacttaatttatgactcaggaaccaaacattaattcaaaaaagtccacgctacatacatcaatgcgcaaaattatcgataatccagtagccaactgtatttaaaaccaagaaatatgtcgagtcccgacaaagaccgttagttaggatattccccttccgttacagcatgaaaatcattatgatgataaaatgctatatcctgtgataaataactttttttttcctttcatgtccttgccgccaaagaatggtaaccaacatacaagtaatgtaagtgcaataatcatatatatatatatatatatatatatatatatatatatatatatatatatatatatatatatatatatatatataactggaatgaagcaattcagatattgatcttgcacatacaactgtagggcaagtaaccttacttggtaaaagctactatatccgaatggaaaaaacaatgtatatacactgcatgtctgcttcagtgcaacgatctactgctactaagcaaaacttcctcaaagtcaaggctgtcctagtccacaatctcacctaaatggctaaatatactaatattgccatggatcagccaaacctcatctgaacaataaaacaatggatacaccatcccatcgttgataaccagtagaaaatggtgccaaaaaacgaatatagaagagaagacatgatgcacccaattccgtcacctgtggcgccggcggtcggcggcgtactgtgatagcgggacgagctccgacagcggggtggcgagcggagtggagactggagtggggatgggcgaggaccggcagaccgggcacgacgcgctccgccgcagccacgcgtccaggcacatgaggtggaacctgtgcctgcactcgggcatcatgcgctgcatctccccttccttgtactcgcagaggcagatcgagcacgcggcctcggcgtccgcccccgtcgccgccctagagaagggcaccttggggtacgaggcgatcaccgcggggtcgagcccgacgggcgacgacgccgcgccgcccccggcgccgccgcgggacgaggagcccggggagtcggagtcgtccgcgacgaagatgacccgcgggacggtgatggagatgtgcccggagctggacgcggaggacacggcgtggcgcgcggagtggaccccctggccgccgccgcggcggacgaccccggccccgccgcggcgggagcagaagtagaaggcgaggagcagcgacgcgaggaggacgaggaagccgagcgcgatggcgaccgcgtacccgacgccgagcgaggagaacgagtcgaggaacgacgccatgacggcggcggcggtggcggcggcgagaccgtggggcggaatggcatggcgtgcgggggggcgcggctggggtgggagaagagccgaggaggggcaaaacgggaagaggggtattttgttttaggtttccggaggggtggatctggtagttggcggcattaattgccggtgaggagggggaggccgaggaggaggggatcgcagttatggcgcggagctggagtgcaggacgcgcgccgtgccgcgcaccgcggtttgccggtttcctctgccgctcgctgccgagccgagggagcggctgggtgagtgagcggggagggggccaaggggggaacgaaacgcgtgaggctttcgccgcgtcgctctccttggaaggccacacggaccggcggatgatgggccacataggttttggcgattctcagcgcgcggaccgaggagaccagactagagattaatgggctgggaatatccaagtctgacaaagggacatacatttgctggttgactaagtctattttaactcccttcttatcttgcttatgattgaatcgcatctctcaggctcaagcgcaaaaccgggtataacgcctctccaagacaaaaactggtgcaaatcgacttcttcgatggtttaggaaacgtttttttttctaatgtgacaggttggtcatgattgactcggtgagtaagcaagtaagataagagtgtaagacccacgtgtcagggactactctattttccatctctcccgatggtagcaaggcagcgataaggcggtagtagcagccggtgaggaaggcagtccggcgaggcgctcgacgaggtcgggacgagagcttgggaggttgtggtggtgcaggaggacgcgagagctcagggaagaaggagtagtgggtgttgtcggcggtatgggagccgaagaggacgacaatcttcacggtagcagagcatgtcgtggagagaggagaagggtgcaaggaggtcaaccttctaggcattggactggagatcattgttggggggggggggtgatgtcacaagtgaaccctcctagggctggcgacggagcctcgtctcatgagggccaacgtttcagcgcaggggacgatagcggggtaggtagccttgacaatgccatgagcccccagcatgtgtcggccaacacccctctcctcgccaaccctcatgtcgactcgctaggtagtggtgggtaggacctaacggctagcgagatcgctctccgcctagagatctgaggacgattggcccaccgcaggtccttgatctacttgcacaccaagagcagcaatggacacgttgcaatcatccaccatggcgaagccaagaacagcagcacaaccttgttgaagaacccgtgctttgcgtgggcggtcaccatggccacgtaggaaacgatgtcctagtcgactgggaacttgtcgaggagtgcccatggaggcgagctcatcgcgcgtgaggtagagctcgatgagcccgttgcaagcagcgcgacagtggtcaagatcgagcttggcgcattgacatggatggctggcgcaccctcaccatgctcccctcttcccttgcacgcgccgagagcctcccatctactgactcagcgagtcaacctgccacgtcagcgaaaaacgtttcctaacatcaaagaagtcgatttgcaccggtttttgaaaatgtgggaggtagggttcgacttaccgtcggtaaccgcgcggttaccactgttaccggccttatcgcgggggtacggtaatagaaaaaccgcggtaaccttcttaaattcaaataaatttaaaaaataatttgaatttttgataaattttgcacggtttcgtacggttaccgcgcggtaaccgtgcttaccgccggggcgcggtaaccctagccccggcagtttgggaaaccctagtaggaggcgttatacctagttttacggttgagggatgcgattcaatcgggagaagagatgagggagggaaacagactttgttagctgggtcgggatcgagtagttagttcctagtaggctatgtacgaaggtcacatgatcgattgggcctttttagagcttagaaacctggaaatgtcgtaatatcgtgcaaaacgtccgtttgatctcccccactccaactttcatcgtttatccatacaatcgaatgcggaggtttattcatttaacaaccggttcgttttccctctcttggggtagtttggacaggggacaacgatttcatttgatgtggcatctagatgatactcgtagtataggatgtgctagattttctttttgaaacggagggagtacatagtatttctattagaaaaaaaaaacagtggaacctacatggccgggactctatttcttcctccccttcctcaatatctctcctgccactagtggatcatgtggggccatattttttgtttttatttgatttttttttcaatcggactgccattgacatgtgtgtcacattagtgttttttttttctttatagtgtcacataaacaccacgtagccgtataggataaagataaggtcaatgtatcatataactgacacgtaggatgaaacggctttcaaattaacgatagtggtaaattggtctagtcttaagaaatggaaatcaggcgacacatgggatgaaaccgcttttcaaattgacgagagttaaatacttaaattggtccagtcttaacagttgtgggagatttcatatttgatttgcggttaagaaatggaaaccagatttgggctattgtaaagggaagcaaaataagatttttcctaatatatatctcggcctcctccactagttgactgcatgaggatataccatggcttttagagagggatcgcattccaatccacgcgttgatgagaagatcaatatagcatagcacatgataattggggaaaaaaaaaattccccgttgccggggatcgaacccgggtcacccgcgtgacaggcgggaatactcaccactacactacaacgacttcgatattcagttgtcgataggcacatatttatttatcggtatctttgcctcgtttgtaaatatgacatgatagactagtgatcggccatgccagcctggagtaatagcatatgctattacgtatttgcatgtaacacaaaagggttttaagtgtttatcgtcgcaattagatgacacaaaagagtataataagatctaggccggctatatacaccattatacttaaaaaaaagctaaatcgtactttatttgttttacattataagatattttggataaatgttagagcaaggtcaatagtgcagcccactgctagctccaaatcttctatagccaattcatacaatagttacttactatactattaatacttggtcccacctgtcatacacacattacgtcatggagtccgtgctgcagctagttacagatctgtagcccgctgcttttctctctcttcctttatctctttaaaatatgtttatagctggcttatagcctgctattgtacctgctcttagtgagtttagatgaaacatagagagactaaaacatcttccgtataatgtataaaacggagggactacgtaacagtgtcgcccacacaactgatggtacactttgtccctttgcctttgcgatgccttccgaagagacactgggctacgagcctacgagagcacttgagcctaacctggacttggcccgcaagaatcagccagccaggcccacaccacaaaatcctcctccttttcaaactccgcaccttcgtctagaagcttctaactcgcccactagctcccttccccttggactctttggagttgttggaaggaacacgcgcggacgcgcccacgacccctccccacggacggatgccggcgaaagcgcaggcacgccacgcgtcgtcactcgtcacggtgccagtaacctcctcgtgatctccacccccttcattacttccccgtgctaaaccccaacagaggtcccacacgatcgctgacaggtgggccctccctgcgcgtgcaagccgattagcgctaattacccgtcgtctcgaggagttattaccacgcttaaccgcgccaattacttcgccgggttaacgcaggacttaatcacgcggttgatcgtgcccgatccaacggccaggatcgcctcactccgcgcataaaacccaacgccacgactacggagaaaaggaggaaaaagaaaagcaaaaaggcaaaaagagttcgtgcgaaaaaaaaaagaaagaagagttcgactgttcgagcgaggagggagaagaagagggggagagagagagccagcagctagccatggcggagcacaaggaggaggagtcgttggtggagtcggtgatggacaagatctccgacaagctccacggccgcgggggctcgtcgtcgtcgtcgtcggactccgacggggagaggacggccgacttgaaggccaagatctaccgcctcttcggccgcgagaagcccgtccactccgtcctcggcggcggcaagcgtaagacccaaagcttaaagctctttttcgcttgtaggcgtctgtgttcttgcgagcgtgtagatccgaccgcatcggggttttcgctccgctttttctgagtggggctcgtttgttgtactttctcccggaactacgagcgtgtggagaacgtcgcgatccgtgatttctgaagtcaaatttatgctgcgttttcgccacaatgtgagtaggttgtgatcagattagtatttgttcgtgtagatttcgcatctaggttgggatttaaatgcaatagaatagtaactgagcggtgatgttgatgcgctatattcctttatgcttaaaccctgagattctttgtttggtagtgtagctgggtatcttattgtttatatggggatttgctctcctctgatgtgcttatgtttgtggttgcagctgctgatctctttctatggaggaacaagaaaatctccgttggggtactcgctggcgccacggccatctggctgctgtttgaagtcatggattatcatctcctcaccctgttgtgccactgtatcatcctcaccctggccatgctcttcctctggtccaatgcctcaactttcatcaacaagtgagcttcctgtaacttcaactgttattcacaacatatcaaacttaaattgtcagtggcatgttaacttgatctagctttttattggcctatagattaatgttgtgtaattgtgataccttatcatgttaacttcatgtagttttttattggcctgtagatgaatgttgtgtaattgtgataacgcttcttaggacatccttttatcggcatgttaacttataatgtattagtagttttttattggcctgtagatggatgttgtgtaattgtgataatgctccttgggacttacttttatcgccctgttactttgtggatctgtagtcgatggtcacaatgcctggaatgttacacgttctaagcttgtggctgtaatatgttgagtttgtggaatgcataaatggtgaatatgtttagtttgtggctgtaatttctgtcttgcaatttttttaggtcccctcctaacattcctgaagtgaagatcccagaggacctggctgttaatgttgctcgctcactgagatttgagatcaataggggctttgctaccttgagggagattggtcaagggcatgacctgaagaaatttctgattgtatgtcagattggcaacatgattaccttttttaagccttcattgtttaatggtatctcttcgacatgctcaatttgcttatgctggtcctctttattaaggttgtcgtgggtctctgggttctctctgttcttgggagctgctgcaatttcctgaccttgttctacataggtaattattttggtacaacaactgtacaagttaccacatttagcactgttaccaactacagttttctttccagcagtctttatggtactgtacaccgtgcctgttctgtatgagaagtatgaggaccaaatcgatgcttttggagagaaggccatgatcgaactgaagaagtactatgctattttcgatgagaaatgcctctctaagatccccaagggtccgttgaaaaacaagaagcattagaaattgtaggatgagccgtagaaggtactatgctaatttatcatccagcctgatcactaattgtcggttttaaaggatggctacgattccatgcctttactgatagtaaatacctacattttggtgtggctagtagttgcgatgtgctgaacttcaatgaattcgaattatgccagcatgctctatctatatcctgttttcaaactcatgtttaactcaacttccgcccctggaagctgttggtactaagtgctatcaatatgtgacttatctttatggtattccatttgaaaggcttgggacctatggtaaagtggttgtttgatgtaggctaatccagaggtttgaccgttgagtaggagttgttttgctttggcctccataatgtccaaatgcacgattcttatggatgggttatgctacctgagtttttttaagtactatagtgagcatccattcttcaaaaacaatagtcttaaggctctatagggtgcgtggtgcgtcatacagttatttggcttccattttgtacggtgggtataccttataatgatagagcttttctattagcttatacttctaagttttaactcggtgtgccgtttcattcagtcgctaccaacgatgcacataccacactcagaaaactaccagaaattaaagagttataacaagttcacaatccacatctcaagtcgatgtatacattgttttccttttactatgacaacgaccaaaagcgtgcctggggataattttcagaatcgctatctgtatcatcactttctgtcgatgaagctgctagatcagcgatgtccaatatgtagtcagcaaccttgttcaggaaagtataaaacaatgctgtcagcacattgtagtgaagaagggaaaaaacattaaattttaacatttaaaaattgttgctgcaatgaaatgagcagtgaattttagacttcattatctatctgttgggttcaaaactatcataaaacactactattaacaataaataaaagtacttactgtatgaggtaatagaggtcctagttttactccatcttttccattattaaggcaatagtgtggagtagcacacgtcaagtcgcac

SEQ ID NO: 67161 - DNA, 5596 bp, Oryza sativa
attgtaagggatcggtgctttaattgatcgagctggtgcctacccgctcaaacaaagtttcataattggacagatcaacataagaaagcaatgcctcttcacgagttgctagagggctagagctggttccactagacagaaacagtgcaaaatcactggaaattcgtcagaattgtgcacatctggggagcggcacgagcttggaagagaaaggggcttactcagggaggagccggaacgcgagcagcacgtcgccggcgacgagagcctgggcggccttggggaggtcgccgtacccgattcggaggagcgcggcgatctcgccgcacgccgtcgggtagtcccacggccgcgacagcgcggccgatatccccatctccctgtacctctccgccgcacccgtctccctccgccgcggctgccgccgcctcaccggcatcgctgcgacctcggaggggccgttccctcgtggatccgcccggacaccgcgagccgccgcgccgcctcgtcgttccgacggcgagatgttccgggcggcctggacgccgccaccgacgcggcccttgtggtggtttgggctacgcgcgtgaccggagtacacgtgtcaggcttccatggatgggtgtgatgtaatgggcttccggaattcgctgaccgtgatgtttggcccgttaggcggcccaggatgacccagtttagaacaaaatgttgctcgacttactaatctttgtacgtgttttagtgtaaactttgactgatataaattcatgtttaattacatagcataaaagtgataatgttaaatgcataacaaaaagtacttcattatacgtttagagagtcattttgaaaaatatttggcttaaattacagtaagtacagacgataatatagatttgatgatagtagaaagtaatgcacctgttggttttgccatcttaaacgatgccacgtctgttacatttttattcttagtaaacacatgtagcattaaaaagtactgtagcagtagacattttctgagcatgtcacaacgtacaacttcatcttacaaggttctgagctcactcacattgcaattctaatgaaccgagaccattgtttggcctgcgtcaactgtgtcgcaaacttgcaatctatgctgatttctatttccctacgatagctgaccttcctagcacatcttaggagaaaactcggtctatgacaaacacggccaagtaagccatgcaatttctgtttcttggcctaaaaacgacgtctatctgacaaaatttcccaatgtgttctgcacaatgctcatgccgaatccaacttgttctgcttgagaaattccaggtccttgagttgccgctgcgctgcttccttggacacggtcttgacgccggggcccttcctctcgccggcagccacctgcttcgccatggaggtcactatcctctcgaccgcctgcctcccgacggaggggaagacggcgttcagcattttgcacagcagcttcacgtccacgtcttccaccatgtcctgcccgaagcagcacacgtagatggcctccagggccttctccgcccgcgcttccattggtatctgtggcgccggagccttcagctttgctcttttctgcaataaaattcatcttctcttagggaccaatttataggacatatagtatgcattcaaatttgcagtgcagggacatgttcttccagaaaagttgctgaattaagcatggctacctcctttgccgtcttcatcatgtcgaggaacgtctcctcctcgaactcgatgtcgttggagaggcggagccgcgcgacgccttccaagatctcctccgttttcagcagcccgccaccaacggcggccagccagcagcacagcagaacgtagaagggatctcctgcctgtcaaacaacggaacatatgctcaccaaatcaattaaaagaacatttttggcatttctgcttggttttgcatcatttttggcattgagaagaagaaatcgacggcgagaggagcgacgggtaccttgccgcggcgttcgttgaaatcgtagaaggcctgggagtccatgacggtgcacttcttgctgacgcggcggcggaactcggcgaagtcgatcatgtcgccgccgacgccaccctcgtcgctcaggatgcgcgccacgaggcccaccacggggagagccccgatgaggcggcccgcgatggaggacggcgagttggggttcggctccatgtacgccaccaccgttccatgccgccggcgccggttgggggcggacggcgatggccggcggtggcgcggcaggaaggccgaggcgagcgagaacctgtgggcgacgggtaacgtccccattgtgtgtggtggacgtggcgcgcgccttatctgctcatgcgcctgcttgactgaagccagcttggactttgggggtggcttggctagttggcttcgctactgtgctacactgcgctacacttgtggtagttggttcggtactcctaatttgcacgcaaaacagtcacaatcattgaattttattgagtaatttcacaaaactacatgtattttgatcaatatatcataaaactacagatttaaaaataggaaaaagtatgaattacctccctaaactattgcgacaacacgaattaccccccgaaccacaaaatcggacatattacacctcaaactattgataccggataaattaccccttgactcaatcctgagcggtttttcttctacacgttgcaccgacgtgaaaatacaatcagcaaaaagaaataaaagaaaatataggacccacctgttagtacccctcttccccctcccctctcttctctctcgggcgtgcgtgaacgggcagcgggcagggtcgcggcgcaggaggcgaggtggcggcgaggttctctctccacctcgttccctctctctttctctgtggtgccgtcgggagagccgagcaaggaggaggcggcggatcctaacaggcggtggaggaggcgaggcgaggtggcggcgaggttggctctgcaagcgtagtggaggaggtgaggcgagcgtgacggcggagaagtcgaggcggttctgctcgccgccgtctcgagatccctcggcgaccctcccacgactctccctgccggcgccgtgaacgaccaccgcactcctcccccgacgagcgtgtgagcggcgacgcctctctcgtttccgcctccatgctgggcgcgctcgtgctcctcctatatggcgagcgtgtgcgcggatcgcccgccgttgcgagctcgccgtggaggcggcgagatcgacgacgagctccactacttgccttgatgcgccagagatggagaggggggaggggcaaagaggaggggggagaagaagaggattggctgatagtgggccccaccatatttatttgttatggctgacaagtgggtcccatatatttttcttttgttttggctgatcagactgccacgtgtgcatccacgtaggaccgaaaccaccctggatcgatctaggagggtaattcgtccggtttgtaaagttcaggataaaaaaattagtattgaagtttagggttaaaaatcggacgactgctattgttgagaggggtaattcgtacttttttttcttgaaaatatgtatcacaaaactatagattttagatattatattagaaaactacagaattaaaatcagttttattacaaaactataacttttgaaactttaatatgttatggatataaactctaaaatatatagttcttttataatttaatcattaaatctgtagttttgtgatacgatactttaatttgtaattctaagataaatttgacactaaatttgtaggtctgtgatacacatatttaaatatgtattttttataatagtttaatcaaaatatatgtagttttattatatttgttttcacctagtactcctaccagtacgcgatgaacgattacacccagatctgagcagttccaaattggccccttgaacaggcttgcacgttttgagcagttgagctttaggggacaccggaacatcacagtttgctgcaggatggttagatattttcagggtaaggaccattttgagcacaggtaatcgttattcttaatcatttcattgttggtcatacactcataatggtgtactctggtccatttcacatcaagtggctgggcattggcaatctggtacatccattcttcccttgggcactggtagaaagaatcaacctgcaacattcagatcctttgtctgaatgaatgatctaactcactcgtaggagtactagttacgacggggtaagtggctagacacggtgaaacggcaaaatcgacaaagggccgggaagattatgaacaatatccttcgtcagatgtgaaacagcacacacaacagatgagcctacaactgacgcgataaaagagggattaatcataacccagcccagcaaaaaaccgcgggaccttgagcggttgaggcagacgagatcatccataccacgcgtgccgtgcgctgcgtccattcccgctgctcggcacggcacgtcacggcacatcgctcgcttatccgctcctcccgcgcggcgcgcggctccgcccgcctcccgctgttcccgtgtgcccaaccacctgtggcgcccgtacgtgggcgagtacaccacgcttcacgcatcagctatgtcggaacaggccgcgcggcccccgcgccatggataaggcagacgcccccacccaagctcaccggcccgcgcggcgctgcagcgcgccaggtcgtccgtctttatccgtcccttgcctcggcaacttggtgcgtttcccgtcgttggcgtcaaggtagccgcaggtgcggtagatatccgaccagcgaagcgctccaatcgccgaacaatccggcggtaacgttaaatcgtagtaagaggaagctctcacggaggaagtggtcctgtcgaccgggtcaccgggagctcacagactcagctgatgtaatcgtggcagccgctttttatcaccgtgttgcagtacaatacagtagtatatacatgggtgtttgggagagaggggctaaactttaggtcccacatacaggctcgccgtggcataaacaaagagggaaacgcccaggtgtctcgccaccaggcgcgactcgacacaagcagtgatgcaagctgccccctgcttttcccccatcctctgctagctgtactgtgccgacttgcctcattagggaaagtgaaacaaaccacctctgattagccccaaagcaacggaggcacgaaggtttgactactacttttcagtatgactgtatgagcgagcctccgcccgccaccgataaaacttccgtacaaaaccacccgagacgcgacgtggcggcgggcatgcagcacccgcatccacgaccctccacgtactggccccgcgcgcccacgtaccccctcgcctcgcgccaaaaccacccacgctaacccgatagctcggcaaccaacaaagggatgctacgcaataccgccttgccttcctcctctccccgccgaaacccaacggcgcttctcgccaagccggcttgctataa

SEQ ID NO: 67162 - DNA, 4271 bp, Oryza sativa
cggcatcgatgaatgcgacgcggacgcggagatggaagagttgatgttcgcaatgcgggagctcggcctccggaaggtgaggccgtcggcatcgtccgtaacgccggtgctaccgccggtgacggacgaggacgggccggatttcgggtgggtgtccgagcttgtgatgtagaagcacccgacaagctcaaagacatcatctctctcggcggcgacgattaagatgcagaggcgcctcgcagaacagcttcattaattaagttcacttcaattcgatgatcatttcgcaaattgcatcattcttctgtacataaacaaatatggtgcaagttaatctgaacacagcaatccgtaactgtaagtgtggcgtgcgtttgcctgcctttttttttcgaaaatcttggggagctagtagcacccttgcttttcgattattattattattatctaccagtgtagatatggagtgtaatatgctaatagcctctgcctgtttcgtgatattatcacatttgatgtacttaattatgctaaattcgatgcttttttttatctatcttcctgtggttaatcaccaggtttcgagtcatcagctgctttactgcatgtcttgatcgaattcgattcgacggaatacacgattggtgctcggagaagatagttcttcttgcttcggcttggctatcgatagagatctatcaatgtcaccatcgctgagtcagacaaggtacgagaaacattccccctggcggttccggttttggagtaaaagcgaagaaatttgagataacccatatggtccccggcataacatagtacaatgccatcataggcaggcttcgcgaagttgtctcgattcctatctcctgccaaccagcttcctccctactgaaaaagagaacagggagtgcacggattcatgttgccagcgtcaatcgtttttaatcactacctaaaaatatcttacaaaaatccactgtttaacagcgtggcttctaaattcagattacacgattcagttggcggtttcagctgaatttcgttcggtttgtgcgtagtcgtccgaaaggactcatcgacgcgacgcaggctggccttttgcggctaagatcaagcaaaaggaccacgggacggacgcatgactagtcgaagagcgcgagagctatccgatccgatcagatcagatcagcctgcgccggatagccagcccagccctgaaaacgaaacgccgccggattaggggaaaaacaacgggtgcgccctttggccccctttgactcgtacgcccacgcgcggcaccaccggcaacttggcgggcgggcgcgcgaccgaggcggaagtccaagtcggcagccactttttcaccggatctctcgtggtctcgcccacgcgcgaccacggtttagccacaccagcttcgcttcggttggctcgcccccggcgcaacggagggggtgtgtgcgggtgtgccgtcgctttgcgtgcgggcacgacgccgatccggttgcgttcaggtggcgagttcccattgttcggccaccaagttgggctgcaacgtgcgttacccttttcccgtttcaacttcgctttgtgctgtcacgacaaggccctggtggttggtacaacggggggagtactaactgctttgcactggatgacatgcggggcctgaccgtctctggagcttctgaaaagctggattcctagccggaggagccgctttattatctgtgggtgcgatgttagagagttcaatccgcctccttattggctggcggaaatatcttacgggggtgcatgcatccaggggaaaagagaccgtggtggtaccaataccatccgacaacgctttcgtgatggccaacggtaccattgttcagccgggttgccggactcttgctgacactgactagacgtgagagacagtccaatggcatggttacaggccgcctacagtttagctctgttgcgtaaccaaggtttgcgatatgccaagacgagattaaaactccctgtttgtgttttatgagatgagactaaaataaaggacatatgttattgtagatcacgatacaggctactttctaagctatgaacgtatagcgccgtccgatggactgcaaaattgtttcatactcccttcgtcctaaaatatcttaacctaagacgggatgagacttattctagaactacgtcagattcatagttctaggatgggatcccatcctagtttgctatattttgggacggagggagtagttctcttctgaatgagaataataacatgattttttaataacttcttgggatgttatatgtccagaagtggaggacgaggtgcatgtttgtttaacgtacaacgttgatctattcaatgacaaaggtactatggtaccgatgaactgatcaaatcgaaggaattagaagaagagatataccccccttatcctgtatgagtgataatatacataaggtaaatagagaacatattatagattcatgtttaaatcaaatgccttaaattgaaattaaatgttcgaacatatgcacttgctctacttatagaaaaataacttttcaattgtcacctgaaaattttcatccgtcggtctctttttacccgtgagtgcgtcttcatcgcatcgatcactcacgtttcctcccggcccatgtctgttgcctccaattctgagtgactgagtccgcctctctctcccttttcccgtgtggccgaatccagttctggcgttcctgcgtgtcgctggctgaccgccgatcacataagagtcatgcgaccccgagaaccaccgcctccccttggatctagctgcaccgagccctggggcattagatctggactagatcggcgagactacgatgatgggggcaacgacgaatgatgacgatgatttccactcctgattcggctccggcctgaagaatgacgatgctctagggacactgaggagacgaggactacccgtagtaagatgatgaccaagaacattcaacaattggatcgtgtcagccacggtgatgggctgctagacgacgtcttgcctgattcaggtggtcagggagaaaactcgttcttcggcagcctggcccggtcggcaagtgttattcggcaaggtatgcaatgcattgcgagcttagcaatgttcctagtggttagcgcttagcaggtagtagacttgaaatgtgaaacacaccgaaatatgtcatatattatgctaactttaccttggagtgttatatactttcataatttatgttgtatcttcctattcagcatcaaagacttcaagattggagttggaattgtctctttagtaacgtttcgctgaatgatatgttcaaattatttaggaatcatatacaccatgtatattaaggagtgatacactatttgtggtgtgtcgtggaaccatatacctattaatgtccgaatctggccttatttaagactttcatcacgtggaaattctaataggctagtatcctggtgtgcaacgtatctaggtgtgtatctcgtgtaactatataagaccgtgtctgattatgttttagtgattacaacatatgattttcttctggtatttaggctgaagtgactatgacaatcaggttaaagtgaccgaaacacaatagccaactactatgcgagccaacactatctgttatacaaatactacatataaaaggtatagcatttatttgtttacactatgttttgtctgtcatcccgattcaaagtctgtaattggttcgatagtttgacatcttccatcatacactcatcactgcattgctgaattttgacaaaaaaatatccattgatgagactaaacaaaaccctatatcccacacttgcctcgcaaatctaacttgtccctacctattgcaatcttcgtttttgtttattccgttgcaacacacgggcaatttgttagtagatatgggataaatagaaaacacattatagattcatgttataatcaaaagccttaaattggacatgttaaatgctcgaacatcttaattggacatgttataatcaaaagccttaaatctgcacttgctcttaaaaataacttcacgaggaaacttgtagaactccatatgacaaaaacatggtaaacacaactttttataatggaaatactttatatttcttgccaatgtagcacacgtaaggccaatacatatccgtaaaaaacaattggcatttgggacaaataagaaaacaaagtaacttcatcgtgcacagg

SEQ ID NO: 67163 - DNA, 1336 bp, Oryza sativa
cacatcctcgatgttgcctcgtgccaggtgctgctgtacccattggataatgctagtgttatctaggtcccgtagtagggctggcttccctgtgaccaactccaacaacacaacaccgaagctataaacatcactcttggttgtgggttgcattgtcattaagtacctacatgtttagccaatgtaatgcatattagtacttgcactagaaaaacaatagaaaaactataagtggtatttggaagaccaaattaaataaggtagatgggattacgaactctggatcaacgtatccaggtgtgccagcaagtgtgtttgtggaaacatgagtgtcattgttgcgattaaaagccttggacaaaccgaaatcagcaatcttcgcctccaacatcgcattcaatagaatgttggttgccttcacatccctatggatgagaggtggattgcaacctttgtgtagatactctagccctacacatcacgatgtcaatattcacttttttagcaaaatcaagtctccaagaaaagcaatagcagcattaggtttagcattacttgccttgagcagattctagagcgatctggagccgccgtctccagggtaagaatcttctcctgctgttttcttctattgcaggcaaagtaaatgaagtgtatcatatcaaccaaaagcatttcaaatgatctagagataaataaaagtaaaatatcaatggcttatcattatcattatcattatcattctttttttgggtcaattttggagctgttgtaccataccatgcacgtagaatctaaatattttaggtactgcaatgtgttcttgtagagttccttctgacatgtactcataaacaagtgccatgttatccccatccttgcagtatccaatcatggaaacaagattcttgtgatgaatccgggttaaaatctgtgcctaagtgatcggttgcaactttcaattttcactctagaaagatcaacaattagtcaaaagagaacaacatatacctctccaaggaactccttgtctccttgcttagagtttttaaacatcaacttgactgccactcgagtgtgatcctccaaaaacccatcatagacacacccaaaccctccccttccaagctctagctggaagttgtctgtcatcatctctagttcccggtatgtgaaccgacggttctcaagctgtagtgatgaactatgcatgtggccacgatttttcgaagcatactctgccttctcattttgtggttctgtggaattgctccttggtccttgatatgcaaaggatgcatatgaaatgggttagttttgtttgtggatatgctta

SEQ ID NO: 67164 - DNA, 1200 bp, Oryza sativa
cccctttccgtgtacacacgagtctactgaagtgtggaagtctccagcctactgagacagagcttttgcaccatgtggtattctctacacgctcagcttaattgccagatattaacaaaccgaaagtagaagaggaacattgatcttgcatattgtgatagagcataatactattccatcatgtaagcacggctccagagtgtaatctacaagtgctgactgctgaagcagctaatcagcctgaagaaactctcacaccttctgctcacatcagaaatacagaaaaatagcacagttcacagcgggtaaataatgcagatatgtgattttgtcacattccagcagcaatataaatcattccaactcaatgttcatcttttgtgcttgatcgtttgcactgctcaatgttcgtcttctacgctttttcctttgtagtgtttccaaagttcaaatccttcagaaattcggtgaacgccaacgacgacgacccgccgtctgccagcgccttcgcggccatttccttcgccattgtcagtctatccctgagttttttcccttcctcgaactccatgaccaacctcaccttcttctccacctcctcggccttgaccagctcctcatcgtagccgtccatcaccactccgagctgcatgccatccaccaagagcaccttgttcatcctctgctcggcgtactgcggccagcacagcatcggcactccggccgacgccgcctccaggacggagttccacccgcagtgcgtcacgaacgcggcggtcgcggcgtgccggagcacctccacctgcggcgcccacgacgtcaccaccattcccctgtcccgcgtcctctccgtgaacccctccgggagcagcattcccaggtcaggctccggacgcggcaggaagaacttggccggatcctgcggcgggctacgcaccacccagaggaaacggtggccggaattctcgagcccacgagcgatctccttcagctgcttcaccgagacggcgcccaagctgccgaagcagaggaacacgacgctcctctccggctgcgcgtccagccacgagaggcatgcgtggcgttccccgttcgccgcctcctcgcctttcgccatcaacggcccgatgcagtacaccggcggcgtggggcggtcggggatgcaggcgccttccctgagcgccctcacggacctcgcct

SEQ ID NO: 67165 - DNA, 1495 bp, Oryza sativa
aacattgattcacgcgctccgtttgcccatccgtttgtggatgataagaagagctcattcgtaattgagtgccagaacgccgaaacaattccttccaaaaaaatactggtgaacactcgatcacgatcagaaatgatggccagcggtagtccatgtattgaatgaattctgtccatgaataattgtgccacagacacagcagtgaatggatgggataaaggcaaaaaatgagcaaacttagtgaacttatccacaatcaccaaaatgctattataagaggctgaacggggcaatccttcaataaaatccattgatatgacttgccaagcatgttcaggtatttgaactggttgtagtaaccctggataaggcacatgttcaggtttagcttgttgacagactacacaactgtgcacaaaatcctgcacagtttgccttaaacctggccaagcaaacagctgcttaacgcgctgataagttacttgaattccagaatggccccctagagcagcagtgtgcaaatttgctagaacttgctgctgaaactgccgattattgcccacccaaacacgtttcttgaaataaagaataccattttgcaactcaaaatgagcagaatgaggtgtaccttccttaaaagaatgcaaaagctgaagagcttcgggatcagatttataacccgaaacaacatcctgtaaccaatccggtagaccaacagataatgcactcaaaattggaagaccatcagaagatctacgagataaagcatctgcagctccattctctaatcctttcttgtaaacaattcgataacgaagacccaacaacttagtcattgctttatgttgccaagaggtggttaatcgttggttatcaagaaaggccagactgcggtgatcagtgcgaattaaaaattcctcgtgttgtaaatacgagcgccaatgatcaacagcaagaataatagccagactttccttctcataagtggaaagaacttgagtccgaggtcctaaagccttactcaaaaatgccaccggatgctgatcttgcataagcacagcaccaattcctcggtcagaagcatcagtctccaccacaaacattttctggaaatcgggcatgaccaacaccggtgctgatatcagactctgtttcaaagtgtcaaaagctttttgatggtgttgagtccagataaaaggctgccctttacgcaatagctcagtaaatggcttactaatgatgccaaaatgtcggacaaacttgcgataataccctgcctaacctaggaagctgcacacatctttaacagatacaggaactggccattgccgaaccacctgaatcttttctggatctgttgaaactccatcagcactaataatgtgccctagataagacagttgagtctgtgcaaaagaacatttggataatttgactcgtaactgatgcttactcagagtctcaaacacctgacgcagatgattcttgtgctcct

SEQ ID NO: 67166 - DNA, 2649 bp, Oryza sativa
gtgtataacggtaaggtctcacattaactggcacagccccaggaatcaaaggaattgtatggtcataatctcgagcaggaggtaatccacttggttcctcaaataaatgagagaattcctgtaccaaagactggacagcatctggaattgaggataactggtctgtagaatcactgagggcagcacataagtgaaccaaacctgccactgagtcgatactgtgcagatgctgtaaatgctgactagaaatcaaagcacaatcagacgtattggactgcaccccacgcaacaaaacttcatgacccataactatcaagtgaatagacttaagctgccaatcaatgtgcattggactatacttagttaaccaatccatgcctaatattgcatcataacctcccaaagccaccactttaaatgtggtcaagaacttctgaccactaacaaaccattcagcagaaggcatttctttctgacaatgcaacacctgtccattggccaccttaacagacagaggatgagctaagaactgaactccagtaagacggtcagccaattgatcactgacaaagctagccgaactaccagaatccacaagcatcagtatattcaacccctgaattttgccttgtaaccgaatggtagactgagaatcagtaccctgaacagcatgaactgacatagctaacaatgaagaatcactatcttcagaagatatgccagcctgatcctcatttacgttgtcaggaaatagtgcaaagagctcctgaacagcgtgaagctgaactgttcctgaacatttatgtgtcggcgaccacttttcggcacataagtaacacaaaccttgtgcacgacgaaacgatcgaagtgcactaaccttgtcagaaagattagtaccccgattgagctctccacccttcttctcctcagatttcagagccttggttggtggcaatggtaatggatatgcatttttaaacttctgcgatccatccccaaatttcctttgctcttgattccgctcagacaactcctcctgtaatagagccaaaaccagagcagactccaaatccttggggcaatgtaacaaaacagctttgcgaatgtcaaaacgcaacccttctatgaactggtgaaccaaattcaaagtgttatacataggatcatacgtcaacaactgattcatcagatcatcaaaccattcataaaactcgctcactgaaccggtttgtttaatctgatcaagctgtcgaatcagttgccgatgttgatttctatcgaattttcggttcaccgcttcacagaatcgaccccaatcgacaaaaacttcatgagcacgagatgaacgtagccaagacgctgccctccccatgaagtaaatggtggctacccaaacccacaaatttggatgagttccataaaccccaaaataatgctcacaacgcaacctccaaccctgtggatccgagccatcaaactgaggaaaatccaactttggtagtctatgattgaacccttgctccccatgcaaatcccgatttccccgactcgaatttgcgccaaactcaatcccatgaggaacagaaaattcagtgggaatttggtacgtacccttgaccggaggtggcccgagagtatgaactacccccgatgccttcccccggtgaaaatttgcgacgcggtggccatctggaccgagttcgctcgccgctgttccggaaaacaacggcggcgtgctgggcgtaggaagcagaggagtttggtgactcccttcctccgccatccttgacgcctgcgaggtgttcgacgaattgccgccctcctcgctctgcttctccaacttgaggacatgcagcttcagctcctccatgtcgtgctgcaacccttgtatagcagcatcaacttgaggtcgccatccagccacagatttgtccagtttgagcagcatctcttgtgtctctccttgcttgacgaccatggttccgatcgccgcttgaatctccaacaaagtcttctcgaatccctcgttttgcttcgccatgtcgtcgacttggatctgaagatgagttttgaactgaggtttctccaggattgcggctctgataccaaatgttaccgacttggaagagaagcaagatattttcagagaatcagagagagttcggaagaagaagaggagaacaaacagagagaaagacagagatgtagagagagagagagagatattgagtttgtattgagttggaaattctgtctttacatgtcatcctcccgattctctctccctcctttatatacagctagttaacccagtttccacccttatacttcgggttgggcctagttacacgaacaggccgttgctgggccgtactctgaacagagccagcgatcttggacacttgttcctgttcatcatcaggtgtcggatgtaacacaggaacgcgcaatgttccaaaggtttcctggtgaacacgttcgagtcgctggagccgcgggtggtgaacgcgctcagggactcgcggtgtcaccacggcggcccggcattgccgccgttctactgcatcaggccgttggtcgagaaggccgacgagaggagagatagagcagagaggcatgagtgccttgcgtggcttgacaggcaaccgg

SEQ ID NO: 67167 - DNA, 8702 bp, Oryza sativa
tgacaggcaaccggaacgcagcgtcgtgttcctctgctttggcagcacaggcgcgggcagccactccgggagcagctcagggagatcgccgtcggcctggagaagtccggccaaaggttcctgtgggtggtgcgcgcgcctcgcgtcgccatcgacgacgacgacgactcgttcaatccccgtgccgagccggacgtcgacgcactcctcccggcggggttcttggagcgaaccaccggccgcggcgtcgtcgtcaagctgtgggcgccacaggtggacgtgctctaccaccgggcgaccggcgcgtttgtgacgcactgtgggtggaactcggtgctggaggggatcaccgcgggcgtgccgatgctgtgctggccgctgcactcggagcagaagatgaacatggttcttatggtggaggagatggacatcgctgtggagatggccgggtggaagcagggccttgtcacggccgaggaattggaggccaaggtgaggctggtgatggagtccgaggcaggcagccagctcagggcgcgggtcacggcgcacaaggaaggcgcggccacggcctgggccgacggcggctcgtcgcgctcggcgtttgcccggttcatgtcggacatggaccgtacagccaacatccgctaggacaacgtgaattcgtgaccatccaagacacaggatattacgcctttccagagtatcgtgcatgacgctcgcccaaatctgtcctttcttttttttgtttctgattaagcctaatgacgttttcactccttttttagcaccattttcccctgaaacgtacgtgtgcgcaagaacgggtttccccgtgcacacggccacgcctacgtgttcattgaatattttctcattgtaaactttactaaatatgttttaaatgtatatgtagaaagtttccttataataatggaaaattaaaagtgctcgtgggcatgtgtaacatcccagcttatgacttaataggatttatagaatactcatatcaacaagttgcaacttttttccgaaagccgaacaccgactaggaaattcttcccgggtgcatacgagtggtttggggcaatttcgggatgggtgactgactggaaaattctttccggatacacacgaatgagggcagtctatgacatctgaaagctgccagatgtaagcgggcccggcctgggagaggcaagatgttacagcatgggaaagggaaaaggctgaaacgagaacataatattgatcattttgactttgatctatcgtacttttgagttcacaatctcactgtaaatttacgaagattttatccatcatataaatgctcatattttttaaattttttttatataagagtacgtcaaaatggttaacagtatggttttataaaattttagaatttacgtattaaaatttatatagtttttcttatttagaacataaattatgtgctacgtactaggagttttatgatatagtgctatcaatcataaaactcagatgatcataaaactcgaccaagagaacagacagaaggaaagaaaagcatatgatcacactgctatgatatagtgctatcaatcattcaagaatgcaataaacacagatgagtaaggccctgttattttcttatgaagattatgattttccctccatttccattagcatgcttttcaaactactgaacggtacgtttcgttatggaagttgctttaaaatatcacatatatccatttgtgcatcaactttatctccatcaacttggtctttatctcgttttatgtgaaaagcattggccccaacccgcaggcctacatgggctgcagaaagggctgtcagggattgcacgttagagtatctccaacaatctctctatcccactctccaagccaaaatttagccattatagacaaaaaaaaacgtattccagcagaatttctatccggcttgccaagccatccggctggctaaactcccccagtgagtggccagatttggccatgctatttggcttgctaatggtgagccccaccttccttctctccccgtctgcagccgctgtagttagtcccgtcgccgtagccgaggaaagcggaagtgggaggcgccccactgcggcgcgatagcaaggagggaggatggcgagccggagccgaagctttgccgccccgctgcccctaccctccctttccctgccctcttgcgccatctcccgtgctcgcctcgttcgccatctgcacaaccgccgttgtgccgtggtctggatcgccatccactcagttgcctatcgtcgctgaggtctgggccgccatccgccaccaccttcatcttcaccacctcccgtgctcacctctccgccaccatcgtcatcggggccgccatccccaccgccaacttcgctgtcggcgtccacggatatggatcggaggacctcgttggaggcagcgggtgcaccgacctcgagcgcattggggaatgctatggcggcgtgggcggggaccaggggtggcagtgtggcggtggggatgagagaggcggtggtatggagagagaggagaagaataggagagagggagaggaggggttgaaaaagggtagtgagcctaacatatgggactcactatttaggttggacagtgtaatagagagtctattggagtgaaatacaaatttggccatccaaatttttgacaaactggccaaatcaatatttagagtcaaatttgaagagactgttggagatgctcatacccaccagctcgatggagttgttgtgtacatatgtgtgtgaaatcgttgtaggaatcattgtcttgagttatatgtcgtgatgaacaattggccatggtgatggttagtccgattgttgaattgttgtggttgtgttggtgaagggtcggtgtacaggtggtccaaccagagcttaagtccgattagaccggatgcgcatgggcggccgaactgatggctgaggtgcaattagaccagaacattcttgattatattggattttgagttatttttttatgttaattccgtgatgtttatggcttccaattatttcgtatgtgtattgtgtttatgctaatgtgagtttaagttaggaaagtcggatatggtttcttcgtttcccatatataagtgttgcttaaggctgagaactgtctatggtggattggaattgacttaagtatagttgtcctaacgatcaagaagattatacaatatgctaaggctaaagattgaacaataaactggagatggagtttttgtttggcataagcgagatgtgtgtagataaaagaaaaagtcaaagttgaaaagagtactagctgaagtaggatttagggtttgaatttacaaagagataaaataatacatggtttgggaggcttttctatatatagaagtaggattcctaatttaagtaggattttggcttttgtggagtgcctttatgtacaaataaataaggttgagcatcaagaggtaacacttttttaaggtgaaaaattagggttatctttaggtcttgactctcgagttgagtttgaaagttgagagagaagtgcttggagacactttataaacacatcttgatgtaatataaagttgatcagcttattttgtcgagttgtgtttttgtcttctaccagttgtcttgcacgagcaccagcggttagactggaggaacactgactgtcagatcgagatcccatcaacagtcgaaccaacgatgtaaagatggtcagactaaaattccaacaccggtctaccaactttctgaagctagctcaaggaacgtattaatggatgaacaacccaacccttagggtccattctatattttagagctcggttctttcaacttaaaaaagatttttttttatgatctccttgttcaccttctctggtagtcttgcttcttatgcttaatcctacaatatgaactacatcgtgttaagtgattccatctaaaaacaatccactatttcccttaaattcagcatgtgctctgtgaagaggccaccaaccttgtttctccaccgttcccatatggtgatgaaatgcgcgattggagtctgtgttaatattatctactcgccgcgctcgatctcaatcccctttcagccgacgagcaggggcaatttggtctcatcaagtagaattccaacgaaaatggaattgaaaatgacgaaaatggagaaaatggcaaagtagctgtgatctcgcgctttagattggcattttagcgaaatgcgtttttgggatggcatttcagcgaaaccgctttttgaacgtggccaaatgtccattttctccatgggaaggggagctggtggtggcaggggagcgatggggcgaggggaagggaaggaaccgatgggggcgatgtgcggtggtgctggtggcgacaatggacttcaaaggaggagaaatgtgactgtggatctaggtttttgactgggagaagaagggtagagagaagggttttgtccccttttagcccgtgcaatccattttttctagcctattgtgcgctcgacttggtgagctaatctaaatttctgcccccgtgatgtaccctttgccgactgttggcgtgaaggcaattgttttgtcgacagataatacgttgcccatgaatcaccgacattttgtttgtctcaaaagactagaatcgccgacacataatacgttggcagtgctatatacatatttgcctacaaatgatgtgttctgtgtaccgacgttttgccaacagtagtagtcagttggtgaagatgggccatcatgtagtgattgtctaaaataaatataaataagtttacctatttaagtacagttatggatttccgtatccaacgtttgattgtccgttttatttaaaaagtttataaaaaattaaaaaaatagccatacataaagtactatttatgttttatcatctaataaaaaaaatattaatcatcaaaattttaaataagacagacggtcaaatattgaatataattggatataaacagtttaaaactatactcttctaggatagagccacggaggtaatattaaacttgctcctaggagagtatagtaccactacccacctcaccaaacagacccccatcataaatggctgatttaattgggctgtactccctccgtcccaaaaaaagataaaccctggtatccgcgcccaatgtttgaccgtccgttttatttgaaaaaattataaaaaaaataaaaagacaagtcatgcacaaagtattaatcatgttttatcatctaacaacaataaaaatacgaattataaaaaaatttcatataagacggatagttaaagttggacacgcaaatccagagtttaactttttttagggcggagggagtatatatggggcaatctagttctcttctcccctcaatcaaacgagccagaggtaggtcgggagaccactctacagtctaccctccagtgcctccacagtacaaactagccagaaaaattcaaagccaccatgaagaagaccatggttctctaccccggcctctccgtcagccacttcctccccatgatgcagttcgccgacgagctcatcgaccgcggctacgccatcaccgtcgcactcatcgaccccgtcttccagcagcacatcgccttccctgccaccgtcgaccgtgccatctcatccaagcccgccatacgcttccacaggctcccacgcgtcgagctccctccggccatcaccaccaaagacaacgacttctccctcctcgggtacttggacctcgtgaggcgacacaatgagtgcctccatgacttcctgtgctccatgcctcccggtggtgcacacgccctcgtcgtggaccctctgtccgtagaagccctcgacgttgccaagaggctcaacgttcccggctacgtcttccacccagggaacgccagcgccttcgccatccacctccagcttccattgatccgtgcagagggtcagccaagcttcagggagctaggagacacccctctcgagctccctggcctcccacccattccggtttcttacctctatgaggaacttctcgaggacccggagagcgaagtgtacaaggccatcgtggatttgtttcacagggatattcaagactccaatggcttcctgatgaacacgttcgagtcgctcgaggcacgggtggtgaacgcgctcagggacgcgcgccgtcacggcgacccggcggcgttgccgccgttctactgcgtcgggccattgatcgagaaggccggcgagaggagagagacagccgagaggcacgagtgcctcgcatggctcgaccggctgtgaaaatcagaggtgcagaagcgttgaacctcgttagtggccgcacctttgttaatatatggtgataacaaccatcaccgtggtttttacatccatatagcatgcagtctgttttgatggatagaagaggctaacaacctaacaaactctatcttatccaatctaacagatctcacacgcatgtatacaatatagtttcacagcccccctcaatcacaaccttcccaggttgagattgtgcttaaagttctctaactgtcttacaggcaaagccttggtaaaaccatcagcaacttgatctcctgtaggtacaaaatcaatctctaatagtttctgagatactctttctcgaacaaaatgatagtcaacttctatatgctttgttctggcatgaaaaacaggattagaagaaagatacttagctcccaaattatcacaccacaacttggccataggcggactctgcacttgtaattctgtcaataaagtctgtacccacataatttctgctgtagcattagcaagagctttgtattctgattcagtactagacctggaaactgtagcttgtttgcgtgcacaccaagatacaagattatctcccaaaaaaactgcaaaacctccagttgatcttctatcatcaagagatcctgcccagtctgcatctgaataagcactaacaagcatagacttggacttgcatagtttcaacccaagtttagtacactgtttcaaatatcttaagattctcttaactgcagcccaatgaacagtggttggtgcatgaagaaattgacagactttgttaactggaaaggcaatgtctggtctagtcagggttagatactgaagagcaccaactacacttctataatttgttgcatccagaggccctagtaagtcaccctcatgagcagataatttctcactagtagacaacggtgtacttactggtttacaatcaaacatatttacccttctcaggagatcacaagcatatttatcctgtgtaagaattatttcatctgttaccttgtttacttctatacccaggaagtaatgaagatctcccaaatctttcagggcaaactcctttttcaaatcctgcagaagagctgacactgcctcctgtctggagctagtgactattatatcatcaacatagataagaacaaatatgattagtcctcctttgttataaaagaataaagatgtatccccttttgatccttgaaaaccaagatcatataatttcttgctgagcctggaataccatgcccttggagcttgctttagcccataaagggctttatcaagcttgcacacatatccaggaaaagattcatcctcatatcctggtggttgtttcatgtatacctcttcttcaaggaatccatgaagaaaggcattctgtacatctagttgtctcatgcaccaacccctagacacagcaatagacaagacaatcctgatagtagcagctttgactactggactgaaagtatcttcataatctataccgtatctctgtttaaatccctttgcaactaggcgagctttatacctgtctagacttccatcttgttttcttttaattttatagacccacttgcagtctataacatttctaccttgcttaggtggaactaggtgccaagttttattattcatcaaagcctcatactctatatccatagcctttttccagtttgtattttgcaaagcatcagttaaattttttggttcaccagtcacagtaagaaaggtattcttgtatttaactgtgccatcggtatataccttctcttttcgaatacctctttgcagacgagtagttgggcgagacggcgcttgagtcacttcctcccctgtcgcgaacggctcggatgcagagatgtgtgatggtgacgggacatcatcattgctggcaggcgtcgcggtggcgtgactaggttggctcggcgaagagctgtcggccgagtgatgcgtcatcacgtcaggagaggcaggaaaatgtaccacgtccagggatgtggcagcgccgggttgactggcagcggtatctgatgcagacggtgatgcagcggtatcctgatggatctgttcagccagattttctgtggcaccggaagaatcatctgcttcatcattttctgcagaaacaggctgcacattgcttccaaaaatttgattagcaggattaacaggaatattagccatattgtcatctagctgttgttccccaggatttgatgttggatttaggagatgtgaaggaagcaataaaatttctgaacgaagtctagcaccggcgtttgtgtgaagtttagcaaagggaaaatttgtttcatcaaa

SEQ ID NO: 67168 - DNA, 4047 bp, Oryza sativa
atctggaattgagcctgtcaaattgttgtttgacaaattcctgcaaaacatggacccagtttttcccccatatatatttatgacagaaatcccctccaaaaaaagcttataaagagcttagaacatacaagtattggactcccttgagattcgcgaaggaagacgatatatcaccccttagatcacttgaggacagatttctgcatggagcaaatatatctatatcaatttcattgtacatttaatcagtgcattctgctttatttttttctcatttatctttgtggtgaagacaagtctatatagatgtgaactacttacaggctagtgattcttggacggatggaagtggaatagctgcaggtcaaactatcccaagcaagtgtcttcggaacacacggatcacccatccagttcttcttcacctgatactttaccttgatagccatcatggcagaggctgttaaatgcgcccaatgttttcagtaatacacattaaccatcatcctgtcgatctcacttattcttatactcctactagctaaatacctatgtcttgctatagataaatatgaattagtattgttgggaataaatattgtgaggtttttagaacaactcatccctgaggatgtctttgcacaataaacttgtattttagagataaataacatataaccataatatgcagaaagacgattttgtaatttgaaagtacatcaaggagtggtttgtaaaagatatataaaagagttggtgaggtgtagctggtaaaactatataaaacaatatgtggtgtggcaaatccgctgacaccaccattacattcttttagggcatctctagcgtgaagttgtgtcgacgcgtgcatgcggcaaaaaagaaaaaaacccgaaccaaatacaccgtgagatgtggctgctatttgttagagaggaaactctcagtcgaggagtcgatttagccgattaaaaaagccatttcttcatcagtttgcatgaggaagaaatgatatggctgattttacgtggtcctggcaaatcgatgctaacgctagaactaccgaaccaatttgaacttcgtttctattagcggtgcatatcgaacttaggactggagatgaccttagaagaaaacagcagcagagccgaggcctggccacaatgggcaggtgcatggactcccgggaaggtgcatggactctgttgcatgcaactggttgaatactactccccccgtttcacaatgtaagtcattgtagcatttcccacattcatattgatgttaatgaatctagatgcgcatgacttacattgtgaaacggaggaagtactaagtactccttagttgtttaccaaattagctaatcaaaaccatatacaaactaatgaaaaccatattagccagcaaactagaaaagtataagcctcactacaccacatatgttcatgtcaatagtaaataatttatagagatatatgaactagaaaggtggctcgcgcctatgtgcgagcatttatattgttgaaaggtaacattttagtttgttcagagattgtctaatagatagcatactaaaggggatctatttttttaacatatctcaaaaaccattcatcgacttttgaatagaagatgaattaagttcatacaacttttgtatcgagtaaatattaaacaaccgcaagctaattatcatgcataccattttgtgcacataccatgtaaatatggctacaaacaaaaattacgagatcagcaaactcaaagtttttgtgattaaatcgcctcatgaaggcacgtgtgacaaacaaattaaagatagattaaaagttggatttttccctctatataaattcaacaatattttctccatagttttatataactttaaagggttttggtgcacacaaacacctacacaattgcttagcttggtagtgcaaaatatcagtttgaagttaatttcttctttttcgcatgttaggttattttgtttgaaacaatatttatttgaaataaaaccataactatataaatttaattagtatgtgcagtttactcataaattttgaagtgttttatagtaaagtttatttctaccatgtaatacggttatataagaatatagttttgtcatgcatgtaaattataatcattaaattcaatatgatttatgtcaccataatgaatgaaactttgtaaatgcaaccatgactacttaacaaaagaaatttttttgcctatttttttaaaattcaaataagcacatattcataatcaaagaaacactcttcgtacaactgacacatcatagcatcactcggtcatatatagatgtaaactatttgtcattagtttcggcccgctcattgctcggtggtatcctctattcacccatcatcttgtgatagtcctatagaccatattttatcaaaatttatctacttatttattttacataaggggcaacgccatgcttctactccctcgtgtatagggcgcaacgtccaaaattctttttcccaaagcatgttcttaattaacacatgtaaataggttattgcatgtgtgatatatatatgtatgcgacacatgttttttttctagcttcaccccgtttatatacgtgtagagagaaattaattatattaaactcgcggtgcttgattcttcttcttgctacattacatctttgatttgtttttaagttactaaaaaaacaataactatccattgatgatttgatacatcttcgcctcggcaaaagcagtagcgttgtagacttgcagtggtcatgatcaccttagctgccttaggtatgacatttcatcatacgtctcgacggcaaagatacacatgtgcattgtgcagatgtccagagagaggtcttccaagacttttttttaaacaaaagatagatctaatggtctaaatagtaggtccattggtttatgtgaaaatcgatggataaatattcttattaaaaatattttaaaataataggtacataatataatataatggtgtaaagtttattttcaaatattgtagagctaattcatttatttctacatgtaaagagttatatgctgatatattctatgtttgtaaagtaacttttatttaaaatttattatcactaattgttgttgttgttgttgttgttgttgttgttgttgttgttgttgttgttgttgttgttgttgttatctcaactatatatcaactaattaaaatattcgtaacttttcgatcgtctcctcatccgtcaatgcactcatttttcgtccgtccacccctccccccctccaaaaaaaatcctagtcgttccgcaacgttcgagatgagagtcgaagaccaaaagaaaatcatctagagtccgcatcaacaaccaaatgcccgagcgatctagcgaaaatttatcacagacatagatacaaaatccaataggacaatcaagcgaaataggaaaaataaaataaaaacgtcgctgaagccgctcacaccgtcatcgccatcggatccggcgcgggaagccaccaccaccgtcggatccgacgcgggaagccggcgccaccggcatcgtcgtcgccgtcaaatccaccgcgggaagctaccgcactccacccctctctcttcttttccgctcgcgaatggagttgtgccttcgttgtcttcgtgccgtgtcggcgagataggagggagaggaagagagggactggcgacgccggtgaggggaggaggagagggggcggcggaggaggagcggcgccactggtcgggagaggggaggggagggggagaggcgctgccaggaggggaggagctaacggtggggggatgggaggggaaggtgtgattagggttagggttttgatggatttagaatcgatccaagccgtccatcaaaccgaatggctcatatagatcccgtgtcgagccggcctccatatcgggccgcaacactactgggccatgcacgcttcatagtccgggcgcgcaatagcaggccgatagggtctaatgggcctttttccccttttt

SEQ ID NO: 67169 - DNA, 1808 bp, Oryza sativa
gcgtcacgtgacggcgtgagagtgttcagagaaaatttgatggacttttagtattagattagcgtgtatctattattattaagtttgctcgaaaatttaatgatccgtcactgaaagagtacatatatgtgcacgtaccgtcctcggaatccgtggcgacattgattgtgggcattacggagaacacctcgatggcgttgatgatcggtggcagcgtcgagttggaggtggcgttgatggagatgttgtactcggggtatcgtaggaagggttttttctcgtagattaagtcagcatagaggtacaacggcgtgtagctctcattatacaccaacctgccgttgaggttgatgtagaactggcgcaaggcgttgctggggaggagctgcacctccgtgaagtagaagttggcgatgtaccccggcgtcggatccttcggctgcgtgtaggcatcccaagcgaactcaatgttaccagaggcgttccgcggcgtaatcgccgtctgcatcacccgcgacggcgcctcgaatatgtcattttctatgttttgcaccatcgtcgtcgttgatatcacggtccagtcgaagggattgatccaaggcacccattctctgtcgtgtggatcgtcggggtacctagtcacaatcgaatcagtacgttgattcactgcacgtataaggattcagcatcttgggttgactatttatctgatcaactcagatcgatacctacttttttttaaaaaaaacactcagatcgatacctgatgatttcggtattactagtcgggccaaagttccagcgaccgaacaaggacaggccctgcgtctcggtcacctgcgggtagagcgtgctcttgagaggcctcaggtccaagccggagatgaacggtgtcccggtgccggtgttcaccaggcagacctgcacgaagtcatccggcacgacgacgatggcctcctccagcgccgcaccgtcgagccccgtgatgttcaccatcgtcaagaagttgacgccgatgtagaggtcaaatacggggggcttcttgaggccgtcgtagttgccgtacacgaaggcggcgcggatgaggtacttgagcccggccgtcaacgaccggagcgtgtagcagttgcgctcgccgtctgggaagctgcgcaggttgtagttccgtctggagattaacggtgtcatgaattcgaccgagatgttgtggtttgtgcccgcgtcggtgaagccgtcgtccgggacataggacaggttggtcttgtcgtccaggtagcctgtcttcccttcaaggccacagtctatgctgatgaaacctgcaatgcaaactctgagctatgaataatgctcatcaaatcgtcattcgctagcttgcctatctaaactgtgcacatgtgcgagcgtgcagatcaagagggcggacgaagagtggagcatatacctttgaggtcaggctgcgcactagtttgaagtacgccggcgtcggccacggcaaggcagaggataaacaaccatgatcgcgcggccattgctctcgctgttgattgctccaaagagcatccgagcaagcatgcagctagctactactactactagagatcatatacataataagactataggtgccccaatcatatatagccagcctttaactaaacaagcaacagagataatttgggggatagcacgatcctgtttggccgcctctttgtgggaccgcgacgccatgccaactaagagaggaatagtcagcgagttgacaacaatgagagctgagttaatcgtcagcgagttgacaacgatgacag

SEQ ID NO: 67170 - DNA, 3651 bp, Oryza sativa
gctaataaatctagatagatatatatatgtctagattcattagtatcaatatgaatgtgggaaatgctagaatgacttacattgtgaaacggagggagtagttgctatcattttggtatatttgactgagtcttaataaagctttcattattaaaaaaaattatgagcaacatgcatgcatgtccacttatttttcacaaaccttcaacttaacacaataacagcctgatcatttgtacattttgtacttcctcaggccaaataataagaccatcattgaagaccacacgtacaaatcaatgtagtaagaacccatagaaatgggtaaagcaggcttcttgtcgtgcaacaggaccaatgtccctagttggcactaccctaagattatgcttcatcccaaaatagtgttgccctagctcatctcagtggtatatgtgttataactcgagtttgggtctatgctgctccctgacatataactgctactcgtgtcgcctttaaagctggtttcctcaagctctagacactcttttagctgtgtcaccacgtcagtcattgtgggtcgctgcccaggagcatgtgcagtgcatttcagagccacatctgctaccttccagatacagttgatgtcatagcggtcgtctggcatgtttacatccaccacaccctcgatgttgcctcgcgctaggcgttgccgggtccattggatgatagtagtaggttccgggagctttataatgggcggctgtcctgtgatcacctctagcaacaccacaccgaagctgtatacgtcaatcttctctgaaacttgtagggctgtggcatacctgtgccatgacaaaacatatcactatgaagtgtactatttggtcaataatcatcaaggcaactagaacgtggtaatatgcatagtaagatcagcatactcgggtgcaaggtagccatatgtgccaaccaccctgactgtggatacatgtgtgtcaccgtcgcatttaaaagccgttgtcaggccaaaatcggcaaccttggcctcaagatttgcattcagcaagatgttcgatgacttcacatccctatgcacgaagcgtgggctgcatgccttgtgtagatactctagtcctgtgagcaacatttttgcaaagggaaaaagggtattcttgttatttctcaatatcagtatgatccatatacaataatactaacatagaactattgtgctagaatgtgtaccttgggcagattctaatacgatacggagcctttccctccatgttaaagatctacctttgcgatctttgcctgtcgatcagaagatcgtaaatgtatttttcttccaaagagaaaatatcattcatattgaaattcgggaatatgtgttttaattgtttatgaaaaatggttttctgtaccttttattgtgcaaaggctatgacttagtctctttccttagttaaaaagaatatacaaatgaaatacttagcaaacctctaagcttatcttccagagttccttctgacatgtgctcgtacacaagtgccaaatgtatctcatctttgcagtaaccgattaatgcaacaagattcttgtgatgaattttcgttaaagtctgagcctgaacaaggaaaaaaaagatcaccttctagagtcggaagaaagttttcatcattcacttgcaaaatgctgatgctttgctatgaatttctgtattcacatgtttgaactattccatagtatcagaatatataatatgccaattgtaaaaagcattagtgggataacatattcactgtcatcatcactagatcatttaaaagctgtatagatatactattcttgatcaagcattacctctgtcaggaactcactatatccttggctggaagactcatcccgtagtttaactgccacatgagtaccatccttcaagaagccgtcgtagacggggccaaaccctcctttgccaaggactcgctggaagttgttcgttatgactgccaagtccttgtacgtgaactgacggttgtgcagttccagcaggctccctccactgccattctgactgtgtgactgcacgccattccccaaaatctgtggcttcacagcaccctttgctgtccaggcaaaatgaaaccagtattatcgactgttaattgcatttacatgtaggaagttgattagtactacttgattattgatgcgctttaatgccaaagctcacatttgttcttcttcttcctgatgaagaaaatcaggaacactgcaactgctcctatcaccactactggaacagcaacatagacggcaagcatagagttgctcttcttttgtgggagctggcatgaactgctgttactgcaaaggtttggattattgccgtacctatcaaaaagaagagatggtgaacatttgttttttgaatgatggtttaacaattttgatcaagtgcaaaagaaatattggaaaaaccttagggtcaaggagccatcttgacttcttttcagaagactagaaggaattgatccattaagctggtttcctgtcaaatctctggatcacatatacataacgttgaagtcaatatttgattttcacaggcacatgcttactcaaaatttatgaacttacagaacatcgagattttagagtggtgattatgacttatggcaataaaattgtatgactaaattattagagaaagatgtcaacatggatcggactgcttacagaaccgcgagaaattgtagctgtgaaatgacattaggaattgatcctgtcaagttattgtgtgacaagtccctgaaataaaatataggcgcatataaagtgcaaatttaactccaaaatcattgtaaaaatggattaaaaacttcttacttacaaattcttgatttcttttagattggcgaaataagatgatatatcgccacttaaaccggcatacgacatatttctgtagaaatgcacaatggtttagaaagcagagtttttgaaatagcattgtttgcgtttgtgcagaaactgaaatgaaacttacactcctgtgattcttggaggggttgaaatggcatagctgcaggttaacccatcccaagccagtgtctttggagcgcatgggtcacctgtccaattcttgttcacctgatacttggccttgattgcagtgatggcagaaactgcattgtttcagtgacagtgcaaaggagcagtggagcacagttatcagatcattcacaaatcacaaataaagacaactaaatgtaccaatcaaccgatggcagaaactgcatgcattatctttgttcagtaacacagcacaaagaggcgcaattatcagatcatcacgcacaaagaaaaatatttaccatcctgagcgtctgttgcaaggtcggctgtggagatgacggagaaagcctccgcggcgttgagtatcggcggcagcgtggagcttcccgcggcgttcaaagaaaagttgtaccgggtgatgccccggtagggtcgatctccgttgtacatggcgtcggtggacagataaaccggcttgtatggggctttggtccaaatcacgccattgatggtgacgttgaactggcgaacggcattgccggccaggagctccagctcggtgacatacaaggtaaaaatcgacctata

SEQ ID NO: 67171 - DNA, 2108 bp, Oryza sativa
tgaggccgtcgtagttgccgtacaagaacttggcacggaccaggtacttggaccccggcacgacggacgggaccgtgtagcagttgcgcgcgccggcggggaagctgcgcacgttgtacaggctcctgtccgtggtcgtcgtcggcgtggcgaactccgacgagacgttgtggattgtgccggcgtcggtgaaggcgtcgtcggaggtgaacttcagcttcgtggcgtcgtccacgtagctggtcttctccggcaagccgcagtctatgctgatgaagcctgcgcggtactcccgatgcatgaacagcatgtacacgagtccaaaatgccggcgagttggcgatcgaagtttaaagctcaccggacgtgtcaggcgcgccgccctggccgcgaacgacgccggcgacggcgaggccgagcagcagcagcagccaccaccgagccgccattgttggtcgatccattccgctacgtgcgttgtgcgcacatgcatgccaccaaccagttgcaattagacttgacatagtatgtgttaaacaacaaagattgactctgaacaaattcgctaactgcatcggccagtggacagcttggacatcaccgaacacggtcaaagtcgcgaagaagaacaaattaagtagacaaatgaacgctgattagtggggctctgccatttaattaacatggtacaactgtaggtaaccatggcaatccctctgttcagtttgattttagagtggactaagaagccactttgtgtaatttgcactaataaaccttatagtcagaagaagcaggaaatcacatggatgatcctgtagttgactttgctgggagttagtcaacgacttagctggaactcaggctctactactctagtttatcacttcagccttttttttttcaaaacaacctccatactagacattgcaaagtttcgtatctatacagtaggaaaaaatataacggtcccatcgtttcgcttatacggcatattcgcaaacgaaaagtagtttgtgaataaaacttttatatatgtgttcttagcgatctgaaagcaaaggctgaaaaataaacttcgatgaaaaaaacctcaaaaatcaacttcaaatttaaggttaaaaattaaaattgtggctgataagtataagcataagcgaaaagatgagatcctaagattatatcctgtgaggctataatctaagaaaataaaaaagaaaaacacaccaccccccatgctggcaacttatacacacaaattattaataccagctagccaccgttgtgcacgatctgttgttgtcaacccttcaaaggggggacaaacgcatcgccctactcttctctaaacaaaatatcatcttcaagcttctgaacatccccaagaaaaaggtagttatgggagagagtcagaaagaagagaatcaactcatccctcgcataacctgaagacatcctagagtaccatcgtagaccaaatcgattggagactagaaagatagaaaatgtgatctcctagacaatatatgcttccatgaaggtcgtgacgtcgccacgtcgcccgcccgcccgcccacccgcccacccaagacctagacaagatttttacctggaggatcccaccatgaagggagagatggatgtttctcagcaatgccccatgggggaaatgaggcacccaaattaaggcattgcgaccaccctaacatcgtaaccccatgttctcccgctatccaacctgcaccaacaatgtgccctgtcgcatgtaacgccccgattttcgttcgggtttaaaaatcattaaataatgcattttctagaaattaaataaaagttaaatcaatttaatcaagtaaaataatgggagaattaaaattttcccttaaaaatcattggccgggaatattttgtaatattctttgtgccctaatgtactctccggaattttccgtgaattttcggagctcgagaaatagttttaaagtcacgaagatcatttaatcaattaaaataaaaagagaacaaataaaatcctccttcatctctttgggccattttcggcccaaattcctccccctccttcctctcccgcggcccgcgcgcctcct

SEQ ID NO: 67172 - DNA, 2630 bp, Oryza sativa
ccttcagccggccgctgccgccacgttagtcgtcgccgcacctcgccgcttgcgccgtcggcaacgccgtgccaagctctaccccggcccctactccatctcccctctccgcctccggaaaatcgccgcctcgcgcaccacctctctcgcgctgccgccatctcgcctccctccgtcggccgcctcttgccgccatccccatctacctcacgccgcgccaccgcctccaccgcattcgctgcatcccaccgtccctcggccgtggctccgccgtggtcgggcgtcatcggaacgccgttctcgtcgcctcccgtgccgaccgccgccatcctttccgccgccggtcgcctctccgtggtcgtctcgccgtcgccgccctcggtgagcactcctctcccctccctctttctccccttggccggccgcctcccgtgcttgcgcgcgccgtgtgccgccgccggtggccgcccagcccgtgtgccgccgtcgcttcggtcccggccgccgccgccgcccgctttgtgtgagcgctggccgggccgcgccacccggctgtccccaagccgtccgatcggccttggccgatctgggccgtccacgtggtggacgcgcgcccgaggtcgcggtggacgcggtccaccgtgtgccctccccctttgactcgctgacgtgtggggcccgcgtgtcggcgccggccgccccttgctgacgtcagcaaggaccatttcctttgtaaaaataaataataattgcgcaataaatcgagtttaattctagaaattcatttaaatggctcaaaacttctaaaattcatatctaattcattcgaactccgaattgagccattcaaattgcaaaattcatctaaaattgagctctacatgtttgtttactttttatgtactgtttctttggtttttattagagtttttcctcgttttgcgtgccagcgtgtagtttccgtcgtttcggaagtccgcggtcgcgaggaaaagagttcgggagatcaaagtggagaagcaaggcaagtcacacattccccttgagcattttgatcctaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattgcagtattagacattctagtatcttgatgagctgcgtgctcgagacatctggccatgcttcatggtcgtaattatccaactaaaatgcaactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgacccaatgcactgtagttcaggtgggttggttgggcctgttcaacgtggtgtagcgttgatcagtggagattcaatattactttaattactcaactgttttactgtttcgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgcgttatttacgtttggaactgtttattacttgtcgttttgtgtaccctggctggtcctggacagggatttaatacacaaaatagtctggaaatttgggctaaatttctgggcgtgacatcgcaccaccatacgcctctttgtcagccaccccctcccccccccccgggccaccttcaacacttcacctctgcacaacgacatctcacgacctagcatagctcgaccatcacactagtcagaactcaaaagggctagatccccctccgacccctctcgcacatgggaccactactccactcgtcatggagttccccacgactggatctggaagcataccaacc

SEQ ID NO: 67173 - DNA, 1038 bp, Oryza sativa
tttggtaaaacaacattgttaaaacttccatgaagatctttcccagaaaatgacagcattcagatcagatgggcaaaatgatttatcgtgcagctggaccggtggccgttgatggcatccttccaaaattacgctccgtctcaaatgcagcgctgttctgacttacatcaatagagtggtcagtggcatacatgtcataacttgagttagagttgctgttattgtcggtatagaaattgttgttcgcattgctgatggcacaacgcccctcctcgagctcgaggcactcttgcagttgtgccaccacatcggtcatagtgggccgttgtgccgatacttgtgtggtacacttgagtgcgatgtccgtagccttccatacaccatttacatcatggtcaccatgcatacgtgcatccaccactccctcaatattaccctgtgctaggcgctgttgcgcccaatgaatgatacttatgggctctggatcacgtaggacagccggcttccctgtgaccagctccaataggacaacaccaaagctatagacgtcactcttggtcgttggttgcattgttgcctggtacctgcacattcaattagttccacaagccttaaactttgtgtttctcacataaaacactaaataacaacatcaagaaatacatatggattaacatactctggatccacgtatccaggtgtgccaacaagcgtgttcgtagatacatgtgtgccattctcaagattgaacgtcttggataagccaaaatcagcaatcttagcctctagcttcgcattcaatagaatgttggtagccttcacatctctgtgaataagaggcggattgcaccacttgtgtaggtactctagccctgaccattaaccaggaaatttaattactgatcaaccttctagagaaaatgtaaaatcaaacctcacgaaacagtattacaattttaaagtagttaccttgagcggattccagcgcgattcgaagcctctctctccaggttaagttctcccgtggggatccactag

SEQ ID NO: 67174 - DNA, 2357 bp, Oryza sativa
aagaaattctacctctgcgagaaattccttatccccttggttggaagattcagaccttaatttgactgccacttgagtgccatcttccaagaagccatcgtagaccttcccaaaccctccttcgccgagcactcgctgaaagttgtttgttatcttctctaaatcattgtaagtaaaccgtcggttctcaagctgcattgatgagccatgcccatggctgccatttgtcggcacatagctcgctgtctcattctgcggctttacggaagtgttcattgatccttcataagcgaagaatggaactactagcatcagaaatgttcaaggacagagaaatagagttgataattgctatgtttgtaacaagcctcaccttgcttcttttttcgtcccagaaggcaaaagagcagtattgtgactgatactatcaccaaaaccagaactacaggaacagctacatagatggcaagcttgctcttgtgttttgctggctgacatgaattgtcgttggtgcagaggtttgggttatttccgtatctgttgatggaatgaagatgtttagccaaatcagtctattttgtcaaattgactgaatttggacattcaaagattactaagagaagagtgggggtgtacttaattactttatatttagggtaccatcttgaattcttttgagaagtccagatggaattgaaccattgagttgatttcctgtcaaatctctaaagaagccatatgcccataaattatatacatatgtcagttacaaatgatgctaggcaataaagtaaaatttgacaggagttgccaaacttacaatactgccaacgaaggcaactgtgaaagtgcatctggaatcgaacctgtcaaattgttgtttgacagatccctgcaagatatgaagcaagtcttttaacgcaaaattccacaaacggtcaacaaattaacattctgaacctcataacatacaagttttgaagagccttgagattcgcaaaagcggacgatatctcaccacttaaaccaccggatgacagatttctgcaaaaggaatatgatcagatgaccgcgagttccatacttccataattccattatgcaagtccaatattcagtactccctccgtcctaaaaaaaaacccacttaaacacggatgtgacacaacatagtacaacgaatctggacatgctcatgtccagattcgttgtactatgtagtgtcatatccgtgtctagttggttttttttggacggagggagtacatgtggactgaattacttacatgtctgtgattcttgcaggtttggagctgtcatagctgcatgtcaacttatcccacgcaagcgtctttggaacgcacggatcacccatccagttcttcttcacctgatacttttccttgatcaccatcatggcggaagctgtcaagtgcacccatgttttcgatcagtaacacgcacaaaccatcacaccgtacgttttactcttatgtattctaccgtctgtctatctacataccatcctgaccatctgtgccaacggtggcggtggagaagacggagaacacctcgatggcgttgatgatcggtggcagcgtcgagttggcggtggcgttgatggagatgttgtactgcgggtatcgtaggaacgggttgctgttgaagatggcgtcggcgtagaggtacgccggcgtgtagccctggctaaacaccatgttgccgttgaggttgatgtagaactggcgcgtggcgttgctggagcggagctgcagctcggagaagtgcatgacggtgatgtaccccggcgccgggtccttgggctgcgtgtagggtacccaggcgaactcgatgttgctcgaggcgttgagcggcgcaatcgccgtctgcatcaccttcgtcggcgcgtcgaatacgtcctcgtccgtgtgctgcaccggcctcgtcgtcgatacctcgacccaatatgatggcgagacccaaggcatccatattctgtcgtgtggatcgtcggggtacctggccattaatcggttgtgttccgtttgatcaattcattgtaccctcttggattgactatttatcatctttctttttcaactgtgtgtgcccaatggtaaagatcaaagatgtaaaccatttctattatctagaaaaaaacttggatgaatcttttaattactcacctgatgaactcggtagtactaattgggccaaagttccatctgccgaacaaggacaggccccgcttgtcgttcgcctgcgggtagagcttcttctcgagaggcctgaggtccagcccggagatgaacggtgtcccggtgccggtgttcacgaggcaaacctgcacgaagtcg

SEQ ID NO: 67175 - DNA, 4045 bp, Oryza sativa
actccagctagtactactattatagcctaatgatcatcacaaagactccatcgtgattagtttaaccacgtcagcacatctgtctagtaacatagcttgccaagcgccgtcttcacacatatatgtggactgtcactgacgagtgggccttttctgacattttactggccacctctttgtaggaccggcatgtcaatgaccctgcaagtcagcaaggctgcaagcccgggaagagagcaaagacgagcagatcacatgggcacgtagttgacttggatggcagctggtcaactgcttggctggggcacgactcgaggcccgagatcggtggccactggccacggcccataggcgcttgacttgttctctgaactgggtacccctgatgggctatggatcgccgtggagatagggtagcgatcagattcgctctccacctcccccctccctccctcaacctggttttcttttttggcaccgcgttactttcctattttagtaaatttatacacctaaagtttacacatctaacgtttagagaccaaaagtttataagtcaaaagtttatatatccgattcaaatttgaatttgaattcaaatatttttttatatatagtatttctatacatctaaagtttatacacctaaagtttatatagatctaaagtttatagacctaaagtttataagtcaaaagtttatatacccattttaaatttgaatttgaattcaaatatccgattcaaatttgaatttgaattgaaatatttttcatatatagtatttctatgcatctaaagtttatacacctaaaagtttatagatctaaagtttatatacccgattcaaatttgaatttgaattatatcttattcaaatttgaatttgaattcaaatattttctatatatagtatttctatacatctaaaatttatagacccaaagtttataagtcaaaagtttacatacccgattcaaatttgaatttgaattcaaattttttatatataatatttctatacataaatttttctaacttttcgctgggcgggtgggggagcgatcacccgcccattagcctttccgctctgaactggaaaacatgcagatagaatcatttgccatgaaagatttagttcctcttgcttgtctgccttttaaaacttatttacgttgtacctataataacatgatagtcttatgtacattctcatgaggttagaggtcaggtttaatataatcattatctaaaagaaagaaagattattatgcaattgcgagaatgcgaggtaggtagaagagtttgttctccactgattcaacaaaagcagtactacgaaattgaaagtcccctagctagcaagatttcggtgcagaaaagtataaactagtactctcttcgtagacatacatatagttttatttagcaattttacagttcttgagaagttttatatcatgagataaaaaaattagtgtaaagtttggtacctcttgatacctacctaggtaccaaatttataattgaaaaagtggtaactcatggtactttctaaagaactataaaattactctattttttaaaaaaatgaaaagaagtgttagagtactaagaaggaatttagcatccatcattgatagagaatatgtagtctagtacttgcagttatctgagtagcaccccaagatcctgagttcaaatcttcgtaggagcgaattccgttcccaatttaaaaaagctgcatacatcggttggatgtagatgccagctaaaaaatactctttacaaaactagcatggtggcccacgcagattgtgcgactagtatcattatattttctctcatgtaataacatatatattttctcaatgtattattaaaatatattaaaaggacaacataattttaaattctgtactagctttacgaaactactaatgcgtgtaatatttatattgtattttatatacgtgttagttattaattatttttaatatcaaattttagatatctgtaaattatattcctatatggactctagactcgtctttcaatttttttttaattccaaatttttgttatccgtaaattgtatttttatatagactataggctcttcttctaatattatttatttttaattctgattttttattttttttctaattgtatttctatgtgtactctaaactcatctttcatattctttaatttttaatttcgaatctcagttacttctaaattgtattcctatattgactttagattcttcttcccatatttttttaattttgaattttagttatttgtaaattgtatttttatacagtctctaaactctacttttaattttattatgtttattctgaattttagttagttttaaattcctatacggactctgtgctctacttctaatattccttatttttaattccgaatttttattatttcttagttatatttctatatcgactctatactctacttctaatattccttatttttaattctgaatttctattatttttttaattgtatttctgtatggactctatactcttcttctaatattctttattttttaattccgaatttcagttatttataaattgtatttctatatggactctagtctcctcttccaatattcctttttgttaattccgaatttcaactatttctaaattatatttctatatggactctgttttttcttttctccgattaatatgagaatttctaggctgtgagagtgaacgtggaggctcttttttctattcctttaataagttaatagataaaaaaaatattgatagagaagaaaatggtgagaaaacctagttaccttcagttgcatcaaagctaaaccgaaaaaaggcatgcacacaaattgtggtaagctatgcagattccaaaagttttggatcccagctctaagcaaagcagcatttagaaatatggattctggttaccataaaaacatgaatgaacaggtacattggtgtttctcttcctgaagaatagtaggcgacaataattccactcaaagaggagacaagtacatgaattctgagttccaaaccaaaatcttgagtttttgaaattaatttgtacatttgtattttaatttggtaaaacaacattgtttaaaccttccatagagatatctccctggaaatggcagcattcatatcagatgggcaaaagaatttatcgtgtggcgggaccgggggctgttgatggcatccttccaaaattttctccatctcaaatgctacactgttctgactcacatcgatagagtggtcagcggcgtatgtgtcataacttgagttaggtttgctgttattgctggtgtagaagttgttgtttgcatcattgacggcacaatgctcctcctcaagctcaaggcactcttgtaactgcgcaaccacgtcagtcatagtgggccgtcgcgctgatacctgcgcggtacacttgaatgcgatgtccgcaaccttccatacaccaattacatcatggtcgccacacatacatgcatccaccacttcttcgatattaccctgtgctaggcgttgttgcgcccaatggataatgcttatgggctctggatcacgtaggacagccgactttcctgttaccagttctagcaggacgacaccaaagctatagacatcactcttggtcgatggttgcattgttgcttggtacctgcacattcaatcagtaccacaaaccttaaactttgtgttcctcatagaaaatactaaagaacaacatcaagaaatacatataaattagcatactctggatccacgtatccgggagtaccaacaagcgtgttcgtagatacatgggtgccattctcaagattgaatgacttggacaagccaaaatcagcaatcttagcctctagcctcgcattcaatagaatgttggtagccttcacatctctatgaataagaggcggattgcaccacttgtgtaggtactctagccctgaccattaaccaaagaatttaactactagccaaccttt

SEQ ID NO: 67176 - DNA, 4442 bp, Oryza sativa
tttacctacaaataggtagagaacaaagaggggtgagaccatgaggactataaaatgatccactacatgatgttttacagtgtactccctctgtttcatattataagtcgtttgacttttactttttgatcaagtttatagaaaaatttagcaatctaaaatatcaaattagattctttaaatctaacattgaatatattttgataataagtttgtattgtattgaaaatactactatatttttctataaacttgatcaaatttaaagaagtttgtctaagaaaaaaaagtcaaacaacttaaaatataaaatggaaggagtactctgcaacttgatcgggaacaaaaacataaatacgtacccgcaatgtgttcttgaagggttccttctgacatatactcatagacaagtgccatgtatttcccattcttgcaataaccgatcatggagacaaggttcttatggtgaatccgagttaaaatttgagcctaaacaagcaaatgttaactaattacttggacttttcttagtagaaatctctatgtagcaagatcaaattcaactgacgaaattctacctctacgagaaattccttatcaccttgattggaagattcagacctcaatttgactgccacttgagtaccttcttccaagaagccatcgtagaccttcccaaaccctcctcggccgagcactcgttgaaagttgttcgttatcttttccagatctttatatgtaaatcgtcggttctcaagctgcattgatgaaccatgcccatcgctgtcatttgtcggcacatagttcgcctcattttgcggctttatagaagtgttcattgatccttataagcgaagaatggagcaactagcatagtaatgttaagaacagagaaatagagcagatagttgctatggttgtaaccctcaccttgcttctttttttgtcctagaaggcaaaagagtagtattgtgactgatactatcaccagaaccagaactacaggagcgactatgtagatggcaagcttgctcttgtgttttgctgcctgacatgaattgtcgttggtgcagaggtttggattatttccatatctgttgatggaatgaagacgcctagtcaaatcaatctattttctcaaaatggttgagtttagacattcaaagattgctgtgagaagaacgtggtgtacttaattactttatatttagggtaccatcttgaattcttttgagaagtccagatggaattgaaccattgagttgatttcctgtcagatctctaaagaagccatatgcccataaggtatatgtagatgtttgttaatacaaatgatgctaggcaataaagtaaaatttgacagaagttgcgaaacttacaatactgtcaatgaaggtaactgtgaaagtgcatccggaatcgaacctgtcaaattgttgtttgacaaatccctagaagatatgaagcaagactttgcaaattttaatgcaaaattcttacaaacaaggttaacaaattaacattattcaactcagaacgtacaagtattgaagagccttgagatccccaaaagaagatgatatctcaccactcaaaccactggaggacaggtttctgcaaagagaatgtgatcagatgaccctgtttcatacttccgttatgcaactccaatattcagtacgtgtggactcaattacttacatttttattacgtgtttggagttttcatagctgcatgtcaaactttcccatgtaaattctgtcggaatgcacggatcacccatccaattcttcttcacctgatacttttccttgatcaccatcatggcagaagctgtcaagtgcaaagatgatttcgatcagtaacacgcgccaaaacaattaggccatttcacttgtgtgtgtgtgtgtgtgtgtgttctctatcgtctatgtacataccgtcctgaccatatgtgccaatggtggtggtggagaaaacggagtacacctccatggcgttgatgaacggtcgcatcgtcgagttataggtggcgttgatggagatattgtactgcgggtatcgtaggaaggggttggtgttgtagatggcgtgggcgtagagatacactggcttgtagcccttgctgtacatcatgttgccgttgaggttgatgtagaattctcgcacatcacggctgggggggctgagctccagctcggagaagtgcatgatggcgatgtaccccggcgacgggtccttgggctgtgtgtaggctacccatgcgagctcgatgttgtctgtggcaaacattgggacaatagccgtctgcatcaccgccgttggcacctcgaacaggtcgtcgtatgtctgctgcaccggcctcgtcgttgatatctcggtccaatttgatggcgagtcccaaggtgtccatactctgtcgcgtggatcgtcggggtacctggacatgaatctcttgaaaatatagcaccttgaattgactattcatcgattattttcaccagtgtataccggccaacaggcaaaagctgaaaatgtaaaccattttctgtcatccgaaactcaaactgaggtcatttatactataccatactaccgtatattagggtggtcatactaattactacctccgtcctagtaatcgctttgactttttttcttttaacgtttgaccattcgtcttatttaaaaaattagtgcaaatataaaaacggagaagtcatacttaaaaagtacttttgataataaagcaaatcataaaaaaaattccataattttttaataaaacgaaagatcaaaagttataaataaaaactcaaagcgacaagtattctgggacagaggtagtatccaatgattccattctattctattaaaattgacacttgttttatcggtattatagtacaccatcggtataaatattatatggatattatggggaaaatatgcatatttataatttgttgcgcgcgcgtgtgtttggagggacgacaacctccaccaccactatcgttgctatttgataatttaacatttattaaaatgggcttccattatttgacatcttgacctaatttcatttactcagatagtcttacatgtcatcctcacaagtatcaattagagcaattggacaacgaaaaaaagtattaaattatcaaatttctcaccgacggtgccatgcccatgggagggcttggcattcgtcatgaatgtaatcgacaagcgaacgaggctggctgcttgattactccgctcgccactggccgatccagtgaatacccctcgccgtcggcctcaacatccaggcaccgctgaggacgtagagaggcgacgcgatcagattgaggagaccaggcgcaagagggcttccatctccctccgccgtcaccgcctctcgcctcccccttatacggctcatgtttaggcgaagcagcccgcgtatatcaacccgctatcaccccctcctcatcgtcgcttgaagcaggtacagtggcgtggattcttttttagttggattccttttcatttctcgggtactttttcctctgctcacgactgtcgaaagtcctaacgggcgatcgatcgctgggcacgatcggtccccctccccacatcgatcaccctctcctccacgtggtttcttttttttactacattactttcctattttagtaaatttatggacctaaagtttgtacacctcaagtttacacatctaaagtttatacacctaaagtttagagacccaaagttcataagtcaaaagtttatatatccgattcaaatttgaatttcaattcaaatatttttatatatagtatttctatacatctaaagttcatacacctaaagtttatagatccaaagtttataagttaaaaatttatatacccgatttaaatttgaattcaaatattttttatatatagtatttctatacataaccttttctaacttttatttttttatttttttaaaatttatggtgtagtaggaagagaagaaggggaggaggaagggggagcatataaggggggatgggggcgatcacccgcccattatcaccctcccacgactgttctagatgagattacgtattttgtaaaaaaaaaaaacctctcaaaactatcgatttacatttaggtctgttatcgttttttcaccgttaatatatcatcggacggctgcggataggtgcgaacacgtggcatgcttctccagccgagaatccggccgggactctatctgtggtgcaacatggcccaatgaatagacgggtttcgaaccctgaaatcgatctataagatacctaaagacactagcatgtccagcgcttcactcttgtcatagtgatgagcaaattcagaacatggaggaataataactaaagaaaacaggaattagttgcaatttgtgtcgttccattcttcttcaa

SEQ ID NO: 67177 - DNA, 4896 bp, Oryza sativa
tttccagtcggtcacccatcctgaaattactccagattaacctcagagttcttttgagatcggcttccgaaaaaaactataacttgttggtatgagtattctattaattctattaagccctgggtcgggatgtcacattaaatttcacctaaatggttaaatcaacatgcacgtaaaggactcaaactcggatggatcgttactcacctgatgatttcggtattactggtcggcccgaatttccatctaccgaacaaggacaggccttgcgtctcggttgcctgcgggtagagcttcttcttgagaggcctgaggtccaacccggagatgaacggtgtcccggtgccggtgttcacgaggcaaacctgcacgaagtcgtccggcacgacgacgatggcctccaggagcgtcgagccggcggggtccgtgatgttgaccatcatccagaagttgacgccgatgtagacgtcgaagattggcagcttgctgaggccgtcgtagttgccgtacatgaaggtggcgcggatgaggtacttgtgcccggccacgagcgaccggagcgtgtagcagttgcgcgcgccgtcggggaagctgcgcacgttgtagtagcgcgccgagagcgccggtgcgaagtactccgccgagatgttgtggaacgagccgccgtcggtgaagccgtcgtccgccgcgtaggaaatcttggtcttgtcgtccacgtagctcgtcttccccgggaggccacagtctacgctgatgaaacctacggcgagtcggcgacagcgacacacattagctagcgataactgcgaaattatggacaatctatgctagatcttagttcattgattggcatgggttgtacttgtagctttgctgtcaagctgggcacgagcttggagtatgccggcggtggcggcgagggcgaggcactagaacataataaaggctgaactctctttgtgatcgtgctctacctatttatagccagtcttaatccagtgagcgtaaccatgcaggtaatcaagttggaagaaaattgcgtaggactgaagtcctacccttatctgaaggacttgattcctctgcacgacacctgtcccacatgaatctcagaatagcctttctccctcatctctccagttcccatttatctatcttcctatcgtcggcgaggcgtcaaggtcaagcactcaagcccgagcaccaagcgcaacgcgctcgtgccctgtggcatcaagctcatgaggacagccgaaaattagagtcaaatttgcctgccgacctgccgcgagaaaaatctttggtttggaataagctgggttatcgattagatcgaatccatctccatgaaccgcaaaaagtttgcctcagtgaaattgttcagtcagtagatttttctttcctttgcttttagtctgtatggtgcactgcactgctctggtggttgaagttgattgagctttcaaggatttctgtttgccggtgaatcttctagcttccatgattacaaaattgactattcacaattcttggtgagtgcctcatgtgcaagcttggatgctacttagttcctctgacacattgtggatgccactcgattccggtgacaacggcagccagccgcgagctccaaggctgctggtcggacgtgagcgagaagaggaaatatggggaattgaagagaaaagagagttagcctattcaaagatttgcgcaagaggtgccggcggcgaggtgaccggcaggcggcggggcgtaggaggcggcggcgagccgtagagatcccgacggcgaggcggggctcgcctgcacacgggccgccggatctggctcctttctcgccggatccggcgcccccctccctccctcccactagatctggcctctccggcgaggaaggccagctcccgacgacgagacaggtacagcagaggaggcagtggcggcggggttgagggcgcggtggcacgtggtgaaggggcaggcggcagatgtggccctcggtgacggcatcaggcatggggagtccagcctgtgaggcccgcgtctacgtcagtgagtggcgccggaggcagtgaaaaggagaatgtgtggaggtacggcggtgcttgaggtgtagggggaggctggacgatgaggggtgacggagggaggctggcgcggcacaggtggcgccgacggcagcgggaggtcggcgtggcatgcgatgcggcgggcggaggcatgagcaagtgcatccatggccggcggggcacgcccagcgcgacgagtggctgtgaccagcggcgggatgtgtaggcgtggtggtgaccggcgatggtcgtggattgggcttaggtgctaaagggatggtgtggtggtcgggcaatggtcgttgtacaggatggttgtgtggagttttgattggaatcgctggcgaaagccttgccaggccatgggccggcatgacgacaacgacaccattaggcgtcgttccccttcttgaaggcgtcgttctggcgttgacctctcctggcaccaagaaccttcccccgtgcaacggtagtcattggtggactcctgcattgcctctgaagctctacaagcctaaggtgtttgacaaggtcttctctgtcttggttctgtttcttgctctacggcaagtgttcatcattcttatttggttactgctgggtagagtcagagctgcttcgctgtaggggtgcgacgaagttcggcaacgatgacacactgcaatctctttataagattgttgatgccagctgtatgtaggaagtggttccttggttgtttgggctaatgtccttcatgggtatcgtttatgcttgttcttttggcgttagggtagcattgcagtgaagtcgaagctgttgtgtcgtttgggcggcaagctcagtaacgaaaacatgtgtgggctgttgtgtcgccactatgacaagcttggtcgatgccttgtgtcgggctccgtcgttgtaatttaggttatgttagctgttagtgtggtgttgtagttgtggttttcgttcaattttccctaattaactggacactgtaaagtttggtcctgtttactccttaaattggggcaccttattcttaatataaaacgtcggcaatggcctgatcgttgaaaataaaattgtgtaagacatgtgtcaagtagagagacaagtcctttgaacgaggtgtaggacttcggtcctgctctgtaattttcttccgatcaaggagagatggattctaatatgtgatgtgaatgtacactcttttttttttcatgtaaactaaatggttataaaataattttttaaaaaaataacaagatagattatgtaatatattacttcacaaattaacatacaagtttaaatttgacttctctaagtaggaaaaaaataactagtcgattttgaagttgcatattcgtagagtgatacattacatattattaatacctatcctgtcaactttttttaaaaaaattcataaccatttagttgacatgtaaaaaagggtgaacgtccaaccaagtgcttaaaatagttttctataatcaagataattatatcactatcactagcaaatagttaccgtctccatgttttaatatcgggaatgctaggggacgggataccgtcccccaacgggatagctcctctccacaacacgattcgcgtccctcgccgctgccgcgcccgtcccccgtcgcctccgcgcccgtccgccgccgccgcgcccgtcccctgtcgacgccaccgccgccgccgctcccatcccccaccgccgtcgtcgctattctccgccgccgccatcgccgccgcggcgtccgtcccctgtcgtcgacgccgccgccgccgccgcgcccgtcccccgctaccaccaccgtcgccgcgcccgtcctctaccgccaccatcgccgtcctcgtctacaagggacggctgcagggggcgaccgcgtgtgtcggggtgctcctccccaacggtatgcccagctatatctagtaggaatcacctgatacctggtaagtatcatccgatacctcgcaagtatcacgtgagacatggtagaaatcgtctgatacctcatgagtatgacgtgatacgtggtagaaatcgtatgatagatgacatgtatcgtatgatacctcgtgagtatcacgtgatatgcggttgaaatcatctgatacctgacaggtttcacatgatacctcgcgagtatcacgcgatacgtggtagaaaatcgcatgatacctgataagtatcatatgatactttgcaggtatcacctgaaacgtgtgtagaatcgtctgatacctgataggtatcacacctgatacctactcaggatcatcatgttatgtagaatcgtctgatacctaataggtatcacacctgatacctactcgggatcatcctgttcgaaaacgggattccgttatatagcagccccctttaatatataacgttgttggcttttagcttagcgtttaaccatttatcttgttaaaaatttacatatgtattattagttttgttgcgacttaaaaccataatcttcacttatttttatatatttatactaaatttccaataaaaagaatattttaaatgttatgtgaaaagttaaactatattagactatcgatgatcactaacgagtaacgactccattgtgattagtttagcgccgtcaacacatccatcctctgtaaggctgtaacacagattgccactgacgagtgagacttttctgaacttccactggtcacttctttgtaggcccgtcatgtcagtgaccttgtaactatagcttggaagagacaaaaagagatcacatgggcagggagttgactttcatggcagctggtcaactcatctgctgggtgcacgacatga

SEQ ID NO: 67178 - DNA, 2219 bp, Oryza sativa
cagtcccaataagtcttacaattagtatttctctaacaaaagaactttaaaaaaagggcttcaagaaagacaacatactctggatccacatatccaggtgtgccaacaagtttgttcgtagatacatgggtgccgttctcaggattgaaaaccttggacaaaccaaaatcagcaatcttggcctctagcctcgtgttcaacaaaatgttggttcccttcacatcacggtgaataagaggagggttgcaccctttgtgtaggtactctagccctgatcattaattcaccatgtaattgaaatactgatcaagcttctagagagagaaaaaatgtaaaatcaaactaaaaatagcattagaaattctaagtagttaccttgagcagattccagcgcaattcgaagcctctctttccaggttaagtatctcccatcatttccttttcctgcaaatataagaattggagatcatgaaaggactaaaaaaataagctggtagatgaagttagttcggacctgcaatgtgttcttgaagggttccttctgacatgtactcatacacaagtgccatatatttctcatccttacaatagccgatcatagagacaaggttcttgtgatgaatccgggttaaaatttgagcctaaagtggtgaaacttgtctatttaatgatgcccccatggagacttttcttgatagaaatttttacatagcaagaaaaagtgcagcttaaaaaattctacctctacaagaaactccttatcaccttggttggaagattcagtcctcactttgactgccacttcagtgccatcctccaagaagccatcatagacttttccaaagcctccttgtccaagaactcgctggaatttgttcgttatcttctccagttcattatatgtaaaccagcggttctcaagccgcagtgatgaattatgcccggagccattatttgttggcccatatctcattgtctcgttttgtcgctttacagaattgttcattgatcctttgtacgtgaagaatggaactagcatcagtagtattcaagaagatgaagtagagcagacaaatgatagcaagacccaccttgtttttttcttctcagtaggcaatagagtagtgtcgtcactgatactatcgcgaggaccagaactataggaacaacaatgtagatagctagcttgctcttgttttttggtggttgacatgagttgccattggtgcaaagatttgggttatttccatatctatatattaatgacataaatatgtttatgtccattttctgaaaaattgatctgcaccttttgctgaagaagactgctataagaagaatgtggtgtcattaccttagatttaaaaagccatcctgaattctcttgagaagtccaggcggaattgttccatttagttggtttcctgtcaaatctctaaaagaagacatacagtaggatattagttcaaaaggattctaaagagtacgtaggtaaaagagtaaagtcatgggtcggtccttaaagttggagcgaggtgttacttaggtccatgatcttgaaaaatagacattagggtccgcgatcttgtttaagtgactcattgaggtccaaaggacctctgaccaggttgactggcttacgtgaccgtccagagtggcagtatatttgcatttcgcccccctcccccgcatccgatccaacccttcttccccatatcttctttcagtatgatttctatggtttgcggttgcaggggctggcggcggcagtgacgacgaggagggagacgggtacggcgacgagttggcgagcatgcgcaaagagggagaagggcgagtagggcggtggcggcggctggccagtggagcgagacggcgggcagcttttagggttttggagggttcgacttggggcggtgagggcgaggtggtgtcggagagggtgaggggacgatgaaggggttcgacgccaccaatgggttcggcttcatcactcccgacaacggcggtgaggacctcttcgtccaccggtcctccctcaagttcgacagctatcggagcctcaatgacggtgatgtcatcgagttatccatcggatccggcgacgacggccgcactaaggccgtggacatcaccgcgctaggcggcggcgcgcacaccggtggatcccgtcccagctgcggccagatccctacggctgcaagccgaaaaggggatcc

SEQ ID NO: 67179 - DNA, 6726 bp, Oryza sativa
  unsure (1)..(6726): unsure at all n locations
tctaggtaaaagttgataaaagaatttgccaaacttacaagattgtcaatgaagacaactgtgaaagggcatttggaatcgagcctgtcaagttgttgtttgatagatccctgcaagatatggagcaagattttccaaattttaactcagattacgcaaacaagttaatacatccgacatcatgaactcataacatacaaatattggagggccttgagattcccaaaagaggacgatatctcaccactcaaaccaatttttgacaggtttctgcaaagagaatatgatcagcccaatttcattgcacagttaattagctcccattagatttaatttcctcttgctatttatgcatgtgctgatttggcattctgagggtgctaataataataataaaaaagatcaggctggtgattgatggtggtatcgaccaccatagattgtattaaaatttcatatcaaataaaaaattctattggaaataacatggggtcttaattaatttttactgccatgcatggcctctttagtttcattagtatcctaaaacttaataatttctaaattcacaagcaacaagtatatcatctcttttattaatttaattttgaactttaaattaataattagcaagttataattgatgggttctctttaattattttaatctaagccattaactatgcattgtgtatacaattaaaattttcatatttacaatagtttaacaatagccatacacgtttgcactctttttatttgggatggaggtaatagttttgttttttcatcacaatagtcatgttgtttttggctaatggaatgaattattacttacaagctcgtgattcttgcagggttagaaatggcatagctgcaggtcaaattatcccacgcaagatttctagggaggcacgggtcacccatccaattctttttcacctggtacttcgccttgatcgtcatgattgctgatactgtcaatcaccaaaaaatttcatcaatgcacatgacatgcttgaccatcagctagctcatgtatgtgcatatttcagtttttctcaaattttttatgaatttagtcaaattctgttaaattgtgtcaaaatttcagaaaatttcggtccaaaaatttctgaaattttcaaaattttaaaaattttaattctaccgaaatggctgaaattttagatgaaatcgaaattgaaaaccctgagcacataccatcttgtgagtcggtgccaatgttagcggtggagatgacagagtacacctcgacggcgttgatgagcggcggcatcgtcgagttggcggtggcgttaatggtgatgttgtactgcgggtgtcgcacaaagggtttggagctgtaggaggcctcggcgtagagaaacgatggtgtgaaaccatcgtcgaacaatatgccgttgatgttgatatagaattgccgtgtggcgttgttggggaggttctcaagctcggagaagtgaaagatggcgatgtaccctggcgctgggtcgttgggctgcggctgtgagttccagaagaagtcgatgttgttggaggcgttgattggcgtgaccgctgtctgcatcaccgccgtcggcgcctcgaacaggtcgttgtctatgttctgaaccctgtttgtcgttgatatctcgttccacttggccgcatcaaaccaaggaaaccatactctgtcgtgcggatcatccggatacctggccattgaatcgatcagttgcatttcctacagataagggtaattttaccatccttaaaaaaaatattagaagatatcatattttctaatttaaaaattggtactttctcaaaaaccgtaaaatttatctacagagaattagagcaagtttaatagtatagccaactattagctccaatttatctatagccaatctaatagctcattcatacaatagttacatactacactattagtacctggacccacatgtcatacacactgtgtattggagtccatgctacagctggctataaatctgtagcccgcttcccttctctctcctcatctatttccttaaaatatgtttgcagctggcttatagcctgctattgtacctgctcttagctaaatatctggctcttatcgggaaaagtgatttcatcctttaagagatatcccctcattttgcatgttggtaatcagaaaaaatatatgaaagtatctgtaaatacgaatctaatattacgctatttatatcactaaacctatatattgtggaaaattttatgatatttgataaagtgcctaaagataccaagattttacaccaataattttgatacctcaaaatatttagtaccgggaggtaccaaattttacactaaaaaatatgatacctttcgataacttcttaagaatagtaaaattaccctatattgtgagactaacttttagttaaaatttatcgagtttgaattatcaccagtaatactgatgatagtataaataaatgatatgataataaatataaacagtctatacgcgtaggaaactttaacttagctcacctgatggaggtttcgtcagatgggccgaagttgagcctggcgagttggagtaggccctgagtggcgttcacctgcgggtagagcttgttcataagaggcctgaggtccaacccggagatgaacggtgtcccggcgccggtgttcaccaggcagacttgcacggagtcgtcgggcacgacgacgatggcctcccggttcaccggctggatcgggtccgtgatgttcaccaccgtccagaagttgacgccgatgtggaggtcaaacgacacgggcagcttgttgaggccgtcgtagttgccgtacatgaaggtggcgcggatgagatacttgaggccggccacgagcgaccggagcgtgtagcagttgcgcgcgccgtcggggaagctgcgcacgttgtagtagcgcgccgtgaccgccggcttgatgtactccggcgagacgttgtagtgcttgccgccgtcggtgaatccgtcgtccgaggcgtaggatatcttggtcttgtcgtcaatgtagctcgtcttccccgggagcccgcagtctacgctgatgaaacctgcaaaagcatgaaaaacatatgctcttttagttcattgaacattgatgtctttttgatttgtgaagcattgcgcgcattactatgaggtaggatactaggattgtactacgtacctttgctgtcaggctgggcacgagcttggagtacgccggcggtggcggtggcgaggcagagaagaaacaacgacgaccgtgccgccattgttgccggtgatgaacgacgctccattgcacatgcagccatgcatgcaggtagcaaagctgctactctctagggacgtgctccatctatttgtaatccagcattccagctagtaaacaagtgaccaagctaataatctcactgtcacaagctaataataactagccaattgatcatcacaaaactcaatcttgattaatttaaccacgtcactacgtcagcgcatctatccagattccagtaacaaagagcgcctcgctttgtgggtcatatagatattcttccactgacgagtggggctattcagaatttacactggccacctctttgtgggcccggcatgtcaatgaccctgagggaagaggcgagtgtatcacatgggccgggagttgacttgtagcccgctggtcaactgctttgctgggcgaaggacttggaggcccgagatcggtggccacggcccgtcgacttgaccttattttccgcgccggaaactatgagcaacaagattattatgcacttgcccactacgtaaaagaatttgttctctctgtcagagaatgcatctgaatctgatctggcagttttgcacaagagacaggcagcgcaagaagatatattttgcctctgacggactgcggctaattagtactaaacataattaggtacctaaaagttttagtaggagtatctacacgactctttggattaaatgatttggtgttttctaaatctccaattaaaacttgcatgcaggtactctagaacaacacaattcagttttaggctcagctgtaacggcgttaaaagaaccaggacaatattcatctcgcataccggaaactggaaacaccggttatgcaagtattcgtcaatcatgcatgagatttagtaataggattgctatgtaagtaatatcttttcaaccaatagggctccaaagaaacatttcaagatcttcatcctgctgtgcctttggtgtctctggcttcacagacacgacgtggtgttccgcaatgctcaaccatcactgctttcagccctgtcaaaatgccaataggaagttaacctctgggcggttcgctttggtccgaaagaccgtgatattattctggcttggaaaaatgtaatttcatcctctgttcatgctctaaattagttgtaatctggactgtaatccatcttgtactcaagtgctattgcttattgacagtttgaatgaaattcaggtggggaatctctcccctccagtgacttggtaaaaaaaaatattttcaaccaatggcaattgtttcttgatttgttcttatctaatgtgcagccaagtcttggcggagctggcggcacaagaaaggagcacatccaaggctacggaagtcattaagggtgtgtttggtttctcgtatgtccccagcctggccgtatccctcatccaggatgccctcagcctggctagggtaatgcaattggttgtgtttggttacttgcatgggtttatcctggatgatatgagatgttgtttgggaggagctgcgggagggaaggtgaggcaaacgagcacacccgctcagcaacgagcactcccgccggctacgagagttcgcagcagagggagcacccacgacggtgcacaggagccccaaaccctagcttcttctcctggggagtgaaatgaggaggggatgtggccgtgcggggaggtaaccctcgcctgcaacgaggggttgtgtgggtgcagttgcgctgcaccggatcagcctggatgcgcagcgatgctcccccctcgcgtttctgctcaacttggcccagacggcgattttgaatccgcctagcctgactcgcgggccggtccagccaaccaaacaagttggattttgctggcttgatgcgatgcaggtgcggtgcacccattcaaatacgccctaattgatgaaggtggaggcgcggggaaggagcaactacaagtggtcactagcggaggcggccatgtggtcgccggcagagatggctgagtagggatggagcaacccctcacggggaggaagcaacggcaagcagctggagtctgtggacagcagaaaaagtaaatagtagaaaatccttttatcaggaatttttgtctaacaaaacgaccttagaaactctaactaggaatgaggctactgagtagcagtaatgagcaaaatattaacctcttccgtgttatgcttgctcctgaattcttgaagtcatttatggcttcttggagtgcgtgatgagtcggcagcaaattattcgcgggcttgatctctctcctctcacccccatcgtcatcggctcacatcattttattacacttactcttatgagtgaatacaatggatgtgacccttgttcatgttacatgatttccattgcttgctagtccactaagtgacatggattccatttgatatctcatcttacattatcaagcaaagtacatttattgtgggaaatcataaaatttggattctaaattcttgataactatattccaagataaaaaaaattattaggtgtatattgacttttctcttcttgaagaatagtatggaagagttataaatatcaaagaatagataagtgtattgattacaaattccacacggtaaaagctctagatcttgattgtttgaaactttatgcgcttgcatttactttggtaaattaaagcaacaatattgtttcagttctgcatgtatctattttaggactagcagtctcggatcagattggcaaaggcctttatcgtgcaactggccctgtagccatggttggcactctttcaaaattatgctccatcgtgttgttttgactcacatcagtggactggtccgtgttgtacatgttataacttgagttgggatcattgttgttgccggcatagaagttgttatatgtatcttccatgccacatcgcctatcctcgagctctaggcactcctgcagctgagctaccacatcggtcatagtgggtcgttgtgtcgatgtctgtgcggtgcatttaagggcaatgtctgcggccttccacacaccattcacatcatggtcaccatgcatgtgtgcatccaccacaccttcgatgttacctcgtgccaaacgttgccgtgcccactggatgatgctaatgggccctggttcacgtagaatagacggcttccctgtgatcaactccaataagacaacaccaaagctatagacgtcgctcttggtggttggttgcattgttgcttggtacctacatgttcatccagttccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 67180 - DNA, 1691 bp, Oryza sativa
taaccgaatatagcaggaatccgactagtggcgatgtgataattttgattggccgattataggattctgaagccaattctgactctagtccgatgatgtcttcggggcttatcaaatttcgctgctaacagatgtggcaatattaccaaattcctaaaattttggcattgccaaaatttgttaaggtttatttcgaaaattgcgtgcatgcatcaggcacccgcacctcccacgcttgcgcgccgcctccaccaagtgcaccatcacagacgttgttgcaacaaatcaactgcatattacggaaacgctatagtaaaggaatccgtttcattttttgttccaccaaaaatgtttcagctagtgtactcgtgatgtttcactatgtacggatcaaatgttgcagtgaattgaaatagtattttgctatttgttgaaatattgtttttatatagagtgaaacaacgtctgattttttggaaaccgtttgtatcatacgttgtagcaaaatgttccacgaggtgatttggttgtatttcagctttttaaaagactaaaacattttcgaactacttagtgaaacattctcgatctacttggtgaaacaacgctcgatttttgaaaaaaaaaaggtttattttgaatacaatctgaacatgcctttagtcaatggctcactgctaaataacaactatacccctattttttcccctctaaatttctactaccgctaacaagatgacagtagaaagcaacatgaacccttcgatcaaatgagatcaacggttcagattattttctacaactaaatagcaccaaagtgaggctcgcttttttattggacagattactagaggcgtctgttggttggtgtatggaactgtacgggtagagctcgtcgtggactgtccgggtggatgacattgtaaacgcgtgacctgtgtacaccgaactacgcgtactggagtgtgtgtggaggaccatgtttagcctgccatggacgatgcaagtcaacaatttcacacaaatacggagtatatagtacacagtgctagccagctagagagtggactagtccactgttttgttcctgctcatcggttttgtggtcggttggcaacttgtcgtgcttgctggtacagtacgtaattagtttaccggcgactttaggaggctattcatgtcaacgccggctgcagcctgcaaatgccagtaccgtgtaattctcgtgtagttccaacgtcgtgtttgtcaaaacgtagcactggatagcagacatgccccaactgccatagtacttcagagagaatccaaatggttcaaccatacgggctcctttttcttattatatatgccttgttcggttcggttatacgatttaaatgatttttttttctataggaatcatgtgctagatcttcaaaatgtattggttccataggaataaaaacatctactccatcttctttgttcagctcactaaaagaaaaaaaatatgtcttgatccttagtattgcatatacattcctacgcaattccactgttttttaaaaaaatcatgtgacttgaaaatcctgtgtttggattttgttgctaggtctgtttggatgcttggtggtgcgctgcaaccaatacaaacaatgtcgcaatttataggtagtcgcagcctcacctgccaaaatgattttttgagt

SEQ ID NO: 67181 - DNA, 1868 bp, Oryza sativa
attcctgcagcccatctaagacatatatatctatctagattcattaacatcaatatgaatgtgggaaatgttagaatgacttatattgtgaaacggaaagagtactaaacaagaacaaagattccaatttgcatctgaagttgtatatactttattaatcggcgtcatggagaaagagatttgcgattaggacctgacgaaacggaagccgccagccgatcgcttttgttgacttcaaacccgggggaaaatcgctggccggcaaacgatcgacgacgtgcgcgtccggatccaaacacgcgtaaacaattatggatgatgatacggtacgacgacgacggtggtggcagaagaaattcggcgaaatttgcttgatttccctagttaatctactcatcaattgggatgaattggaccacatggtttgatgaatctaatgtgtgtgctctggtcagtaggttcgagactttgggttgactgataaagtgctaatgcagccatgatgcgagatgatggaatattttactatcttcatcacaaaatatataaaagattttctacaatagtaaaaaaatacttggatcgtcttctatttaagagtttggtaggataacattagcattggttatttttcagttacgttagatagggtggtatgactaaaagttcatattaaaaaatagtctactttaaaattagatatttaaaagttcaaaaacaatacaaattctcagattaagtcgattccaagcggaattttaatacaaattctcatatgaatgttgttgtgttagtatacgtatccgtgatgtatttgaacaaataccaagttaggcatctagaataaattattatgttttactaaatacaaatatgtagtacatattgtggacactcgagtttgctaaccgtgtttaacacgtaaggttaaacaatatcatcgtcgaaaatagagaaaaatgagaacaaaacaaaataaaatagcgaaagaatactgagatatttacccccagtatagagaagaacaaatttatattaaaattatgaaattttaatgattcattaatctcaagatatatcagctcaatcttccgaaggtactcgtagacatggatgtacgtgtgtacgaagcgtacacacgttaaaataacttatattgtgggagtgagtttgcaggtgccatgagcttctacgttttaattgcattccccgtaaaagatagtagtaccaatgtttcataatcagcatccttcctagcgtagttgtgaaaaaaaaagggaaaacaaaaaggagatcgttgtgcggtgcctcgacgagacgacgatatttccccttcccctcgtcgtcgcctccgactccgactccgactcctcgtgagctcgccccgccgcctgcgccgccgatcccgcgaggcgcgccgccgccgttcgtcctgctgcttccgccgcatcccggtgagcatccattcatcctcttcctcatcgctgtgtacccactcactttttttttccctccaattttgcgttgaaccctttggttgttcctcttctagacctcggaggaagcttttctcttaatttgccttgaaaacttgacacgaatagtagtttgcttgttccccaaattttgcgttgaacccttgttgtttctcttctagacctcggaggaagcttttctcttaatttgccttgaaacttgatacgaatagtagtttggttgttccccaaatagtttgggggttcagtttattagatccgcccctgttttagcataattttgatggtatactttactatatgcgtatttaggcgctaatcagttttttgttttgattctaataccgtgggagcactgaagaaaactgagaa

SEQ ID NO: 67182 - DNA, 2971 bp, Oryza sativa
  unsure (1)..(2971): unsure at all n locations
tgtttacctttttaaatctctgtcaaatatgcttatcttgccatcatgcagggagatgatccagcacaggccttatgatcataaagtagatgtttacagctttgggattgtcttgtgggagcttataaccggcatgctccccttcacaaacatgacagccgttcaggctgcatttgctgtcgtaaacaggggctctcgtcctgcaatcccgcaggattgtgtggattctctgagcaagatcatgacttgctgttgggacgcaaaccctgaagttcgcccatcatttgccgagatcgttgtcatgcttgagaatgccgagatagaggttatgagaaatgtccgcagggcacgtttccgctgttgtattgcggggccaatgaccacagactgaaactaatgcaggatagagtacagaaaagaaaaaagaaaagagagaggacaccatgatatcggtcgcgtttgcgtgccgatatggaagtctcatccctggccttcaaggtttaaaattgctgatttctactttatcaaatatggatggtaccttgtatgattgtatatcttagcaaagagccgtgttatgtaattctccgaaatgagctatcttgtgaaataatagcagctgtatttgctggttgatcagcagctgttgtgtgttctttgtctgaagcgtcgacctacttgtggtcatcatctcctggtcttgttgatttgagtcggttgtatatgctgccattctttgcgcctccaaatccatttcatattattctccttgtgttgttttccatatggatccatgatacttatctatgcctatcatctatgtcgaagtcaaatctaaaatgtatctgccggttccactccggtttttgattatccaggtaaattatgcagattttccaagtggttttgtgtcaccaaattctaaacacctatagtctgttgaacttccacttattggagtactccgttctaaaatactttctctgttccaaaatgttggcatttttttttgtaggaacagatattaaaaaagtaggtgaaaatattggaggaatattatgattgattcacaaaaagaatgtagatgaagaattattatgattggttgagagaagatgatgggtgaagaaatagctttattttgattcatttgggacaagattttgtgctaaaaataagaaacctttattttccataaaatctacattaatattttttttaactaatatgaattaaaaatgtttttggtggcatgtgtgtagtatcattattcgtattttaaatatttatatatgatgttaattttgtagtaattgataatgcattatgacagaaattaatgataaaataaatataacgttatcctccgtgtaaanagctggtaagatgcacatagtacaccgcaccagtcagaaagaaaccatatgctgtccaggcgaccagaagtcaagcgcaacggcatatcggggtanaatctctctcccttttttaaagagggatanaattactttaaacatgttaagatttcaaattatactattagacactgaaaaacagtatgcacagggaaaaatcatgtcttgtttcccgaaagagctaatattctgacaaatggttaggcagtagattgtacaacgccaagaacaatgaataatttgtacaacacgaagaacaaagaattgcacaacagcaattacattttgacagaaataaggttgaaactagcacactttgtgaacgcttgatacttagatgttggcgttcacaaggtttatctgaattatgggaaggtaaataaacacacggatatagcattgacactcggcagattggggcaagtcttggacgatcttggatagtccaggacgtgtgcttattcatccatactagcagcgaccgtgctggtgatcattgcaggcttcaatgtatctggttcagaccaaacattgaagactcgtaggaaggtttgatccgctctagatccggaaacacagtgttaccggtgtccattgtgaactgaaacacctgaggctctactgcttgatgttgtccatcaacccaaaagggtacattagagtttccttcgcttggtacactgggcaatgtgctgttttggttcgaattcgtaaattggatgatagaagatgtttggtgtccggggtcagtcaaaccccttgaactagctgacagaagagagagagcacgctgaacatctagtgctccatctagttttgaagcagtttcagatgcatctgcacctgcaaaattggaccatcaaagcattagagcgacagtcgaaagaaaataaaatagtggtaagtgataacagaaacgtatgaaatgaaaaatcaagcatacagcgccagtaaataaaactagagaaaatactactctcaagacacggtatctgattgtattgagcatatcaaggggctcggaggatggaaagcatttagcaataggatggatctcataagttcactcgtgcatagtggtcaatggtgtgatacctaggctataggtatctgccatgatgccacaagtgtaactggaatgctggattgctagtcctacatgggttgtgaatattcaaatatacatagtaactaggaaaattttcatttcaaatgttcctaacttcaaagatggggggaaaaaatctgcagccaagattttggcactgcataagaaacttgcaatgttgtgaaacaacaaattgggagtttggtttacagaaagaatgctgaactataaacctcaaaattcaaatatcaatgtacctacacatgtttaaagttcgtttcgggatagatgccagtatcaacaaacttgatgtatcaacccattttgggtagtggccatatggattttactgttttatttcttctttttactagtaatatgccagtgctttgcaacgtaccaagctcatacattgaggattgggcgattggctgggtggatggattaa

SEQ ID NO: 67183 - DNA, 5031 bp, Oryza sativa
taaactaactttgtcagcataagtaaaattattcgagtagattaattttccattcatgatataaaaagatcatggagccataccttttattggcaagagctcatttgtgtcatgacaaagagttggcaaagcatttgacaaacggatatttgcactgtctgccccagcttttcgtgaccttttgcttatgtccatcacttgggagagctgtaagtcagatgtccacgaggaacttgaagtggtgtttgcatggttaagtggagcgttattatcccatgcgaaacttatttgctgcctatcatctgcaataacatttgaaattaagaaagagaaacttttagaaaattacaaagacaaggagggaaactacccaagcattattaaggtcaatggtaaatgattttttgattcctcaaagaaaacatgtcaggagaacgaataaatgcatgctctttgttttgatataccgtccaatagattttgcattgacaaaatcccaaactaaagtggcattaatataatacagtagtggctaaggctactatcccatatggccatacatgctattattttcatagaaaatagtgaaggatccagctaagcattatttcagggaaatacagtgtatgacatcgtgagatataatcttgattttttttcagatattaaatatgcatcacatcagccaaccaccaacaattttctccaatatattactagacagaaactacaaacaacactgtgattgacttttgtagtttatataggtcacgagggtattaccaaacagtgatcgcggtagtgttccagagccaaaagcaaacacatctgtctgtggtttccgtcgacgggcattatgatcagaaagtcgtctccggcagctccgtttctcctgatcaaactccgaaggcgcgtggaaccttgataatcccaagatagaacaaaaaaaatcatcaaaacgacataaacatgccgcaaaacgtaatgaattattgtttataaccacaattaaaagcagaatttggtcacagggagtttctggcaaaagcagatgcaagaatgcaactatgcaaaatactactatctacacatagcaatcactcattgtactaacacacacctctttgctgaaaatacacattcacatagacacgcaagccacaggccgtcctaccagaaattcaggaagccttgccttgcacagacaattcactgtcttggcagctttccagatgcagggcgtacaggcaaattctagcacagtactatcgacggggaaacaggatcttacctccccaaatcaggcaaggggcagagaaccttgtgaccaatcagtcatgcacagagtttcacactgtaccagcacaaaatggccacatacatatttataccctatcttttactgcacaggtagtatagtaatagtcgtactaatgattactactatgcacttaggcatatcgaagcaattcaaacagggcgcgaattcgcccaatcgaatcactaacggggcgattgaatcaattactagtagaactttagggcttgtttagagagcttcctgacggccgcagtttctccagtctcctaagagaagtcagcttctccagattctcaccaactatgcttctcagaatcttaagcgcggtattggaggagaggagagcgagaggggaaggggaggagggctgagtggctgacctgctgcactgctggcagaagcggcggtcctggccggcgacgacgacgcggaggcacttggtgtggggctcgcagacgcggtgcttgcggtagtactccttgtagcctcccagctccagcccgcagccctccacctggcaccgtggcgcctccgccgccaccgtccccggatcccccgctgctgccgccgacctcccacgcttcgccgacgccgacgccgacgacgaatccctcccgccgcgcttcccgggcggcggcggcggctcggcggaggcggtggcgtcccagtcccagagcagggaggaggaggtggtggaggagacggggttgcactccatgggcgggatcccgggggtggatcggagtcggaggaggaggaggagacttggggagggaggagacgacgcgggtggaggagggcgagggtgtgggggttatagaatagggccactacagtgtggggaaggaccggaggtaggggtagtggggttggtctctttgttttccttctctttttttccatcctatttggtgatttttgatatgtttggagtagtgtcaatttgtgccaagctaatatttcgggagttttaaatagtactttgatagtatttggattgtaaccaatttttgcctagctagtaataaatctacgcttgacactaccaacattttggtagggcctcaaaccaaatcagctctttatatttattactccctctgttttttaatagatggtgtcgttggctttttaatacatgtttaatcattcgttttattcagaaattttatgtagctgcataagatataaatcatgcttaaagtactttagtgataaaacaactcacgacaaaataaattgtaattacataaatttttttaataataacacgaatggtcaaatgtgtgttcaaaaaagtcaacagcgtcatctattagaaaacggagatagtgttaattttactccctctatctccaaaatagactacatttgttcgggaaaatatgtaagtgtaaatcgcaatgtagtaaatacttgaaaactatcattggattaaaaaaatagatgcttgagatttgtttttaattcttggtgatgtggacaaataccatgcgtctattttttaatacaacggtagttttcagttttcactgtgtatatggtttaaactatatattttccttggtataaaccatccatgtatgcataaataacacgtctctatcttctaaaattattttttagtcctctaccctcgagatcttttattctattagatgcgtacattgaatttattgagatgattcaaacaaggatgcagttgactagtttgtataaatatttaatgtttatgataatatttgattaaaattttaaagcttttgctataaatattttcttaaatgtttagttttgaaacaagaaaacgatatgcctatattttttttcttcaaaagtaataccacaatatacaaacttattagatttcataaacttactttaatataaaattgatgataaaagtttaaaagtttgaccgaattttgctctaaacgttaaatatttgtaagcagtgacaattatatagtatttgtaagcagagattgttatataaggttgtattagtttatgcatatagcatagagctatagaaggaaaataaaaatgcaataggccatgacaaaaccataaaaaaaaaaccttcaaaccgtgtgccgacgctgatgtgcatatgatttttttttgtcaaatactatattatgcatgtcaacgaggagcagtaacgacctaaccaatatctatattctgagctcagttctcaacccgtctctaaactttgaaaaccttctagaaggtcatgcacggtgctaccacatttaccttaaaataagttaatctagcactagatatgatatattctagtattgtaaatctaaacatgcaatacatgatttcgaaaggaagtatattaaaacatgtagacaaggcagtatgctcatatttagacacagaactatatggtttagtattttcgttgtcaactagggttgcgtgtgtacttgatagtatggaatacccagagtatataactacaattctacaactattagggaatgtctatagttaaaaaaatgtaccctgctatatttcagaacctattgccttatgtaggaatgctactaaccttttattgataatggtacttggtaggatgtaaaggaatatttctcatgctaatgaaaaaatacattatgagagagcatagatttttggttgtgtaatgtattgacctatactagtgttggagctcacttgtcattgagatttacaatccattctttgtcgtatgggcggtttttaaatattatctctgtttttcaatatgtaacgccattaatttttttataaatgtttgatcattcatgttattacaaaaatgcaaatataaaaaagttatgcttaaagagcatttgatgataaatcaagtcacaataaattaaatgatggacaaatgatcaaacatatctcaataaatcaacggtgtcatatattaagaaaaaacggatggagtaactcagaaagttcagagaacggaatgcatcttgcattatataggtgccaaaaaaaccctaagatggagccggtcaagactcaagagatggagaaaattttcaattcttttgacaaatgacaagtacaggggctacgaccaatttagggagggaatgtctgtgcgaacagtacaataactaggatgtttcatgacttctcgaacaagtatgtacacaagggaaggtggacattagagcaattttaatagtatagcccattactaactttaaatcatctatagccaatataatagccaattcatacaataattgcttactatactattaatacctggtcccacctatcatacacacattatgtcttgaaacatgtgctgcagctggctacagatctgtaacccgctgctcttctctcttttcctttatctttttaaaatatgtttataactggcttatagcctgctattatacctgctcttaggacttgggacttgggaggctctggttcagctactagttgatcaaatgcgaaagattgacttggtaggattttttattctttttttcctttttgaaaagaagattgacttggtagttgctgatcgtatgcctctcaatgttgcatgagctactagtagttaggccgatagtcatacaatactttgaccatcattgagacgcatatgaaaatccgctagcttttattaagagcaaattccctgactagattatcatgaaactacagatttcaaaggg

SEQ ID NO: 67184 - DNA, 2924 bp, Oryza sativa
ttgattgctgccacgttttagagcaaacatgatccataaactttgccgactttctacaataaaatagtccactgcattttcattgttcctttcaatacacatgcttgagtataattttgaaatttgatttttttaaaaataatttcaggtataatttttactcgtcttcatcgcaattatgaaaagagagttgggtaacaaaaaacaagcgaataaacttataaatttggttctaaaattgaaaatctgaagaggtggaattgtgagaaaaaccagatcatcacaaaatcttccaaggcctcacctaaaatagagccatagcaaaattagcaaaggacaataaatactccactggaagagaggctctctaatttgagagatatttatcctccacacctaccaaccctactgtcactaataaatcattgtttattacttaatcacacgacatcaacctcattgtcccctaacagcaacatccaatcccatgcaccacgacgattaattactgaacaggaggaggagtagtagagtacagagataacacacacagacaaagacacatccaaatccattctttctccaccaccaaccagatgatctcctcttctcttctccaagagaaaccattccattattacaaagctcatttttctaattacaaagtccatttctttttatgttttctgaataatttttcttcttctccctttggcatgttgctgtaggtcccctacaaaggtctagaggtcactagtagtacacactcctacaaaaggttgtaccaccacaccaccagcctcattgctctcattgcattgtctcctcttcctactgctgctgctgctttctctctctaggctgcttgctttgcttgcccctctctctctctctatctacaaatgttctcttcttttgagagaagagaggaatagctgcaacacaaaggaaggcactgcttgcactgtgcagtgtgcaggcacagccaagttttcaaaagaacccgccatcttctttctctctctactgtcctagcaattctctctctagctccagtattaatttctttccatcctccattttcttgggcaccgtgcgagcttagctctgcactgtttgcctcagttgggttggtttggtttggttgcttcttctctgcttcaacggttggtcgacttcaatgcaagaaagcatcggcagcaattgctcctcccgttgagtttttcgtcgtcgtttgaaagcgaaggagacggcgacggcgacgaggaggaggaggagggattaatgtcgtccatggcctccaacgaaggtattcttctcttctctctcaaatattctgtttctcgcatacaagtttgctcctcttttttctttcttcttctgctctcttctctcttcttcttctgtccgtcttggggaagagagagagagagagagagagagagagagaaattcagaagaagaaattgttggtgatgacgaaactgaaggagtatttggtgattgaatctgcagaggtcggtaatgaagatgggaggcaggaggatctgcttgttaaggaaggttagctgtggtgattttgattattttttttactgcttaatttcctcatctctttgctgcatgtgtggcacaattagtgcttgtctgtatcttctctttctttcttgctttagtctaagtgctccattagtcctggaaaaatcatggcttttttttccaggcatgctcacagctttgaagctctaacatgtcattttctaagagggcaacaagagattaaaaaaaagagagatgtcagctgctggattctggtcttctttgtaacttttaaatatgctattatgctgggcaggcttgcattccctatcatcatatagaagatgggtagattgtcaagtccttccaattcttctcaccaaacccaaatcctttgacatcgacatttatgttgatttaagcaccctcttgatgatctttcgcaaattgcaagcaaatcacagagatgcacgggttattttcagacttagttgtgtgtctgtctgtgtgtgatagatagaaagaaagcatcaattttggaagggtgcagagggtggtgcgcatgtcaattcttggtgcaaatctctgaattatagaaatgcctcagatactgtcgactggcagcatgtggttttcatgggaaacgagacaaacacaagcctctccccccttatcatccactgtcaagggatctgagagcctgtgtttgtgtgtgtgatgatgatgtgtttcttgccttgacttgctttgcactttgtttgtcttgatgtttgtagtagtaggtagttaatttgtcttcttgataaaattcagttttgtagcataacaaacctatgataatagcccatgctatgtctacatctcctttgctgtgttcagggccaggggagcaccaagaaaacaccatcagagattccgacgaagcgaaaaatgaggattgcagcaatagcgggtcagtaaccgaagccgtcgtatcaagcgaagaacccagtgacaggagcagcactgaagaacccagtgacaggagcagtactgaagaacccagtgacagtagtagtggtggtgacagtagcagccaatctgctgattctgatggaggtagcaaagaggcgcctaagatggattcgaaggccggtaacgatgacagcagcgagtgcaccgatcagagctctcctcgcgcggtgctagacatctcggtatccggtagtgtcgactccgatgagagctcctccgttgagcagccagcggagtcgaatcacaatacgcagtggaggaacctgatcagtggattgatactcaggaggaggaagtcgatggcgagagcggggacattccctcagagaaccaagaccacagggcttaagaggtacctggaaggatgcgga

SEQ ID NO: 67185 - DNA, 3827 bp, Oryza sativa
agtgtaatgatgactgattactgattagaagttagaaaagtgagaagtattaaagtataagtgcataacactgtaataccaaatcattaacaaatagggcctgattttgttctacattgcggtaactctagcatataatacagaaatctagctgttatgctctgcctctatatcatagctccaagggtcatgtgatacaaagtacagcttttggcctaattatattatcttcatctatgttaaatattctctgaatcttttgcttcatgcttgatattactagaaaatttgatcggaaaaggcgggcatgctgaggtgtacaaaggacatcttgctgatggacaatttgtagcagtgaagagactaacaaaaggtggtaacaaagaggacaggattagcgatttcttatctgagcttggaataatagctcatgttaaccatccaaatgcggcacagctcttggggttcagtgtggaagggggcttgcacttggttcttcagttctcacctcatggaagcctggcttctgttcttcatggtatggtttcctctaaatattctttacttaatgaatccaatttctgagagatatgctgcattgctgctatgtggtggcatgttacatcatatatcattttttagaaaagtaagaaatatatagaccttactattaggaatcaactagagaacagatatctcttgacattcatgctaccatgtagtacaacatattcatttaggcagtatctgaactatgaaatgtagttctccaataagtatgtgcgaatttgtgatttccattttggtaggcttcatacaaattttacattatcacttcttgtagccctcatttcaattgcctcttaaatgcatatactataggccgtatcacatatctgaactcaagcatcatcctctttctaaaaaaaaaatcaatataagagaatacttagaatacccttagtctggtgataaaatggagttcagctgaacaggcacaaagggagccctcaagtggaaggctaggttcaatattgctcttggaattgctgaaggactgctttatctacatgaaggctgccatcgacgcataattcacagagacatcaaagcatcaaatatccttctaactgaagattaccaacctcaggtatgtattctactaccagtctcttgccgtagtcctatctgttatatgattcctagggttcttttaaatgcaacagtttttactccctcattgcacagatctcagattttggacttgcaaagtggcttcctgacaaatggactcatcatgttgtgttccccattgaagggacattcgggtgagttcgataagtttttttcagtttcatcacaatgatttaatcgtacccagaaaaagaaacaatgccattgttggttttaacttagactttacaccctttcttaggtatatgtctccagagtatttcatgcacgggatcataaatgagaagactgatgtgtttgcatatggagttttgcttcttgaactagtgacaggacggaaagccgtggattcctccagacaaagcctagtaatatgggtaataaaagcaaatctctaatatgctccattatacaaaaattcaaatcagctcattttatatcattgtctggtcatattgagagaggcaagtgatgatcaaaagttaattctacaatacttgaatggataacatgaactggtataatcacatacatctgaagcccttgaattcacaagctgttgtttgtcatgtgcataggcaaaaccattgctcactcgaacaacatgaaggaactagtggatccttctcttgatgttggatatgatccagaagaaatggctcacatcctagcagtggcatccatgtgcattcaccacagctcaagctcgcggcctagcatgaaatcggtgagtgcgatgaacacgctaactatacggccattgtaaaggctaaaaaagaacaatttggattgtaaactgacctgttggtttgatgcctgtaggtggtccgtttcttgaagggggatagggaatcactcgaaatgatgcaaatgcaaagaccaaaactcatgaaacccctcatgttcgactccggcgattcagaggattatactcgctcaagttacctcaacgatctcgaccggcacaagaagcttgccttggagcagtgatacttgagttgattttgactgccatcttttgtacatcatcatcattatcaacattgtgatcctcctcctttccaaaggtgtagtagtatgcaggctgtatggatggatgtaagggttcagtttatcagttgctccctttgttgctgatcaccatggtgtcattttggccaaatgcatgttgtgataccattattcgatcgatggaccatttcagccctcgcctgtgtgttctatctctgcatgaaccttgttcaccatgtcaaacaaaaaaaaaaagctcctagatccaatcaagtaacctgaatttcaaaaaggtaaatcagttcaatagaagagatgcacttgatattgtagcggtaaggggggtgattccgtgtttaattctaaacacactcataatttcttctaattattggataaaaaagctccttctcgatttcaattctctagaatgctaatcaaccaaccatgattatcacaggcaacaccaatttcgaatggatattctgaatcctaggttgcacctgtactccactgtacctttttttgtcgccgccgtcggatcccccagctgccccgcggactccggcgcagcaggcggaggctcccccgtcgcctggaagcctctccggcggacgagcaggcgaggcgcagcaggtaagagtgcgctcgttaaccctgcatggctgcatcgattcccgtggaccggcctcgcgcggcggggttcgccggaggtccgccgccgtgtggagtagaggagagaggaaaggcaaaaggaggatcgaaatgcaaaatgcgaatagttggagggtcagtcgtgcaaatatcggcccaagtaaaggccccattagcttctgattaggatacagattctatgcgtgcgaaaaaactttttgtatgtaaatttctttaaaacatcaaataaatctgtttcaaattaagcttgtaatgattaaaatttaattaattatgtgttaaaatttaattaatcatgtgttattggtttgttttatccatatcctaactttcatttttattagaaacgaatggggccaaggctcatcttttattaaagggtaaatttcacatctggtcatttattttgaccaagagttaaactaacattttcacttaacactatgcatcattttgtttggattaagggtaagggtaccgacgaaatatgtgagggaacttcatatgagatttacacagggatacatataaaaaacaaagcattgtactatgtttttacattctatttagtttgagtggtatctaattaagttatactttctattctatttttattcagttgccctccgtatagattaatttgtgacacttttaaacatattcacatcaccattttagtgtgattttttttaaaaaaaaggttgttttctgattttctaaaagaccatttgatgggattttctgagtttctaaagatatttatcgtgatactacaacactaagaatgatggtttgaaccatttctttgacattctctgacaaacacctatgatattccaaactgcaactgtaaagatatgtggtgtcaagtgaaaatgttggtcaaattccaatgtgatatttactctttattaaacttcagtgtgatgccgcccctgggataggaa

SEQ ID NO: 67186 - DNA, 2388 bp, Oryza sativa
aaaaagtttagaactaacaaaggccttagggtgtgtttagttcacgccaaaattagaagtttggttgaaattggaacgatgtgacggaaaagttggaagtttgtgtgtgtaaaaaagttttgatgtgatgaaaaagttagaagtttgaagaaaaagtttggaactaaactcggccttattatctctacttccatcctcacattcaacattagcagaatgacaacgcaaaagaatcgattgtgatgttttctgctatatattcacacttattgcaagtaattaaattgagggatagccatttatttatctacgcgcatggcatgccagaaatcatctgcacatctagcacgaatagttgcaaccggttgggaccctgtgtcatgtgtccatgtagcgtcaaccagctagttgattgatggcttaacagctcgcagcgataggttcagtagctttcctcagccattccttctcctgctcattcaggtaaggttgcaaaatttttctgcaatccgagtgatacgcatttacccattcaatctcagcaggggtaagtaaggtggtgtctatcagttttgtctggtacggagtctgcatagcacaagaaattcatcaatacatgaacatgagcaaaacaaatgacgcagatacatggtgagcagcattttgtatttagagatcatgaaatgccagtcgaactggcaacaaaggctgactttaaaatggtcatacaggtataaacagagcaacaaaacaagaatacaatgtattatcaaccgggatatcttgtgaaattgatacggagacttggagattaccaaagagaaagttaataatttaataaaatggagattgaagaaacttacccatgttatatgttcaaaagccaaataacccttatctccaaaattaaatttagtattggcttctttaactatcagaacattctccaaccttataccaaagcttccgtcttcatagtaaccaggttctgcaagaaaagattgtgcaagttgaactttacatcgatcattgcagcaagagggactatcatcgaagtaagaattacaaagtagtttcacattaaactgttgatagtcctattaaaataaatagtggttaatttaggatatttactgaccatctgttacagtcatcgatgcttgtagtggtacatttctagcagaaggtctgaagctaattagatgaggacctgggttgtaagcacaaacagaatggattaaacatttcaaggtagcactacaatcagataatttactgtcatagaagaggatgaaccagcaattgagtatctgaccttcatgaacattcaaataagatccaataccatggcctgtaccgtgccggtaatcaagaccacttctccaaagtggtgttcgtgcgagaatatcaatagcatgccctgttaaggtttaagtaacgcacaaatatcatggattttgttgaaatataacttgaaaaagtaagtataacacaatgaacataaattggtgtcaaaacatggtagtataaatcattttcttcatcacttgctagtttctgtcatctttttttttttcaaatttagtgagatagtctatcactaaataacattagtgattactggaatcttcttacagtttccaaatgttaaagaaacaatggagtctatcactaaataacatttgtgattagtggaatcttcttacagtttctaaatgttaaagaaacgatggacatgatctctgaggcaacgaggctttgagaaaacatgatgtcgcatgtttataagtaaatgcactcataaagaacaataatgttatcacatactacactattaggtgatgttaaaactccatggtacatctggcagctattttatcattgggacacatgatcaatgttaaatctcctgagttcatatagatggaagtataaaagctcaaaacactcactcacctgtggttccattgggaaatacagcagtgtccagtgcaatgtggcctttcaaaacctatttccaatgttcgatatcacttgcattagaaatagattaaatagtagcaaagaaaattaaaacctcacagacaatatcttgtaaactattagattcaagcatttaatatgatgtttatttctacaagagaaataaagtaacaagtgtgtaaagaaaacttgaccagccactgttgacataatattcaacaatggaattttcagctccattaagtaggggcaagtaatgcaatacaggaaatgaggaaaccaataacattgcaacgtgtcagaaaacaaactttcaacatgttgcatgtcagccactaagctcttaaattcatggaaaataatactacagttgtcaaataaataaagatagctagcagttatgca

SEQ ID NO: 67187 - DNA, 2473 bp, Oryza sativa
ccccccctaagctagccagattaccaccacctttgcggggtgaaattgcgaaaagaacccagctactaactactacatggacttcgctctcagcaacagctctgctcatcgcatcctgatcttgcactaaggctagacgagacaagaagcaagcaaagaagagcaaagagagagagagatctcgcgcgctcacacttgggcatcttggtgttcctcctggccgcgccgccaccgccgccgccatccccgtcgaccccggatccgccgttgctcgtgctcccgcccgccgcgtggttgttcatcgcgccaagccgcagccaccaccacccaccacctcctcgaccccacgaccaagaaacctcaagaaccgggcccccggagcccgaggcccgggcaggcgggcctccctcgaggctagcttgccgcgatcttggagcttgctaggattgcaagcaaggaaggggaggatttgacctgtggagagaggggagggaggaggaagacgaagagaggaaaggaagggaggctttgctgtggtggttggcttgggaattgggagttgggattaatttttttttcatatggtcaaaacaggttttattttcactgtctttgttctagaatatttttttcttttcttttttaaggacttttcttataaaggtttaggccctgtttgcaactgataaatatgaggattaagaaagtatacgcaaaaacgaaaaaaaataataacatatgattattgagttttgattattataaatttagaagatgagttgatttgatattgtagagcaacttaatcagaaaataaaaggcctaatactaatatatagtttgtttttcttttttttagagattttttcacagctatcagttagatctattttgttccttttcaagcacttttcttcccatgtttagtactaatgggttttttttaaaaaaaatctttgagatttttcgtagctactatactcatatttacgtagttgctaaaaagttttatgataatatgttaatacctcctcttagaataaaagaggttttagagtttgacacgattgttaagaaattaggtagaattaaatagagagatattgtgattgattaagaagttaagttaggtgaaaaaagtgaatggtggaagagttgttattggttgagaagagaatgttggtggagaagttattgtattttaaaacaaattttaagtgctagaaatagttatattttggaacagactatacctaccataatagcacatatagtccctgtattatggagaaaacgagatagaaggacagtctgtactctgacaaagcaagattatgtgttacaaactatggcagaaatagtgatacggaagtatcatttcaaacaaatctgcacatgtgattttagtcagcacaacaaaaatatgaaaggtactcaaagttcaccttagactaatctggcccttatgacgaactcaatatacggaacatttttggtcatgcatgtgacacctggcaataagatattggtgcttttgtgctgcgcctctaccctctagcctttctagaagatgaacaccgttagtcgttaattaattaatcttctacagttgtagtttgacttgttcatcactctcttgctgataatttatcattatatatggaatcaatgttggtcactcattttcgtacttacggtagaaaaatcaacgaccataaatgatgtatcgtatacgttatctcacatgaccatgacctatagaacattgacacttaatttcaagttaacagtcatcgttatcatcgccgtttaggtttgggtctcgttgaaatttgaaaattcaaatgtcaaggtcaaacaatgtcatcttggaagacaaaataaaatgcgattaattagttgccctcttgtgcatcctgtccgtccaatgccattttccggccatccatcaggtaggagaatattgcgttgacgttgggaagtctttggtgggccccggctgcaggccgcgctgtattgggctgatagtgggctctagtatgggccctgatgggctggatacgtcgtttcagcctgattcgtattatagctaatttttatatattttttacgagggattgcagtttataaaggatgagtttcaccaccatctcgaataaatattgatattataagttgataatggcacaatgcctattggagactctaggatgaaaaataaaaataaaacagagaaagaaaaacaaaagaaactccggttgcgcctaatttttagcaaaatcgtttggttataggttattacatttttggactctgggagcagttagcaggtgctgagtcatatgcctctacaaataaattcggatatcatattattaattatgccattttggaacaccatcaaacaagacagtgtacatatacacacacacatatgcttattgagtgatcatgcaagaggtttattacacct

SEQ ID NO: 67188 - DNA, 3994 bp, Oryza sativa
cccccccacccctcacctccattcatgtttctctgtatggagttgcaacgatgttatttttgttttattttttcggatgttttttcacacttaggatcacgatacaaccaaccaccaaaaaaaatttcaactcgaactaccacttagctaagtctaccacttagtctactttgcaccttcactaaaattagaccataacttctttagtaaaaccttttgatcagcatgttaaacataggagagatcctttagtaaattagactatatgaaattacttacttaatctaattcaaaatataaccatataaaatgatagccataagttaaacagtatagagatgcaattttttatttttatttcattttttgatatttttttcacacttaggagaacataggaaccaaccatataaaaaataaactcaaacggacaaaatgtgacttgtagaattttccaaaactcaccgaaacggacaaaatatgtcatttattgaaataggcgtaactttctcatacggactcggaatcaggcaaataatatatccacggacatctacataaaaagttacacccgattctcccttgctttgccaggttcggcgatattaaaacctccaaattccacttgcaagattgtgtttttgaggagagaagtttttcggtagagctttgaaaaattccacaggccacatatttcgtccgtttgagtttattttttatatggttggttattgtaagttcctaagtgtgaaaaaatatcaaaaaaaaataaaaataaaaaagttgcacatctctctcctctgcactagttcggagagagaggagaggagagaaaaaaattctacgggttacatattacgtccatttgagtttattttttctatgtttggttcttatgtatccctaagcgtgaaaaaaatatcaaaaacataaaagaaaaataaaaaattcggggggggggggtggcgccagccattctggcgcgctctccctagtcacctcagcatcgccccgccacgtcggcggttatgggataagtttttttaggggtctatttgcgaaataagtttttcacaagaaccaaatgtgaaaaatccagatttatcctctcacttccttcctggaggtgagatcttcgcctgctcattggcggcgggccacgtggcaccagatgcgagggcttggtgtgctttctccatcatggaccgcatgtatttctcctgggcctcaaccctcatctggaggtgcttttctgcctgcatgcaaagaaatatattcactttctgggtgtccaaagaaaatgcatatgccaaatataatactcatgatgagttgaaagattattgaaaaaaaagttgtgctagcactagcagggtaaacttcccaagaatgttcctcttgcaagagacatatcatttaattttcagatagaacatgtgagaatttaatggggaacgttcatgcatgtaaagttcagaagcaacatgctattccttccgcaaatatcctcttttttatcaaatcctaataaaattatactacattttatatgctccgatcctaatacatatatctgctacttttataaatgggaggagcaaataatgaacttaaaggggtactaatttattttgagataaatgggaggagcaaataatgaacttaaaggggtactaatttcttatgtgaactagtcatcagtatgcaatgatgaatttaaaaatacatatgctctctcacctcttgttgttcttggctctgggccttcttatctgccccattcacatgcacgttgcggctgtgaagatcgacagaacagaaaattaattttgaaaacatatgaacatgcatggagctagatcgatcagaaagtatagacaaaagaaaattaattttgattgtttggctaaaaagagggtgcattttgaattaatgaacaacaaattaatatagccatggtaaatcaacttactctgaattcgtgcctgaagatggcgctgcattccattgattgtccattgctgaagtactgggaattgaaatggcgatggatcgatcgaatgcacgaagaagatgatgaaataatcagtactctgaccggtgtaataagagatatatataggagtacagtggcgcagttaaagggtttgtctatggtaatattctaaaatcatccctaattatcatcaggtaattaattagcatgatcagaggagccacatatatgttaatttgcatgcgcagatcacgctactaccaaggaaaaccgcttgtaataatacaagggacgagggcgggtgcatttcaggaacaaatatttctttcctgaaaccagaaatattccacctttctagtggatttcaggaaagaaatcgggaccatatataattgcaagtcccatgtactcaaggggatatgaaaacagccagtttttttatacagccaatataattggggtgcatgaaatgggctgattcatacccgccgttatctttactattgtacaacctgctcaccgcccctcctctttattgttattgggcttttaaaaatcaaacataatcgttattttggttctgttttatatttttttaatatcgcgtcaactgccccaccctatcatgttgcctcttctatttattattattgggattttaaaggtcgaacacgattcttgttgggattccccaacatgaattaacatacacgtttctcaaactcttaacaatacgtgatttttgaaaaatttgtacatatatgaatttcttatagtaaatactatttaatttaaatctatttcctaactttataatacttcattcatttatacctcgaataattaatcttaacagctgctgaaaaaaaaatagaacagttgcttgtgtccctgaccatatgatatgatctgaattctgaattgtacactagcacaagcagtgtgaagttcagcaattccaggggcactgtgtatagacattagactgtacatacatatgcagcattgcagaaaggaggcgacgcagaacaaacgaagcttccactctcagcaagaaaaggctgcatgcatcatgctatacagggctcagtcactgatataattggagcaaaattaatccaagctaattaactgtggatatatttgagctagctactttaaattaagccattgcatcgtgattcgggaacagtgcttaattgtgctgttatgcagtgttggtctttctctctccccttctctcccttctttgcttctctatcggtgagaggaagacagagcaccggcgacgagggccagtcccctccacccgccgctccgagctccgccgccccctcctcccgctgccccgaactctgtcctctgctgccccgagctccgccaccccctcagccctaagctcagctcaccaccgtcccgagcgccggtggttgcgggcgccctttgctgccgcccactccgcccgacatcgtcccgagctccgccgcccccttcgtcgctcctgcccgccgccgtcctcaaggtgaggaagcgagaagagtgaggattttggagagaggtagagaggtgaggggtaaaagagagggtgagagactgacatgtggggcccgctgatttaaaaagaaaaaaattgctgactggattgccacgtaaaccaaaaccgtttgtaaagctgctggggggattcatccaatatcgatagttgagggtgaaaattgactggttttcaagtttaggggataattcgtactcatccaatatttcagggggggtaatttatactttttccttttaataatccatagcaacaaacgagtaattttggctagtagttgatcgataaaaggaacgccaataatatataacatttttaagtgcttgggctcattaataatctttttaaatgcctacccccaggccccgagtaataatcatgaaaattttagaaataatgttaatataatctagatgacatgcaagtatatgggctgcaggaat

SEQ ID NO: 67189 - DNA, 3084 bp, Oryza sativa
cgatcgatcaagcacttgcacttaattatatccttaaaatattttacccatgagtaaaaacatgttatcacatgcatgcatgccgtactgtgacacgactccaaatacatatatataagaaaactttcgttaatgttcagacaagcatggatgaattaagacaacacaaaattaaaatttacaaactttaagccaaaattaagaatgtaggcacgactaattatctagatcaccctcctctctcaagaacttaattaattgcatgcatggatgcatcctaattaattgaacgatgcataatgcaatactacttttgtatactctcccaactaataacaagacagttacatatgcttattcagtgatcttgcaagatcagttcagcctgcttgctggtttcaccacaaaattaaacatgcagttaatataattacctcttcaattcatcatcaattagtttacccataggagatgttcctagccttggctccaacaattggactactcatcctctcacttcctacaggtagcactgtttgctgtggaggtggtgatctcatgtcaagcttagagctcatctgaccctcaaaccccttactgcccatggagtctcctcctgacatggtgatggcctccatcatcatcgtcgtcgtcgccggcgccgccatctggagctgatgatcgccggagatcttcgccggctcgccgccgccgtcgtcggcgccgggccacaccattgggctcttcccagtactggagctgtaattgaatgccaagaaggtatcaattgatggcctgatctccatctgctcatgctgctgatgcaggtgatctagatggcttcctccatataactgcagatcatcttgcagagaagggaagctcatggagctgccaatgtcaaggacagcttggctgcctagagatttgtatcctgcgtgccacgtggcgcaatctcctgaggacgagatggcttggtatgctttctccaggatggtctgcatgtatttcccctgggcctcaaccctcatctgaaggtgcttttgcacctgcatgcaaagttagttatattcacttcttttgtgtccaaagaaaatgcatatatgccaaactcatgagtgccacagatgagtataggaaaaaaataaagttgtgctagctaggtaaacttcccaagaatgttcttgcatggatgcatctcattttcagaacatgtgaaggacaaacattgacatataagctgtccacaagcatgtaaacttcccaagaacgttcatgcatgcatgcaaaagttcaaaggcaacatgtgaaggagcatatgcagaataaagcaaagcaaattaataagtaatttcttgggctattaagttcagtatgtgattaatttgacaccatgctgaattacagaaaattaatttgtttctgacaatgctcttaattacctctaattgttcatggaatcttctctgaacttccatcttcatccttagtgcctcattcacatgcacgctgcggctaacaattcatagaaattttgaataataagatagttattaaaaaccacattttgaattaatgaacaacctaatctagctagggtactctatgaaaaaaaaatcaacttactcattcatgcttcttcccatgatgcccgaagaagacgctgcattccgttgcatgtccattgctgcagtgggaaaatggacgaatataagtttgaatataattcaccttttgattatattcagagaaagtgtgaaattaactattctgaaagaatcatggtaagtaaattaagctgtttaaatagctagctagtacaaacgaaacagaaattcactgctaacatatatcaagtcggtaaactttaacaagcggaattaaaggaaggaaaaacatgcatgtgcgaacaaactaacaagctaactagccagctaattataagaacacaattaggaatgtaatatgctattttaacaagtagatcgtgtgtttaccatccttaaccgagtggtcgttgaaatccttgtgctgcttcccaagtctgaatttctgaaaaaacaacaatctacaacacatgagagatccagagatacagaagtctgaatttctgaaaaacaacaatctacaaaacatgagagagagagagagagagagcataagctaaccctagttctaaccatgctagctagtgcaactagaaaaccatatatagacatggatctatatatgtactgcacacacacctgaagatggctcttgagatggtaaagtgtgagtcccttgactcccataaccctcatgatcgtctttggagtcgcctctacaattgatcaagagtttgatcatgaaacatacaagtaatttacaattgatcaagagtttgatcatgaaacatacaagtaattaattaagaagaaccgaactcgaaccaaataaaatcaaatcaaattctcagcatcaagatcagtcatgtatagagcgtagctacgtactgtccgggcctccgagctgggtgacggcgtcgacgaagcggtcatggagctcgacggtccagcggaggcgtggcttggggtcggtggtgaggacgaggccggagtcaccctggacgcacaacggcggccgatcattcgagctcgccgccgccgcggcgccgccgacgccgacgccgccactgagctgctgctgcttcttggaggaggaaggagaaggagaaggagaagaagaagggaacattctattctcctagctagctttcctcctcctcttaagaacctctctctctctctagactcactagatctcctccctctctctctctctctgttacagatttggaagagattcaagaacaaaggaatagggttcgatcctctcgcggcacgcggaacgaggaggggagggggaggaggagagaaaggactacggtgttggtagagaagctgtactgctgctacggcgacgaccacatcacttgatctctcttagcttcttttcttgatgatatgttctcatctctctctctctctacacctctctttgttgcttttaggtgctttgattctctctctttctcctttctct

SEQ ID NO: 67190 - DNA, 2448 bp, Oryza sativa
taacaattattatgtgcgttcggcagcaacacaaggagaggaaaacttttatttattttttttaaaaaaaaggaagtctcaccatgttttttaaaaacaaagagaagaaactgttgtgtttttattaagaaaaatctatagaaaaattgtttcaaaagtcatatttatctgtttttcagttagaaataattaatacgtaattaattaatcatacgctaatgactcactatttttttcttaatattctctttttttctcctcaaacacaccctcagagcgccggtgcatatatacgtatcctcgaaaatattaaattagtttttcctgcatttattaagtttttttaaaaaaatcaaacaatatttgttaccatagggtgtataacttataaagattgttagataagtaaatcatatattgttgaattctcgattctagcaggtatacttcacccaatttgcaaaggtttatccattaataagcaggggtgaaaacggatcgagttcggtcagatctcaaccttttcatatcctaacccacattttataatcggaatcgggtcggacaaggatagtgtcaaatacggatacaaactcgtataatgtcgggcaaaaatatggaacaaatacgtaccaaaatagatacacacactattggttacgaatatttattcggatatcaagtcgaagcaacaaccttatatatcacatagacaataaccatttaacaattccatatatccataatacaattatattaggccattaggaacttaggaaataaatagggtataatacatcatagcagaaccaatacatagtaccaaaaaatgcctcacaaaaacataatataggtaatatccgtataattatccgggtaaaacccgaattttttaccggataatccgtatccatcggatactatatttccgaacccgatcttatatccgccaaaaaagacatgtattcggacctgatatccgtgaaaagtctcgggtacccgaatttgtcccgaaataatgtggccgggcaggagggcgggaaatacccgccccattttcacccctattaataagaagcattattaattccacatgcattgttcatctatcaatatatatattcttattgctatgctatgagaaggatttttttacctacttaattaattaccaggagatacaacatactccacattcttatgtcctccggttacacgaattaacactaaaattgtcgacctaattaagctgaattatgcgcgccaacagagaagctagattagtggaaacaagagatgacttcgtcttttatcactagtgcatccaatcatcatatcgttatatatatgtgggtcaaactctataatatatatgcatatatctagacacatcatgcaattagtcatggaaaaaggagtgtactcaaaaaacaccatcatatccaaatgatggcttgcagattgtgagggaattaaaaagacatgcatttgcattgagccccgtgggaatggttggttgcccaagtagacatcacaacatatacactgaaaaaaaaaaccctaaagtttatatagtgtgcattggggaccaatcaaccacaaccagtcaggcagctttagtttttagttttggtttggttcctacaaccataaaccattaattgccatcttgtggcacttaattttttttaagaactggctagctagatattcactggtgcatataaattgatagtaatatactccatattggtaaatcaaacaaattaattgttgtcaagaattgatcaggttcatgcatgattagttgactgaaccaaatagcaaattgatattgaacttgttggtagtaaattagtttatttccatcaatttcaatttttccttttgtatgttacatatatataatgctggaactgctagctactctttttctacttaaaagatgaataggtgaatgcacactctccttgatcttctaaacagtgtgttttttcagaaagaaaaaaataaagaactttctatacataaatttcatttctgtttttttttggcacactagtatgatttgttcaaagcaaattaatgtgatgaacaaattgtctacaggtattgatgccacaaagggtcaaaaaagtgagcagcttacaatcaatctcactgagagtagtctccctttagtacaatagaagattgtctcccatacatgcacacgtcactaagcatgcatcccattatgacacatacaaatccaaacaaaaaaaatggtggtcaaaattgtggcttgaggggcccatttgggagaggatgagtgagaacattataaagcaattaagctctagctcaatcgttcctagcttactcttccatgagggggatggacaagccgttttctttacacgagagggaatagatgctttcttctttgacaattaagcaaagattcct

SEQ ID NO: 67191 - DNA, 1680 bp, Oryza sativa
aggatggagacagatatcctcaccgtcctcccagcccacctccacactcttcctctactcctcgccgaggagagaggaggcatatctaggcaagcagcaaaggagaggggcgatggcaagcggagtggcaggggcgaagcaaatatggactgccagatccatgacaacagagatgagtcagcgatagcaacaagggaaggggtgcatggtgaagagcggcagtaaaggaggcggacctaggcggcgagagatgatcagattaatttgggctaccagattcatggctcggcagtggcctggtgacaacggttctgggataagggcggtggtacgaagaggaggggcgtaaggtggagggcggcagtggaatgtgagtcgaggtggtgacgacaaccgctcctagatctagtacagtggctccacaacgacgaccatgactagggatgcgacaacgatctcgacctcaatcatgacctgttggcttctagtgacgacgatcgcgatcgctaccagctacgacgtaggcggcaagcgctattttttcccctgaaaaattatcttcatatgtgggtgtcatagtgactcgcttgcaaaaatcaatgatttttacattcatttggttagatacgggccgtccgtatggaaaaattatttcctagtggagtatatatgattaatagatatatgttagctttatcagtgatgggtagtacgctttctctgtcatgaaatgattaagaccacaaagatcttctcctgcttgccaatcttataaaatatatgtaatgctttacgtggcccattaagtagcaactttaataagtacgtaatcatggttacccaatatttgatgtttagattaatgtctgaacacgtatgaacaaaacgggtacacgcacacactcgagttctttcggccgtcggcaaaatgtccctttgcaaaaccgcccagattatactactactatagtcctagaccatacagatgatttggaaggaaatccactaaagtgagcaccaatcaacatatttttgcatttatcggtctagcttctctcgtgttagaaaaaaaaaaaaaaccaacgtcacgactgctgggtgcgcatcaaaattaaactttggatctaaaataaaagctattaccgataagtcatccgtaatggtctcaagacgataccaataaaaggtgaccatcacatttttttggtttatagtacgttaccatgtatcacggatgacttatcttcaggctttgatttgacttctttgttgggttaaaattattagtgatggtcttttatatcggcctgagacaaatcactgttatcggtgaccaattatccataacgcggcctgtcggcgatgcagatgaaggttcccgtccgacacagatattttttttccacactagtgtctagttctgtctcgagttagcacttcatggccgaggtgccttgcctctctaggttggattcatcatcatcttcttcttattttttcaagaatggcaacaaaagtgtgtatcatgctagctaggccaatcaactttggacgtatacacgcgactgcattggcagtggcactttcattcgtttgtttttctcttgtgtgctttggcggcgttgagaggtgtgttgctttggcttctttgcgttgggggcttttctctctctctctctc

SEQ ID NO: 67192 - DNA, 7598 bp, Oryza sativa
ttggaagtacgtctacgcagtttctagattttttttatgatattgttatttggtatgcacgatgtatacacgtaaagatttgtgtgcacatgatatgttcccatcattacacactttatccataccattttacgtgtgtaaagctcgaatccaaaattttaaaactcgtgttcacattataaaaacgtttcaaattgggttgaattcgtagaaatgatttattgtatatagaagcactttttgcaagttttagaccatttctatatagagcccacatataaattacctatacccattggataattttcatacccaataggtatgggaaagctaattataaaatagatatgggttacccataccctccccagtgacatctaaaactccaatttaaactcgatgaaaagatgaggaatgtaaagtagacttattccgttgaaaaatggccgcttgaagctgatgcggcccgtgtcacaggcggcagcagatgccgatcgagaccgagcaggagaagcccatctgtcccgtttgtttcgtgctgaacgctcgcgtcgcgtagcgtgcgatgaggccgtggaagtggaactgggcttgaatcaaggacaccaccgttgcaggcctcgctgatatgggtttagttcgcaggcccacataaaataggcaaaacctctttctttttcccagacaacaaaatgctcttttgcactaataaataacggaagcatgaaattacatttcaaattgctagttttaattaaaaaaacaaaaacccttcaaattgcgcttgcaaagccaccgatataaaacgtgtttgaagaaaaggtttgggaaccctttacgtgaacaaaaaaaaaactcattagagcatgtttaattaagtattagctaaaaactttaaaaattaattaatatgaatttttctgaagcaacatttttatagatttaaaaaaagacgcaccatttagctgtttgggaagcttgcacgtgaaaaaagataagttaaaaaaaaggagagaaatgaactcaccccaagtcttgcttatttgcaatcttaatgctaaagacagtctacattgcctatgcgctgatagtatctctaacagaatatacaaattagactatccaaacacctatacagctatatctccaattgatttggtaagccaaaatcgttgctcacgccaacagcttcttcatctaccctctccactccaacccatatgacactgcaacccatatgtcagcctctaacatctcttcttcttcctcctatttctccattcttcctttgcttccgctggggccaccctgagctactctccatccctctccctccgtgcggcgacgatgtttgtgtgatggcggatggcgacagcggatccgtgagcgcgctaggcggggtggctgacgcggatgaaaggaaggccgtcaacaaagcgcgatacccatgctatagtggcgcttgagctcactgacgtcccgtacactccccaaccctgtcgttgccgtgggcttcctccatgccagcggaggcaaaggctgtaaaaatcgccgttgagaggagacaacgagagctgagggcccccgagtccatgcagggacggaggctgtgaaggtcgtgtggggttgaagacggcaacgacagagtagaggccacggtggcgaggaggtatgtgtaggctgcgacggtggagtagagggggaggtgcgggatgtggcggtgacgatggcggtggcaaacgatgaagacaatgattgtctcgttagggggattgcgagcgggaaaccatggtggcgaggaggtgcgcagcggcaaagttccacttgatctgcatcgcaagtgggaggaaagataataggaggtagttagacccacatatggcaagtgtagttggctcaccaagtttggtaagtaagggaaggagtttgtccagtcggatagcttgaagagtgggatgaagagaatgcaatttttatccactgttgctaaactttggtttgaagagtaaaatagaaaggctgttgaagatgttcttacgctgttacacgtccatgcccatttttctctctgtcaagattcactggtatgcttacatcaatacactttttcttgttatatgtttgttaccttattagctatagccaatatttatttttttaatttaattttgagttttttttaccataatttattttcttctttggcttttaaatcaacaaagaaacatatacataaaattgctataaatcattttaatttcttttcactttgttcatttttgcaggtaaaacgatcataacaatggaaaaatcataggggaaaaaaaagaaaaagtagagtcgtgagtgcatgattctatccacgaagactgaaattttggtgcttacgaatattacacacgtatagatgattttttaacaggattttcatctttagagcatatgttacgagacgtattcacgggtgtgagtgtggtgttatgcgtctgccatacaatccaaaaaaaaaaacaaaaatcatggagtaaaaacctgattcacgaatcaacggtgatgataacgcgcaagaacaaggaataagttcatctaaggtcccttaacttatcaacgaatccgattttcgtccttcaaccacaaaaccagatacaacgggtcccttaactatcaaaaccggtgcatattaggtccctcggcggttttggctgacgtggcgcctgcgtggctaattttgactcggtctcgatctgacgtggtatgacgtggcccttacgtggcaatttgacccgggaaaataataaaccccgtgggacccacatgtcaatttcacacacaaaaaaattaataataatggtggaacccacgctgccccacatgtcagtctaactcacccctcctcttctgcttcctctctctctttctctcctcttttcatctctctcttgtgctaggggatgcggccggcgatgacgatggcggcggaaatggagaagagtgactgccaggggcataggtgtgacgtcgctgggggcgctttgaggcggaagtagactcttacgacgtggccgtcggaggtgagcgaggtcgtcatggactcacgggattggcggtgtcgtcggcagcggtggagcaggagttgtagttggagtccttgtcgtcgacctcgagttcgtcaatgtgctcgagcatcacccaccattagtagtcgccggcggcggaaggtagcgccgccatctcctgttgggtttccatgggccgcggcgagcggatcgatatgggttcctcgtcagtccggccggaacagtgttttcttgcctaaaacaatgatcattcattcattcatcaaccccgtcataacacaagcaaatgatgatgacgaagcaaaatatactctagtcagctagtactagtcgctattgcttctacctttgtatgattaggcacataaacgcggagcggaggtcgtcggctttggtgccccagccgaggccgtggacgaagagcttcctgctcacgggatcggcctccgccgtgcgccgcacggtcgtcatcatcactggggtcgtcttcgcagtcggccgcctctcccctctcccgccggcgaggtggccccctcacccgcccacgtggacggccgccttcgaggatgcgcgcgtgtgtcggccggtcggcgggacacgttcatcccgccgccgaggatgccgaggtcgacgtcaacatcgtccgcagccacggccgcggcggcgctgcctccgccgccgggctggttcctttctctccgctagtttccctcccaccggccgccgcgccgcgccccttctcccagccggacaccgtcctctccccggcgcccgtgaaccggagagaagagaaagaggagaggggagagagatgaagacagagaagatggtgaagaggagaatcagaatgacccagcgcaagagagagacgaagagaggggaggaggagagagaggaagcagaagaggaggggttaattagactgacatgtggggtccgcgtgggtcccaccattattattattattatttttattgtgtgtgaaactgacatgtgggtcccacggggtttattattttccggatcgaattgccacgtaagggccacatcagtgccacgtcagatcaaaaccgagtcaaaattagccacgtaggtgccacgtcagccaaaaccgccattgaaaccgccgagggacctaatatgcaccggttttgatagttgagggaccaattgtatctggttttgtggttgaaggacgaaaatcggattcgttgacaagttaaggaaccttagatgaacttattcccaagaacaatcggtacgatccaacggcccagaaaccaccgcatcgcaccggaccagcccaaccatttcgtcgagcacctcacgcacgcgctcccctccaagccctaaacccattccccaccaccatgcgagccatcggcccgccgccgccgccgcgaggcggcacgcgcacctccccacctcctactccgccgccttctcctccttctccggcatcggcggcggcgccgggcgcgggcgtgggcgcggcctcccgccctccgcgacgccgccgcgcgcccccggtagccccgtcccggacgacgacgacggcggcggcgcggatcccttctcctccccggcccccatcggccgcggccgcggggaggccgtgatcccgtcggtctcgtcgccgccgcttcccggcgccggccgcggccgtggatcgccgccgcccctcggtgaggtcgcccccaagcaaccggtccccgccaagctgttcgacgcgccggccgccgaggcctcgtcttccgagccaccgccaccgccgccgccgcgcacgctcccttccgctggcgctggccgcggcgtgccgcggatgcagcagccgccagtggagatgccgcaggaggagaaccgattcatccgacgccgcgaggagaagaagaaggccgcgtcggcggcgcgtcccgctcccagcgggcagccgaagctgtcgcccgaggacgccgtgaagcgcgccatggagctcctgggcggtggcggcgacgacgatggcgggcgtggcggcaggggtcgtggtgcccgtggtagggagcgcgggcgcggcaggggacgtgatggcggccgcggccgccgctctgctgatatggaggagaagcatgggatctacttgggggacaatgccgatggcgacagactccagaagcggctcggcgaggacaagatgaagatttttaacgaagcgtttgatgaggccgcagataacgcgctgccagacccgaagcaggatgcatatctggaggcttgtcacaccaataacatggtctgtgcagcaatgcggttgaatccgcaaaattgttagagttgttagatctggccgttcatgcaaggttcctgaattatttgtttcctgtgggtttatgtatgcagatcgagtttgagccagagtatcatgtgaatttcaataatccagatatcgaagagaagccacctatgtcattggaggatatgctacagaaggtgaagccattcatagttgcgtatgagggcatccagaaccaggaggaatgggaggtgatttctttgatggaccttgtactatattatttttctccacagaaatgtttgtgcgagtagatgttttggtacatatgttctcttgcagcattgaggaaccagattgcattagaaaatgccggagaaagcctgcataaatagtgtaaatgatactttgtttttccagcaataggattatagcatgctcaacgggtgcaacgctgcaagtctatagttggatggcattagaatcctagctgcattatcaagttttcataaataaactgatgaactcgagcatgttaatagacttgttccctgtttggaataatcattcagcctgattgaggcttcagaaataattctaatgagtttgcagatgcatattgctgtggtacgtaagtatgttcacagccagattggcctagctttgcactgatatacctagatcgggctgaaaatgatattagtagattttgtgttgtttcacctttcagaacatgttatttggtaagctgatttatgcattacaaatggagcggatataaggtttatacaaaggatttattatctttgttgcatgaacgctgtccagctgattacttagtaattgtgcctgctcctttctgatgaggttaaactgtaatctccagataagtttcaacttgttctaaaatccaagtaaagagggactgttggctacgttagattagagattttaacaggattgggtcattctagcttttatgtatttcctgcagtcctggacttattgaactaaaagaatatctattattccgcttccatgtttctgctaatcagctttaagtccctgtttggaaattcctgtatgacaccacattagacacttgtctcataggcttctactattacatgaaccagtacatgcttgaacttgcagctgtattcgccttgctgctaaaatgagtttttttttttttggtgatgtatacaactgacccagtataatgtaccgtatcactaataggaagctgtgaaagatgtaatggcaagggcaccccatatgaaggagctgatagatatgtacagtggccctgatgttgtaactgcaaagcaacaagaagaagagctgcaaagagtggccaacactctcccaggaaatataccctcttcagtaaagcggtttactgataaaactctactgtctcttaaggtttgttttcttgttataattgatgctctgaacagtatacacatttttatagagaacattattcataatattaatggtctgatatttgaatgttgtcatctttataattcaacttctgatttctgaatctccagtggtgatagaataacacaattcctgtctaattttctaacttgatagacatgtgaaattatagtatcaccctttctaagcttgctttcaaaaatagagctgtattcaattagcatttgaaatttgaattctagctacacaaatgatcaatttagctttttttaatgcaatgtatctacaatttaatggttcgttccaaccatcaaggcataaagtccctctgtagtctgacatgccctgtggtctggtcttactaagctagttctataacatgtctgtgtttatcatcacttgccatctgagatgatatatttgatagtttcttatcctattgctctcaaagatggcgaagtgcacatgctttaagttggctagttcacctgactgaagtactctacatgttggagattctgttatcatcacatgtgcaaaatttaccatactggttgtcatcatcttgtttgataaaatattttcatagccattagaactttttacctgtattcatattacaaaaagaagtctggagaccctgttcagtgtgtttatgtattcctatttgtttcaccttcctttgaagaaacacaaggtgctgcttattgagatgaattcgttcttgtttctccttatatcttttgcagaacaatccaggctggggttttgacaagaaatgccaattcatggacaagttt

SEQ ID NO: 67193 - DNA, 2935 bp, Oryza sativa
  unsure (1)..(2935): unsure at all n locations
attcctgcagcccgcccatcaatcacttgatagtccagtagtaattgtatgccaatatgtcagtttcagaagttatttttcttcagagaagtttcagaaatatgtttaccttcacatttgtggccatctccttggaaacccggggggcatcggcatccagtcaatgcagtgtcctatgaaattgtgcagagagtgattagcaaagatcataacaaacaacgagaggtttttctgcaagtgaaggctagagagttacagagcaagcagagaacgtctgatgacccctagtctctgaccagcagcctccgttgtccaccgtacacctgcctggcccaacagctgaaacaaaaagaacaaacatgcaattacattaaaattcaaaacatggtgagcctgaaatcgaggttcctttggaatgcatgaattttacagaattttcatggcctatcgaccaactatacctttgcaaccgatgtacccgtcgccctcgtactggacgccattcaccactgggcactcgcacaccctacccctgaacgtgtcctgcgtattgttgtgaacacgacgccagaaaaaatcagattaaaaaagctttatcgatatcagacaattacatcgagatgatacaattaatctataaaaccatgtagtaccttgcaagccgtaacgttggttttctcgtctctccagcaaccgccgttcctgtgcaggcactcgttcgtctcgatatctacagttgaagaaatgaaaacagagatttcattagaatttcattccaatttttcagaattccacgaaacaaaacaatatgtttctctgcgttttctacgcaccattgctcaagcagacgcgaggttcagtgccctccttgaagccggcacagacagctttcagcacggccgtcctctccagtttcccttcatttttcacaaccatttttgtttttttaataatggaatgtaacatctatgtctttactcaaagagctacagttaattattacagaaagctatttttattgttgttaggaatctctaatcagcttcagtgtttgcaagtaactaatttgttcttaattatcattcttggcgaaagagatgtgccaaccaacctctgtactggacgttgttgatgacgagagtaggcaagatggtcacatcccctcgcgatccacggccaatctgatcaaaggcaccaaaaccaccgacgttaatggcttaacacatcatgtaatgcaagagacctgcgagattgtgactggccaacatctctgacacctgaagattaaaacgctaaaaaaaattcttctcctaatgacaccatgaacagtatagtttcagtcactttgcatatatacctgatcttcctgctctttggccaagacggcgttgtcggtgtcggcctctggatcgcccatacattccagcaccttgtcaagcgacagacctaaggaaagaaaaaggtcaagaacaaaagaacatttgctattataaaagcaccaaattcaaattatagtgtctacagataatacgcatgtgcggatatgtttttaatacggagttaggaaagtggatcttttttaaaagttacatatgaacaattgcacatatgtttttaatatggagttaggaaagcggatcttttggaaaagttacatatgcagtatgtttttaatatggagttaggaaagtggatcttttctaaaagttacatatgcacatactacatccgttctaaaatatagtaaccgacgcatcctagtattcatatttatccagatttatagtagtaagatgtgttcaattcagctttagtttgatacacgaaacgatttaactattttttgataaaaaatatgacgtcataaatataaaccactcccattagtgaatttaagtactttttgctggcctctatatctttgtagacatactcaaggtacatgcgtgtgatatgcataatactccctcctttttaaattgatcatcatataaagaaatctaaattttcttaaattgatcatcatataattgcatggacatgaatttcatcggaatacaattaatatagcatgggagaatctgtacatactagggtgtaattgatatggtgttttaatcgatacatacattgtgagagaatgtgtatatgatgtcttgattgatgcaatttaaattatccttgatcttgatgcataagcatatatgatgatcattttgggatggagggagtataatactcaaggtgcgtctttcgtgtaatggcaaattagagcaagtaacgaagaacgatgaactgatcgatgagcatatgcacactgaatgtatggtaccatggatctcattctcacctagggccttgacgacgtcctcggcgcagcccttgctgtacttcttctccttcatggagcacctgatcttgtagtccatgacgtagtcccaccacgcccatggccgcccggtctcgttgccacccggtgcacgcacagctgcctcaggttctccaccaccacgtccttcccctcgtacccctccccgaaatcctgctccgggtccggcgcacaatacctgcacgcacccatcctcaccggagctcgatcaaccactccatcgattcatggcgcatgatggtgtccccaccggagacgaagaagaggatactatgatactctttccgtttttcagtttttcagtgtatgacgtcgttaacttttttttatatgtgtttgatcatacaccttattgaaaaaaaaatgtaatcaccatttatttcattgtaaccttaatttgtcgtcaaatgttttgtaattaagcatgtcttaatttttttaggcaaaattggttatatagcatcgaaaggncacatttttggttttatagcaccgaaagttaccggtcactttaatagcatccaaagttcaccatgttcctatttt

SEQ ID NO: 67194 - DNA, 3001 bp, Oryza sativa
aaaagtaacaatgtccaatattttttaaaaaagaggtacttcatattataagtagtctaagtttaaccaaatttatagaaaacttagcaacatttccgacacaaaagaaaaatattatcaatatacataaatgttagttttagtgaaaccaatttggtgttgtagatgttactaatttttctataaacttaatcaaatttaagtttggatataagaaaagtgaaaacgacgtaataataatataaaatgaaggaagtatgattaaaaaaaaagaaatcgaaacgatttataatctgaaacgaaggaagtcacttgcctgccatggttgatgcactgggacttgcactgctgggtgagcttgaaggcctcggggcagtaccaggtgatgtagtgcggggtgaagagggcgtagccacctctctccatgatctgggcgtggccgcggaagccgcggacgaactccatctgctcgtcgcaccgggcgccgcactcgtcgttgctgttggtccacagctcgtactccacccgctcgtcggggtggggcatcgactcgcgccagtccagcttcaccaccacctccaccgccgcctctgacgacggcgacggcgacgacatcctcttgagggactcgccgaacgcgcggttgaccagcgcggacgggatgctgatccggtcgatgtactccgtctccggcgactcctccggcgtgtccatcgtcagcagctgctcgtccacgttgtccgcgatcagcaccgccgccgcgcccgcctgctgcgcgttccacgccttcagcgcgaagtagcactctgaatatcaacaaacggaacagtttgtcaggctcacatacatacagggggcgtaagtggctaacccggcgtaagcccacttataggtcaaaataaacgggctcgtggtttattttgatttactacagtggatttcgcgggttggtcacttacatcccacatagtcatagtatgtaaggttatcaccgacaaaagaaattaaaccataatgtttattagcgattaaaaataatttattggtaaattttttatatacatgttcttagcgatttaaaagttaatgctgaaaaataaattacggtaaaaaataaccaaaatatacttaaaataaagatttaaaattcaaatagttgactgataagttaaagaataaaaattcaaacgatgaagctgattatctgcattaaaaatattaaaattgcttcttctttattgcaactaaaatgcactgaattgagtgagaatttcagtatattagtacagaataagtgggtcaatttgcaattcctatttcataatctgatggtaaaagtgtcctggtgcagagttcagaatctgatggagagtggcttggaaacgaaggatgaacaggttgttcagtgctgcctttggcttgaaggaattgagagacacctgctgattggtagtggaggagttgtgatcaagtgcgttgcagtggttggatcaaataccgaatcaggtatgagattcaaaattcaaagttgcaatggataaatgtacggcatatgtatcaagaacctattctcgctttccttggttcagagttatctgaaactctgacggaaagaaaggaacaaactcgtcgaaatgcttaaagttgagccgaatcccgaaagtaattaaactaagtgtgtgtttgaatcttataagtagtgaataagaagtggttaacatgtcttcaataatggctctgaactaagattccgtcctagttattggtattatgttaggtagtattctgcaatattggacttgtttttccaggcgaaacaaacaaaacaatttgattcagagtaagtgatctcagttctcaaacaatttcaaaaataaattaaaaagttttggtctaccatcgttcaactctgctttcagaactgaattataaattcccttccctcgccacaataaaaaaaatatatatgaatgcaatctttcagacttctaaagttggacaacaatccacatcaaagaattaaaatactatacaacttaaccatcatgcctaccttgatactctcttgctaaccatttcttttgttgtttttttaatcagtggactagctaaccattggattgacacaacccattaacagaacaaaaattggcatgacttagaacattggaatcaaatcatcaccaaaccaaactctcaaaatccaaataatcatcaaaaactaatactacttctcaagtttgttcagttcagacttgcagactttggaacacaaatttcttgaaaaatacttatgcaaatcaaaacaagcacaaactaattgaatcaatcattggaagtttgaaatcaatctcctacctccacggtcgagcaggaggatgaccgggcggcgagacttggacttgaacttggcgtcgaactcggcgcagccggtggccttcttgtcggggtagacgacgacgccggtgagcgtgccgccgtagtccggcacgccgaagttgccgatggcggcgtcgtggtgcccccggatgtgctccggcgagagcaccctcacgctgctcttctccaccacgaacctccccatcgccggcacggcggcgcccaccaccgccaccacgacgacgatcaagaacggcacggccccaatcccggcgagccatggcgccctcctcgccattgctgcaactcgatcacctctctctctctctctctctctctctctctctctctttccaagaggcgacgagaggaggagggaagaagacgacttcaaagaagaagaagatgatgaagcttatgcttggtgggcaccaagattaggtggctctcgctcgcaagtagtataaattaaatagaaatttaaggaaaaaaatgttcttgctgttaattaacaactgtgagacgagctcaaccgtgcaaaggggaatggatggatggatgaaaaaaaacaaaggatatcacgagaagaagatgaaaaaattgtgatcttttgagaggaaaa

SEQ ID NO: 67195 - DNA, 3940 bp, Oryza sativa
ggaaaaacaagggaaaaataattaattaattttgcatgtctgatggttcacaagttcgatcatattgtccatatggaatatatgccttgtagtgatacgatatttcttcagatgtaacactgcacttgttctgaaactatattatttgagggggtgttatgtgggtgattgcttaccttaatggacacatcatgcccaactaaaatccgtctctgaactttcaatttcttgttgaggacacagtacgtacttgcattgcttgcttcaaagacaactcttgtctgagagagagaggagatccagcagcagtgttctgcaattctatgcgtatggtagaagggaaaagatcaacacacttcctagtctgttcttctggatgggcatattgcaggaattgtgtggatttcatcagaaacaataggtgaaaaatgttgttttttttctggtaaaaagggtcgctttggtaattaacttggtcggctgagtcttgatcgggtttggtctcctgttattagtgcaaccgggcaaagcacggcaggttagagtcgagactgaccgattcttcagtggacacgagtgggttgacggtcacgcgtgctcgttgggtttgggtttgtactgctccgtattcactatctattgacattttaggaagacttgcaaaaagtgatagtatactactacctccatcccaaaatatttgacgccgttgacttttttaaaaatatttgaccgttcgtcttattcaaaaaatttaagtaattgttaattcttttcctatcatttgatttattgttaaatatatttttatgtatacatatagttttacacattttacaaaagtttttgaataagacgaacggtcaaacatatttaaaaaagtcaacggcgtcaaacatttagggaaggagggagtagttgctgagttgagttaggaactccacctccacatacggaaaacaaatattattattaacacatgattaattaaatgttagtctaataaatttaaaaaaatggattaatatgatttttaaaacaactttcttataaaaaaacttgtgaaaaaaaaacatatcatttagcaggttgaataaacgtgtgggcggaaaaaaaagtgtgttgggaaagaaggacgaccatagccttaaaggagattttcttccttctttctcaacttatctccctcgttttctatgcgcgtgcttttcaaactgctaagcagtgtaatttttttttaaaaaaagttatatacggaagttgctttagaaaatcatattaatctatttttaatgtaagccagctctcttgcacactgctatttctaaaagtctggtctcattctaaatgttaggatttgagtttaagattaatttttagtggattttttcggcgctcttaaaaaaattctacctaaacttattctcaacaatcacatttaaaaatgttagcatttgagaaaaagcattgtcaagcgacgccaatgttctaggtatgattccttataatgatcgaatggtagatttttagatatttttttaagaatggttctaacttcgaaatttaattttaggtctagaatgaaattttgaagttacctaaacgcagctatgcctatctaatttattttgtgagagctcttcagccaactccattctatttttgagtgaagtttggttaagcttatgatctaagagtgatggagctgaagataaagccgtgcaaaacgggcctaaatatgtcttaaaaaatactacaatgaaacgtcttattaaaaaataaaataaaattttgtaatatatttttccaatttttgcaatgaaacgtggagggcaatatccacacgagccacgcatcatccagcaaccaaccaaccactactaccactggctacactatgccgttatcctctctctccctcctccccctccaccgcgctccgctcccgccaacttcaaattacccgccaccgccgcctccctctcgcgccctcctcctccccctcctccgccactcgccgctcgcgcgccgctcgcccgtctcccgggcgcgtgccgtagcagccgacggcatggccgcggcgaccgcggcggcggagacgccgcccacgctgctcgagtacatgggccaggctggcgcggccgacgacctcgtcgtcctcgtggcgcacgtccagagcgcgtgcaagcgcatcgccgcgctcgtggcgtcgcccgggaacgccgagctgtcgcgggggaaggcggggggtggtgtggcggtggcggccgggcgggacgcgcccaagccgctcgacgaattgtcggtgcgtgcagtgtcagggttgcgtgggttattattgtctgcattctggttctcgcatctatctacatgcatttcatccttcttcttttttttaaaaaaaaaagaataggtccattttttgtgagattgttatcacatctcagtcatacgcttagcagctggagtagcactcatttggagtgtaaaatgttcatttactaattaagtttacttgaggtaagttgtgcaaagtgcacacaagagactttccccacattttcattcttgcattctcaacaaaatactacttgcatttgtggtgaaccatcaacagaagcacttcctatttgcaaaaaaaaacagttattgtttgtctgatgctactaacttgcattatagcttccaacaacatcaagactaacatatttttcaatttagaatgagatcatcttgtcatcactccgaagatctggaaaggttgcagtgatggcttctgaagaaaatcatctccccatttgggtttccaacgacagcccgtatgttgttgttacggatccgcttgatggttctcgcaacattgaggtatccattcccaccggaacaatatttgggatatacaataggctggcagagcttgaccatctacctgaagaggagagagctcagctcaattcactgcaaagcggcactcaccttgtcgcttcggggtatgtgctgtattcatctgccaccatattctgtatcagcttcggtgcaggtacccatggcttcaccttggatcacttgactggagaatttgttctaacacatccttccatccaaatacccccaagaggtaactaataagctgtaattcaataatttgctaattcccttagtcttcattaaatgttaaccagatgtcacctaaattcacttacactagtagcgcaagttttctcaatttatggattggtggatgaacagtttatcaatgtcagtaatttgaggagatgttttagttgaacagcggcaagagtgcttgcattgtgtttgagaacatgacgtagagaaatttcttataactgaacgactgaaatattaactgtgttgaacttagaaatgcatgctttcatctttgctgaaaagctgtaatcctgagctatgccaggacagatatattcggtgaatgatgcgcggtatttcgactggcctgagggcctaaggaagtacattgacacgatcagacaaggcaagggacagcatccgaagaagtactcggcacggtacgtgtgctcgctggttgctgatttccaccggacgctgatatacggtggagttgccatgaaccccagggatcaccttcggttggtctatgaagcaaatcctctgagtttccttgctgagcaggcagggggcaggggttcagatggcaagagcagaatcctctcgattcagcctgtgaagctgcaccagaggctgccattgttcctgggaggcatggaggacatgcttgagttggaaagctatggagatgtgcaacagaaggttaatcctggatatgaggtgtgaagatatataaccttagataatgaggtctgaagataatgtagcatgcgaaaagagaacagggggacctactggagaactctgtatttgcaaaaccgatgtttttacc

SEQ ID NO: 67196 - DNA, 2411 bp, Oryza sativa
acttgaactgtttttctcaggcaggctggctgacggaacaatcaaaactagagggcatttccggacgtgtgattgcgatgagacgtgttgcaatatccagaccagtggctagacgtgttaattttaacttgatgaaacgtaagaaggctggatccaaactttaattcttttccatcacatcaacctgttatacacacaatttgttatacacacacaatttttcagtccaaaatttacgctgaactaaaaacagccgaagtttgagttggaaaaaaacttttttggatttgttgtgatatgcccattaaacaacttaccaagcgattaaagactgtgctatacgtgtgatccagttgtatgatttatgtataattagagatatacaatcatataattagagacaccgtccatttttgtccatgtgtcataagcataccaattttcggtgattaatcgctaatcgacaaggcgatcacatcaaatatttagacacatgcacggagtattaaatatagaaaaaaaataattatatagattgcgtgtaaattgtgagacaaatcttttaagcctaattgcgccatgatttgataatatgatgctacagtaaacacttgctagtgacggattaattaggcttaatattttatctcgtagtttgcaggcggaatatgtaatttattttgttattagactacgtttaatactttaaatgtgtgtccgtatatctgacggagcacacacaaacttttcacctgaactaaacagtgcctaatttatcggactaatcggccgttttattgcgtccatgaaacaaaaaccgttctgaactgcctcgactcccgtctcctcgccggaaagccgccgccgccgccgcccttctacttccgccgcctcctccttcttctcgagaaggctctgcaccacagacgagagctgagccgcggagcacaatgtcggcggactcggcggcggcggggagggacgctctcctggacgagctgcgcgcgctcatggcggcccactccccgtcgctccacgcgctcgtcgtcccgtccgaggacgcccaccaggtccgtccgcgcccgctgccacctcccgcggagtcgatcagatcagatcgggcttggatttttgttgttgttgttgttggattttccgttttgcgcgatctcttcttcctctcgatgatggttgaggatttgggtgtggttttgtgggtgattgattgattgattgcagagcgagtatgtgtcggagcgggacaagcggcggcagttcgtctccggcttcaccgggagcgctggtatgttgcttcctcaattcatcccttctcgtttcccaggcgatgaacgctgtgtattgtcctagaccaccagccatgagtctgttgcgatgagttcattatacaatagtgcattttgttttatgcactgtttgtacagggtgccaatttttcccttttgtgttaacacaaaaagtggttttttttttgttcgcccgaacttgattcagaaagcggttgcctagtaatagaggctaatggttgaatttttaggagcagttatgttttatgacactgttatgtttttggaaatttaggtgattaacagacatttttggactggattgttttatacattgcttcggccaaacaaatcgtaataaaattattgatagcttcgctaccatttatagttatggtttaatctagctggactaaagtatggaatgataaccacctttgtactgggaggagcttaattgattcctattttgtagtaggatggagttgaatatcataaaatgtggatgtaacatattgaacttgttgatttcttttgttttcccccagttgtcgtaatcagagagttgcattaatttctcagaccgagctatattgcgttgctacacaggtttggcgcttatcactatgaaggaggcgctactttggacggatgggcgttacttcttgcaggcagagcagcaactcactaatcgctggaaattgatgcgcatgggagaagatcccccagttgaagtttggatagctgatgtaagtgttgacatctcttcttgatcatgttcatgagtttaatttcccaagtcttacataataaaaatattggttcacaaaacttgtccatggaaatgaatttatttggttataccctctcatttttttttgaacagccagatcaaaggtttatccttgctttttgaattctgccacagtttttgtgttgtgaaatcccaaaagtggttttattcttgttaattttagctagttttatctcccaaatatggtccttttcattttgttaaccatattcagttgttttgttaataccccaagcctactatctttcttcctgtctgctgtagattcaaggaactgcatgatagttggtttg

SEQ ID NO: 67197 - DNA, 1744 bp, Oryza sativa
  unsure (1)..(1744): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtatcacgtgcaaacatcttgtaagatagtgattttccttccagttgtctaatgattttgtcaaccttacccacatcaaagctttgaggttttatgttgcactcaggaccctctactgttttagcggactgttcttcccctgagattagttttacatcctcgtcaagaggaaatatatacaggtatctcctccatttggctgcaaaattagggtgaaattcacgtgagacctgcaaattatgccatcagttaataacaagcgtagcatcacccatggtggatgtcttgacattctaagaactttacatgaaaaatggacaattctaccactagcagcaatgcagcatacatatcaagtgcagtcatatattctgaaaaagcaaaagaaaaatacctgtgacacatgcaaaggtcttagtttatcaggtgcagccttgtttattgcatcctttatatcactagactttacatccttcctccatgtatctaaggaaattagaagtaaatacacatgtcagctatcaggagaagtaatgtatctagtcccatggtgtatctcagcattccattagagttaatttctcacataagtacacaaggattgtctatttatttgtgcaaatgagttcttcatgtcatatcaaatgaaatgaatggcatgcattggtggagttagtcaaataagaaggttagcagttcattgcacgtaggccagagttctgcactgctatatctccaggctattacttctttgataggaaaacagtggtgtatttggtattgacaaattgttgtgttaatgattttataatcagaagcaaattacttgttcaaatgcttctgtaaacaaagcaaaattttcaaccaaaaaaaaaaaaactctacaaaataactgcacataagctcttcttgagaagtagaccctccatcccaaaatataaggtattttagagttggccacagatattaaagaaaaaggtaaacatgatggatgttgtgattggttgagatgaggaagtaggtggagaaactaaatggggattggtgcgattggttgagaggtggaaaggtagctaaattttggaacaaagggaatagtttgtaatatgacatgttcataaaagtggataattagttgaaggaccactggaaaacaatagtgtgttctcaggtgcaactaacaaaatgagcaaacttgctgaagggcagtcacccctttgtctgtgcgcccagcaacaacagcacagccttctaatggcaatgatcttgcttcaagctgtttagctttcttctcgtcaacaaactggccaagatgtttttctactaacctgcaagaaatacagagtgcaacaaatggttttatcctgtcatctgtcttgagatgcaaaggaagtgaagaataaaagtgccagatatgtctatagaaatgacataactccattcttatttatccttacccttgaacagtgttgaggccaggctgcttctgccaaccatcaaatgaccccccatgatatgaaaggacaatcttgaaggttactctttcccatcgtcctcctcgatctttggatgatttagttgatgt

SEQ ID NO: 67198 - DNA, 17584 bp, Oryza sativa
cctccaagaaaaaatgtgttcacccaaaagatttcaatttctctaaacgatgtgtactacttagatggggaaaataccaacatttggctcactaagagaaattgcaactaatactaacacattttccccttcccatttactgaatgcgaagaaccactacctcagggtttcacatggataattctagaaacaggcctgcaccgacaaattccaaaatcttaatctatcctccaagaaaaaaatgtcttcacccaaaagatttcaatttctctaaaacaatgtgtactacttagatggggaaagtaccaacatttggcacactaagaggaattgcaactaacactaacacattttccccttccaatttaccgaatgcgaagaaccactacctcagggtttcacatggataattatttaaaaaataataatatcattccttctcacctcatccttcccaaacaaatcggcgagccccgctgccccggcgccggtgcgcacgagctcggcgtagaagtcgaccaccctgctccacggccgcgcgtacatgtactcgtagctctccctgccgcagccgcagtgcccaaccaaaaccaaaacagttactaccaatcaagccccaagccgcagataagccctagacgatggaggaagtgatgggggggagccgttacttggctgtccaccggaggtggtggcacgcgtcggtgtggttgtagtgcgcgtgttcgtctccctccgccgccgccgtggaaaacgacaaagccggagctggcttcgccgccgccgccgccgccgccgccgccgtcgccatgaggggccggagcttcgcgagcatgttcttccctttttctttttgaccgtaatttgaccgtaatttttttcaagaaaagaaaagaaagatggttgttgtacaatttgaatccatggattagcacaatttgaccgtaatttttttcaagaaaagaaaagaaagatggttgttgtacattaccttggagagaaatttagagatccttatcctctcactctcactctctcgttctctctctctcccactctctctctctcgttactcttcaagccggctgacgggggcaaggagggggggcgtccaggtgtagatcggggtggagacggcaattctggtggcggctaactggcctggcaaccagatcggtaagatgggtgtatgggcggcgcggatgctaggggacggcgacggcgaattcgatgcggcgtctttccggtcccctctcgcacagatccgtcatcagctgcgacgggaggggttggatccggcgacctgttcctctcccgctcagatcccgttgtctctccgtgccccgctcacgcagatccgccgccggtgttaacgggagggtcaagatccggcggttctaccgtggtcgtggcctccctaccgccgccgcctctgcacgcgcggcccctacgccgcccccgcccctgctgcctccttctcccccacgccgtcttcgatggctgcgataaggggcggcggcggcggcggtgggaggcgctagaggaagggatatgaaggggaggcgcatggtccggtgggtgaagaatgaagaagtgggcggtcgatgagatggaggcgaaggtggcgagaggtggtcgccaagacctccgtcgagcatctggatccggcatcccttatcctagcgactgatggcgctggcgcgttcctcatccatctcgatctgacagcgccgccgtaggaggaggtcaccatctaccagtccaacgacgccaatgtgagtcctcaacccaatcatccagacactttcctctgcatcctcttttgattttctcttctatccaggatacttggtgctatcttttggtttgtgctttcaccgataagtcaggggacccggtgttggttgctaagcacatcgcatttgaggatgcaacttctttttaagtccttatggggttcaccacattccattagctcatcagatttgtctctgcttcttctggtggagaaccgtgtttgacaacactccttatgtagtcatagtgtccaagctacatacactgcagataatctagttgtgtattaatctacatttcttcagatcttcagaaacatcatccggctcactggagctatgctgataggcaagccttacgggagaaacaatgtccgcattatactgaatttctttcgaggccaggctgcggccggctgagttcgaggagagttggcccgcgccgtgcttgccaacgaccgacgtccttgactcgccgtcagttccagccactgcctcccaggtgctttattttttaagacaatatatcatgttgttgatgtgaaattttgggatcatcttgtatagtagtaatccggttgcttagaaattagaatacggttcttatctgagcttgtgttttgaaatgtggaattgctggacaacagttttgtgatcatgcttttatgttgtttataatatcatttacatcccatgttacatattttcctttgcttaaactaaattgagagttgaatccactgtcatttatttgtttcaagtattattttttgtgattctcagcattacattttcactctgatactcccaccgttccaaaatgtaatgtgttttagttttatcctaactcaaagttatcttccttttagaaaataatctgggtatttgatgcaagtacagtatgatctaacctggtcagcattcttatataatgagttattctttgtaatgagctagaagttatagatataatttattcgttaaatccatagtatattttcatcacaaaattaaaaattagaagtgattttttgcttctctctgaagtcatgagtacattgtgactacatatgatggtgaaactggtctggtagaggggtcaaattatctgttagtaaaaaaacttgaagcatatattgtttaactttattagatttagcatgcgatgagctttgctgatcaccttcataattaatgcaatgtgcgtccttaacatttggaaggacatttgaatccttttttcgcttataggcgtcatgacgtttcttaagtattccttcttttcgtcaggcattttgcgcatacagctttgtgtctctgtcttcgtgtattgggatctaagaatggggacgatgatccagatggcgcatctagcttggaagatgaagctgtacataaacattatcaacaacaaaagcatgatgtatcttctcgaaaacaacggtgagaagcaaaaataatttaatcattcacttatgttttttcagctgattttgttcatttaaatgagccgcaggatgtgtttatatatgtgttggacttcgatggaatcaattaatacaccaattcttttggtggggattattctatctcaatgttgagatagcttgcctgagcaaggtcagttatcaattttgtgcaaactacagccatactactgcaaccaatttttttttctcttccaatgtaatatctgatcacatggttgtttcctgctctgttttggttgcgatgtgcatgcttcattggtcatctgtttggaaacactcaattctgacatgtaccaatgtagtaccaaaaatttcatgtcttagtttgctatgccatgatgcttgatctaaagaaacttttgttctgatatgcgatagaggttccacttgattttctaggcaagttattcgttattgttttgttttactaatgttccataatattcttttatgtgttctctatatgcaaatactgttaagtttttttttatgctttacttatgctatttgaaatacctttcacgttatggccctaggaagtaataggggaactcaagcaacagttatgtacacaaaacaccaagctataggccaaacatttaaactttatacgtaggtcttcttttgtgtgcgcgcgtagttaagggaaattgtttggcagactatacatccgaaatcagaaataagtgtagcaaataaaaatataatgaagtaatagtggtattattttggttaatagtttggtgtgataatttttttttggatttgctaaatttctggcaccataaaattccattgattacagtcggtttgcatgcctatgcgctatgccacacaaccgcacaggcctgaggcctcccaactgtgcttccgtgaggttgaagattatttccacacatacatcatgatgagagatgattatatattaattacatatatgcaatttcgagacttacatatgtaattttgagacttacatatgtaagtttgtgacttacattgtaaatacaataaaattgcatatgtaatttataaacttacgatgtaaatacacaccgactattttttggtgaaaaatatggcgccataaatatagctactccccttttttttagctaatagaagatggatggttttttcttcagaattactaataaaagatggttgcctcttaaataaggtatgagatccgatcaatctggtgttaccttgctgagcttggtagttttatttccatgtattttttccctcttaagattgactgatttatgttaattgttcgttatatgtcataaataatgtatacatcattaaggtctaaagaattaccttttatcgttataaatgcagtaaaagcagattgagtctcacaccgaacatgaattgctcagtttcaaaaaaatatctgggtatatgagtagcgccgagcagagattgcttagttccacaccaaattctgggtgcatatattagtcttgtttgtgctttcagttttattctatatataggttgagaagttgtttgtatcctaatcggtcatgtaattcttatgtttgggttctatgtaatttatgtgctggactgaatttgtaattcctgggcaatgggcccaaaaataccgcatgcgggaactggagacggacagctaaaaaaacgcgtgcattgaaaaaaaggcggactcactaaaaagagcgtgtgcgcaaaaaaaaggtggatgggcccacagaaaaccgcgtgcgaaaaaaaccctgacggacaaaaaaaaccgcgcgaaaaaaaaacggacagaaaaaaaccgccgtgcgcgtgtgggaaatcggcgacggaccaaaaataatgacggaagccttaagaatttttttattaggtatagatttgacaaatttcctttcctacatgtgtcggtcagtgtatttccctgcatggtttcctatcaaaaaaagaccaagaaaacaggtgtttggttgtgattagttcacgctaaaattagaagtttgattgaaattggaatgatgtgacggaaaagttaaaagtttatgtgtgtaggaaaattttgatgtgatggtgacggagctcgtggctcctcaccgggagaccgcgcaggcccccctttgccggttcggccgggggcttagggtgaaatctcaagctctcgctctccctctgtatctggaaagatcgtctgcccgcaagacacacgagacacgacgatgtatacaggttcgggccgctgcgaagcgtaataccctactcctgtgtttttgtggatttgtgtatggacaagttacaaaggatcgacttcctttcctctcagccttccgaaaggaccaaaaatcccccgttctaagctctaaatctcgaaaagaatcccccccctctctatgggcaaggtcctccttttatacttcaaggggataccacatgcacccttccctttccaaactggacttttcttctctttatggacggagattggtatggttgctgtccgaatgacactccgatgggacagcccacacctacctccactcccggcggagacaggcgcaacgtgggatcgtggctgcccgttgctgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccagcttgagacgagtgcctagaggctttcgtcttgacgggatggggcaaggcgtgcgtcagaccgccagtcgccacctaacccgtgatctgaccggtctgtgactggtcacagaccggataaagaaacgcgctgtactgcgttgcatgcagcgtgacacgcttgaccagactgcaataaatgctgttaggtgagcacagctgtgatcacttatcccatgtatgtggcgcagacttccttaaggggtcggggtgcctcggccctcggggccggggcaagcgcaaccagacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacgccacttgagcagcgcgcgaatctgggtgagcagatttgtctcgcccggagatatggtaacgccgcttcggtcggcgagcgtaattaacgcgcgcacgatacaatccatttcgattgccacaaccgcatatccactcaatgcgccgcaagcgggcgaatgggattagtggaagcgtgggcacgggaaacgagggagcgagatagcgagatacgagggagcgaggtagtgggcgcgagaaacgaggagtcaggcccagcgatggcaagggtataaaagcatcgagaaaaggatttgcttccttcctttcgccattgttcctcttgccttcgccacctgagctctaactctttctctgctacgccctactttcgccacacgcgctcgttctcaatcatctcttcctccgccgccatggcacggggctctgctctgctcgacggcagtgtactaccgccttcccgcatcgtgaatgagaggcacgccggactgccgcgccgcttcatgccggagtccgccaccggtcgggagatagtgatgctgggcgaggggcgcccggcaccagactacccggggcggtccatcttcttcctcccctttgcgatggctgggctggtcccgccattttctcatttcttcatggatgtcctggagttctatgacctccagatggcgcacctcacccctaatgcggtgatgacattggccatcttcgcgcatctgtgcgagatgttcatcggggtgcgcccctctcttcagctgttccggtggttcttcaccgtgcagtcggtgtcaccgccgtcggtggttggcggctgctacttccagccgcgggggccggtgttgaaccgctacatcccctgcgtccttcgcaagaagtgggacgactggaagagcgactggttctacacccccctcgccaacgaagcgcgcctccgacttccaagccagcccccggcgcaggtctccagctggcgggcaccggtagatctgggggaggactacgacgccgtcctcgaccgcctggcgggcctgcgatcccaggggctcaccggggccatggtgtacggcgattacctccgtcgccggattgcgccgctccaacggcgcgcccggaacgcctgggagtacactgggcctgaagactacatgcggacccaccagggagccagatgggattgggctcccgaggacttcaagatcgtggtccaaagggtgctgaatcttagctccgcggaggcgtctcgcattcctcaggagatcctccccctctgcagcgatcccgaccgcgcctccattctaaccattatgatgggggtcggggcctcagaggagagagcccctaagggcccgacggcgcgggcgagcgccgccgaggggaacaatctgccccaggagggggtcgtgcttctgggccccgcgccgggggctcggggagcagccgccctgccgacgcccaggggaagaggaagctgggaggaacacctcccccatctcctccccgagggggcggggcggcgcgtgccagcagtcggcgcccggagggggccgcgccgacgtcgcagcccgagggggagcgcaagaagaaacggctccgcaagacgggggagacggaaccatgccgggggaacctgatttctcctccaaggtggtcattcaaccgaccccctcgcaggttcgtctcactctcattgcaaccacctttctcccaaagagaagttttttcttactcattttgttcgtcttttggttttttcttctgcttcagcgatgtcccgtcgcattcctcccgccaccccaaatccggccagtccgaggccgaagatccagcggccgcagaggagcggaggcgagagtctgaccggcgtgaagccgcagcccgccttcgggaagctgaagaggccgcccgggttcgccaagcggaggaagctgctcgggaggaggccgcccgggctcgccaagccgaagaagctgcccgggaggaggccgcccgggctcgccaggctgaggcgacagctgctgctggcgcgtcacttgggcctactcccttgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgccttttctccaaggcggctcttctcctcatcttctgtcgccccgctgagcgccgagccccttctgcaggccctggccgccgcaaacaccgcagtgctggatgggttcaacacccaagtggaggccctgcgtgcagaacgagcggagctcgaggccgcatgggcgcgtgttgaggaggggcggcgctcggtggacgccatggtggaggtgggccgtaaggctcaccgccgtcatgtctcggagcttgaagcccggaaagcggcgctggcggagatcgcccgtgaggtggaggaggagcgggcggccgccctcatctccaccaccgcgatgatcgaggcgcaagacactctccgccttcagcacgcaagctgggaggcggagctgaagaaaaagctcgacgccgcccaaggggtccttgactccgccgctgcccgagagcggcgggtaacggagactgaagcggcgtttcagcggcgcgaggaggcccttgaggcccgtgccatggcgctggaagaacacgccggcgccgtggagaggggcttgacggaccgcgaggccgccgctggtctccgagaggcgacgctggcggcgcatgaggccgcctgcgccgaggaggagtgcgcgctccgcctccgcgaggacgcactcgctgagtgggagcgagctctcgaggaggctgaggccacgaccaaacggctggcggacagcctgtcccttcgcgaggcggcgcaggaggagcaggcgcgccgcaatctcgaatgcgtccgcgccgagagagccacactggagcagcgggctgctgacctcgaggcgcgggaaaagagctggacgcaagggcgcctatcggcggggcggccgcgggcgaaagcgacttagccgcccgcctcgcagctgccgaacacaccgtcgcggaaatgcagcgagcgctggactcctccaccggggaggccgaggcccttcgcttggcgggcgagattgggcccgacatgctttgggatgcggtctcccgcatgaagcgcgccggtcgtcaagcaggcctctggagaggccagacgacggtgccccccaccaatctggaaggcctcgctccgcacctcaacaggatggcctgggtcctcgaacgactccccgaggagctcgagaagaccatcaagtcatcctcgagggacctcgcccggggggcggttgaactcgtgctagcgagttaccaggcccgggaccccaatttctctccctggatggcgctggaggagttccctcccgggaccgaggacgacgcgcgcgcgcgcgtcggggatgctgctgaccacatcgtcaacggcttcgagggctcggcccctcggctcgcgttcgcccccagctccgacgaggagggcgacgccagcggcgaggacgacggtggcgacgaggccggcgacccgggcgcatttgaatgagcccccaggcccccgccaatcttaacttttttcttgttctttcttctaaggccttcatgcctcttttttgtacaatttaacttaatctgcaatgagaaatgatgaaaaaatttttgtgttagttttattttgctatatgtgagatgaggatgatctgtgccgtggtctttttgcgtcttagcttgaaataagggcccatgcccaagtcccagtcctcgaaaagcgcgggtcggggctagtgcctggggagatccgcatgtcgagactggccaggccgggaacgtggtgaccgagggttatgggtgacccaattgtgggtttttgccgattcccccccggagttcaccacgccccggggcacggctcggttctgggccccgtttggcgattttagctgaccgaaccgagcccccgagggcaaggttgagcacgagtgacattatttcaagtcaagattcttcaaaaggaaaaaacggcacagacacaacctttagaaaattgaaactgcttttattgaaatgctgaaataaaggaaaaagggatatatgtgcatgtgtggtagcccccggccaatcctgcacacccgaggggggtgcggggttggcccgagccaaaacctgacacccgaccccccccctttcaggggtagaagcgacgaaggtgttcgatgttccacgggtttggcagctccgtgccgtcgcccgtggccagccgtaccgagcccggccgggggacaccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaagctctgctggtagcgcgcggctcggagggccgcgcgccgccttcgctcttctaagtagtagaggtcatctctgcgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggtactccaaaacgggccgtgatgcccttaatgaatttgagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcgtcattgagagctgtcggccaataaaatccttgacgaaaggccttgccaaccagggtacgcgaggcggaatgggctccgcactcgccctcatggatgtcagcaagaagctcaacgccttgttcctgaggaatgcatttcaggaggattccgttagccgcgcgccgatagagggtcccttctaccagcacgtagcgtttggaaatgcgttgtacacgttcactcccttcgcggtcctcaggtagagtcttatctgtgaggtatgtttggatctcagagatccaggcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccttgagagttcatcggcaactatgttatcccttctgggtacatgccgaagttctatcccatcgaaatggcgctccatacgccgcacttggcgtacgtaggcgtccatctgtgggtcagagcaccggtactccttacagacctggttaacgactagctgggagtcgcctaataccaagaggcggcggatccccagtccagctgccactctgagtccggcaaggagtccctcgtactctgtcatattgttagtcgctcgaaagtcgagacggaccaagtatctgaggacgtctccgttcggagaggtcaacgtgacccccgcaccggcaccctggagggacagagaaccatcgaactgcatcacccagtaggtggtgtgaggcagctgcgaggggttcgtgctggcctcggggattgagacggtctctggagccggggtccactctaccacaaaatcggcgagggcctggctcttgatagcgtggcgtggttcaaagtgcagatcgaattcagaaagctcgattgcccattttaccacccgtcctgtaccctctcgattatgcaagatttgcccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacgggccgctgcacctttcggcggggccgatccccttcgctaggggccgtatccccggggcgttcttcatccaagtggcctctcggggtgcactcgtcttctgtgccgatgacctcggggtcggaggacgacaggagcggccttcccacagtggcctcggggccgtcctgggggtcgggggctcctggcgtcatcggacaagcgggcaaggggccagctccggtcgtcaggggcctcaggcctcctttcggctcgggggcctcttctccctgctctctcccgggtcgagtcagcacagggttagcctcggggccaaagggcgataagtgcggccttccctcagtggcctcggggccttcctgagggtcgggggcacccagcaccgtctgacaagcgggcagagggccgactccggtcgtcgggggccttaggccaccgttcgactcgggggcctctcctccctgcctgctcccgggccaagtcggcacagagtgggggtgcgcagaatgaggattgtcctcatcgcgctccacaaccaacgctgcactaactacttggggggtcgctgctaagtaaagtaacagggactcatttggctccggggcgactagaaccgggggagagctaagatacgcctttaactgagtaagggcatgttcagcttcctccgtccaagtgaacggcccggagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcagggttcagctttatgcgggcggagcggaggttctcaaaagtttccgctagatctgaaagtaaagtttcttggttgcgcgtttttacaaccaagtcatcaacataagcctcaacattacgtcctatttggctacccaaagaaattcgagtagtacgttgaaaagtaggacctgcattctttaacccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccaatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggcccccggggcccggcatcttcatctggaggtaggcgtagtggaccgccgccatgaacttcaccaacgcgggtctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgtgggggaaaggatgttgagagccgctcctccatctatgaggacacgccccaacttcacgttgcagatagtgggggaaaccaccatcgcaatctgccctccccgggcaacgcacggtgggtggtcggtctgatcaaaggtgagggccacctccgaccaccgcgcccgacgcgtcgcctcatgagtaggggccgcggctagaagctctcgcttcatagccttgaagctccggcgagaaacgtgagcacacgctcccccgtcgacagtggcaatggtggccccaggttcttggaaacctaggtcatcatcaccgtcatcggggtcaacggcgggggccttctgtctggcctcacttcgccgtctaccggagggaactgccgcggacttgccctcacggcgttcctgcctcctgtcctcctcccacttcctcgttcgctcagccaaatttttgactgcacgacagtccgcgagatcgtggagggaggtgttgtggacggagcaccacttgctggctgggcgctcccggttgggagtaccagcctctttctttttgtcgctcgcaggcctcccctttcgggtggcccgcggagcgccctcgacggcgaggacgtgcccctcgtcgccggaatgggccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtcgtgtcgaggtgacattctggacgaggaggcgccctccgttgcacggggagtacgccggctattacgcctgcgctcgatgttgaggcgggcatccggctccccatgctgatcctcccgagtcgacggtgtcgacgagggagtggcagccgaatgacgtgcagccgccgccgctcgccgcgccctccgccttgatgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgtggattcggctccccgtcgtcgccgctcacactcggagagaggtcgtgcgcttttccctgctcggccattaggctgaacaagaaaaacttggcgcacacggaagagtctgagagctcagaaaacacacgctgagccccctacctggcgcgccagatgacggagctcgtggctcctcaccgggagaccgcgcaggcccccctttgccggttcggccgggggcttagggtgaaatctcaagctctcgctctccctctgtatctggaaagatcgtctgcccgcaagacacacgagacacgacgatgtatacaggttcgggccgctgcgaagcgtaataccctactcctgtgtttttgtggatttgtgtatggacaagttacaaaggatcgacttcctttcctctcagccttccgaaaggaccaaaaatcccccgttctaagctctaaatctcgaaaagaatcccccccctctctatgggcaaggtcctccttttatacttcaaggggataccacatgcacccttccctttccaaactggacttttcttctctttatggacggagattggtatggttg

SEQ ID NO: 67199 - DNA, 3157 bp, Oryza sativa
attcctgcagcccagaaacgcgctgtactgcgttgcatgcagcgtgacacgcttgaccagactgcaataaatgctgttaggtgagcacagctgtgatcacttatcccatgtatgtggcgcagacttccttaaggggtcggggtgcctcggccctcggggccggggcaagcgcaacccgacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagatggaaaagttgaaagtttgaagaaaaagttggaaactaaaccagcccattgaagtgaaagtctgggttcttatacaacttcaaattatttttttcttaggtcttaacctacagtgtatttagtagtactcgtaaaactaagaggcttgaatcagtgtttgttcagttttcttttttactttaattacgtgtggttgcagttagaagctaacaatgaaggtttcgtgactgcagctgcgccgcagcaacattaccctaccaaatagtctcagtaaaaatttaaggaatttaagttgcattggagttatacaattcttagcttctattttcatattttgtgtaataaaattttattctatgtgataatttataggccgtcaatgtagtgatttttttttttaactatccttattataatataataaatagatgtaaagtgagctacctcaactggttatattcgttagattctttttttagtggaattaactcactaggggatgctcgcatttacatttacttattgtttcagtggtagatgatatatcctcgatagtgatgtgtcattcaagcatactcttgtatctcacattcctaataatttccagatgggcagtgaaaacaaaaccatactccaaaaacaaactgtcaacaaacggacactgattcatcttatatttttccatcttcttgttgatttcctgtagaactgtaccaagtttgcaaggacatcatcatctatacagaaaagtcaaaaacactcgagcagcaacaacactgacacatcgattatgatgtggatcttcctcttcccagagaatggtttcaagtttacaacacgaacttttcgtcgcggcaggcatctcacattacaaatgctttccacaacgctcctctctacatacaattgctagtcggaacagcaagaaacctaacgaggtagagtcttccgccatcagaaaaaattttaacaccaactttgactctgatcgatcttgacaacaagatggatggatggcaatgcgaaatcgccggtagcgaaaacttgaatcgtcataaaaaacttctgtgtgacttttatatcttgtacaaatcctcgtccggtggatcctttatgcttccatctctggaaggggatgacaatgcctccaggcctggctgctggccatcagagtctggagatgggatgtacagcttgcattccaaagacggctcgctcttgctccggccattccctggccgtgttctcctgctctgaggcacgggttttccatttaccggtgccggtgccacggtgaccgtttttgctgctggttgttcttgttttatcttctccggctcgacgctctccgtagggtcctttgcaacctcgtagagtgtcactgcacccgtcatgcagttctgcaagagtatgtcttggcattcaggcatgttttgcacagcctcaaaggtctcaacaacctggctcatggtgggtcgtcctttgggattctggctcaagcatcggtacgcaaggcctgccacctcaatggcagccttggtggagtactgcccttccattcttggatcgataatcctgaacagcttccgattgtgcacgaggaggggacgtgcccactcaactaggttgtgctcacggctaggccggctcttgtccacagccctcctgcctatgatcatctcgagaaggacgacaccaaagccatagacatcacttcgtgctgtcagatggcctgtaacagatcaaactggttagagtaacaatttaacatacatgatgtcagctacaatgatatgcatattcatacttaagaacattaaatgcactcaagaatgaacgggttggcattctaaaaatacagggagattccattgctcacctgtcatgacatattcaggagctgcatagccataagtacccatgacccgagttgatacatgggtttggtctccactaggtccagttcgtgctaggccaaagtctgacagcttggcattataatcctgcagaggtgacacagagtgagactgcggcagtatcataagataatcgtcaacatataacatcccaagatctgaaataagatatttagatcagtattccttgtgcagagttgcatggtttaattggatggatgagggcacacataatatctactatttaaagtggaaccatggaggaggaccagggacaaataaatgattgatcaagtgtttcatttgtaatcgtccttacatactttttgctgtgtcacactaataaattgagaatattaaaaagatttcagtcgaaatatcagtggtaaacaggactgtgttgaagagcaagcgggaccagatccaaactggtacgttattgagatcgctgatgtttagaatcttactgctgaaagaattgaatcattcattcatcagaagatttagtagctttgaccatgctggcagcaactgaaaccaccatgacggtttggagggcaagcacactattctatcactacttcagaatcttggattctgtaaagacagttatgggccttatggctagcatgtaggctaagttatccggttaactgttagttctgtcattccaagagttcagaacaatgtaggaaatggaatcttgtctgggttggaaagaacaaagttgctagagcctgatgagatggaattcctataacaagtgattgaaaaagggtaatgatatcaaagtattcagatagtagatgaagtacaaaccgcatctaacaagatgtttgatgttttgaaatctcgatatataattgatctctcagctccgtgaagatattccagcccccttgcagcacctagagcaatc

SEQ ID NO: 67200 - DNA, 8193 bp, Oryza sativa
ttgtgaaacggagggagtagctagttgggacttggaagaacttcaaaacatatgctaaccattatcgtttcaaaagaaaatcctttatttttgaaaattacatggagggaacgggtacacagatacaactaaattgtatatagtggtcactactcattagattaaattgcaccagtaaatcgagcactgaaagaaatataagtgtgaatgcatttatattaattctactgatagatctgctcatcttgttgaaaataaattagtgtttttgttcatgcagcgtgcaccaaactgaccattttcctttttacttttgaaaatgcaaaaacaataaacatgttgcaggttctgctgccatggacaacggccattcagtaggtgggagtgataactgtcaagaaggaaagggtcagcttacggcgaaaaagatgcttttcaaggctgccgcaagccatgtactcgtaaacaagcagtctatgagagccttcacagcaatacccaatcagttcgactagatttggatggctaagttgcccaaggtagttgacttctgcctggaaacaaataataaaactataagtatctgatatatgctgtttaatcaaacactaatcagtataaaagtactctttcaatgtccttgcttaaaatcataaaatgtaaataagtcaggtaatatagaaactacaataacaaacaactattatgatcattaaattgaatcgtaaaatctaattagctgatgaaggctgatagacttgtgtatagttcatcatggtttcaaaaaaaatgaaataaagcaaggatacttaccaaccattccttgtcaccctgaaatccctctgggtttaattctttcacagcaacttgtgtggatggaaagcccgctctaacattttcatcaattacacctttgtaaacaacaccaaacccaccctctccaagaatttggtcaggccggaagttttttgtggctgctcttagttcattatatgtgaaaatattaacatttccgtatccttcgatttgcaggtcctccacatcttttggaggggcaaggacacttgctgtagctttagaatcagatttgcatttccttaacccatctggcccaccagcttctgcttatagaattaatagaaaagaaaaaacatcagggaataatcaattacatacgaacattaagagctacaatgtggcgtgattattttgccttagtactttagttttttaattcatataacaccccccatacagctcctgctgtgcagtctctgtaatgttgttgtgcattatgtcaaaatgataatctgataagcataacatcttagtttgtaaataccactaacctacccaaaatggtgttcatcttctaacttaagaaacatgtgttccattgtgtcaagctacaatgtcattttgcaatagctctacagcaacaaaagtattcattgatcatcctccacgttcaagtggcaggttaatgtgcagctaaaggccatgacatgacaaaggaaggtcccaatttaatttggtatctcaataaaattctagaatagctccaaacacgcatttgctgctcatggtcctatatgcaggacaacatttgtcatctcttccagtctctgaacaagaatcttctatgcagaacagaccatttgcatctaagttatagggttactcgatacttccatccaaccaacttaaaatcttctagcagctttgccaatgtagttcaaaccaagttatgagctaaatttgacttgctgcagtttgacttttcaggaaccgtgactgcaaatttcatagacaacataccagtacatcataatatcgtgtcctctaccagccatcaaagagcaaagtttgtaccatgcaagtttcgtctttgtcaaagaaaaaagagaaactaagctacagatagaggcctgaatgtaacgatgtccaataagataaaacttttagcacttagagaatggcattcctcacactcgacactcagtcacagaagaatcaaacatcaaccacgcgatgcctaaaaaacccgaatttgcaacacgagttactacatgatatagccccagagacaaaattgatcctgtcggaactctgacataaacgagacagcaattctcgctcaaaaaccaaatcttctgaagctgaatatacgctgaaaatccatagcccccaatacgcccaaaaacccaaccgcacgactaaattcacaaccaaattacaacaaaaacttcacttccatgcaacatgcacacagctactactactactacaagcaaaaacacacatcagagactaagtaagatatatatagctcgaggcaagaaagaacacggacgaacctgtcttgccctggagccggtgctcctccagcgagaagcatccgcccatgggagcccccaacaccgcgcctcccactccaatccgccgctccccctactcccgcctccccatcgccagcctcctgccagatccactcccaagaacacacaccaccaccagtccaccaccaccaacccaagccccgcgcaccaacccggaaatttcgcccgcaccgactccgccgcttggttgggcggaattgctccgccgccgccgccctccgaccgccggtggatggatggattcgcgcgcaaccgtcgccgaaatttctggtgcgttcttggatgcggcttttcttttttcctttgttttactttgggcgttggagaagacgaagaaagaaaaaaaaaacaagaaaaagaggaggatttggattagctgtgccagagggaagcgagagtaaaaggaagctgctttggattaataaatgcagcaggggaagcaactggggagctgagctgaggcttggttttttttttcctttctttttcttttctctcttgttgctttatggttggattggagaggcttggagtttatgggggtttgattaatgtgctgcatggttgaaaagaggatttggccgtgacagtggtttagtttgggttttagttaggatggtttttttttctttttttgactgatggcatcatggttaattggttattaagtgatatatggccatatgagtttatttggtaaaaatatagcatcatatttttcacttaattttactcatttttttctttatgtgattgattcaaatatgcgcatgtttatgtttttgacagattgtttcaaatgcttaaatttaattagccaaggaaatatcatatacgtgacacgtctggctaaaattagggtttgtttagatcccatgacaaaatttttcattatgtcatattgaatgtttggacacatatatagagtattaaatattaaaaaaatacatagattacgtgtaaattgcgagacgaatcttttaagcctaattgcttaatgatttgacaatgtagtgctacagtaaatatttgctgatgacagattaattagacttaataaattcgtctcacagtttacagacggaatcttaatttgttttcttattaatctatatttaatacttcaaatgtgtgtatgtatattcgatgtgacacgtcaaaactttacacccatagatttaaacacctcatttgacacgattaaaagacacaagaacaaaacaaagctaggtctttgtaataaatttatcaatgagtttccgagggacagaaatccctgtgctgtgcctgtgatgcccttttgagttttttgacaatggcacctgaaatggaagactagcaacaccaccagaccagaccgtcggttgcattttgcattgcgaattcgcaacacggccggagagaggtttgtctcctttagctgttgaacctactgcccaaagactccaagaaacggcagaaaaataccccaacacggcaacagcaaacagcaactccacacgaactctacaactacaagttcgcaaaacaaggggctgtttccttgtcccggttcagcgcatgtccccgattccaggtgctcctcggatttgtttttcttttcatcatcaaaccaatcgatcgatcgccaccaatccatccatccatccaccgtgcgtatcaatcattttcttggccaccatatgtttggtgttctgggagacgcaatttggcgtggaaaaacaatgtgattggcatggactcggtacgcctaaatccgaaccaaatccaagacaccacatgggggcgcgaggcgtacgtccacatgggagcagagccatctgtattgtagtactactagtactccccgaaccattttaaatgcagtgaccgtatatcttattttaaaaaattattaaaaaaataaagataataagttatgcataaaatattattcatgttttatcatcaaatagcaacaaaaatattaattataaaaaaaataaataagatggatggttaaacgttagacacggaaatttgtagatgcacttcaaatggaacggagggagtagcattgcatttgctatgctttgggaacgagttgttttgtggttgcccaaagttgcgagatccaggtttggaaggttccatggaatgatttaagaaatggcattagcgaggagaggggatgcttttgagtgggcggcagcatggcatgaatcaatcaaccaccgtgtcaaagtgctcgccaccacccccgtttctccactcggttttgtttgtgcttagcggaatccatttctgtacgccttccaatcacatcctctgcccactaactccagcaggagtacacaacttgttattacaagtgtgacagcttcatcatcatcattgcaataactcgaaatcttagaaaatactggtaattgcggtggtagagtagatagatacgaaaccaatctggagttgtactttggtgaggacgcgggaacggaggattttcggggcggaaaacgcccaaaaaagaggtcgccatccactccaccaccacgcgcgcgcgcacgcggtttgtctctcgcccttcttctcccggtcccccgcgtgccgacccctcctcctcgcctcgtctcgccacgcgcgctcgttctgcctcgcacgacgacgtacgccacctgccaaagcgccaacccagcgccgaaccggcgccgccgattttacatcggagaccttgatcgagcatttcacgtctgccttgtaaaaaaaaaacgtactactacatttaaatttaaagatttattagttgttttacttttaaactttggaactaacagtttatttatcgaggaactcttatacaattgctataaataaatgcaaactggatagttctgattgtttcgctgacgaagggcatgtagacctctcaaaaagcacctatgtagttctatctcttctctattttttaaaaacttacaaccaacaaattaatcaccttctcatgttctgtttatggaggatgtgaaccaacgcatgaacaaattaggatcaaagatgctagtggaagacaaaggggtggtaaagctaacaatcaggagtaatcgtatggcacagaggggcacactgtggcacacatagtatatgtggtagaggggccatcaacgactcgatgttaacgccaccgtggcagtgatggaggggctcacgtgatggcctgttgcggctatgtgacatgggacataggttagcgtctatagtgaaatggggttggtgctaattaatatggtagagcacacctagctgaatatcgagcggtgcgtcagtcgatgtaatacatttgacagagatacaagatgacgactcgatgaggcataggtggggaggagcacgtggacataatgagaataatcctacaatgatacaggttttagtgtagatgctacttaacaattcttattcacgggaaccgaaagattcaattcgtactttgtagggctggtgttgctgctgtctgcgtaggctactagtcttttatgtaccagtatctcaccgacgaaaaatgagagataacatactttttttctaacttttttttttctaaaacaagactatagtttaaattcaattgatttttaattagcaagtgcatatattgttatgtccatgcagcgtgagagctacacatgaaagaaggtccacgggaagaactagaattcggcattataaagggggtagcgcacgagacctaaaagtggatggatgcggagacaagaatttaaaaaggttcaggccctctcaatgagaggtaataccctactcctatttagggatttgaattcgtcgggttgtagtattgatctgacgatcggattgtgaatctctgcccatgccccttggagggggctccttgcccgccttatataggttggggggcagggttacaaaggaaaaacctagccggacacgttatcagtatcctaatctattactccctccatcccaaaatataagcatttttggaccctgacacggtcttcgagatgctactttgactaacaatatctatagaagtaagatgttttaaataaaaagagttgtatattatgatagtttgtttaatgataaatctaataacatcaactttacatgattgatcgtttttattgttttgttattaatggtcaaagttaaaaatgtttgacttgtcactatgctaaaaatgcttatattttgggatagagggagtacatggtagtacccgattggggctttataccctgccttggaatacaaggcaacatagcgaccgagtcctactttattacatattctatatacatgatctatcccctgtaaccagtcggatagcccagccgtgtgggtatgcggtactcataatctccgcagaaagcgtcggtgaaggatggtggattgattttgatcgggtggtgggggtcaggggtgtgcttccattcgcgcagggaaggggacatcatgcgtgcgagaatcgctcgagagggcatgggagtcaggttgagcttaagatggacgagggactgtaaaccaccgctatacttctaggccttaaggatttattatttcttacatttatagtttggaactaatggtatattttctagatcctttgtaacacactgacagtgtaagcttcttttttctatttaaagtttggaactaattgcgtatttattttatatcctttgcaataggttggtattctcgtagtattatataaactttgttgatgactatagcttggggccttggccaactatatgaaatgaagcttaacttagcacctctcaaagctggcttcgcttccattctatccattaccacttattcatgttggagatatgtaacaccctgaaaattcgaccaacgaaatcaaaacaccaaaaatacagattttcaaaaactttttaagtaataaattgcatcatgccgattttattcgcctatttcattggattttgatctcggaatttattaatcgcggataatgaataactaactaggaataaaccctaaaaatcaagttggctaaataaataattaaaatataaattaaaataaatattaggtgggattggaaatatataaaatattatcgcgaccatattagcaataattaaattttagtacgatggaatgagaattaaccctaattaaaaattcaaataaattatataaaataaatatgagtgatattaaattagggtgaatttttagttagtataacacaaatatggagtaaacttcatttatgcaaaagttagaatttataggactatatttaaatagaaaatgggctaaaatcgggataaataggaaaagttactgttcattgcggcataggtgttcgatcgtggtccccctggccccgcccccttccctgccgcgtgtgccgcgtcgcccgcccgtcgcgcgcgccgccgccgctgccgcgccgtcaccgtcgcgtcgccgtcggcctcgcgccttgtgccgccgcgcgcccgtcccctcgcgcctgcgccccgccgcgcggccgtcccctcgccgtcaccctgcgtcgctgccgcgccgcccattccatcgcgctgagccccgtgccgccgcgcgcgtcgcgtcgccctgcctgtcacgccgctcgctcgccacccgccgcgtagccgtcccataaacgcgcgccgtcaccatcgccgcatcgagccccacgccacccgtcgcgtcgcccgtctcgagccccgcaccgtcgccggtcgcatcgccgctccgagccccgcgccgccatcgcgtcgccgcccgcgcg

SEQ ID NO: 67201 - DNA, 4379 bp, Oryza sativa
ctcccctctctacaaataccccccctctctccattttcccccaccccatctcacccttcctcccctcttccctctccactgcgccgccactctcgtgccgccgcgccgccgctctcgtgccgccgcgccgccgctctcgtgccgtcgcgccgccgttcccgtgtgctgccacgccgccgttcccgtgccgccgcggcgccgttcccgtgccgccgtgccgccgctcccgcgccgccgtgcgccaccgtcgctgccgccgtcgtcaccgctgctgccgccggtgagccgccctccttccccctcgtgtccaccgccgccgccgctctggtgggagagagccaagagagagagggagaggaaaagagaggccggcagagagaaaaagagagaaagagagaaaagaaagaaaaagagagagagagaaaagaaagaaaaagaaagaaaaagagaagagagaatggagaaaaagaaaaggaaaaataaatagaaaattaggaagaaattaaggaggttaatagtttaagaaaatctaaaataattagaatttaattatagattaattatggtcatagaattgcaaaatttaatataaattatagattattcttggtaatttctacaagaaatcaattcgcggtagtagtttaactgtaattaggaactaaacgattagatgaattcttatagactattatagattattttgggtaatctctataagtaatcgattcacggtagaaattcggatttatttactagggattttagccgtatattatatttaatcatttagtcatagactaaattaaatcatataatatttctaggatttcgtccgatatttagctcgcgatagaaatctctaacctattatatggatataatgctcgggtagattaaattaaaaacttatgacaacaaaacatttatacccgcaaaatagtttgaatcgaaattgggtttgccttagttcgcgaataataaagttaaaataaaggaatcgactttcgcgttcgacttccatttggatttatttggattttttatttgaattctaatcgaatccaaatcagttttcgcacgtaactatagagcccgagggagttgcggatccaagtgaaggccaagacccccaagaccttgagcaaggcaagtcatcactattccttgaacatgttgatcccaattgcgaaattattttgtttataaataaaattgcatgcaatgatgaacatcctacttgtgattatgccatgccttgattattgtttatcccttattccttcgtaaccatgtttacgtatgagtccctagtcaattatgacaattgcttagaaatgctattctaggatcatgcatactcatatttatcaaatgctaaatgcttgggcaattacctttgggaaggtaattgagatgcggtatgtggagacatgagcgccacattgccatgaaattgataacatgatttgtgaaaggaaaataaagcgaaaacaactgttttcgactggggcggacggatgatttgggtggtatctggaaaaggctagtaccgtccccagtcaattaaggaccgagccatgaagttaagcatgaaacgacccccgtacaactgtacttctcgaatgggtatagacctagcggattagatagccgagcggaggcagtatccctgcatagatggttcacccctgagtgaggcaggtgcgctacgatgggacagccgttgaggtagggccgagaagcgtgccctacatcggtgtcgccattggtaggactgccatgagtatgtgagagagagaacttaacttgaaccataatttaatatgtgtgtgagacttctctttcctgggagcgccagaactcctctcactactagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacctgtgtgggatgggatattgcatgatgattttttatgctgaatggagccacttcctgataggagggaaggtggacgtcctcagaaaaccatgatgactcaatggcgggaagctatccttgggatcacaatggatggtggacagaaccgtcgttgtttaatgtgaacactggtattaaaacttgatcagtctatgctaggtcttaggtttgtgaaaagaattacaaaactggcttagcgcaaaagagccatagccatcctttgaaataccccttttcatatgcattgttgttgtggtggcttgctgagtacggttggtactcacccttgcaaatataaaattaatcagaagcaggagataaagctttggaggatccctatgcctactaccaggagggagatgaagacgatggcgctcagtaggtcttagtacggtcgttgcctgtggcaatggcatgccgctgcgcctgaattccgctgccttatctatttctgcattttggatgtattccgaactgctcggtccgatgatttaagacaatgcctgcgggcttatgatgtaataattagcactagactctcgtgtatgtgcttttggtatttcagctatgaactcgtgtgtaccagactacttgatccagggaaatggtactgtttacacgaatgattcctgttataaaaacgggggtccagaagatatgattagttaatgtgacttacattttgttttagcatctgaataagctaaacgatgtactgattctttatacttatagtttcatgtcacggtgtgatcgattcaacaatttgttccacaaaatttttaaaaaaacaactgtaaacaatatttatgacaagctaaaagggagaaatgggctacattgatttggacatatatatgtactaaaattttgagaaatcaaatacacacaatcgtcttaatgaaagctaaccaaatataacatttttccatacatccactataaacagcatatatttgaaatcgtgttcacatatagctccacaacaatgttttggaaggacacatgtatgccttattttgccactggcttattacaacaaaataaccacaagaaattaattgtttgcttgctcacgcatagcatgatctctttcaagacaaaattatttagaggttaataattatcatgcaacccaatgcaagaatactcatgtctattaattagacgttgataccactcttgtattcagagccggccgtaaagctttcggggatgacgtcgtcgacgacacggtagccgccgttcttgacaaggaagcgaacggagaaggggcccttgagcgccgcctcactcttgagcgaccaggtgttagtcgatgactccttgagtgccacccagtccttgccgcccttctccttgatctccacctcagagatggcgacgttggtgacgagctctagactttttccgctagaaccctcaccgaccttgaaggtgacctcagtggcgcacgagccgacgaccaacaatgccgccactgccacagagagccggaaggaggacaacgaggccattggcgagctagctagtttgttggtgttatctttcttgtttcttgaagggtagagggatggatcgaggtgtttggtgatccatgttgtagttgggtgcgtatttatggtggcagggggcaaagaaaaccaggcatggacgcatgatgcagcatagagatcgttggccggctttttcgtcgagcaagtctaatacaattcctataaatagatgcaaacttggtagttccgattgtttcgctggtgcaggacatgcagacctctcaaaaagtagttatgcatttccatgttttctgtactttttttttaaattacaaataataaaaatttgtgatgttccgtttatggaggatatggaccaagacatgaaaatattaggggcgaagatgctagtggaaaacagaggggtggtagagctaacggtcgggagtgatggccaggcacacaaagggccaccgtgtagcatccatagtagatgttgcagaggggccatcagcagctagatgttgatggaaccgtggcagtgacggatgggctcatgtgttggcccgttgcgggtctgctcgataggggacataggttagcatttatggtgagatggggctggtgctaagtaaattggtagagcacacctagtcgctagctggatatcgagcggtggtggcagttgatacaatacattgggctgcaggaat

SEQ ID NO: 67202 - DNA, 2169 bp, Oryza sativa
attcctgcagcccgtttatgagccactgtttagtattgtaacagagcaatatttctgcagtcgtaaattgaaatctttgattaaattagctaacaagtgtgcggacatcaacagctgaacagatttcagattgttcaaaggtgacctgcagtctattttacaaacaacactgacctgacaagtgacaatcaccctcatgtacaaaaaaaggaaaagaaaaagaaaacgacggcgcaatgtgcaatctattacgattagaaagagctgcggaaaagttacttcatgctgtggaaaatttgactcaggtagaagataaaactcccatttcaatcttgttattactcttcaagtttttggtgcttttgaaggaacacctttgatcttatatcagcctagcgaaggatgaaacgaaacgtcaaattagtacccaagatacaacgtgctgacaagatgaaacttgaggtatactatttacaaaattctacctggcgaatgggctcgggaatgcgataattactacagaacttcactatcccaatggctgagtcaagtgaaatgcgatgcccaactgagatgtagatcggcttcgacaaactagggcaggagcacattgcctgggataagttaatagtttagttccaacaatagaaaccttttcattatcaggaaatatatgacagaaatgaagtgaaggatgcattcagaggtccaatatagaatctcctacagctccccatgttgtcccagactgtccagtcaataaaattaactccttgttgcagttttcttttgcttctaattgtcttctcaattcagattggttaaggccatccacatggtgcagctggggcattcaaaacactgaggacttagtcttctctcagaggatcagaacatcagaaaaccatcaagtacttgaaatggtcggaaaacaactagatgagagaacttccataggagtagttgcaatggcagtaatattaatacattttttccaactccaatggtcggcaggtctgcaaggacaccaagatgacaagctaaccaaaacctgttgaacatatgtaagttagagggtcatgcattcaagtagtttattgatgcagcttgcagtgtatatgcataactagacatgctgtacgctatcaccaagtcaattgactagggactacaaggactgtcaaggtagttcgttctaaaagaatataatataatcatgttatgtgtgtgattctgcagtttttttctaatcacatgaatcatcttagtcttacaaactaagattgccatgatactaatcactaatgaggtatacctcgtggatgaagtaatccatttccatcaaccatgagtacctgtcagttcatcaagttaaaccatagagaaggcactggcataactagtgttaaatgtaaaactagaagacgctaacatatctaaaatttaatgccaatgcttatgccattaagcattccagatcaaaattctagaataaatgatatttatgatgacaaatgattatacatcagcgcagacaattcacactgttttcacagtcaaaatggaaacaacatatgacaacatggaatgctacaaagcataaagccacagtaaacctatttacagaagggtaaattgcaacgacaaagcaacctgagggtagaaatgctggttgtttgtcttcattttttccaagagtcctagaagaattggagcctgtaacaagtagtgcatgttgacacttttagctgtataacaatatacttgatgtatattttaaaccatctaacaaagtagaataattaaaagaatagttagcatataacaacagtttatccacgtccaatcataacttgattttgcattgaacatgctagacccatatatggttatacagataagaagaaagaatagttagcaaaaacacaataaatatgaatgtacccatcttgattttgtttcattgtttgcttgtctgcctgttcatcactacagaaaatgaaaatgtctaggcccctgaataataatacagaaggcatggataaactgttgctcatgatctagcaaacatatgttttgatcaaaccaaacacgccaaaataagaggacacacaatacctctctgaaagcaagaaatcctggaatatatggcacttgcagccgaacaac

SEQ ID NO: 67203 - DNA, 9237 bp, Oryza sativa
cgtcgccgtcgcccgatgccgccgccggcaagcctaccctctcctcttccccttcaccggcctcctcttctccccgcaaccgctactcccgtcctccacctcgccggcgcccgcctgctcgtgaccgtggcagccctcgtgatgacggcggcggcggagccggagaggcgaccttcgccggcgaggcggcgcgagagatgcagaggaagtcagcgagacacggagactgacaggtggggcccacaaaagagagttgacagatcgcaatctcggcccatctcgctttgcccgggaaacttgcgacggatgggccacaattgcggcccggatatgtcatacaatgggcctttacttcgaagaacttttcctgatgggactgtctaggcatgtggcgtgttatttttgagaaaaaaatcacccaatttttttctcccctcgtatctgcatccaacggtaaaaaaaaaaataacaatacagagaaaccgtccaagtagcatgtgattgtacttattagtagagtagtattcaataaagattaacacaaatgttgcatttataactaaaattaccgacaaatgttgcatttataactaaaattacagtgttttataactaaaattacatttataaaaacaatagatatggcatgtaagtgcactataatttatttgtcgttttagtataaatacattgcttgagaaaccatgcagatatctgaagtgttaaatgttatatttataactaaaattacagtgctttataactaaaattacatttgtaaaaacagtagatatgtcatgtaagtgtactgtaattttagtacaagtgcgctgtaaattttggtaactagaatatttgtcgttttagtataaatacatgggtgtagctatatttatggcgccatatttttcatcaaaaaatagtcggtatgtatttacattgtaagtccctaaattacatatgtaattttagtgtatttacaatgtaagtctcaaaattacatatgtaagtactaaaattacatatgtaaattggggtgtaaatgaggtgtaactactgtgtaagtggctgaaaaaaaatcgactgtagcatatggcgccatatttctagcaactccgtaaatacattgcttgagaaaaccgtgcagatatctaaagtgttaaatattgcatttataactaaatacagtgctttataactaaaattacatttgtaaaaacagttgatatggcatgtaagtgcactataattttagtacaagtgcgttgtaaatttgggtaactagaatatttgtcgttttagtataaatacattgcttgagaaaccgtgcagatatctgaagtgttaaatattgcatttataactaaatacagtgctttataactaaaattatatttgtaaaaacagtagatatggtatgtaagtgtactgtaatttattttagtacaagtgcactgtaaattttggtacctagaaaaaagaaagaaagaaatagatagaagaagtaaatggctactgacaatctgacatgcgtgatgtacatgaatccatcgatataaagtcaggttgacttggtcatggactcaactgaccctgcttttgcacaaatcttggaaaacatcgtgcggctagaaaaacgtcaaatactatgaaaaaaaatcacccggcaaaaatttagcaaaatcgtttcatttccggattcgttcatactacaattttcagataaaattcttcgaaaatcatctgaatgagaactcgtacgtataaccaatcattgagagaatatgaaagcttgatggtgtggacgatcttgccgaaatcagtcaccaaagttttttttgggcattttggcaatgttgttcaaactcgctcagcatggtcgtgttcctaaattctctccctaaatgtttttaggccgtttgaaactccttattagattatagcatattagcacataaaatgagacggcccatgaataattactaaacattataaatttcaaaaatagatttctttgattttgggtaatctgcatttcagtaaatgaaatgggagagcgctgctctccttcttaaaaaaaaatatttctttgatttatttttaaaaaacttatatacagaaatatttttttttacaaaaacacattatttagcagctcgagaaatggtgctaatgaaaaaggataatgttgtagtttggaattgaagttttgggcatgatgtgcttgatcatgcccaaactcaccaaagcttttggaattttcacaatctataacctatttcaaacccgtagaccacgatcgtgctgcttaaatctctctgcaaatgttctcagtctgaaactctcaactcggtatcgatatatactctgaacattctgcatacatcaatcaacacaagaaaccaaatctgcagggagagatcatccgactgctctgccgacgtactcgacgtcgaagaggagagtggagttgggcgggatgacgcaggaggtgggctcccagcctctgcacccggctcctctcgcgccgtaggccagctccggcggcagcctcagcgacctctttccacctgaacattcaaccacatttccattcagcttcaccatttctctaaattgatacaaaatcgaggtgaatctgatcgagtatggtgagttcatttcagatttttgtcatttttcagggttcagttcaggcagggagacgcaccggcgagcatcggcgggatcccttcgccgcccactatgccctggtcccatcctttgatcacctgaagaattatcagtgaatatgcaatgtgagtgatcttggtatcagagatgagtctaattcatcgtgtagctgcgtaatctgttgccgattagtacaatgtttgaatatcttgcagaatctgttagtgtgcttgattgattgatcgtgtttacctcgccgacgccgacgcggaaggtgagcggcttcccgcgcttgtagctgctgtcgaacaccgtgccgtcctccagcctcccggtgtaatgcgcctgcgtgggacgaacgaaacacacggcgaggttagcaagaaccccgagacctcgcctcgccggcggcggccggtgggcgggcaggtgcgtgctgtcgtgctgaccttgatgagctgcccttgctcggcggcggcgccggtgccgacaacgcggtcgcagaaggcgagaccgttgggcgccacctcgagcgggcactcgccgccggacgcttccgccgccgcggggagcacgcgggagaggatggatgcggacagcacggcggccacggcctcgcgccggcggagggcgacgacgggggtgctgttcttggcggccacggcggcgccggcgttccggctcggagaagacacgggaagtttcacgctggggtttgggaggctgagcaggagacgggacagcggcgaggcggtggcggcggcggcggcggcggcggcggcggcggcggcggagggagccatggcttgccggctccgtcctctgctgctgcctcagttcattccaaagctccccaaaccagagaaacacagcgtagcgttgcagaaacggataaggttcaacgtcttctgaatcgtggacgaatccttggacgacgtgggtcaatctcgaccatctgtattggatccaacgcgcccaaagtaatgttctttttcatccttttggagagcgtctggtagtttttccccatgagggcctcctgaaccgtaccaaaaacatatacttccttctaaaaaaaaacatatagttcctccgtttcagtttataagactttctagcattgttcatattcatataaatgttaatgaatctagatacacattcatatagatgtctagatttattaacatatatgtgaatgtgggtaatgctagaaagtcttataacctgaaacggagataaatttggagaatttctatattataggaaaatcgtaggaaagtcttcgaaacaaagatttaatcctatacttttgttttaaaatcatataaaatggacaattctacaaaaaaaatttagaggaaaattacaagaactctaaacccttgaaaaatttcatgcgagtctatttatctaattcgattcatgtgttttttccgcggtctacacaaaccactatttctatatttttcttatgttttgttgtactctattttgcatttatgttcacgtttaaatcctttgctctttttccattattccattttttttcaatactacgtttcaaagaaccatgtaatttggattaaagatgatggatttgtttatgtgaattagtcaaatattatatattacaaaccttaaaaataaatttaaacacaaagcagtctaaacaatgaacagttctaacgtttaaagtttacggagaaatcgtgaagtaagcgttgctcaattgtttagattcttcgtggtggaaccagcctacctgggtacaagttctagatttgacacatgtactcacattcacggctaattattctttcagtggtaggtgctgtacctgccgacagcgagacaacatggtgacttcgtcaatctcgagatatgtcgacatagtcttccgaaaggtcatagcggtagggtgtgcgtgtgtgcattcataggagtgagagtacacgtattgtgagcaaatgcgtatgtatgtttcgaaaagattttgtagaaatcgaatttttttggagcatggcacgagtaatccacaaccaataatctgaggtctgagattttgttgacatggcaattggcaagttgatctgttccactcgtgctaactaggaatttatgtggcaaaaccaaaagtggcccccgcatgtcatcatcactgtcctcccctcttctctctagcttctctctctctctctcctaagggggcgcgcggtcaaattggagcaagggctgccgaatcgaaggagaagtcgcggccgtcatctatgttgggacctcccctttgaacttatctagcaaacagtgtgagtgtcttaccggaagacggcggaccatgccgatgctacctttaccttcgacctcatcagctctatcgcttctgtcgaccagtcgaggagcgacaaagaggtgcctggccggaccgccaccgttgactcgctgtggagcgcgtcccactggtggagacgaaccaagattcggtgaataagccaaagaacgagcggctcgggacgggaactaggacatggtgacgcaaccaccactcaaagctcaagttccacctccacggctcctcctcctattctcaacatgattgggtggaggcggcgagcccacccctagtggtggggaggaacgtcccacgaggatgagcatgagtggtggggaagagcccactccagcatcacaggaccgcaggagtacctaaggcgagttgctggggcattggatcctctccttcactgatgccttctcgcggatggctggctccctcgcctcccttctcttttcctccactatggctgaccaccagagccacctcatcaccgacctcccaccgttgcctcgtgcggacggtctagccagctgtcaccgctctccttgccgacgagctcctatgaaagagaggggagagatggaataggtggggagatgtggaagtccacttatatgtgggcccacttgttttttaatttcctttttgctgaaacacgtcagcaaaaacaagtatccatattgtcacgggatctgacttgaatggttttactatgatggggttgaagatgtctgatattgcagtttagagttatcaattaaactcgacggaaagttgaggaatgaaaatggacttattcctccctagatctctgaaaatttctgggccaaagccttcctggcctgctcaacattatccggcccatctacccaacacacctcatcttatagcccatacaactacccaaacctgacatccttcatcaaatttctgcaggcaaccaacgtgattctgaacaaatgcgatataataaaacccatcgatatcctcgtatacagtacactcatggcgatccaacaccgtcgctgtcttcagttacacgaacgcacgatctcgccggaaagaccgccgcttcggccggcgagccaccggagttcggcgtgtgagccttcaaatccgcacgcacaaatggcgtagcaaaacttcgttaggtttcggtcattttcacaggcaattctgatctctcaatctcttccacacacgccgccgccgcagtaatggctcgatctgcagcatgtgcctgaccaaactctcgatccacatccatcgatacatcggttaataagtcaggttttgtactttcgtttgaactggtctgcgaggaaaaacaaaataaaaatctttgttattggagagacagtttgatcacaaatcactcctgtgatcgtggtccaaaatccagtacttgtcggtgtcagtactaccgttctgttgacaagtaactcatggtgattgatgctcatcttctcttctgatcttctccttgacaattgtaggaaatgattaattcccaattttagactttgtttagataaaaagaaaagaaaggagagacaatcttgcgaagttaggtttcatgcgttgcaaacagcggcaccattaacaggagcatatcgtcatctctgacatctagtgagtcaagtgacacagcccaggacttgggccagattaccagaatggataattggagtcgctcacctgctcgtgatccatcatctctcttcttctgttgctttaggttgcttgcttcactgcatcttaagcttgtactaatgcaaaacttgcactcaaaaagattagtgttgttgttttgctaaccacacacacagacatgaagtcagaagctcagatcatctgctcttctcctgcatatgccaaagccctccaactccatgtttcagaaaccatgacaggagcatccacacaaccaatttttagcttagtgatcagcaaagcagcattgtgtatgtcatgtcaaaatccagtgattaattagcggaaggtgacttaatccagatgcaccaaagctatactatccttatccactgaagcacccaaaaaaagtctttcagggacaaaagtgcagtgcagtgcagacggcaggcctgctcaactgtattttgaccggctgctgttgcgacactaccaagtacaccaaaccacttcaatctcaagctttctttttatggtcctggatctcactggcgtcatctcttgacatcttaattttattttggagcttgctaggctgctagtttcccttgatttgctcttttcgacttattcaccgaattattaaaacatattatttattacatgcttagaaacataagttttctaaaaaaagacattcttccaccacacattatttaaggtgcgttcgtttaagcgaatgactggaactcttcagtcaaacacaaaacagatactccctccattgcaaaatgtttgacaccgttgactttttagcatgtgtttgaccgttcatcttattcaaaaaaaatttgtgaaatatataaaattatatgtgtacatgaaagtatatttaccaataaataaaatgatataaaaagaataaatgattacttaaattttttgaataagacgaatggtcaaacacgtactaaaaagtcaacgatgtcaaatattttgaaacggagggagtatatcgttaatatatgattaattaattattaattactttaaattttaaaaatagatatgctgaatttttttgcaaaacttctatatagaaattgttgcacaaaacacactgtttagcagctcaggaaacttgctagcaatatattttcctaaaaaaaaactcaagcttctttttttttgtcctcgatttctttggcgtcatctcttgacatcttaatttttctttaaatttggtgccagctaatttccctcgatttaattttttttctgaattttcttttgatgccatcaggagagctaattttttctttggtgttgacgtgtgaagggggtatcagtacagtacgaaggcaatttaaggagccgtttggtttgggtgatgccttaaaaatgaggcctatttatttaattttcctatcactaggaagccatgtgctaatggtaccaagacagtattagtgctgggcgtgttgtaattgtggtttttctaggaccatattgtgtcctctcctaaaaaattgattatccataatggtctttgggacagaggaagctgtatcctggtatatatgtcgtgcattgcattaatgctttgccatcaactgaataagctagcgctcaaatgcgttggtcaccatgtaggtaatggagtgaaaacagtggtttgcaccgagcacactgcttcttgagttacgagcagttactaaaatttaagttttaaaacttaattttggaggcttttcatcaaaaattatttttcagtatcagcttttaagaacaaaagaaaataaattctatagattaatttttgttgtttcgtttatttcgtacagcttatcattcatcgcgtaaacaattaaaaacgcaaatatagaaaatgacataatatcaaataaatagaaaaggtgagactttgaactcaggcaatgtcttagtagagctagctggaaaacctctcgacgtttttcaatgcataaacaatctgagactaggatttgttggaatggctaattttctactgtaaaaaacgagctaattctcctttgccgctgcaacttacctctcacttcatgacaaaccagcgacctaatatggaaatttttttaacactctgttttaaaaggatgatgtcctaaatgcatgcagtcaaatcttaaactcttagaacattcagagattaaaaaacattagtatttgatatggaaaaaatggtattaatatatttttcataaaaaacactatatgggaatatttttaacaagttttataaacatataactagaaaacgtaatgatgaatgaaacatatacattagagaaccatgtccatgtccatgtccaaaactaaaggtaaaaaagaatagaggggtatcattgcattctagtgacagttataatctttttttttctcatggataatttattgagcaatgaaaaacattagcagtttagcatccagttagtaatactttttttttcttattgttgtttgtcttttcctagcatgtttcttcagaacaaaaagatgctacttttcgcttaaaagaaggggacaaaagacca

SEQ ID NO: 67204 - DNA, 2754 bp, Oryza sativa
ttactaagctttctataatgcataggaatgccgagatatctaataggaaaatcacctagctatcacatatgaaacaacaagtattaacagattgaaatatatgtttcctttcatcaaaatataatcatgcgatatcttgttctaaagatttaattacaacgaatacaatagtgtgatcggattgttgattggataagtaatttaggagaaaaataatcattttgaagcttgctaaaatacatgcacgtatgtatggatgaggtggagaaagtggagagagagagtagtagcaagtagtttaaggaattttgtggaacacaatgaagacacacattgaaacatatcactaccacgtataaaaaatttagttttaacggtttaaaacacatgtttttattttgacataatataatcatatgatatattgttgtgaagatttaattgcaatgaatacaacggtgtgatcggatcgtagattgaataagtaatttaggagaaagaatatttaaagagagtaggaaagaaggagaagaaacagctagacatgcatgtgacagtaacagggttcgtccgattcattgggctgctgatttgcatcatttttccaaatttcgtgttagagtactgatcgtatcagggaaagcaaaaatttatgtattagagtaaaactcaaattaatatacatttgtcctatccagatgtaataattactataacctactacattctaaatttgtaatacttaacatgcaaaaataacacatcatcatgcaatagtaatttattatattttaatcctcatgtaaacattgctatatcatctatatgtattatattctaaagcttatacatacaaatatattaaatcatcatcccacataatctagtccattaaattttctacaaacgtttctagggcagtcctaaacgttcctgcttcctagttgtagctcccattcatgttttgtagctatattatatctatgaattggatttataagtaaggaaaataaaaacaattaaatccacaaccctcttcccacctcacctcctccccatcccctcgcatgtgcatgcagctgcgcatacccgtttcctgcttcccctcctgcttcccattttgaagctcctattcctattttgtagctatatatcaaattaaaagagaaaaaaaatcaaatgtttttaatctaactaaaatgttgttgcattcataattaaatccatagtgcccctatttttgctatatatgtcattcggccaaaaagcagtgcactttgcatgccatataaatagcaataaattactttaaaaattagcatatattgcatcaccatataccattctataggcatatgtatggctaaattaaatttccagtatccaaacaaagattagaaaataaactattcagcgatattttatcgagggacaacaccctacccttctaaacttcatctcaactgacataaaaacattacaaaattattcaacaacaaaggttgcaccattatacattattttgcaaatgtgaatagataaaatataaactatgtaagaaaaaagaactaacccaaaatgaataactaaaaccattacataaacaatctgatgccttcagtgagagaaaaataatccaagcaagccaaataatgtttcacataagtgctttaaaatatattctatattaccatctaatcgaatttagacaatgtttaatgtatttttaatacatcatagatgaacataatttgttctagtgtacaaaccgttgaaaaagtggatcatccttacatataattcataatatttaattgttgattttttagaaaaagtatttaaatcatagaagcaatcataaaaaatcatataaataacaatgatgcacacatagtatatttagccattgtgttctcactggattgcgtggactctttactcacactctgctcgaaaagttatttgatgggttgtcttccacactgtgcaattgaattggactttacgagcctgtgcattaagcataggatcatgtccaacccaaatccacccattaataaacaacaagaatataataataataataataataataataataataataataataataataataataataaggaatagtactatacatgacatttaactatgtacaatctgttttaactcttgaattattttggagaggaagacagacaaatatatctgtgtattgatgaaatggataggatcaaccactcttgaggtgaggacgagagagggggaaacctatctacctatccagctcatcatgaatctgggacatatgttctcctttaggctgaaggaaactgccctatataaagcctatacttaccctatactatacttacaccatcagtataactctttctactcttgctgtgacaaggggcatgggagatggagagcagtagagctagtagaagccttcggtgatgcatagaaccttgtcctttggttttttacgagcatatggctagttctatggatagtacgaacttctgatgtctagctacggagtagatggataagtgatttatgtttggggtaatgggttagtctttatgtaaatgaactgtgagatactttctcgatagaaatagggtacttttagatacttccgggcggccgccgctcctcccgctgcacgttgacgacgccgacgccgccgcacgcctcttctccctgcagttgctgacaatgccaataccgatgtcgccgctc

SEQ ID NO: 67205 - DNA, 3583 bp, Oryza sativa
tcccaaacacccccttaatcatctctaactaaatttgcttacttgcattatatattgagatggtgatgctaacaataaatattattaaagaataacagattgatgattttatctatgagaataataatgtcataatcatagaacatgattgtgatacttagcctgagatggccgatatctgaaacaacaatatagggtcagccgatatctggaatacctcacacaagtagggaattcagtgacgtgattctcagttaaaggtatcactggttgggaaaatagactaaaggaataagattataacaattattttaatacctctgaagagtgtatttgaaccactatatttagtatcttttattaatggatggctattaatatctacagtaataatgtttcatctaagaaaaagagtaaatatactaatcttgcttagtatgtgtaacatactcatattatttcttgctatttgatgtgcatagaaactagtcatgatgacatgtcaaagggggatggcgacagacaggcctaatggggagtgttgtcttctttagtcttcagtttaaattaagaggatatatagctgcttgccaggtgtagggaatagacctgatgacaacatggtggtcagtggaccagtggatgtatttaagccatgtagctggtgcaaaataaatgaagccattgctctagttttgcaaactctagttgggatagttagacattacatcttacctttgtatccttatggaacatatgtatatatataatccctttgtattcttatggaacatatgtatatatataatcagtatatatgcttataaggatacgacagactccaaaaaaaaatgagaaattttgggtcatgacaagctgcttatacaaaaggtgattggtttttattaaaaattacaaatggtgcaactctatgtcactatttaccatctcacagaagttgaacatgaaacaataattttatgtaggaaatgccaataagaagtaaaatgatcaattcgagaaaatcttataaaaatctcagttccttttcaccaaatttggaacacccgttatcgtagcattacataatttttaattgcttagatcctaatagccttctcacagtcctatacggtgttattagttcctccatatcttacatatataagggcactaaggtagcaatacataattgactatgttttttttccttaagatatactccctccgtttcacaatgtaatcattttaatattttccatatttatattggtgctaattaatctagacatattcattcaatatgaacgtgagaaatactagaatgacttacattgtaaaacggaggaagtactatggatctcacacatccgaaggaagcatggtctagatatgtctcttctctatctttatttgtatgatccaattagagggatgtcacgccccgaactagtcccgagcggaactagcccgtgacgctccaaattaacctgttaaccgataccagtcccaggaaacagtgctggtatcacaggaagacggaatatcacagcaacagatgtctctttattatagagtaggagtacagtcatgttgggctgcggacagatcccgagctcacaactgcattacaaaagggaagtggaagccaagacttggaccaaacatcacaggcgcgacttgggaactaggccgaaaccctaaaactcatcgtagccggcttgctcctggaagaactcctcgtcagcgggatccgcttcatcttcttcagcaactgggggggaattatttatatagagcaagggtgagtacaggagtactcagcaagccatgggaaataagtgtttaatgtaggcttcaaagaaaggctgttgtttttgcgattgattttatttaaactcttttctgaaacaactaagggagtgcttctcaaatgacacggatgaacagtgcgtctcgtccggtcggagtatgtgcaatgattcagtcttttgaattgatcaagattggcacccggccaaaagctttcaaacggccacccgggcctggctgatcccatcagccgcagattttccaaacatcaacccattccacacagcaaatttcacaaggcagtagtcaaacaaaaactacgctaggaatcacctcacatccgcccatgaccgtgggcacggctattcgaacagttttaataacctctgcagagggggtacactttacccacacgacattactaacccggatcatccagcccatgcagaacggccacgactagagaccttaaggctttcataacaaggcatttcgaaagccgacacagtttcaccatatgccaacgagaggggtcccagaccaacaccagattaggtcccagaccatactatgccaggaagcccaggggtcctccccgacaccaccccggcgaattcacatgtctcttggcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttcctcggtccgcgattttggaaattcatttagttcgcaagcaccgacccagctgtcgggttttccaagtcttttgtaaaacccaagttttacccaagaagtttctcagattttaagtttgaaggcgaccgtcgatacctgtgcagagtgcacgattaccgaggcgcaactaggtgtatacaagggaacatggtataacaattacaatggaagggtcaaatgcaacaaattaggtaggtccgccaatctgccttgcagacgggacaagcagattaagtgcgatcctatcaatgcataatatttttcaagcaatataattaagttcaaatataggctcaagatgttcaaaggtggcttgcctcgctcgagatcttgagcttgatcctcgaaatcctcgcactacgggtcttcgggctccgaaactacacgcgaaacgggacaactcagcaaacggcgaaaataaagccttattattgacctctaagcgtgccattagatagatctcgagatttgaggaattttggaagttgaacggagtcaaacggacttactgttgggaagatattgaatttctaagattattggatttttagtctaaaggaaaaggatttatttaaatcctttttgaaaaataaaagaaaagaaaagaaggagggacggaaattagacttccctcgggcggctagggcgcgacccgagagaatggggcggctcggccgaccttaatgggccggctggcccaagaaggcggcccaaggcgcgcgcgcgggcggggaggggagagagagagccggtgggccgggtccatcccgcgtggtcccgggtgggacccgcttgtcggcgactcggctcaccgtgagcgaggtgcacgcggggcgtgctagggtttggggagggaggcgcggcgcatgcgcgcggttcgcggaggacgcggtgcggcgggcccacgcgcagcctcacggctcgcgcgtggaccgcacgcgcgagggggcggagggaa

SEQ ID NO: 67206 - DNA, 4507 bp, Oryza sativa
gaatcgcatcgagggaggccggcgacgagaggcgcttccgagctcgggcggcgacggcggcgagcacacggcgagcgacggcagcagtcggggcggcgccggctagctagggggggctacacatgctactaccgaaaactaaggggaagagatggattgaggagggagaacggggagatgcactaccgagatgaggcggggcgctgtgacaagaggccgacggcacgggagtgatctctccggcctcgggccggggaagaggaagaaggcgagcgcccggagtccccttccgcgtccacgaacgcaccggctctcccggtgcttggcgatgaacggcggaggcgagacagaggggcgacaatgcgcggtggcggcgagcgaaacgggaggaggaatcgatgggagggcgccttggtttataggacgacgatgtcggtttggaaaccgaccttgggcggtcaaggcgcgagctggcgctcggcgctcgcggccaaaacggcgacagaggcggatgacgtcggcggggaggggaaaaggaaaaaggaagggagaaagggggcttgcccattgccactttgggaaaaggaggaggggatgggggcgaccggcagagggaggaggagctctgccttcgtcccttggaggctagcgcggggagaggcggggccgagtcgatgacgacggcgatgacggcggggcggtttggagcggagcgacaacacgggcggctggcgtgggcaggcgctgacggcggtggcgaccaggcggtcggccaccatggcgcgcgcgcgcgcgggaagcaacgggcggcgcggcgagaagcggcagcgagggcggagagcgctcggctcggcgcggctcacgcgcacgcgtgcgcagcgcacgggtagagcgggggagagggagagggagagagagagagagagccggggagggagggggagatgggccgagaggagttcggcccatcgaacccgagggaggcaaaatagacttttgcggagagatttgatttgggaaggatttggattcgggattgaactcgacgatagattggggatttgagatctgagatggcatggacactagacaacaagcaaagaaacggatttcgtaaatagggtttttaagagatagttttcccgctaggcgccacgatggaacgggcgctacaagggaggactaatttgattgtacaattaaacataattattagcaacaatagtgcttttatatttgtgaaaaaaaaagagagagcccctaaactttccataaagaaaaggaatttacacctacttgtttttaaaacaaactaagtctaatttcttttagatgatgaaatggatcataagtattttcttattgaatgcattgtatattataaattggccctcttcttttctccaacaaaaactggataaacttttggataaaaatggcacgcttttcaaactgctaaacggtacatttcgtgcgaaaactttctatataaaagttgctataaagataagattaatctatttttcaagtttgtaataattaaaactcaattaatcacatgttattaccgcctcgtttcgtgtgaaacacctaatctttatcttcattttcatcttcggctccagtggtagcggcggcggaggcaagggcggcgggacgtggagtgaggcggcgacggcgacctccttccctaccgtcgcggcggcgcagagctcggacacaccggcactgcggcggccgcccccttcctcctgcgccgccgtccgccgctctcgcctccgcccgtccttgccctctgcctacccccgcccgtcctcgcccactgcctgcccccgcccgccgcacttcctcgcgcgccgccgtctgttgcccaagcgagccaccgccctccgcccccgcccgccactatcttccaatcccgtctctggtgcagggcggcggggcctcgaagacggcgagggggaagtgccatcgtgcgccgcagcctctgccgtcgttgccgccgacgtcgatgtcgtgcgccgcctctaccgacgttgccaccgtcgccgcagcctcttcccgccctgacgagcgcgtgcccgactcggccatccctgccgcgctcgcctcgcctcgcctctaccgccgttgccgttgccaccgccgcaacagcctcgtccctccccgacgagtgcgacagggccgccatccaccgcccgccttcacgcccagaaatttagcccaaatttccagactattttgtgtattaaatctctgtccagaaccagccagggtacacaaaacgacaagtaatataccgttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcttctaacttcgtcttcagctcagaagcacaatacttctgaaaatggggaataatagcaaggctgagtacaaccaccgtactcagcaagccacatcaatgatgcagacgtgcaaggggaacacaaggacggtttgtggctatttgcataaaggcggttgtaaaacattttattgagcaaaacagtaaaactgttgagtaattaaagtaacattaaatctccactcatcaacgctacaccacgttgaacaggcccaaccaacccacctgaactacagtgcattgagtcgatttattaaggtgggactaatcacggtgaatctggtcgaccgcccgtaactgcgggcacggctattcgaatagttttactctggccagaggtgtacaactgtacccacaagactcagccccacgacacgtttccgtgcgccgacatgccaccacgacatactggaaagaggccgtgacaggacccttcgcataaccccctctaaccgatcgcaccacaccttagggttcgcccccgcccccagcagacaatgggcagccctcctctcgtgccgcgatgaatccagaagccgatcaaccggacaccccggccgacccaactccatcatgcccaccctcgcctgggtacgtcggctagaggaaagctacactacaagcccagccgttaccacgctggcttgtggtaagtacgataagttcttctagggcatcccacgaaccggtctttaattgccatgggtgcgactagcataaccatgcacccacagcccaccattcagtcgcattctagttggataattacgacaatgaagcatggccagatgtctcgagcacgcagctcattctgatactaaaaaggtctaatattgtaattatcccatcaactgagctagtggtaattaagcatggctaagcatatagttctagctaggtcacataagtaacatgagctagccaatttattacccaatgttgacaaaggacggatatcaagtaaacatggcacaagcgagcagataggtaaaactctgatcccatgtaattagcaaaacatgcatatttatttgcaaatggtaaaacatttgtaaattgggatcaacatgctcaaggggaatgtgtgacttgccttgcttctttactttgatcttccgaactcttttcctcgcgaccgcgaacttccgaaacgacggatcctacatgctagcacgcaaaacgaggaaaaactctaataaacaccaagaaaacagtacatgaaaagtaaacaaacatgtagagcttaattttagatgaattttgcaagttgaatggctcaattcggagttcgaatgaattagatatgaattttagaagttttgagccatttaaatgaatttctagaattaatatcgatttattgcacaattattaattgttttctcaagggaaaaggcacggctgacgtcatcaaagaggaagggcgcgccgacaggcgggccccatacgtcagcgggactaggggagggcccagagcacgggcatggcttagagccggcccaaccgagacacgatgcgcggcggtgaacggccaccgacggcgagcggtggcgcgagagggcgcgcgaagggtggcggaaaggagaggaggaaggggatgctcaccaagcggcacgacaccggacggaggcgagatagcggcggcactccaacggcggccaacgggcgacgaggctgcggacggcgaccgggacgacatggggagcacgatggaagggttaggaaaagggaggaggcgcgaggcggcgggaaaactcggccgaaagccggcgacatggggagtagctcacctcgacgggaaggagaggactccggcggtggaaggcgagggcgatggggcggccgaggtgcggcaccagcggagaagccgacgaggcgacagcacaccgtgaggaggtcggaaacgacggcaagaggtggccggaggcgacagtcacggcggcgacctcgggttcacggtggggtggtagatgcggtggcgatttgggaaaaccaagcaaaggccagtgtgcggca

SEQ ID NO: 67207 - DNA, 1808 bp, Oryza sativa
ggttaaaatatggtttattatttccatcggttaaatagtttttccctctatttgattgtgtatatgtgttctacatttccaaataatgttatctgagccgtttgtattcaataaacaatatacatattttattgtagtttgcctaacagttttttctttttatgttttttccctgttcactcaatttaatataattattagttatgttttctaagaggttaaacgtccttaatatcatactgctacataaattacatggatattgaaaatccaactgaattacttatgtgtttgtttcatatttttattcatcacaacaatcagttttcctttttagtccgtgtgagcgtatttgaatatcttttgttatgtgcttaaaacatgagcatgaatgtgtaaagaccttactcgattcttattagatctgttgacatccctaccccataccgtatttcatgttgccacaattgatgtagcaaatcttcaaagatatctagttgggagatagtgattttcataattttctatgtagcttgaatttagctaggccccattcttgcacttttattttcttttcttttttaaaagtataatatttgcatgtggtggattccttgacgcaccaaagaccacaagcagtgatggccacagcacaagtattgtttcatcgtttttactgcaagaaatcatttgttcggttagcgttaaggtaagcaatcttttgtctcagttactctgatcaaaccagtctttgattttatgagttgaaccaatgaatatctctgtttatgcttgcagagagttgctgcaagctgtgtttggctggcagggaagttggaggagagtccaaggagatcaaagcatataatcattgtcttccatagaatggaatgtaggagagagaacgtaccaatagaacacttagatgtgttttcaaaggtttatctgtttctttactctctgtttattttaaatattttttgaacctttgtgcacttcaaatcttgatgtctctagttcttgctctcttgctgctagagctgtaatacctatgcttttttttagaaaatatgtaacttttataaagaattatgctaattgaaagctgtaactatttgttgcagaaatactcagacttgaagcatgatctggtaaggacagaacgccatctgctgaaagagatggggtttatttgccatgtagagcatcctcataagttcatatctaactaccttgcaacacttgaagcccccgaactgacgcaagaggcatggaaccttgccaacgataggtacttcatttgaactaaacttaccttattgtagttagatattcttattgaattttatgcagttcaattatatcttactcttaagtcttaactagttttttatagtccttgggaggtatttctagttgtagactattaaggctgtgttcggcagcttgtgttcccaacccctctccctcgttttctgcgcacacgcttttcaaactactaaatggtgtgtttttttgcaaaaaaaattctataggaaagttgcttaaaaaaatccatttattaagttaattttagctaatacttttttaattatgcgataataagctgttacgttttccatgccggagggatagactcccaactggcacaaacgaacacagcctaattgtacctgttatcttataatacctcccaaggaccaaaaataataatatattctaccttattggtgaaattttgttttagtttagaattattggttctcttaaaagatttttccagcattgctcttgactttctcttatag

SEQ ID NO: 67208 - DNA, 2886 bp, Oryza sativa
agctgtggacactataaatcagcggttttgtttatgttagccacgtggaaatgacttgagttgtaatcaatgccatggaaaccattcgttttcatttactaagatatactgatcattaccatcgcttattaatgctcattggatcaactttttttttgaataaccatgtttctgtaggcgaatggcgaagcgacggttgtgagtaattagcccaaatattcctctgggttaagttaataaaagttttggatgccagcccaattttgtgctaggtggagattagttgttgtaatgttcgattccgccgacttaacctgtcagagatgtaaacagaaagtgttcaatctcatcatacttgcaataaagaatttgcatgcataactgcgcagttgcttgatgatcatgatgagttttaaggaaacaatacacatcaagctatgatcaggtggtttcatgttcatcattcgtaatggaaccaatatctgtgattggcaatgatacatcattgtaatattcagctgcttatgctctactcctttccattgtacttcatgtcagtctggagaagaaaggtgtacgtgattgctggacgtttgacctatgaatgttcaagtccattcagagaattattatataaagctctggtttatgcctaagtttgcagcttaaaatggaactttatcaggcaaggatgctctgttcaggatctgtactctatgagtatgatcttttgataacgtggcagtttgaatcactcgatgtttttctcttttgggttgggcaaggatgtaacctaagatttcttagttgactacggttgttatcggatcactaagcttctctaatacttccttcattccaaaataaattattttttcacctatctcacacatcaacacaaaacttaaaagataagaatacttttactttatcaaatctcaatatagatattcttcactttatttatttttaatataattatttcttattttcacaaactctgatacatttacttaaaaaatgagtttattttaagataaatgaggagtcaaaaataaatttattataagatggggggagtaggttctagctggttgaaaactgtatcgatcagttgattccaaaggattagactgcctctattaaccctctggacggtctatgaaaactgtaatgaccagttgatgcaacaaatcatgtggtatttgagcttttatatgctggactagcagcagaaactgacaaaagtagttaaatgctaaaagtaaccggtggtgttcgaaactggtgagatgaagattaagtagatgcaaataaaataagaaagttattagtacatgattaattaaattaaattatcataaatttgataaatggatatatttgatattttaaagcaacttctgtataaaaaattttcgcacggaaaacaccatttagtagtttgaaaaacgtgctaattgaaattggggtaaaatccgaatcttaataagaaaagaatattgtttaaatatagataaaataattgaaaccatcaatgatgaccagtattgcatactgacgtaatcacatgcatttatattttacatgaaccgtcgaggtaccggttgtattcacgtcgtgttcatcgtcagaactcgccgttgtagtttctctctctatcgggaccacgtcattatcggtcacgttcttgctgttatgattttcttcgttgccaatatccatcatctatggacgagtcacatcgtgggacacatcctaccatcttacttactattattggttcaccgaagcaccagcatccatcttccctcctttttgtttctcgcttttggctaggaaagacgatcacaatgcctgttgggtgctattgcttctttgtccaacctaaccatgctcctgaatcactcacataatattgaaaccatagtaatatgaatataataggaaaattctaatttatgttaatgaaacgggcacccgttcggaattaatggatcaaattttcatctatgagttaaagtaagctttttcaatttctagctaatttcatttgttttttcatttacaattttagttttagcactatttgatccactaaaaattatttttaacttataatttttctctgtattgaattatttatagctaaatgaaaaaaggggatttagttatataattgttttaatattaaattatcattccgaccaaacttatttgtggtttcatgtcgttatttttttattatatttctttcatcatttatgccgaattatgatatatgattttaatttatgtcaatgaaagttatctagaatctattacaatacacaaacgttatgctagtacatataaatattatatgtacgtatatgcaattttgctgtatatttatcaacaaattttctcctaaaaatttgacggatgtaattacagtacaatcgtaatgtaactagtatgtaactacaatgcaacttgtatgtaacttttacataattttgaaccgttagatttgtttcaagatttgtgcaactaaagaaggaaaaatgtcattgcgcgcatatatgcaagaggattcgttcccacgacctcttcaccgaaatagcatgttacgaagaaatttttgaaagtgatatacaagttacatataagatacggtgtaattagatcatgattatactataattatatttgtcaaatttttagaaaatttgacgaacaatgccccacgacacgcggtgtccgcgtcatcttccggaacggcaaaaatatagtcctatcacttttccggcggcaaccccaatttggcaactcccgagtctccgacacatgccaaattgcttaatttcccttgcccggccggctgctcccacactcccacactcc

SEQ ID NO: 67209 - DNA, 1207 bp, Oryza sativa
cgatgaggctggatccattggaaagaggactccgtaggctttccatcaagtactcacgggccaaaaacggaggtcgtatgcagattcggcggccgtttgaaatcaacagtgcagcaggtggccgaatcggattccagcacttggagaccttgatcttgatgtcttcttgttcacgcattatgtgagcaatggttgtatccgtagtagccatggtcacatcagtacccgaggaagatccaagctttttctaactatttctttaggcggtgcagagaggatacgacaagaaaaataaaaggcaacttgactaaagagtgaacaattttattccttaatgctggccatatacatattataagagtcacgagctccctcaggaatcaaacactttgtagtttgtactctagtatttcctatactcactccgtcactcgtcaatacaatataggttaattcttcatgagacttgatatagtttttagtactgcgatttgtttcaacaagatgagtttgcgccaaggtacgatgccgtcgatgcgtactagatacatataaagatttcgcctgcttttctaccacatccagaagttgaatttagaagagtttgattttgaagtcattttatgaaaacaattttttaatataggctttcaaaccgctaataaaaatattaaaccatatttttgtttgcttcttttcacgtacatgtcagctgtggttttgaacaatcaaagtcgtatgtacccctgcattcttaaaaaatcaattctaattataaacctagatatatgcgtgtcaggttgtatatagggttttatcttcttttagaacagactagtaggcacaaataatctaagcgaacaactagcatgtattttatttacagtacgtgacacttctgctctatccgctattagtagtacttttttttttagaactggtattagtactatttctactttttttttttcgcattgcatgtttcacatgtgcacaggcagttgtggcagtcagagtgtgttgggacttgggagagttgtactgggagggaggcagtgtcaagtgaggctatgcgatctgcgatactataagcttgtatatgttcggttgttcactttatcatcattttaactttgctaaattttgataggggtaataatctaaaacaaaatcttagcaatatcattctaccaaaaattagtatact

SEQ ID NO: 67210 - DNA, 1141 bp, Oryza sativa
aagcttgaaatcttaaagcactttgattagtaaagatgataattgtagattggtcctgaaaaatacttctatataattatatttttaatgatctctatgaccaggcatgtgaataaaaatgtaatgataagacatcatacacattggagacaatgcaatggaaacggcaaacaaaaaaaaagatctggtatatatgtgattagggggatcatcaatatcaatcaattttttaaactgcacgattgcatccaaaggtcacaggttaatttttttacgatcatcaaaagtaaagaatccccaccagtataaaaaaatattatcttcaaaagcattaaaataaatctaaaagagatcgtgaaaagaatatgaaacactgatgctatactagagttggaattaacttcacaacatatatatgaactcttttggatcctttcttttgtgaaagcaaaccctcatcggtacaactgagaaataattaagtgtgtagtaaaaaaagatgaaatgaagaacagaagagcaattaaatggagccttccattccttcgatcgatcaatcgatcgatgaggcatgttagctttgctagaagccgtgagcaatgcacgcctcccagaagagcctgtcactctcggcgtcgctgccgccggcggcggcgacatcatcctccgtcgccggcgcggcgcacttgccgtcgtccgcagccaccaccagctggtagcccgcgcagtactcccgcatccagcgctcccacgacaaagcctccacggagccagccgccgccgccccgccgcctccatcctgatcacccccgcagcacgactcggcgtcgccatcgtccgcagggcagctgccgcggtccaccgccgccgcgtccgactccgagtcgcccgtcgcctccatcaacgacgacgccatgctcggcggctgctcggagttcataccgacggggcgacacaggaggccgagagggagatcgttgtgtcgtggcgtggcgtggtgaggagaggcgttttgtatcgggcggggaggtaaaaacgtgaagaatgtgggcaaaggtcgcaaggaaatgagcgagcgacgggtcaaagattactgatgcgaagccgaagcagcagcggcagcaagaaaaaaatgggtttt

SEQ ID NO: 67211 - DNA, 883 bp, Oryza sativa
atttctccgacttgtcgcctgtcagagatgtaaacagaaaatgctaagtgttcaatctcatcgtacttgcaataaattaagaacttgcatccatgactatgcagtttgcatgatgatcatgatgggcttcaaagaaactaataaagcatcaagctatagatcagatggttccatgttcatcacgtaagattacacctgtcgacttgcttgctactaaaatatataatactagcaaaagtgcccgtatgttgcaacgggaagaaaaaagagaaaattgaattcaaacatattaaattctaattaattgaaatataaattttttggaatatttgggtatttttaagtaggtaggtatataattaaattaatttataagtaaactaagtgtgagaaataaaatgatatggttgcatttattttttattaaattctccatattaattacactctttgaaattttcttgaaatttacagagcttaattgttaattttgataatacaaactaaacatcattttagcatttatttaaataaaaaacattctttctctatgggccatttttagcccattttcttcttcagcccgcaaccgagccgtcccacttttctcaggccgcaaggtattaaagtctaactaacatctccatactcctctcagttccacgtttgtgatggactgtcggcccgcatgcggctcaagtgtcaccgtgtggtgatggaggcctgcccaacactcgatcgatctgagccgttcgtttcgatggacaacaaccccagtgcaaccctaaccctagaatcattctccccccacccttccccaccacaccatcggccgcctcctcccgcccgacgccgccttcccccgcccgacgcagcctccccc

SEQ ID NO: 67212 - DNA, 3546 bp, Oryza sativa
agtatagaagagaccgaagcttggcatagtacacttgctcgaagacgattcatcccatgaagacgtgtcgcagatgggcgcttgattgggtgatcaggccaaccacgcacagtacgacactggagtgagagatgccgcgtagaccgtagtcgatcacggcattgtcgaggaaatcgttgtagccgagctcttgaacggtgattaagtcaaagttgcgcggggctagacgacgaagacggagcagaattaatgctgatgtcggggacacgaagagtcgacgacgcaaacccgttcattgaagggaaaaaaaaaacaaaaaggtacagcaagcgcagcacagtaaccagcccatagtgctccatggtctatagaccaagtccatgtcctgtcgaaacccagtcagccgaccccatatggccatatcagccttagggcatctccaatgtttatgatcatgagtagcattaaggtgtgtctcactatttttatggttattaccacaatgtttgaagcaagagtaaactttaagatgggtcccacaatgtactattctagtacttcttttatcagccatgcaaatttttcatcatcacattcattttaccctattattttattgcttggggtcaagccataagcttaaagctttcttttgcatttaatgccttatggctttgtttcacaatgtttatggtcactataaaatcttatggcctcttcttatggccacatggtggctgcccttatcctcccacgacttactccatgtctccatccatgtgtgaacactgaacaccgtggctgctggcggcttggcgcagcacgtcagcaacggcgggaggcggtggaggccatgggcgctcgtcgtcgtggagccgttcttcagatccggacaggggcggctgaggcgtgtggagaggcagttgttccccagcggcgacgtgggagagacggccggcggggaggtcgtgaggcgggatctggctggaggagggagccacggtggcggaggcggcgctccctcccctccctcccagatctggccggaggggggagggcggcggcagcggtggtcccagcgatggcggcgcgcgttgtctactgttgctcgggcgcacgcgctgcgtcaagctcgtgccgccaccacatcgcgtctgtcagtccaaggtgcatctcgcctcatgttcatgccggtaccggagttctcatgtttcatgttgcaatgcaattttattggggtggattggagttctctcatggatccctctgctgattttatttgggtggattagagtccaatttgacaattcaaagttctctttatcatattcgcgtacgaattggaaatttggaaacgggctagctgccgaacgacttggttttttttttttggaacagacggtatatgcgattttttttttaatttaggcctatgggcttaatctcaaactggagtaggaatcggtgtgggtttcttttttgcgtgacaattgggcgcgctttttttatgcgatctaaccaaatctgatccgaaacaaatttttttgctatatatttgttgacaaattttatcccaaaaaattgacagatgtaattacagtacaatcgtagtttaattacactgtaacttgcatgtaattacactgcagttatcgtagtgttattacactgtaacttgcatgtaattacgctgcagttatcgtagtgttattacactgtaacttgcatgtaattacactgtaactacagtgtaacttgtatgtaactttcaaaaatctttctgtaatattttatttcggtaaaatggaggctgtgggaacaaatccttacacatatgtgtgtgctgtgattttttatttaacgattcaaaattacgtgaaacttatatacaagttatacggtagttacatgcaagttacagcgtaattacatataagttacactgtaattacatataagttacagtataattacactacgattgtactataattacacctatcaaatttttagaagaaaatttgtcgacaaatgtataggtggtcccgatccgaaatcggatgcggtggaaaaaatagcgccagattagaaatcggaaaaacgcggtgatggacgaaaaaatgcggatcagaggatgagacgattggaaaaatagcaatatttatattagttaagatatgactagaaaatgggcgtgcttgtgatttttagcccgtaggtattgctaagtgctagtatttcaagatttatagtgtcatattattttaggaattagtttagttatatattgggttaaacctatccaagtgttgagcatggccaaaaacttctaaggtccttgatgtaaaatctatcattaaattgtagttctactattaggcgcgctcctaatattacaagcgccaaacatgcatcagctcaggcccaccccaccccatgtcccagcccaggcccaccccaccccatgtcccgttatcccactcccaccattgtcggagtaaacgattgtcggtgacatggggccgggggtatcgtgactagaggcttgggtagccgcgatcactcacgtggcccgaccccctcggggggggggggggggtcgggcccgacggtgacgtggccacctctccctctgtctccccgaggggtcgggccgctcccgtttcggccccgagggctggggcaccccgaccccctgtggtgattggcgccacgtgtgtgggttaggtgagcacagcggcgctcacctaaccgcatttatagcgggttagacgagcgcgtcacgccgcattcaatgcggcgcagcgcatgcttatccggtctgtgaccagtcgcggtatgtgaccggtcacagaccggtcagatcgcgggttatgtggcaacaggcggcctgtcgcacgcctcaccccgtcccgtcggaatgatgagagcttcctggttctcgtctctagccggagctggcgtgctgactcctggagttggtatgtcagtcccggtcagatccattccaggcttcagtgcaagcatggcaagaaaatcgctggccattgaatgaaggatgaaacgggcgtccaccgggagagctgacgagcggagcaggaggcgtgtgtactgcttgtcagaggtcatttccggctgtagattagccctcattgtaaaaagcatgtttcttttcttaggcagagagaggcccatgtggtgatccctaaccagataaaaaaaggaggctcaggcctaaggagagaaaaaagggggggaggtgagaggctggcgacttgatcggagagcctgaactctctctcgctctcgagctctctggctctggagctctcggttttccttcacacacagatccaccagaacacaggagtagggtattacgcttctcagcggcccgaacctgtctacgtggcccgtgtcttgtgcgctttttctcgctgacattcctcatatcgagggcgaagaacctcacttagcgcccccggccgaaccggcaaaggggggcctgcgcggtctcccggtgaggagccccacgctccgtcaatc

SEQ ID NO: 67213 - DNA, 1495 bp, Oryza sativa
cgcctcgtctacggcgatggcggtacgccccagggcgcgctccaggctgcgggcgcgctcttgcgtcacccgcccgtcgtccccgatccagagactccagcccgacgttggctggatgacgtggccgacttggtcatgacggcgcagcagcgactaggcgccggcgggcggtcctccgccaccgaggcctctggcgcagccgccgccggctccaagtcgtcgaggcggagggcgcggcgagcggcggccgttacccgccattcgtccgccattccctcgtcaatgcctccaacccaagaagatgtgcgtggggggccggatgcccgcctcgatatcgagcgccagcgcgacgctcgtcacgccgcccgcgcaacggagggcgcttcctcgtccggagcgccgcttcggtctgggcactggtccggccccccgtgtccccggttggcggtgccggctgtcgagcctttgtggcgagccttcggaacgtccgttggcccccaaggttccggcccaccatcaccgaaaaatacgacggaagcgtcaaccccgccaagtttctccagatctacacgaccgggatcgaggccgccgggggtgacgacagggtcatggctaatttcttccccgcgtcggtccactcttgggagaatttgtgccaagcagttcaccacgaacttccagggcacatatccgcgcccaggcgaagaagcggacttgcacgcggtacagcgaagggacgatgagtctcttcgctcgtacattcagcggttctgtcaagtccgcacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagcttcggccgcccccgggtccgccgctcggtcagggcggcgggacaggaggaggaagaaggggtcggcccgtttcgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaagaccctggcggctcccgccggcaaccggcgaggtgaggccaagcagaaggccatcgccgaggacatcgacgatggcgacgatgacctggggttccaggagcctgaggccaccgtcgccaccgtcgatgggggagcgtgcgctcacgcttctcgccggagcctcaaggccatgaagtgagagcttctggccgcgggccctaccatgaggcg

SEQ ID NO: 67214 - DNA, 1469 bp, Oryza sativa
tgacttggttgtgaagacgcgcaaccaagagaccttactctcggatctagcggaaactttcaaaagtctccgctccgcccgcataaagctgaaccccgataagtgcctgttcggcgtgcctgcgagcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcactacccctatttaagctcctcaaacgctccgggccgtttacctggacggaggaggctgagcggaccttcactcagttgaaagcgtacctcagttctcccccagtcctggtcgccccggagccagatgagccgttgctattctacctggcggcaaccccgcaggtggttagcgcggcgttggttgtggagcgcgacgaggacaaccctcaccccgtgcatccccaccctgtgtcgactcgacccgggagagagcagggaggagaggcccccgagccgaacggcggcccgaggcccccgacggccggagctggccctccgcctgcttgtccgacggtgccaggcgcccccgacccccaggatggccccggggccactgcgggaaggccgcgcctatcgccctctgaccccgaggtcgtcagcacagaagccgagtgcggggccgcgaggcctctcggacgaagagcgccctggagatgcggcccctggcgaagaggatcggccccgccgaaaggtgcagcggcccatctacttcgttagcgaggccctccgggacgccaagacccgataccctcaggcccagaagatgctttacgctattctgatggcttcgaggaagctgcgccattacttccaggcgcatcgggtcacggtggttacgtcttaccccctcggccaaatcttgcataaccgagagggtactggacgggtggtgagatgggcaatcgaactctctgaattcgatttgcgctttgaaccacgccacacgatcaagagccaggccctcgccgactttgtggcggagtggaccccagctcccgagcccgtctccgcccccgaggccagctcgggccccccgcagctgcctcacaccgcctactgggtgatgcagttcgacggctccttgtctctttagggcgccggtgcgggggtcacgttgacctcgccgagcggagatgtcctcagatatctggtccgcctcgactttcgggcgaccaacaatatggtggagtacgagggactccttgcgggacttagagtggcagctggactggggatccaccgcctcctggtgttaggcgactcccagttagtcgttaaccaggtctgtaaggagtaccggtgctttgacccgtagatggacgcttacgtgtgccaggtgcggtgtatggagcgccat

SEQ ID NO: 67215 - DNA, 2246 bp, Oryza sativa
ggcttgcccagccgtcggcgcgacccgaccccctaggggagacggacgcgcctgaacggcccctgaggcccgtcggagtccaggcctcgggacccgagggaagcgctcccagctcccctagattgattgcttggatcactgagatccaggcatacctcgtagataagactctacccgaggaccgcgaagggagtgaacgcgtccggtgcatctccaagcgctacgtgctggtggaagggaccctctaccggcgcgcggctaacggagtcctcctgaagtgcattcctcgggaacaaggcgtcgagcttctcgccgatatccatgaaggcgagtgcggagcccactccgcctcacgcccttggttggcaaggcctttcgtcagggtttctattggccgacggctctcaacgatgcggtcgacctggtccggcggtgcagggcgtgccagttccacgccaggcaaacccatcagccggcccaggccctgcagaccatactctttcgtggccatttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcgatttggggtgcctaacggtatcattacggataatggcacccaattcactagtgagctcttcggtgactactgcgaagacatgggcatcaagctctgcttcgcctcccccgcccaccctagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtccccttgggtcaccatgtattgcgaggctgatcaagatcagcttcgccgagacgacctcgactacttggaagaacgaaggcggcgcgcggccctacgagccgcgcgataccagcagtgcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctccgttcggctggccacgggcgacggcgcagagctgcctaacccgtggaacatcgaacaccttcgtcgcttctacccctagtgggggtcgggcgtcatgtctcgggctcgggccaaccccgcaccccccgggcgtgcagggttggccgggggctaccacatgcatatccttatcttttttctcttccgtatttcaataaaagcattttcgatttcctgaggactgtgcctgtgccatcgtttccttttgaagaatcttggcttgagttagcacgctcgtgctcgaccctgccctcggtggcccgggccggctaaaatcgccaaacgaggcccagaaccgagccgtgccccggggcgtggtgaactccggggggggaatcggcaaaggcccacaatcgggtcatccataaccctcggtcaccacgctcccggcctggccagtctcgacatgcggatctccccaggcactagcccccacccgcgccgcttgaggttgggacctgggcacgagccctcgttcaagccaagacacagaaggaccgcggcacagaccatcctcgtctcatacacacaacaaacataactgacgcagaaatttcctctttacttgattacagattaaatcagtctatacaagaagggggcccgaaggcctcggaagaagaaggaaaagctattaagattggcgggggcctgggggctcactccggcgcccccgggccgtcggcctcgtcgccactgtcgtccgcaccgtcgtcaccgccctcctcgtcggagtcgagcgcgaacgcgagccgaggggccgtaccctcgaagctgtggacgatgtagtcggcggcgtcccggacccgcgcgcgcgcgccatcctcggttccgggagggaactcttccagcgctgcccacggggagaagtcagggtccctggcctggtagcttgccagtacgagctccaccgcccccggg

SEQ ID NO: 67216 - DNA, 3230 bp, Oryza sativa
acgtggcggactccgcggtgcgcgccgtcatcgggagcaggttcaagaaccgcgccgcgttcctgcggatgctggagcggaggatgaagctcctgccggcgcagtgcttgccggacctcttcccgtcgtcgcgcgcggcgatgctcgtcagccggatgccccgccggatgaagcgggagcgacaggagatgatggatttcatcgacgacatcttccaggagcatcacgagagcagagccgccgccggcgccgaggaggacctgctcgatgtcctcctgcggatccagagccaagacaagacgaatcccgccctcaccaacgacaacatcaagaccgtgatcatcgtaagccgagctcagctcgatcagctacctccccacttaaaaagttcaatttcctcttctttttgtgcaggacatgttcgtggcgagcagcgagacggcggcgacgtcgctgcagtggaccatgtcggagctgatgaggaaccctagggtgatgcgcaaggcgcaggacgaggtccgacgagccctcgccattgccgggcaggacggcgtcaccgaggagagcctgcgcgatctcccctacctgcacctcgtcatcaaggagtcgctccggctgcacccgccggtgacgatgctgctgccgagggagtgccgggagacgtgccgggtgatgggcttcgacgtgccggagggtgtgatggtgctcgtcaacgcgtgggcgatcggcagggacccggcgcactgggactcgccggaggagttcgcgccggagaggttcgagggcgtcggcgccgccgacttcaaggggacggacttcgagtacataccgttcggcgccgggcggcgtatgtgccccgggatggcgttcgggctggccaacatggagctcgcgctcgccgccctcctgtaccacttcgactgggagctgcccggcgggatgcttcccggcgagctggacatgacggaggcgttggggctcaccacgcggcggtgctccgacctcctgcttgtccctgccttgcgtgtgccgctccgagaccatgagcgatagattgctacagtatcatttggaaatggataagacatacagaaaaaaaaagaaggatcaactggatgtcatcatgtcatcagtatatatacagactcatactctcatttggtgatgtttcaagtgttatctgtaacttttaaattactgggttttgtcatcatgtaacatatttaacctagcattgaatttgtggaggggaatgagtaactcaccagcggtggcgacaacgactttcagattgtagcatcagcgtgttaaaactccgacagagaacttggaattccactacaagaaacttgttaatccatgacgaattcttggtgacggattcataaaccgtcactgacagaggcaatccgtgacgataatttgttttccgtcgtggacgtgcactagtggatattcttggcccgttaactcgtgacggttttatccagatcgtcacagtgtgtgattttaaaatcgtcacagtgtgacgataatcaaaaggcatttcaaaacttgttttgcttgaaaaggatttgaatttgaggttcaaatgaatttaaaaaaatgaaaagctacactctctcttggaccatttctggctcactctctcctcttgggctcgggccagcctccctctcgcgctctgccccttcagctgggccagcggcccattttccacatgggcagccaagacaggctagccgcaggccaccctgcgccttgtaaaaaaacaagaaacaaaaaaatgtagccctctaggggactcgaacctacgacaacacgcacagtattcatgaggaaaccccactgagccactgaagcgttttgccaaacgacgtgcactgtattatatatattaaactgtagcaggtaatggacctgccacctactcgtggtgttcatcataaaattcacgagaatagctgcagatttttacttttaatgcgtgtataaaaatttaaattagtttatctccctcatactaacttcaactttaattattcttttttataaaattttctaaactcatgatctatccatttattgtgctattacaactattatttttgtcatactttcatgtgactttgttttatcaattgaagatttaaatttcaaaaagtggcaacttcaaacaacattttgaagcagtaaatgattgcaaaacaaatcaaacccaaaagacaaattttttttgaactaaattattttgttactaatttgttacttgtatatgttgcatatggtaaaactgaaaatatttgcatatatatagtgtgcgaacaaaaaatatttggagcttgtaggaatttaacctaacacctatagttatccagcaacattcatagctacttcttttagttgattatgtatgcactcacttatacttttcactacaagaaatatattaaaagttaaagcaatttaatcaagtgaattaatcaggaaactaaatttttcctttaaaaatcatggccggaaatatttttgtaaaattctaagcggtctaaattattctctaaaattttccgtgaattttcggagctcaataactagttttaataccacaaaattcatttaacctattaaaataaatggaaaataaattaaaatatctctctgtccttgggccttttttggcccaagtgttactctctccctccctcagcccgcagcctttctctccctcctgggccggcttcccattcccctcttcttcttcgggctgccagcctagcccatttgctcccccctcgccgagaagtccattttagctccctcttctcaattaatttcaaaatataaaaaatccgagtcaaattttatcatactaaataaacttatgtgaaaaagttatcaaaaacaaagttgtataacttaattagatctatcaattttattttggttatttctccatctgactttgattgacctatataaaatttgaattttaaatataagaaaaatcaaataatttttctggtagtaaataatttgaaatgaaaaaaaaatgtcaacaacaaagttgtatgacttatcaagatctacaacttttgttttggtcattttgctatatgacttcatttcaataatttgaatttgaatttcaaattatgacaacttcaaacagcagtttcaaatactaaatcatttcaactgaaaaagtcatcaataacaaagttatataa

SEQ ID NO: 67217 - DNA, 2177 bp, Oryza sativa
ctgccttttgcctctcaaggcacttctctttgcgctctgttttccctctatttcttggttcgatgatgaagtatatgctcctgattcagaaatcttgttcctcttattatggctactctcttcaaggactctacaccatttaggttgttctttaagatctttccacatataatccaaggtgaaagtattttggttgttctaacttttgtgccattcagggctttctctattatcatatgatcagaatacccattagtgaaagtacttctagctttacaataaaatccacagaacttagtgacatctctcttgacattatcccaatgtgttctgcattgcttggggttccttttgtgcccattgctaggcaatactggtgttgaactctcaagctatagccttccaatactaatattattttttgtcattgcctttgatgggatcaactgagttgttcaaccaagagctcattagttgtatattgtcatcttcagtccaattgatgcgtgtccctcttcttccttcttcactgctttcacttgcctcttcaatctcaactacttgtttctccttatatcttgtatggtatggaaaagctcatccatgtgaagaagtgttggctgcagccccaattgaagtactatagtgcataccaaattgtgatctattggctgcaaatccaaatgcttggatagatgactacactagattttcttgaagttgaaaacctttaaagcttcctagagtagtttgcgcataataatcttgttggtgagcaccttaaaagattgaagggtgtccatatagttggtagttgcttagaggaccaaaaggatggaaattttggagaaaactaggtctcaagttttagggataacttgtgggaaattgggtagaatggggagttttggacatcactatttgttgcttacttgtttggcttaacaaaaggctccacttagtatctagggaactgaatggatcaatatgttgttcatctcacttgtgcctcctttcgtaggtagcacaagaatgttgtaagaagcaatggctaggaaagcaaatgagcaactcaaatgaaagagcaccaacggctagtagaagtagttactatctgtagtaactgacatgtatattttattggtgtgaacagaaaaacattacaagtattatattttgtagctttgtggccacaccttaagcttaaagtctagttttattgcatgacttgtggtctgactccacaatgttaaatgtgttgtactatagcagcatttattgcttatggttactttttagtgtacattgtgctattgtggatgtcctaagacagtatgtaattcaaaggaataaaattattaacgagataaaaaaaatgatgtagcttgatttataaaaaatacagatttaaatttcattcataataaataaagataaaaagttatatacatatttaacaaaatttacctgtatagctagagaaattatattgcaactatgtaattacaatgtaattagtctaattcagtaacatattttaagagcacacgttacgcttacaaaaaatcctcgaaaatagtaaaagtgaagtgatttcttgcatacactgtttaatgcaatttcaaatttaaatttaagtttagattgtttgtgtgtttttttttaaaaaaatcgaactgtttggatcagtaaaaaaaaacaaattgttcggttaagtgccaaaattatggaatcgtttgaggtactgaaccgaacaagcacctccgccgaatcattcgcggcatatcgcatcggcatcggattgcaattcgcaccaaaccgaccgccaccgccgcaccaccaccgaaattctcaattttctctcgcgacgaaaagggaataaaagcgcttcgcctcgcccactgccacgccccccatctcttctcccgactcctgagagaagaagaaccgctgcttctccacccgtcgcggagccccgtgtccatcctccggcgcggcggccgccccccagcgatccgcctcaggtgagagcaccgcccgcaccccctactgctctcccctcccctggagatcggcgtcccactcactcccatcccccacctcatcggtggattggattggataccagtaggggggcgatcgctcatcgctgcttgtgtgcatttcttctggtagga

SEQ ID NO: 67218 - DNA, 1717 bp, Oryza sativa
ggacaggaatgtagttgtggaggagacagctaagttttctgagctgaagcttcaggcacgttcaatatttcacatctgattctgttaatctacaattatttcgaaaatctgatggctaaaataactagtaacattgttctattgccgtacatttgcatggatacagccagagacagaacagcgtccacataaggtcagcttttttgttgataaaaagagtgctcaggaagtgataaagtctctctccggtaatatggagaaatgcggggtgaggcaacattcgacttgatgttagcttgtttcaattttggataacttaagaactatttatggtttcttttcgtattatgttaactgctatatttcttgtaaacagcttgatgttaaaataatctacagtggtggccaagaccttgacatattacctcagggcgctgggaagggtcaagcacttgcatatttgcttaagaagttaagctcctgtggaaaaccaccaaacaatactcttgtttgtggggactctggtaatgatgcagaattatttagcatccctggtgtacatggtgtcatggtcagtatacaataaatttcatgaagtgtctaacaaagttcatgccagattgaatataagtttactgtaactgcaatctttttttaaatttttcaggttagcaatgcccaagaggaattgcttcagtggtatgcagaaaatgcgaagggtaaccctaaaattattcatgcaactgagaggtgcgccgctggtattatcgaagctattggacacttcaaactaggacctagtgtttctccaagagatgtggggtttccttatgttaagcaggaccatatcaaacctacagatgctgttgtaaagttttacgttctctatgagaagtggcgcagggctgaggttccaaaatcagattcagttgtacagtacttcaaaaatatcactgtaagtacatcactgcccagtgtgatgtttcttcaaaataatttgtaacctttgtcaaaatcagttttatcttttacctcaaaagaaattatcagaaccttctaattttggaaaagaagttatatttccaattaataaagtgaactgggtctgacgtattatattgttgagttaactgattttttatttgtttttggtttgtcttagcatgcaaatggtgttatcattcaaccttctgggcttgaatgttctctccatgcctctgttgatgcattgagttcatgttatggtgagaaacaagggaaaaaataccgaacatgggtggacagactatttgtctcacagtctggttcagacagttggctggtcagatttgacttgtgggaggcagaaggttagtccttagaattgtgtagaatgagtgaattagctcttatatgatattttttacacttcattcaaatttctttaatgttttacttacacaatttagcttgttcaatcatattttttcacttgtaggtttctctagacatgtcacttcaatctattaattttgttgtgtgttgtagtatatcctcgtacacaccagaaattatatgaaggttttaggcaatagtttatgaaaagattgacaacatattcaactctgcatctgtacgtacaaatgtcataatacattacacatatgcagtctagtgcaattcatttgtaaataaaagtaagaaaacatactcctcaataaaaaataatttattttat

SEQ ID NO: 67219 - DNA, 1879 bp, Oryza sativa
  unsure (1)..(1879): unsure at all n locations
ttacgtagatcatcgtaccaacgtacctcaataccctctatatccggtctacgggtacccaccgtcgacagtggcgcgccaggtagggggccttggtgctcaaggttctactattatgacatcaagcttcgtcaacaatagcgtcaacaatggagtcaagcaaaaatctactgtatgatcggcaacgatctatacaagaaggcgccaaacgggttacttcacaaatgtgtctcgtccaacgacggcaaacacctcctcctcgacatacacgaaggggtctgtgggtcacatgccgccggtcgtacattggtcagaaaagcctttcgacaaggatttttctagccaactgccctcaaagacgcttgcgacatggtacaacggtgtgaagcttgtcaatttcatagcaaacacacaaagcttccagcgcaagcactgcaaaccatccctctcacttggccgttctcgtgctggggctcaacatacttggtccattcccacgaggacaggccggctacaaattcctgttcgtggcgatcgacaaattcaccaaatggattgaggcaatacccacgggggaaatcaaggccgacaatgccatcaaattcattaaaaggatattttgtagatatggattgcctcaccgcatcataacggataacggctcccagttcattagcgccgatttccaagattactgcatcggactggaagtcaagatctgcttcgcctcggtttctcaccctcagagcaacggacagttcgagaggacaaacggcatagtactacaagggatcaagacccgtgtctacgacaggctcatgtcacatgacaagaagtgggtcgaagaactcccctcggtactctgggccgtgcgcaccacaccgacaacgtccaacaaggagacacccttctttctcgtgtacagctgagaagccatggtcccgaccgagttacgacatcagagtacacgagtacagaagtactccgacgaggatcaggaggaacagcgaaacgacgatgtgaacctactcgaggaacatcgagaacgggttgtcgttagggcagctagctaccaacaggccctccgccggtatcacgagaagcgcatccgagcacgcatactntcgatcggcgactacgtcctctggcgagttcaaagccaagcagggtgaaacaaactctcacccaaatgggaaggaccgtacacgatcacacaagtcttgcggccaggcgcattcaagattgcagacggcgatggtcgcgagttagcaaattcttggaacattgaccaattgcgtaaattctatgtataagtcaatagtatccatacttgtaagacatcttacaacttcaataaagcctgtttcaaggtacagatttcaatcaaagtgtcccttcccgatgattccttacccagatgacacctagcgttgaaacctatcctcatgttcctttacgccgtcctgacaaggcctccgaggaacctaagggaacttcggctgaggacgcccagagctgataatgcctgtcgaatcctttagagacgaaagaccatgtaagatctggtcatgtaagagttctcgccgtgcgtattaaccaagccgtgtaattggaaatggattttccaactttacggctgggggctaggattagtgcttatgcaactaaggcaagtcggtccaagagccttatcttccgagaaaaattctccgacgataaggctgggggctagggagagtgtatgactcaagtgactgatcgaagtcacgaagtgagaagacactcgtacacaccgcatccagagtaagaaaagcttagttagatagatttcctttctacttcacaagtatttcttacagtctgcaaaaaattccgaaat

SEQ ID NO: 67220 - DNA, 1157 bp, Oryza sativa
ctcgatcgacggcactcctgcttcagggcctcgtcgatacgcttgccgatgccttcgagctgagcacaggctccgtttagccacgagatatatccggccgctgactcctcgggatccccgcgaggtactcggagttccctgcagacgacggccatgactgtgcaacaactcctgaggtacgagttgaaccacaccttgcgacctctgagtgcctccacagcccggtcctttttcacttccaacatagtcctctcaagttcggcgacctcgaacttcgtcctccagtattggatgtgacggtcgcgatcagcaagcgcactctcgaggtctgctcgacaagcaaacaactaagttaagctgttctcctcttttgagagcacggcaagttaagctaatccagatagaagagcaaaggagatggaaacaaaaagaaccaacctaaaggagtcgtcgtcatgcatgtctccacgggcagattctggtctatgtcgtcttgcggcacatacggctcaagcgcaagtgccggaatgattacaggcaactcaggctgcccgcgttgctggacatcctcgacatcgacatctctacaaacaacaacaaagtactcggaatcaaaatgccaaagaaaactaaggtgataactgcacacaccaaggcagttggaaccaacaaattgttttacaatgcatgattgattaaggagtacaggcgaaccgaagtcctactcttcaaaaagtgggagaatagactctcctagatcactgacttcttccatcacgtccttacgcgcgtcgttagccgtcccctgatccaaaatcctttggagatcgagctcaaggtgcgccaaccttatgcacgcgaggacatggcacgtcccgatgtagatcccgttggacgtctcctctctgatcttggtcgcatgcttggaggggatcgcctccatcaccgtcgccagttccgcgagcgaagtcgtcagcgagaactcgtcgggattcaccggatggtggtcgtgacccgcactccccggcgagctggtgcagaccggtgtaggtaacccacagcgagccacggatctccgacaggttgttctcgagctccgacatacggtgctcaagcccctgccgttaccgttcgttgccggccaccagctccctcat

SEQ ID NO: 67221 - DNA, 970 bp, Oryza sativa
ggaagcttcgaataataattgggtaaataaaaccaacaaagcaacacagtttatccatcgcacaagtccgtcttgtacttgctttaactccttcgatactccgactcaactccttcaacgttggaacccttcatacctgtggagcaaaactacgcataaaccactatatcgaactaatgacagatataagggatatttactaaaatcgataacctgaacatataaaataacctatagcagttcccttactattttatacgtaactcacaaaccgtctaacggaatctagcaaataatataacttcggacatctagacaaaattgtctacaaccttcatgttgagtgaaaaatcagattatgcctctgaaaatcccagattaaggaaaacgaatttgctgtcctgatttcaggacccggtcagcagtactatttctgttgtttgtcctaaaccgtttatcggaatcgagcgaaaccagcggcgttagaaagatatcgtcgatgactacaaactttatttaggacaactaacctgaatcgtgaaggtttaatgtcagttttgaaaataccgtttccagcccataaccaataatctcagaaattgcacaaactgccaacgaattaattcctattgaaatcttttacatctagagactaaaagaaagtccaattgcagagaaacactactttgcaacaaatttccctaatctgcgaaatcgctgaaattccccaaagttgttctaccttttccttcccttgttactcctgttcaactgcttcctgtgctgtctggagccttctcgtctctgatcgatgcagcagcgtcaagcagcaagccacgctatagcatgagcagcagcaggaacgttagcatgcacaggcagcggcaccaacaccagaacagatccaattggcggcagcattagggaaaacaggaacagcagggaagaacacagcagcagctcaccaagg

SEQ ID NO: 67222 - DNA, 2418 bp, Oryza sativa
aaggtgcaagcttgtgctaaggctattgactagacctctagggccatgtaatagggggatccctaaaaaattttacgaattaatacaattgcttttacattccaaatattgttgagagaaccacgcctttcaatgtgacatagttgtccattcgacaacagctggcgccgtccgtggggatacccagaccgaaagggcaaaatgggacccttctcgccacacgccacgcccttcgccatagtaccaataaggtacgtcgtcaagggctgcgggtgaataggtttcgccacacccacgcccttcgccatagtaccaataaggtacggcgtcaagggctgcgggcgaagagttttcgccacacgccgcgcccttcgccatagtaccaataaggtacggcgtcaagggctgcgggcgaagaggtttcgccacacccacgccctttgccatagtgccaataaggtacggcgtcaaaggctgcgggtgaagaggtttcgccacacgccacgccccacgccacgccctcgccatagtaccaataaggtacagcgtcaatggctgcgggcgaagaggtttcgccacacccacgccctcacgcccttcgccatagtaccaataaggaacggcgtcaagggctacgggcgaagaggtttcgccacatgccacgcccttcgccatagcgccaataaggcatggagtctagggctgcgggcgaagaggtttcgccacaaccacgcccttcgccatagtaccaataatgtacggcgttaagggctgcgggcgaagaggtttcgccacaaccatgcccttcgccatagtgccaataaggcacggcgtcaagggctgcgggcgaagaggtttcggcacacgccacgcccttcgccatagtgccaataaggcatggcgtcaagggctgtgggcgaagaggtttcgccacacgccacgcccttcaccatagtaccaataaggcacgacgtcaagggctgcgggcgaagaggtttcaccacatgccacgcccttcgctatggtgccaataaggcacggcgtgatgggctgcgaggcgaagaggtttcgccacacccacgcccttcgccatagtaccaacaaggtgcagcgtcaatggctgcgggcgaaaaggtttcgtcacacgccacgccctttgccatagtaccaataaggtacggcgtcaagggctgcgggcgaagaggttttgccacacccacgcccttcgccacagtaccagcgaggtacggcgacaagggctgggggcgaaaatgggttaaggagttgctcccaagagcagccgaaagagatttatcatttttcaagatgctccgaggggccggcaaactcaattggacacctgagtgtcaagccgcattcgatgggctaaggtagtaccttcggcactagtgtaaaaatccatttggaaaaacattttctgttgattcggtgtgccgaaagagttcattaccggcaataacaagcggtttgactccgagaagtccaaggaaatatgtgaggggctaaaacttgaaatcaagttcgcatcggttgcacacccgcagacgaacggggcagccgaaagggacgaacggcaaaaccctagcagcactaaagaaaagaccgaaagccgataacagttaaaaaggtcgaagtactaaaaagaccaaaagccggcaatggtcaaaacgatcaaagtacctaaaaatacctttgccaaaggcaaaaaggggaaagtacaagccgaacagccgtaacacgcaccacaccccatttatttgccaaaaagcacaagttacagataaattccattgcccaccaaaaggcattcggactttacatccgattcatcagcaaaagcagtcctcaatggcgaaggactacccccttgagcatcttcttcatcgctagttgttagatcaacacaaaaaaaatttaaagcggcgaagaaggaaaaacggggattatgctgcgtcgacgctgggcaatggcaaactgacgctcagtcatataaaattcatgggtgtcttcgccttttttgtgtatgatatttcgtggaaaaaccccaaggcaaacgtttgatcaacgaaaacaccaggggggcgatacgaatcggtcgaagcatagctcgccgaacgttgaaaccgcgaaaccgcgacagctcgttttcagaaaacataccgatcgtcgctacactcgacttctgcaaatacttaagcatttctggatgcatatgccaaaagtcgagagcgaatgatgcgggctaaaagtcaatgtgaattccttttgctaacacacaaggggaccgacatgcttcacccttccgaacgtacaagttacaaaatgcaatgatagcgaaaagaaacttaaaaacacgcacaagctccatcgggcaaaagcacatacgtgttatacaaa

SEQ ID NO: 67223 - DNA, 2683 bp, Oryza sativa
caacgctcgccgaacattgaaaccgcgatagcttgtttcagaataaagatactgaacgccgttacattcaacttatgcaaaacacaagcgtttttcccagcgcaaaatgctacgagtcgaaaacagaagtcgaaagctgaaaagtcaacaaatcttttcgccaatccccgaaagggggccgaacgcatgacttttggcaaaatcccctctaaaacaacagggaaaaggggaaagaaaaaaaaatacaagtcaagaatcgtgcaaagcagacaaacttggcaaaatataatcacccagtgtcataatacagcttcgccattttcgaaaggcgaatgccagtgttcatattttttctgcaggagtctaaaaagaggtttcgacaggaacatcagccgaaagggggcgcctcatgccataccgtatagtttgcacggtctcggccgaagctccttactcacccttgcccgtgaggggcttgttggaggcatgccatgaagcccttcggccggacctgccgaaaccatagtaccagccaggatttaagctaaagacatcaagaccattcaggcgaagccctatggcgaaagccataagcgaagatggcgaaggctgaaaagccgcgtcggtactccgaaagtaaaggcatctcgggcgaactacaaagacttcgccatgacgagttcggcatcaagaaggcccaacaggccgcccccggccttttaggcccgttcgccatagaccaggcccagcctatcagcccattaaagacccatatgtgcaaatgacactgcgtacccatgtaaatgtccctttcataagggcaaccatgtaaaatcctttgtaaccctaaaccctagaaggtggaagcttgtgctaaggctataaatagacctctagggccatgtaatggggggatccccaaaaaattttaagaattaatacaattgcttttacattccaactattgttgggagaaccacgcctttcgacgtggcatagttgtccattcgacaacaaacttattagagaaggttagtgatttgataaacaacgttagttagtcaactggttgcatcattgccccattttcaaggtaaaccaaaaaattatcaagagtaatgcaaattaacagcctgcattatctcataagttgagagtgtagctcctgagacaagtcatctgggctgatggacaggggtggacagaaattccccgaagaccgaaggccgacccaacctgacccgaaccgaactaccggtttttttcggtcttcggctggagcttgggtttctaattttgttttcttcggtgttcggctgttttatcagcttgtagataacgcaaaccgaacgcaccgcatacaccgatctactatagcatgtcttgtgtctcacaatcaagaatggcatgtgggccccacatgtgggtgggtcccacattattttgatgtgaatgacaaatgggtcccacatatttttttaattctagaacacataagcgccacatcaaccccatatggaccgaagactaagtcaacatcgccacgtaagcgccatgtcagcgaaaccgccctccaaaaccgccgagggagtcaaattgtaccggttttaagagttgggggttgagatatccggtattttggcttagggtcacgaattagattttgatcagttttgagggtcacagaataaacttattcctcagataaaaggcaagcagaactgaaaaagtacactgaaggtccctaaacttgtcatcgggataaaaaacgtcctcaaaccgcaaaaccagatatgtggggtcccttaactatataaaaccggtcacccgaggtccttcggtggttttgaccctggttttgctctacgtggcggctgagccagcgtggcacccacgtgggccccacatgacaggtgtccacgtcgccctctctctttcccctttcttttttctcttctctttgccacgagtgagtagcaagggacgggcggcggtgagtggggctgagcgacgatcggcggaggcggcttgcgagcgcacagcggccggcgaagtggagtggagcgggggcgcggaggaggaggcgggaaaggaggagggcggcgccgcgacagcggaggacgccggcggcggccgccgccgccggcgtggggaggcggtcgttccatgaaaacctaaccactaccaaccctcttgcccagacgcggacaaagtggcgaagctcggcgccgccgtgtccgatggccggagcgagcgcgtcaccactgcggcggacaacccagagacgctggaggaggtgattggcttctccccatagaagcttgaggctatgggtgtggacgcactcatgatctaggcgaagatggccgatgaggacgtgccgttcgaggtggcgctggccgcgggtgacaccatcaccgtgttcgacacgctagtgtcacccgacgagtagttggagtcacacggctccaacgcctgtgtcacgctggtggcgaccgtccagctacgtgacccgtcacggcgctgcgatgcgttggttgcgccctggaggctggaggggggagagagaggggggagagagaagagggtatttaggcgttgactcagcaccgaagaccgtggtgaaagcgccatggtggacaaaaccagcgccatggtggacaaatctggcgtcaatactgtc

SEQ ID NO: 67224 - DNA, 1365 bp, Oryza sativa
ttaccctagaataaacaaaaccccaactagtggacactctactcaaggtaccactagtatgattttaggtagatgcttcgccgcttaattaggtaacattaggtggttttacaactctagactttgggatattcatatcacctggacactatggaattgttggatcattgtggaattggattcacacctcccctctattcaaaaccctcaaaatggttttaggctgggctcggggtgcatggttttgatagtagcacctcggccatataaggacaggtcttcgggcctctgttgcaaagcactaccgtacttccacatgtctagtggtaaggcttagtttgtggctcagtctggttataaacaaaagtacacggatggagatggacgaagtcgggggtcgatggacatctctaggacaaatgaaggctacacgagctgtggcccggtagtcgagatgtcatggcacagggccagtgtcctgctgctaggggctcagtcttgcctacctgtcccaggggttccggccgtaggtggggttgggtcggtactcttgtctatggctaggatatgttggaaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagtttggtctgaatcatcgtaggccttgggttaaggcaggctcgtgtgggttcacggcattgattaataatattatatagctctagaatcgtgtttacaaaatagctttgagcaactaagtgtctattaatgctatttactgcaaaccctaaccctatatattataacccccttgtactcccttgcatttattctgcacttgtgggtgacttgttgagtacggtggttgtactcagtcttgctcaatttttcccaaactcagaagaggagttcctggaagatgaaggctttggtgtctagctcgtgcctgccgtcaaccgcctgtggtcgtcgccctagttttccgctgtttttcgtttgtcttcttgtgtgctgggtcttcgccgcccatgtaataaattaattaattacgcttccacttgttaaactctgaattgtatcaacttttggtgtaccttgcctcctgggacaaggaataatgcacgcacgtaaggaacgcccgttgggttatttccggtcgtgacatcaat

SEQ ID NO: 67225 - DNA, 707 bp, Oryza sativa
cagtacataattcatcaaagcctacacagcatacaccataaaagttcacaacccataaagtttttacaagcaacagtacataattcatcaaagcctacacggcatacaacataaaagttcacaacctattaagaaatagtaaaaatagtatattgtcaacggtgggtacccgtagaccagatatagagggtattggcgtacgctggtacgatgatctacgtaatacaacatcaaggaaacaagagacaaagattatactggttcaggccccttaataggtaatagccctaatccagttgatatgggattatatggagagatccaaaaattacaaagggaataatagaactcgatgataccgatgagatcgtagtcgagttgattcaactagatcacccgacgacttggctcctgtaggctccggctttgtaggctgtggtcgttgtattggctatgagattcgatgtgttaggtcctcccggggggtctcttttatatcgcaggtcaggtggtctccaagtaggactcggagacatcggaccctgcacgatacagtgatgacccagtcctatacgggtaggaacctttccattggtggacttcgtgatgaattttcttagcgtatacagagaacgtccgtacacgcgcagatgtaccatattgtcgtatagtgtacatccaagggtagagggtataccttatccgta

SEQ ID NO: 67226 - DNA, 3302 bp, Oryza sativa
cattattggagtaaatgatttacttcgataaaaacaacttttcggttttcggtatatattctatttttcccgtacccaaccaaccactctcgcctcacttccttttttttctcttttttttggatctaaatcgatccaccatcccaccccacagatcggcgacacaccatggaggaggacgatgacaccgtggcggttgatggcggtggccggtgagcgatggccggcggcggttgaggcgaaggcactgcttcgggcctcgttgccggacgttgggcagcaccttaaccagcaataaggtatcacctgggccaatagcaacaaccagcggctactccaccacgtcggcggcattgatagaataagcaagtaaggaaatgacactttgatttgcatctgcatactctccttcaacttcatgcatgaagccccaatatttttttcaaatcaaattaacgtgcaatctccaatattacctgatctcaattgatgggctgcacaggtcctacatttgcacatcgtgctccatgtggctggccgtagaggatagggtggagtccgtcggtgatgtaggttgtttgatatttttcttttgctcgtcatctctattgacatgaacgagaatgtttttacatttttttgcgcccgctagatgatgatggctgacctacgtaatgctcatgtctagccgaccccgcttcatccctgtatcattccatcgtagtatgcaactcgctcgatggatgccctctccactcccagtgtgtgtgatcagtcagtagacacagactgttctatcatctttatagcaagatccagcatagccaccatatggattttgagttgaatcattttttttcatttctagtttgattcacctgtgagtaatttcatcgtctgtgtgtgagtgagcctgtaattttttcacttgtatgactattttatgatacagatcaacaatactcttagtatcaattttttactcttatactgtacattgaacatatcagtaaacatattactatatggtggctacgagatcatggctatatcgagaggaaggtggtaattgtttactcgcagaccaaggaatctcagtttttactcttatactatgtattgaacacatcagtaaacatattactacatggtggttacgagatcatgggctatatcgagaggaaggtagtaattgttttactaacataccacaaaatctaaacaatatttataatattggtaaaagaactactagcattgtaagctggtagtaattcttttacgaccatctaggtatggcgtcatacgatgtggagacattcatgtgagtaaatttgttacttttaaatgagcagatgtgggaggctgggagtaaatgaaaaactccacggagtaaattcgttacttttgaaacgtgcggagatactagaaaaatggaaaactcggaaagaaaaactagacggtaaatattttactaaaacgcgaaaacagaaaaactacagagaaggaaccaaaaacagaaaaatctggatggttaatattttagtgggcccattgatgaagcacggatgagatggaaaagagaaaaagaaacacggaaggtggagtggtaaaagcgaaaaaaacgaaccgagaaaaggtgggatgcggaggaaaggtggggtggtaaaaaagggaaaaccggaaggagagagcgttgtgcggcactcgaactaatattccgcgctgtagagcgcggaatagtgctaatggaattttatcaaatcgaatgcgagaagatgaacaagagagaggatggaggaggaagaaatgctaagttagtccaaaatttcattgtaagggcagtgagaggcatatatccaatatctacaagtttataatggtatatatgttcaaatatataaatggtagtgttatatttcaaactacaaaagttacgatgacaagcctaccagaggaggtgaatggtagattatgtcagcggaaaacaaataatcgaatcttaatagattaaaagtacaccccaacctcaaaaaccaatggaatacacgtccggcggtctatccgacctactagagtcggtctgaccaaaacctagccggtctaaccgcaggtcactcggcggtctaaccgtcagccctaaaaccagcacgacaacgcttctgtgaaaacttgatctctcttaaaccaaccattagatcgagttgcagactcgatagaataaactaaataaactaaggaacaactccacctgagagatttgcaaactataaacggtttaagagaaaacaccctcgaaagtcagctgtctcagaattttagcaaatctgaactaaacctaaaacttaagcaaattcgaatctagtaagaaccaatcaacgaaactttccagatctgatctatgaagtattagaaaggttttggatggattaacttgaacaaaatcgcagcaaaacaaacaatcacaagttaatgccaaaaccaaatataaacgtaaaacttacgaaaccagaatagatcatcgatgccttgatgattgaatatgatctttatcacttaaatatattgttcacaaggtgtagctacaacaccccttataaatttctcacgaaaccctctctaatatgggagttcgtagtacgcgcgtacgcgccgcgagcagaactagcgcgcacgcggcacacgttttcggaaggacgcggtagccttactaactctgttagttaaagataatgatggtaattaacaatagattttttattttattaggagagtttttttactaatagattgaaaaaaaataagttacatttgaaaacttttgacttaagatttaaactttgaactcaaattttgaaaactttcaactcaaactttgaaaaatttcaatttgcaagaaaattttttaaaactttcaactcaaatttgaaaagtttcaacttgagatttgaaaactttcaactcggatttgaaaactttcaactcgagatttgaaaatttttaaattaagatttaaaaattttcaagtcaagatttaaaaacttttttaaaaaatgaaaacacttgctactggaagattaaaaagtaatcaggaaaaaaagcaaaagaaagcggaaaaaaaagaaaacagcggtggttagatttcgtgtgcgcgccgcgtgggccgtatgggccgggagtgcgcgctgccggcgcgcgcgtgcgaattaggattatcactctaatctctcaaacttggcttaccttaaggcataacctccatctctatttataccaagaaccttcaacttcaacttaaagga

SEQ ID NO: 67227 - DNA, 2328 bp, Oryza sativa
aaatgtcaaggcgatcacgatgaggggaggtaagtctactcgtgatccgccgtatcctaaccctgcaggaactagtgggatatcaaaagaagcgccatctaatgactcggctgacaaggaagttcaaccagaaaagtcagtgccgcaggagtattgtgacacacggttgctgcgttccctcacggagtaggaaaccgtcggtggacgagcaattcgctcgttttgttaaagtaatctagaagatccacatcaacgtgccgttgttggacgctatgcaagtgccaacatacgcccgttatctcaaggatatactcaacaacagagaccgctcctaacaacggaggtggtcaagctgatagaacaatgcagcaacttgatactccacaagctcctagaaaagaagaaagatccggggtgtcctacgatcatatgctcgatcggggcacaacaattcgaccaggccttgtgcgaccttggagctagtgtcagcgtcatgccgaaagacgtcttcgacaagctcaacttcacggtgttggcaccaacaccgatgcgccttcaactggctgactcgtcagtccgttacccagtagggatagcggaggatgtgccagtcaagatacgggatttcttcatcacggttgacttcgtggtactggacatggacacgggaaaagaaacgccggtcatcctggggcgtccgttccttagtaccgcagtagccaacattgacgtgggaacagggagtatccgttttcatattaacgggaaggaggaaaagtttgagtttcaaccgaggacagaacaatgctccgtggtcagaatcaagtacgggccaaacccgtagaatattcaagtggtcgaagtggagccacccaaaatggacagcctggtgaaattcatgcagaatttcctagagaaggaaataacgatgcccaagcaccgttattggaagacgccggtaaaaccacccataccggccaagaagttagagcagccggctcagaagaagccgtcttccgcaccaaagccgaagaaggtgtggaaggaaaagccaaagacgcccgctccatcacccccgaagatgggtggaactaaatcagaaggaggtatggtcttgcacgtcggactttaaatgacgcgagcttcgccaacaggtaaattggtatgtatccgcaaattttctttcaacaatttgaatttttgcatcaacatatgtttgaacttcaaaattgcatttatgaattttgaggaaattcttcaaatgaatctttcaaagcaaaccaaaataaaattttcaatgtaaatttgctgtgccacgaccacactgaccgttggaatccaacggccaaaagtggggccggttgggcccaccaggggttcggccgaaccagtgactggccaggccaacggtcggctgcctctctttttgaggcaatggttagtgggccccacaggtcagttttgatcgttgtgggtgcacttcttaagccaaccggccgggagagggaactccaccctgtttaaacacattttcattccctctccaaagtttgctctcaagttcaatcaagctttgatggtttccctcaaattcaaatacttagttgcatatatacaagttgcttgggtgaaactaaccggcgggtgaaattcttgtcattcctaattaacccccgccgagttagtccgttcttgttccattgtgcagaatgaggaggcgactgtctcgtctgttcaaggggtccggctcttcatcaagtcatcatgacgagtctagtactcgttcatcagcagatgtctcgatggaagatgccgaagctctgaggcgactcctaaacgacaccgacctcgaacttgtcagtgatcgggagagacaaacctactacatgctgagcgaccaggagtatgctcacacgcgagagtactcaccggagctgctaaaaaagataggtatggatgttgagtttcactctatttggaaagctgttgattggtagagatttgctgtggtagatgagcctggttctcgtctgcttactttgcaatttctgtacactttgaaagaaatagaagatggtatttcctctcgctttttccgtgaggagttcacacttacatggaaaggcttaagtacacttcttggttttcacgattcctgtaaaatcgatatccagaaaggaatttctgggttcgagaaaaataggttttaggaagatatttctggtggtccaatttgcaagaaacctaggacgaatgatatccataatcctacacttaggctcatgcacaaatggattgctatgactttgtttccttgaggtgatctta

SEQ ID NO: 67228 - DNA, 1832 bp, Oryza sativa
atgtggtgtgcctccatctctaagtgaatggtgctcaagttcctctcgttgggacttgggtgaaatcactaggagaatggacacccttgatgtgcagacaggggagatccagtacaacctcacggaacacatagctcaaacgtaagaatggcaacaatctgctgatgctcagttcaccaacatcaacatgatgcagcaacagcacgatgacctacaagcgtactttcgctttcaggggttcaatccttatcaaggaccctgagcgaaagccaagcttggggggatatacctctccctccactaaggtaacttgtatcacattgtatatttccctttccaattgcatatttgctttccacttgcatcttataaaacttgaaaacaatataaaaatttgcaaaatagaaaataccaaaaagataggataggtttaagtcatgctaggtaagacaagctagttctcttcgttgaaatgatgaatagttgctctgttctatatctctgatatatgggttcttggtaaatgctctctcaaaggttaaatattagtagccaacaattatccgggaacctgaggtaaatgagctgcagttgctgatctaagtctaagttgttgcgagatatgagatagtaaatatgagttgctatgatcctgatactagtttgactttcattcaggatgttttgtttttcaaaatgataaattgagagttcctcatttgatataaattcctaccagagccaaaaatgtgctatcatgattaaaccatatacattttggttgcttgtcattccattgaactttgtcaaactcttgtgagttgtgtagataattctcatgctctatgatcaagatcatacacccacatatatgcacatgctaaactcctacactgggagctaagcaatattccattccatttccatattaccaccaaaataaattctccatactttcatatgttttcttctcctaaaaaaatccttttgaaaaagaaaaaaaaaagagagagggaaaggcatggttatgaaaaaaataaataataaaaataaagttatgctccattagcatgagcatgacactgaaaaaaaaatgtagccatgccctctcctaatcaataaaagaatgattttttgggagaagaaagtaagcacaaaggagaagctttttctttattttcctttatataccatttccatcatataccacacacacatattgcatgatcttgatcttgagtatgtttagtcatttgctttagtctaagtttttatttagtaataaaggcgaatgcaagtatgccatgtttgatccctaccgagctccacatatcaagccttagagtaggaatcaaaaaggcaaagtggtgaggaattcattttgatacacttagagagactgagtgaatcatttgaggaactaggctttcttatgcaaaatcatttgaaaacttccggaataagagttgaataatgattgggtgattggtgctctaattgttgttctgtctttcaactgcccaaggcaaggagaagcagtgtctcgtgggaatcaggggtaagggtaagccaccgtaccaaagattatttaatctgagagagagtacatataccttgcacctatatctttgagatatgcagcatagtagcaactcctgatcaacaaccaagtctttgtttcctttcgtccttcacttgggacgagcaaaggttcaagcttggggggttttgttgacggttgttatcgatcagttttgaccgtcaatattgccaaaatatagaactagtaatgcttgcaacgcatatatctgttagaataataatattccact

SEQ ID NO: 67229 - DNA, 2212 bp, Oryza sativa
gaatacaccgttgccacactgttaacgaccaaatttggtagtccaaatatcggatgtaaaggaggaatcgagatcgaaatcgagatagagattgtcccgcccacagagtgaagatcggctaaagtccaaatcggtcacgactagcatcgacatagttcgagttgcacggggttagccgattaagccgaatccgacaatatcacacagcatatgttgtcggtctaggttcacgtgcttcatgatgattgccacgcatggatagagtcctgagaagtccattgtatctattaattagcatattctatataatttccttagatatatgtttgggcaacagtctaccgcaaagacctatggtatcttagagtttgttagatataagagtcgtgtccgatatgtacgtattttgtaattatctgggtataaatagacccgagccccatgtaatcaaacgaacacacgttcaatacaatctcggcgcatctccacccattttacattcgttttgtttcgacgagttctcacttgtgggttaactgcatcagttttgatttctacaagaggtaaaacttgttatggcggcttgcgttctccggattagtgcttctatctttatgacactctaatcttgtttatgtaattcgtcgagttatcatatatcttacgtaatctctagcaatatcgtcatataacctacaatcggccaacatctgctaatagaaggcagccgattaggttaaatactgatgttgatctagattatataggatatctaccactctataaaacatccaacgatttgattgtctagatactgcctttcttttcatacttatagctgcatcagttgagtttgatcttataagtcgtgattagaatttcaatctctagcctgtctttggttgccaattagggttgtattggggtttcagccgatcttatcttatttaactatatttatcttatatgctttattgacatgttaaatctgccctttatgttaagatctgttgcgctaaaagtatattaggctttctgtttgatatattctacttgcattaatatcttaatatagagtggtatcggagtattagccgatacatgctagatctatctgactggctatgctatgaacatagatagtcttttgttggtatatatttcgatctaagtgatttatactgtctcggcatggtgaccgatatgtcccaatcacttgatttaagtatatatcgacataaggattatatattgttaatatctacagccgattgagtagatttagttctttcttatttattcatgactgccgatcgatgcatatatgacatcggctcaaagataaatgatttgtcatcagcatccagccgatcggctatcttttatggatttaaccgtggtttctttgtctttatttcttgttgattgcaggatcaaatcaactggcacgctcacacacccaaaggcaagttttggacctgcactggagttaagcagatctcccaggcctcgtgtttttacatcaacaaacacacaagcatataaatactcctatagatttatactcatatttcaaatataatctacaaggtgcatgtgtgtcggagggtgcactcctcaagcgagggacagtgaggcccccccttgttagttcggccgggggcagtgggtgaaaatcaaagactcgatggaaggtgtgacatagagggggttgggcccctcaggaacgatgagacaaaagtggtttatacaagttcgggccgctgcaagcgtaataccctacttatgtgtctggctgattgagtgtaagttacaaatcacttaagtcgctcagactcgagtgtgagttcgcccaagaatcgatctctcccctcaccaggcctggacctccttttatatctcaaggggctgccacatgggcctagaaaactgcctaggggagagcgagggcattcacattaaatgcatgtcttgttgcttaacttggaagccactcgcacgggcgctacgacatggggcccgtcaatccaactgcctgacacggggggcatccgtgtcattcatcattaatgagtgaagacttctgggtctttacttgcacggggaaacggaaaccctgctttgactaggtgagatgtactgactccggctaagcctctcatcatcacgacgtgacagaggccgcatgacatgcaaccagtgcgtagacgca

SEQ ID NO: 67230 - DNA, 719 bp, Oryza sativa
tacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatgatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacactatgtcatgacgatgatattagagtagtatctggtagtttaggcgtggtgtctagattacgggatatcattatttggagttatatattgcggatgagaggtgggccgctgatggtgacagctcagtacgggtattcctccacgccggtatataatcctaagttaatttcctagggagggtattcctccatatttagccccggttgtatggtcatgacgggctgtcgtaaggaactcggcagtcaggggtggcttctcgaagtaccaggaggacatcggatagagggtattagctagtatatcggtaactagaatgtatgtatactatgtatattagaagtataggaatagattttcttcctcttttctatctacttagct

SEQ ID NO: 67231 - DNA, 1440 bp, Oryza sativa
ggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcggagaaaccagtcggcaacagtcaggtcagctagcagtgaagatgtaggcgcccaacaacaacaacaaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgaagaggcttaacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcttgaatattggagagtcacttgttgtagtaaaatatcatggcattgcatgccgagatgtcgaggttcacaaagacgtcgtggttggtgaagtagtaaaacttgcgaagtagcagcaatagagtttgccggtgccgaagataataaagatgaagtcgctccaccatgatgacaaagttgtattgccgtaatgaagtgaacacaagtcggcggcaacagaagcaaaccggtagtgaagacgcgtagttgtgaagataaaagcaccaatcggcggcagcataatcagtcggcgacggaagatgatgatgtccatcagtagtggtagctgtataaaccagacgtagaggtaagggcactagtcagcaccagacgagacgaccggcgatgaagatgtagatgcccaacaacagctgcataataggccaatcaacactgg

SEQ ID NO: 67232 - DNA, 1240 bp, Oryza sativa
gactacacattattattgcacactattggaatttagttttagattatgtttctgcttagcataagttttgcgtagaacttgtaacggtcatttaaagttccggtccttattttcacgtggaatttgaggagctaggatggtttggattgtgtggattatatcgttattgagttatcttataactgactgtcgtggatgtccgtaattttaggaggagactgccgaaatttctaataattttcggagttaagtggtttttgagtgtattttggtatggcactctaggtacgtggttacctgggatgttacatagacaccaaccgaagaaaaagatcccctaactacttaattctattagagaacctcgacccgaagttggcaaatagatgcataattgtcgtgtcaagtttacgacattcatcatttattagcttgatatcttcatcatgtctttgtaattgaacccatcctcgaaactaatatgttgccctgaaaaacacctgcaaataagattttgatggtgtttttatcaaaaaccatatcatttctactaagcctaagagcccaacatacagcggaagctccaacaagaataattttttttatttttttactaacacccaaaagccaattcccaaacgtatgagatgtactatgtagaggataaagtccaaaaaataattgtatagctctccaaagaaatttagaaacatggcactcaaagaatagatggtatattgattcatttttcatataaaagcaacatcttaaactaccattccaattccttctagtcaaattatctttagttaaaacgatccctttaaggagataccacataaaaatcttaatcttaataggcattttaagtttccaaataatcttatttctctctatgtattattaattaaagctaagtaaatagatcgaacagaaaattggccattttgatgaaaattccatctaaaaatgtcatcctcgtctgttaagttaatatgtacaatggaagcacacaaattatgccacctaattagattttgaccaactaatgctcttctaaaagtaacattaagcggaatagaacccataacattagcaattgaggcatttttccttctaactatagaaaataacgaagggtacttttccttcaaagaataattccctagccacttatcctcccagaatcttactcccagaatcttacttgttcaccattattaataatccaggaagtcat

SEQ ID NO: 67233 - DNA, 1044 bp, Oryza sativa
cggagaaggcaacccggtccgtgaaaagttagacgcccaccacgggcagcataataggccagcggtgcagccgaaaacaccagtcgccggcgttcaaggtggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaagcaccagtcagcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcagcataataggccagccgtgcaggcggaaacaccagtcggcggcggtcgaggtggccggtcggtgacgacgtagacgcccaacaacggcggcataataggccagacgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaattgcggcataaaggccagccgtgcaggcggaaacaccagtcggcagcggcgaaggcaagccggtcggtgaagacgtatacgcccaacaacggcggcataaaggccagccgtgcaggcggaaacaccattcggcggcggcgaaggcaagccggtcggtgaagacgtagacgcccaacaacggcggcataataggccatccgtgcaggcggaagcaccagtttgcggcggacgaggcggccggtcggtgaaaacttagaagcccaacaacggcggcattaaggccaaccgt

SEQ ID NO: 67234 - DNA, 866 bp, Oryza sativa
gaagtcgtggacgcccaacagcggcggcataataggccagccgtgtaggcggaggcaccactcagcggcgacggaggcaagccggcggtgaagtcgtagacgcccaacagcggcggcataataggccagccatgcagacgggaacaccagtcggcggcgacggaggcaggccggtggtgaagtcgttgttgcaatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagtaagaaattaatctgagattagaaatcaatctaatatatattgataacaaattgaaacgaaaaactcaagtcgagcagtgaggctggatcatgagtgatagccggcgacgtgccatgcaacatgtataagccccggcaactaacagctaactcgatgttctttcggcatgatgccatcatcggaggtagccggcggagcccatcaaccatcatacatgcaaacaggaatcgaatcctggcggcctgtgccactcctgcaacacgtccatctgcaaggaaaggaagagaggagcactcggacacggcaagggcacccaagtaggcgacgatgatggccgtgtttcgatctcatccagtatatgaaattcgtcaaatatcaggaaatcaaacaatgattaaaaattaatctaatagagattaaattgcaacggtagacccgattgaagatttgagccatcgaaattgatgagattgatctcggggtttcttctgaagttgattccatcgcacttttcgacaggtaattcga

SEQ ID NO: 67235 - DNA, 974 bp, Oryza sativa
ccagccatggcagtatctatctccaaatgattggcttgggtttatgagcgcaagcttctgtctcctgcagtccatactctaggttccaagaggcaatgcgacaagtgattggtggcatgaggtaaagagaacagcagtaaggtggtgtttggttggagggactaaagtggggctaaactttaatccctctcacaaaaacaaaaacagtagtaaggatggatggatgcaatgtgtgttcagaaatgacagcagttggactctgaaatttgctgcaaaggtagctagtaggggatactcctatataaagtggtcacagaaagatttgtgccatactactccagtcaatgcagtgcagtactcatcttgtcatggaagttgggacactgcgtagcagctgcaggagtgttcaggtaaaaaggatttgagtcagagttcaggaattgttctcctgctagtagtacagaaactagcaatcctctgaattcgtgtgaagcaataagccaagaaagatctgccaagacaccactgcatatcatgatatttaatctttgcagaaaagaattggagatgaaaacgagcttgcaaaacagaaaagaaaaaagttcttcaatctgaaatgacttgacattgtcacacttcgtcagaattactgtactcacagttccatacttccatggcgatccattggccgatagcccgatatatcttgtgttgcaccgggatgaacaatacattggatggattgttcatggctccttgtggtacggaagaatcgattcgtaaagcctatactcgagaaggctgatctgcagctaggcaaagcatcaaacattgtacagtagaaaacaaatgcagagaaacttgagaacgaatgggttgggttcagaggcagccaagccaaaaacaccttgtagaagcaagagagaatcatgcagtagcatttcaggctttgattaacgtggggctgcaggaat

SEQ ID NO: 67236 - DNA, 2212 bp, Oryza sativa
caccacatatatttgtatatacattagcagcagatcaagctgcctccaccactgtacgtatgtatatgtatacacactggtggagacagctcgaccattaccatttacgaactgccattaacatatgtaaaatttgatcgattcgttgcttctttctttattacaaactgtcatcaatatataaaaaaattgatcgatcatcgtgaaacgctattggtggtttgggcttaagaaaacagtatgctgcacacggcacggatgaatgatgctgggaataccttcctatacgtccggacacgaatgtctagctatagctagtagctgcatatatattcctctcgagaagtagaagatataaggatgtgtttggataatggaaaatagggggtgggattgggattggaaaatgaataaagggttaggattaaatggaagagggagaatgaatggttagtatttaaagatgggtgggaaatcatttccctttcccatttgccaaacactcactaagagcaagtataatagtgagctataagcctactataagcttagatggaggagagaggtagcgaaaaattaagaatgttggctctcatgcaagagctagcttatcactagctctaagacaaatgcattaaatatataagtgagagatagagagatgagaagaaaattatagtcaatcttatagctaatctattatatatgttggctttaagatgagctaataatagaaagtgtgctctattattatcttgctctaaagggaaaaaaaaaggaaggaaagatggtagtaataaaaagctgggacgagtggatcgatccatgcatgtgttgttgcgtacctgcgatgcaggtagaagatgctcctactgccccccttttgaaggtgttagatcttcaatccatcaatcaatcccgtttcttctccatctctcatcgccacgcaccatcgatcgatcaccaaatggttagtactcagtacagtactcctcatacctttccttttccttttcttttttttttctttctttcttgttagtagtagttgctgctctagctaggttgttgttttgcagtcctcggaggcagcagcagcagaggccaggggacgcagaatctgctatagctagctgctgctgctgctgctacttccaaaagagtacccccatggagggacgccggttgcagcagtcaaaaggcttgcaggtgtcgacctcccattggctcaccgtggctgctgcaaaatgctcgccgaatattgcactgctgccgcaccagccactacgtacgcagtataacgatcaagccaatcaaggagcacttgcctgtttgatagagctcccgctccaactctatccaaccaaacagtttcagctcaaacaggctaaaataatctgaaaaaaattagaatgaggcgaggtttcggctgttccacagcttcactttagctccgagttagatctagttgttggagatctgccaaacaggcttgcaacaggtagcttagctatacacttgtctccttttttctgctggtctctgatctatgctagctccagcatctcccgtgaccgggaggaattcatcgtgacgacagagagaagagacgcgtgcagttctgaagaaacgaaatggattgatgcatgcatagtagttgcagtacacatttgagcgctatagctggccagagaattaatggtggtgtacgtcgtgctccctatagctcgcttctcgctcgtcgtcgtctcatcttctctggaagttgaggtacttgatggccagggcgaagacgacggcgaagagcacgcagaagccggcgaccatgcaggggacgacgccgaggaagtcgtggtggaagcggaagtggtcccggaggaagtcgacggcggtggtggtggtgatgccgtcggcgagcagcagcggctgatccaggtcgccgaactgggaggttagcaggccgtacagggtccatgacaccgggttggcccagtaataccacctccaccacgcaggaatcctctgcattatgtttaagcccattaatcattagccactttaatcacgtcctaatttaaacaaaccattattgcttcccaattgctaaagtggttctagtacatgacaagtggtcactgtaggaaaaaaaagttactggtgggtttggtgaaattattaggggcactggtatatcagggcgggctgcaggaat

SEQ ID NO: 67237 - DNA, 1598 bp, Oryza sativa
atggataatgtgcactggaatatggattatggggaaaacagatcatgggtccagtacaattagaggacgttaggtgcaaattatgcatggggttcctgttccttccgtacctttcttgggatcatgaacccacagaagagattccacagcgtgtagaatggagcagcaataataggcgcaacagtgtggttgggagtgatcgccgttgtcatcatgccatagaaagtgaagtacagcaaggtgaagtacatgaagaacaggtaccacaagaacttcactgctgtccactcgaacgagcccaagctgtagaaaatcgtgccgtagataagtgactgcacaagaatgtaagggaactccactgtaacctgcatgccgaagaacagttcgattgttagccttattatggtactactacgagcatcaaaacatgatgagatgacaggagtttttgacagggaaaattaccagggagaatgcaaaaggcagtgccgagtacatcccagctgccctctctctgtacgagacaaatctttcgatggaaatcacaggttgaacagaggtggcgttagtgattcctatgaagagtactgctgcgtacatggcacccatggcattgaatatgtcatgttgggtctccctgtcaaacaaagccacatgttcgctataaggccagccaagtacaggaagaaaagtggagacagaatcatcagtggacataccttcgagacccaaatttccagcagattgtcccgaacatcaaggaaatgatgacggtgtagaagaatcggaccgcagtgtattgaggatttctccagtacgacaggttctgcttccataagcaagcagcatattgagcaaagaatggttgggaatacttggtggcaaaagtaagttcttttgattctcttcttggtctgctcaggatatcaaccatttcttgggtctgcctggaatgccataacataaacatgtttaaggaaaaagagaccaagatttatagaggtgaaaagggtcgttgtgtttactgaaataattttgactgccggtagtattcagcaaaatccactccaagaatttgctccatttgagtacttgtgacttccaacatccatgcagcaggattatagccatccctgattttaggaactcctggaattgcctgtttacaaacttgaaagtgtaaggacagttttttcgcgaacgcaaagtgtaaggacagagaaacttgtataagctatcatcactgaggaaacacattgtgcagattgtacctcaaaaaactcgaccagattgcgtgatttcgagcccaagggaccagcatatataagttgccccccacgcttcatgaacaaaagctgaccagcatatgaatgagttaggaaagggtgctggttaaatgttagtacatacttgtataagaaaatttcgcggtttccctaagtagcacaatgaaagttcaacagatcaagtgtaaaagggactagtttctgttcacatccatcattgataagaaaactgattaacatcaaattatgaacgattattaaaatctgtactgttgcttcgaaaaaatatcaaaatctgtgctcaacttgtta

SEQ ID NO: 67238 - DNA, 1371 bp, Oryza sativa
tcattgaaattgaaacgatgtgacgaaaaaaagttgaaagtttgtgtgtgtagaaaagttcgatgtgacatatttgggttcaaactttgaatctaaaccaggcctaggagtatgatcttctctcttagtactctttggacactcgtttgctcggttgataaaattgaatgaaacaactaaaaataattaagtacaaatgtggttttttttgtttgttgaaacgcgcagctacagtaaaactgcttgttagtcactcgcaccaggacaaagcacaagtgttgatgagaacagcaggcagcaagctaagggacaagaaggatttgatatccacaaagcacctattcccatgtgtaaatacaggtaaacctttgttctttagcagtttggagctcacgtgatctcttccctacgctttgttcttaccctacttcatagaagtactccgagttacgatttatttttttttcagaaaaaaaaactacaagtgatttggctgaacaatcttcagatattagtaactttatagtttggacactacagtaaacaccaacagaacaaacacaaagaaggatcttaatggccttaatgagctattttagttttatatattagtgaagtgggagaagcaactactgatatcaatcattcagttcacaagctaacaagacaaaacaaacccaagggagaaaataacaggtcttatcagttgtcctgattctcctcctgttgatatacaatattacacaaattttgtttcttccaaagttccaagcctatatctaattggtttattttgattgtgcaccctacactaaactttatacttatacttgcaaaaaaccaaaaggatgtttagtgagtagatgacacacaagattctcttcgacagagaaaagtgagcacccgtactaccaaacggagtatgtagaatatgctatgctgttagtgcattgtccgatgcaatttcagtggtcaaacacaaaaacagatgcagtagacgcctcacaaattttcaggctgtctcgtggcgattgaccaaagaacaaaactccccatttggttcagtacatttatattgaacatgcatgatgcatccaacgttggcacatcggccaacacatttgcatggttgcatactttgcatatgctagctgctactagtgcaaacccaacacaccactagctaccatgtcagctggaatttaatttcttgtgaaagaaaaacaagaatttcaccataacagtcaaatcaaaatattctattttgcgagtaaaaaaattcaaaaccttctttttactaaatgttgtgcatattagttacatagttataaaatattctgaatgaaataattcgtgtttgctaaaattatg

SEQ ID NO: 67239 - DNA, 1167 bp, Oryza sativa
tcctgcagcccgaccactacagcacccaggatgaattccctccagcagctaccaagcgcgagcaaagaacaagaaagtgctgattcaccaaaaaaaaaaagatcctagaaagaatcactttgtttgtgattgcaagtgtttaaaaaagtaattgtacccgaattacggtttcttcacatacaaccatacaggataaatggccaaaaaactgctttatgtattatccttacatttagcattagaagaaggtaacactgcatctcacaccaactacctcagaatagtgactaatccaataccaatacacgcaaaaacacagatcagctggtgtacacttacatttgcatgttcaagtccaatgttggatcagctggggcaattgcaaatgcagctttcaagctctgcttctcaaagtagctgaaatgatgcaagaaataaatgcaagagcatgtgctactaaaaaggaaaaaatgcaactctagacaagaagtgctgaagtatcaattgagaaagtagaaccaaccgtgatataaaaggatgagttgaaaacataacttgcattactgaggccatatagcaactgcaaagaaggaaacgcatgcattacataagagaaattattacaaaagaaaattcatgacgtcaaccaatgaaccaaagctacctatttccaagatttacaaggccagtataaccagggccgtataaaagttcggcatctttgccactttcttgtattctattccagtcataatttgtgttgtgatcaagctctctttcagcagtagtcatctcggtctgcacaacaaaagggtcacatcaaatagcctctaaactagacagatagacaagcatataaaggggaaaacacagtatgaacatgagatgctacagaatatattattcccatgaaaaagtactaatctgttactatcacaataaaaaaagcaagtcatattgagcagagctaaattatcgctcataaatgtcatcgaaaatgatactactcaccttttggagtgaagaaaaatcaataccaaaatgtgacaaatgctgcgctaatagtggatcttcaacgctatcatcttctgggtatgagaaaacgtctgagctgtcacagaaaagcttgtatgaataggtatatttaaatataaaacaacagtaact

SEQ ID NO: 67240 - DNA, 2083 bp, Oryza sativa
tgattattccccccacttccatcccaaagccgcctcccacataggatcatgccatcagttaaatttaaccagagattctcagttttatcacacttgctgcacttccatcctgtaggtggcacaatgacaccattgtctagctgcttcagatccatagcatgtgcactgacttttttcttgtcagcaacccaagaagccaattgttgttttcgatcagcactttcggcaagtataactttgtcaactgcaatcctaacctgtggagttgtagagtagtaagtaactactatgtagtaagtaagtacaatctcttatgtcaagcacagttaccttctctggcaagtcaattgatggaaaagggagagaagtaaattcaggcaagataacaatttcaaaagcctcatcgtattcgggttcttgatcagtgaaacctccctccactcctataaattgtagaaaacccggattagtaaagatggtcaacgcattcatctatttgccatcatgggaatacagaacagagaaaatacaactatatagatctaaatccaggacataggcaactattctaattacaaataactagcatacagatatcacataacaaacaattcaccaacatggccaccatatgttggtctctgtttccagattagcaaacaaagcaatgcactagcatattttttctctacagcacagtagctcaacagatcaaacagaacacaagatatatgataactaccatagtttggtaagtctctaccacaaaggggaacagataatggggatacagattttcaacagtatgaaatacgatgttgatcatagggtaaaaacaagtcgcaataggaaaacgatcacatcatccaaacacaatcacataccctaacgcgattcatgcgttcacaattttaacagtatgaaatacacgatggtgatcagtgggaaagcgctgtcactcataccgatggcgagtagcgtgggcttcttcagcgggcgatccgcctcgtcgtcgggctccggcttccggcgctgcacgatgtggaggtacacggggttcccactcttctcgtagttccacgccacgtgctccctcccgaaccccaggaacgaggtcatgtcgacgtacagcccaccctccgacctctgcacggcgaaatcggcgtcaaaaccctaaccctaggaaaccagagcgaagggggggacaaggcgtgggtgggtgggtgggtggttggttggtttaccggggtgtcgaaggagacgcagcactcgtccttgtggatgcggctgccgggctccgggatgcggaccttgtggaggtgcgagcggaggagatccatggccgcgggcggcgccgggcggcggcggaggaggaggagcgcggcggcggctagggttttgggggtggagacggcgaggcgacgaggtggggggagggtggaagaggggaggagtgattagattagagatggaagaagaggggttaagttggtattggtaggggcaggagacttgtacgggaggcgatttaaacacgggggttagtttggcttttgccggcgcatttattgtcttgtttttagattttctttcagaaaaggcacaaatactacccctctgtcccataatataaaggattttaagattttacttgcactgtttaaccactcatcttattcaaaaaattttagaactattatttatttttttgatttacattattatccaaagtactttaagcacaacttttcgttttttatatttacataaatttttttaataaaacgagtggtcaaacactacgagcaaaaactcaaaattccttatattataggacggagggagtacttctttgtttgatattatattttgtttttttctaatcaagtttcattaagtttgattaagtttataaagaaaaccaaattagtttcactaaaactaatatttaatatattatgataatatatttgttttgttttgaaaatgttgctatatttttttataaacttgatcaaactcaaaaaggattggctataaaatatcaacacggcttataatagtaaccagggataaatatgtg

SEQ ID NO: 67241 - DNA, 886 bp, Oryza sativa
taaaatttgacacttggttcttgctgcagaatgacactgctattgggccctccaagttcaggaaagacaaccttgcttttagcccttgccggacggcttggccctggactaaaggtgtgccttatcacatcaatccgtcttcttttcttcgattctcgccgctcaaagatgatgagcaaatctcttctatatgtatacaatcaaccaactctgcatctatcacctgctgacaagagtactagtgtctcaaatagcatgaaaatggttttctggtcaaacgctcatccttctcatttcagaaatactatcgaaaaataaatactacttcagtgctataggcctgtgcttattctgatcagtgcaagaagccttttaaccatgcggcattattcaggactatacatttttactgactaccaacacccaatggattgcaggtgtctggaaatatcacttacaacggccatcatctgaatgaatttgtgccccagagaacatctgcttatgtcagtcagcaagactggcatgcctcagagatgacggtcagagaaaccttagagtttgctgggcgctgtcagggtgttggaataaagtatggtaggtcatttcaccacaatgtccttggtgttgttccttacctccttggtagtttgcgctttgacgttaatcaatatgtagatatgctcgttgaactcttgaggagagaaaagaatgaaggtataaaacccgatgaggaccttgatgtgttcatgaaggtagatcacatccagctttatttggacacacactacctgttttgttggtgattgtctcatgacactgtttgtacttaatttttcaggcattggctcttgaggggaagcagacaagccttgtcgcagaatat

SEQ ID NO: 67242 - DNA, 1227 bp, Oryza sativa
tagatccacgtgtcagtgaacagtactgcagagaatcctctttcaatataaccttattctactaagataagcatattatactgctgatgttggtcatcggagatgatcagcaaacatttactaaagtttcaaagaaggaaaagaataataaagctttaatactactactacacatttggtcctggatgaatggggaaattagggcttatttgaattaaaggatttttatgatgaggaaaaaaatggaggaatccaattcaaaagaaattctcctactatatgagcagtttagtttggatcatacgattgtttcaaagggatttcaagggataggaaaagtctctccacatcttcgaggaattctagcatggggtctaacctcgttgtttcgaattcttttgtgatttttaaggcatgttctctcctcctctctctagcaaattaaacatgtaatctcaattttctctcacccgttcgatatatccaaacacttgtgtttgaatgattcctgtagtttgattgcttggaggatttttcatgtcgtgacatttcaatcctaagttttcctcttcctgtattttgagtcatgttccaaaggaacccttaaagtggacttataactttcatcaatacatatttggtaactcatggtaaggagattggaaatttagagtaataagctaatgaagggattgatcctgtaagtttcatttttaatctctgtcgtttgataggagatatgagaattatgatgaatttgagtgagaaatgaattttaagtgatgatatactaacttatttttttctctcagttacctgcctctacccaaatattgaaaagacgagagttcgctcttaaaactcctcacccctcaaacttccatcatcttcaaacattccccctccctcctaaccaaacactccctcagcgttctgaatgcaacgtgctattcaattaatcacagaatataactttgactgacttacaaacttagtaccagaaggggataagaagtgaaatccgagtagaaatagggagattcaaaatcacatataggaaagtaagaataaccaacaccttcactcttggataaacgttgtcacaaaatacgtaccgtcaaattttaaaaccttaaatggccaattaataaaaacatcaaagttttacacaatgatgaaatatgtctgttatacctattgatagtgagacatctacatgattttctt

SEQ ID NO: 67243 - DNA, 1087 bp, Oryza sativa
agtagcagtatggtagcatggaaatgaaacgatggactaataaaccgagccatcatcatgtctagctactactggctactgatctcaaacggattcgtccacatcttgtctatgactttcaatgcaaatgatgctcagacagattatgatattatcctaacaacttttatccttcctaagcgatcgatcgacgattaatttcacatatcgtatttaggctaagatttgtcaattgaatcatgttccattttccggtgctttgtggtagcacaaaaggaaacaaaaggacattgctcatgggaccccatgctgaatgaaggagccacacaagggataagagtgatagatccagcttataccaacatgaaacactgtgtttggcttatgtggatgaatcagtggacactatctagtgtatggagaggatccacaaatggggtacttggcaaattgagcatggtgtttgcccccctggttcaatggacttgattgcgattgatgatgattttaattaattgctaatatatactaattagacatgtttcttaatttccccttgaaaaagatgaacatgcatgacatctataatacaggttattatcatggacagtccacttttaaacttttcattgggactctagatatatattacttactctatctctaaaataccttatatttagaggatgtttagatctagggtgtaaaattttgacgtgtcacattggatattatatagggtgtcgcatggagtgtttgggcattaataaaaaaactaattatagaatccatcagtaaactgtgagacgaatttattaagcctaattaatccgtcattagcaaatggttactgtagcaccacattatcaaatcatggagcaattaggcttaaaagattcgcttcgcaaattagtcgcaatctgtgtaattagttattttttagcctatatttaatactttatgcaggtgttcaaacgttcgatgtgacagggtgtaaattttttggcagggatctaaacaggcccttagtcaatctcagatatattaataaggatgtgaaaaaatgaatacgcctttcattaactgt

SEQ ID NO: 67244 - DNA, 1052 bp, Oryza sativa
acatgtaggtagaatgcttaatttgtttaaacaccaacgcaacaactaggtgcattatattcagttattcacttggcagaagttaagcacaaatcagtgtagtaattaactaactagcaagcaagcttgcttgacagaattgtcaaacaagaagactgctaattatcatcttagcatcgttgacaatctataataatcaaataatatcattgtctagttacctattggaaacttggaatgtgttcaccaagagcacgcaatatcggaaagtaatttgtcagcacgaacactttgtgtcacataagctgaacacacacacaagaagtgcagaaatgtgaacaaagagctataagaaactaaaactttattgaacttgtagtagagtacatttggatatcataagaagaatctgaagatctaattaagaagaaataaagaagaagaagaagaagaagaagaagaagaagaagaagaagaagaacatcataaaaacctaagaaagcaacaagagaagactactgagtaattaagagaggcgattgatcgatgaggtgtagcagtgtagctagctagctcaagctggcgtcgcggcggaggccatggccgacgccctcgttgacgccggcgacgagctcggcctcgaagttggccgacgacatggacggcagtcgctcgtacacccgcgacccgaggtgctgcagcttcttctgctgcgtcttcaccgtcttgctgatgatcttgtagttccaccgctgctgcacgtacaccgccgcggcgagcgcgacggcggcgagcgggatggcgacgtcgccggacctggagtagaagtcgaggctggtgttcacgaactcgtactcctccgcgaagtaggggttgatcgccggcgccctcacgtagtcgtacacgtgcggcagcagcctcaccgccgtcaagccggcgtagtaccccgtcttcagcggccggcagttgatccgccacaccacgttcccgatcacctgggggagcaggaacatgtcctgggcgagcccgatgtactcctccagcgtcaccgc

SEQ ID NO: 67245 - DNA, 1715 bp, Oryza sativa
cggcgcgcgtcgtcagcgtcagcgtcttggggtagcggagcacgaggaggatgttgccgtccttggtgatcggcggctggaacctgtcgcggtcggagtgcttggcccagccccacgggttggcggcgtcgccgccgcgcgccggcaggacggcgtcgccgaccatgcacagcacgctctcgccgtcgtcgttctcggtgtacaccccctcgagcagcaccttcagctcggtgttcccgggccacaccttgaactccggcgacacgtacggccccatctccggcccggtgccgttgcgggagatggcgacgccgagcacgccgctcacgttcagcgccgtcctcccgcgccgcgccgcgtcgacgtgcgtgagcgagaacgacgcgagcggcagcgggtcgcgcgccgccccggcggcggcgtcctccgccacgtcggtgccgtcgaatggcagcagcggcgcgccgccgccgccgtcgccgtcgccgtcgtgcttccagtcacccttgacgaaggacagctccggcatgaggccgttggcgcggttggcgtcgaacgtgagctccgccgcggaggagagcacggacttgcactgccgcttcacgtcggcgaagcggacgtactcgtgggggatgaaggggccctgcccggcgccgccgcccatggggttcgcatcacggtggaacggatcaaacgacgacacgacggcgagcagcggcagcagcaacgcgccgacaagctgcagacttcttgacaccattgctgcgcaaaaccaaacccaatgtcacaaactcgcaatctgaactcagatgaatttagcaacgctgctttggatcaaatttgaccaagtgagtgattgacatcaaaatcttcacacttcttggcaacttggatgaacacaacaatgcagtaaaactaatccttttcagcttgcatgatcagatcagtatcaacttggatgaacacaactatgcagtaacacttgcagaagaatgcaaaaaatctaataaaatttctgcagcatatctaactaatcctgttcagcttgcatgatcagatgatcagatcactgacctcaacatagaaatttcttcagtgctcctcaagctgggagacctcgatgagagtgaggtgagtgtcgaagaactgttcaccaaggacggctctagtacagactagagcagcatggatctctgaatttgaccagaatgtggtgtcagatctagaaaaaattcccggaccagattggatcagctggaatctaatctaccaccactgaacaacactgatggatggatgcttcccccgcattatctttttccacaccttaattccccttctgcatcatcgaatcaatcaagggttctagtatagtattgggggttgactttgcgacgaagtgacccagaaacagagggttacacccttgatcaccgagaatgcccctgatcagagtgacttatcacaggattgccactgtgagaggatcgtctcggtacaaacgagcagtggcatttcggagattatctcgcaactgtgagggttacagcgaggtgaggatgggggagttgacgaagcgacgcaggtggcgcgcgcggccgccgcggcgggcatcgcggccggccggccgctcgccgcacggggaagcccgtgccatgtcagggcggctgaggccacgagagggacgtcgcgccgtcacatggccgcacgtggcc

SEQ ID NO: 67246 - DNA, 2924 bp, Oryza sativa
caagtcggactgacgagccgaggaaggtggtaccctctctcgtcatagacggtagcagagacgagacatgttggaggatgcaattggaacccttgcgtcgccaccctcttctcatctcctacctcgtcaccatcactgcacctttctaggtttggctcgccaccatagtcgcttggatgattccttcgatgtgggaggagagcctcttgttgatcaactacaccgccttggggctattatggccgtcgtacacgccgacaaggccaccacctgcgcctggtcctcgagtgcctcgttgacctgggccatggcgacaaagtagtctcccaatgcaggaagagaagagggtggggacaaagcagtctcccactgtagggagagaaggaggggaataaaggagagccctgacacgtgggctctacctgttgatgctgccaacataccacgtcagtagaaaccgtttctaaaaccaacaaagaagtcaatttgaaccggttttcgaagatggtagatgtattatacctggttttacggttgagggaagcaattcaatcaggagcgagagtgaggaagtcatgataaacttattccttttctgagacggctgttaaatacggcctggcccataatggtccatcactagtatagctaaaactgtattcatgggcctgcagttgattgcaggctaaaaccgctgtaatactgcgtaatcatcaaagttcatttttaaaagtgtaataatcaaagttcttgcaaataaaagagtcaaccgagttgatatgtttgtctccaaaaatattctcctatagtcaaaatatggtgaaaagggtgttatttatgcgaagaattaataaagaactaaattgactttgaccagtagacttttataaaacatcaagaatctgaatagccatcgcaaaaattcctgaaaatcgatgcggctgttgcttttcaaagtgtcaggattgcttctacagcggtaaagctgcaatatattccctggacgataatactatatgacgtttcggacaaacaaaataacttgcgcttaatggattttagctgtcggaaatatcaagtaatctttgccggatggagtacttaggctgcgttcagaaccctatgttcccagcacaagctgtgcacacgaaaaacggaacggtccattagcgcatgattaattaagtatttactattttttttaaaaaaatgattaatatgattttttaagcaatttcgtatagaaattttttgaaaaaatacacctattaacagtttagaaaaacgtgggcgcgaaaaacgagaagagaagttggaacaaaggttctgaacacagccttggtaccaccaagcatatcattatcccattggaaaatttaatgtcatatgctatatttgtgcataccaaaacataacaactactattaattagaaccattcacatataatcacattaattgcagaagcaaaccctgcattatgcattattggtggctcttcacaattctcaacttaacaacaacaacaaacataatctcccaaacaattacatctagctcatatttaatctctccaccatcacataattttgatatttactactagtactaccggattattaaatcaggaacagctgagagtcccaaaaaaggaagaaaaacaagagggagaaaaaaaaaccagcaaaagcaaaagcaaagtaaagccctcacattatccatcgatccatagttccatacatatgcatcacatcaacgagtgagacaagctcaagctcctgctccttctctggtcggctcggctcggctcggctcccgttctccgcgcgcgcgcgccaacaaaaaatcacttttccctttttccaggtgacgctaattaatctcccggattagcgcgattaattaagctactagctagtattattactaatgagtaattaattacgacgcgtggtgatttgattggttggtttggttgattaattagtagttaatcgctcccgcgctcgtggtggtggtggtgttgatctcgtcgttgtcgtcgtcgccgtcgacggcgtgggcgttgttggtcgccgccatctcgtcgtcgtcgtcgtcgtcctcccgctcctcgccctcgccttcctcctcgatgctctcggacatgtcccttccggctccggaggcggcggcgccgccgccgccgccgctgccacggcggtcggagtccggggacccgagcctcgccgacgccgacgacttggcgctgtagggaggggccagctgctgctgaggcggcagcggcgggggcgggggctacggcgcggtggtgcaccagggcggcggcggcggggtggtgctgcaggtggtggtggtggtggtggtagtactcctgcgccgccaccgccgccgtgtagtgcggctgcgtcgccgggtgcgcgccgtagatggccggccccgccgcctgcgtcgcgtactccggcggcacccagatgcctcccagcaccaccagctgcggcgtcgctgccgtcggcggcgccggcgacggcatcggccgtcttgtgtgcaacctgtacttctgcccaaacaaaaaaaaattcagatcaaaatgctcattatggcattcatgtctagcaatcagttaatcatactgtcttgtagtcaatgatcaatttaaacagtatttaattaagaacgtacgtgagatggatgaattgcatgatgagatgataattaccctacctggagatggcttttcacctcatcattggtcaatccatcaaccttcatcagctcgcgaatctgcttcggggtcgccactttaatttgcaaagaacaaaacaaaaacgcaagctcaagattaatttgtttgttgtcttttcatctttggtacggcatgtaatcatggtgttcgatcttgatcgagttacatgtgtaggtgta

SEQ ID NO: 67247 - DNA, 846 bp, Oryza sativa
tttagcttaggttacatacaattactcaccatgattgagaagctgcatgcagagagggagctcacgcttgaaggcgtcgatcttgagcctctcttcctcgagacgtgacaagaactcctgaagcttctgcgtcgcctgccccgacgccgcagccaccgccgtcagatggtggtggtcgtctagggttaggtcagaagacgaagaagccatggctatcgatctcctccctccaagtatacaagctctacaaaccaagctagctcacgctagctagctacagcaaatagccgaccgatctagctagtatattactactactacttgagatgaagtagctgtgcaaactgcgagtgtaagtgtgagtgatcgagatcgaatgtgagaagggttttgatgagggatcagatggggaatcagcttctttttaagggagagttttgggagaaggaagaggagaataaagttggatttagaggaaaaggaaaagctagctttgtatgatcttgcacatatacacttagctaaacagctatagctagctagcaacagtagtgagagatcagagagagagagagagagagatagggggataaagcaaaggcatggtaacttcttgcaaagatcaaaggcaaacaaaaacaaaaagaaaaaggttaattctgctcctcctctgcatgcaggaggtttcatgtactacgtaccaacaggggaatcaacatatctcctaacattacgaccagatgggtccatattgcatatattgcaccatgcattgcattctctctctagatctctctctctctctctctctctctctatatatatatatatatatatatatatata

SEQ ID NO: 67248 - DNA, 1176 bp, Oryza sativa
catatcattcttctgaagatcacaacactgctgatgaaatcgcttcagacgagcaccaaatgcaaagcagaattgatgatgagagctgcaggaatgagatcaccgaatgctccgatgagatcgtcgaggtcggtggcgatggtgctactgagcagcaggacaggtgcaggaacagctttgagatcaaggagaggggagaggagaagaagatctggttcccaaggtctgacagctccaggggtttcaggtctctgccttcctcaccttccaagatccttggaatgagaaggggtgtggagtgcatgagcaggaagcccaaggtggtcggcgacgacaatggcagatacggctatgaagattcagtgtccacaagcagcagcaagttcctcaccaggtgcaagcaagccatcaagaaagcagtgaacaaataaacaattctttgcaccatgatgcagcacatttcaacctgtttattcttcaaatctgtgtgtttaaattcgtgtcaaattgctagttttgttttctgtagctgaataagttagtactcaagtgaggcatacatagctttgcagagttccttctgcaactagtgagacagacatttactgttcatggtcactattatgtgatcatactggcgttgtacaactatttgttgatttatttatgaagagaaactaaattcttaagtccatttcgtcctcgaccaaaccagaaatcttatatgcttccctctctttttagaacatcacagatttatttatgcactcaagtgagcagatttatctgaatggtttcaccacaaacaatagttcagacagaaaggtaactgactgtaattaaaggtagtaaaacagattaacgacccacttagccatcagctttggcttcagaatttcagatcctctcatgacatcgacttgcgccatttcggcgtcggcgtcgcggcggcggcgccggcggcgccgcccctgcccttcttcccgctcgccggcgtccgccgctcgatgccgctctcggagtcctccacccgcgcgacgtcggcgctcatgccgccgaaccataacgtgctccacttgaagaacccgccgccgccaccgctgccgcctccgccgtgccgcctcctgtccgtgctcagcctgtccacctgagcctgcagcgcgctgcactggacct

SEQ ID NO: 67249 - DNA, 5935 bp, Oryza sativa
tgtattccacttgaatatttgcaacaaagtcaagcatggcaaaaaaatactacgaactagtaagctaaaggcactcaatttggctctatcttttagtaaaccaagcaagaaaaccattaaaatggtagtagcgtatatacatacgcatgtctgaattttttttagtgaggctgggaataaatcaatgaatacaatttcatatcaagacttgaaaggattgatggttctgaatcttgtgatgtcttgttaagaaccactgaagatatcatgaacctgttttaaacgagatatttaaccatttaccacttttagatgtagcaattaaaatctaaaagtgataaatagttaatgccctgttttaaactagttacattcaggtgattgggttatcttttcgacatttttatatagaaaagcaagcatagtatatgctcttttacacgagacaacaaaaaaggatggggcttccatggagtaggcactggagtgcttgtagcaagggggatcaaatacaatccagtcattttccactgtaacgcatgtgaactggtccagaatacatacaagagagagagaaaaataaaactattgagagctggtattctcatgtcagtgacacagagaaagtagagccgtagtagagctaggcagtggcctatgaccaaagagagcaagtaccacctggagccaaagattttgtgcaacctctactactacaagaaggtgattttattgaatgagaatttgaacccaagagggtgattttataactgaatcttagttcaggccttgtttagttccaaactttttctttaaacttctaacttttttatcacatcaaaacttttctatacacataaacttccaacttttccatcatatcgttctaattttaacaaaacttttaattttagcatgaactaaacacgccctcactcttttttttaaaagcttgcaaagaagaaatggtagaaaccactccattcattgcatgaatgaagaaagaacagctagtggtatggtaacagtagtaatggcagcagttagccacagcaactgctccccctcctctgcttgctgctgccactactgccctgccctccttgagttgggtgagtgagtgacagtagtgtgtgtggtgtagtggtaggagaggaggagtatctcttgtatggctggggcctgtagtaggctgtagccccaaacctcttgtctccttttcccctcctctctctcccccactctacttcagttctttgcttgtttgctagcttctctcattgcctctcttgttgcttgatgcttttagggagagtagagtggtgtagtgtagtgttgaatcctcctccacatcttggaacttcttcttcttcttcttcttcttcttcttcttcttcaaagtcttcaaaggcttatcttgggtgaagaagcacctgaagcttccatcatttttgctttaatggtggtggtcttggggaaacttctgaagaaatctccgggggaaagattgctgctttgctgctggtttcgcggcaaatcttgattgattgcgttggaagaggtcggcttcgtgaaggaatcttgcttgcgggatcaatcgcctccgctcgcttgcttgctttttgggcggttcttggtgctgctttattggggtgaaaggttgggggatctcgcggccactcgaggtagcgagcgatctccccgcggcttctcctcgttgccggcattgcgggggaggcgagctcgccgccgggtcgcttgttgatgcggtgaggcggcggagcggagcttctcgctgtgctgctgctgcggcggccgccaggtgttcggtgaaaggcgcgagcaagcgagcatgagggacttcccttcctgcttcggggagagcggcgtccagatcgcggacgcgtcgtcgtcgtcgtcgagcgccggaaagggcgcggcgcagaatctggtgacctgcctctaccaggcgcagttctcgggccggccatgcgtgatctcggtgacctggagcaagagcctcatggggcaagggctcagcattggcgtggacgatctgtccaaccagtgcctgtgcaaggcagacatcaagccatggctcttctccaagaagaagggctccaagaggcttgacgtcgaggacggcaagattgagatcttctgggacctgtccggtgccaagtttggtgctgggccagagccaatggaagggttctatgtcgccgtggtgtttgaccttgagctgatactcctgctcggcgacatgaagaaggatgcataccggaagaccggcgcaaaccggccgatgctgaatgctgcatttgtggctaggagggagcacatatatgggaagaagatttacactgccaaggcacaattctgtgaaaatggtcaattccatgatgttgtgatagagtgtgacaccgtcagcctcaaggatccatgtcttgagatacgggtcgacaagaagcccgtcatgcaggtgaagcgtctggcttggaaatttaggggaaaccagacaattcttgtggatggtttgcccgtggaggtgttctgggatgtccacagttggctgtttggattgacgacaagcaatgcggtgttcatgtttcagacatgccaagcacctgagaagtcgatgccttggtcatactcgcaggtttttagggagtctcagttgcagggtcttggtttctcgctgatcctatatgcatggaagcttgaataggttcttgcagaatcataatttgcttctgcaattgcctccgttttagtgctaacgggatgtttatgagtgtcaattcttggaaatgttatggaggctctccaatatatgttctttcaatttttcttggttttgccatcttttataaacactgtttgaatagtttggcaagattctgtgacaatcctgtgattctcaaattccctccttttgctcctaatgctctcaatagtttactgtggcaatgctccaagaaagaatgttgtcatgatgtaaagtacttcaaagttcggatatagattatttgttaatagcaacatcgtcagacgatttctactacttgttcttccctgtattatcttgtgatcagtcacaattgttacttggagatcaacaaacttgtaaagttcatcatgatataactttgatccctgtggaaaagtgtggattttgaggaatcaagactcatggaatacgcgcgcatcaaggtctatttaccctaatggcggtcctttttatgcttatcacagacatctgattgtgtctgtctttttcaggaaacatatcacaccaatgaggatcctgaagttcaaatgctgcaactcagtgaagagacttcaaattctgtgtaatttcgttctatacatctactaaagtgatgatctaccgttattgttgctgttcttatcacctgaagtgaggtgggtttcaaaaagaaaaaaaaacaaactgaagtgaggtgcctcaatggccattggctaaccaggaagctggttggcttagctctagtgtgctttatttaggagatcgcattgacattagcaatgatgaacaatcaaattaaacagcctgtagctttccgaactgttggaccacatcagctttgacgttttaaacattaaataggacattatcttgtcatctatgatgaatttaaatctctttttttttcctgaaaggtacaccatttgtattgcttatataatcttttaactctagtgagtgtatctaattccattgatgcttccctttgaacagaagatcgtggaaattcatcattaacagtacacaacaatgtctaaactctgatcaaatcatgaatctatgaaatgggctaatattatattattttaatcatggtatcattggttaagtggttaactgaacaagtcctttctttaaccatgctgtaagttggcatttttatccatcaacttattttgtgagtagtacaaaggaacagactgaactatcgttaaaatcagaaagctcttggtttgcaaccaaaattaccaaatggaactggaaatttcttgccttgagctgagttaagatccaaagtactccttagggtcttacggccttgctagacccccaaatatacaggccatccaagatatacttcagtagaacttgttttgctcaacgtaaattgggttgcaaagccggcttactttgcttccttaaatcaatcttgtagtcttcattgattcattgttggtaaatttaattagccttcctacattattggaagcatttcatatatgatattttgggagtaatattcagctctctgacagttggttttcactagtttcacacagacagacagcattctgtctgttagttcctgtccattcattcagtaatttcttgtagctactgtttggagcaatacacaagattgcatttctggtcaatgcaaacatagtcctttaacagtgacatttgagaagaacctcacaactgattctagtgattgtccattgatagctacatcatatgaatggaattttctgtcactataagtactgactactacctaccggattgcggtgctagtttaacaaggaactgttccaacttttcttagtcaggtacagtaatatggagggatgactttagtacggcagtaatcttactgtggcttaatagcatatgaatacaatggaaagtgaccatgtggtgtttgcctgtttggtacagtaatcttatttaggagtataaattctcttccaaccaaaaatagatgatatcctgttccaactagaagaagaaatggaaaggaaagaaaaaggatgttgatctatctaaatggaagacattgcataatcagtaacagtatgcagtagatgtaccatttattgtcatcgtctccatcatcttgctgccttatttttagaagaagtctatgtagattattgtagataaactccaaatattggatttgtaggccatgcagattctttatttctttggttatatacatattacaaacgatatccataacttccacctttcatattactgtatcctctaagaaggagcaattcagataattgacaggtttatcaagttagtgagtccatgttaggagagtacgaacatcaaaattttaagcatttgtgagtgcaacatgggctgggccaggattggcatttgccttgtggcagcatagagcctgaataggcatcaacaggtagggatgcctattttatttctattgttttagttgatgaaaaatttacctggttggtgctcgactgctcgtgcttcctgattttcacatgttttctccaatcttctactcaacgaattgttgcatgtcatagttgaatacaaccttctcattttgctggtggaagaagccgagtcaaagatgtctatccttattgacaagggcggcatacgacatatcaacagcaggtcagacagtaccaaaaaggtatggttcttgtcgcagagcataatatattcaaaagttacatgtttactttgaagctggattcgtgttaacacacatatgctttgttatgatggccagttacttgaatcttatggtataaatgtaaatataacactacaaatttgtaatggtgttcgtaaaagcaggcaagataatgtttgtgctgactacctatagtcttaaaaaccatccaaaaagcaggcaagataatgtttgttttgactacctatagtcttaaaaaccatccaaatcagcaacagctttcctgtacgaaaagctaagaacattgagttagtgctatacccaaatgtccaagcaaaatctactataagtttagcataattagttcatgtgatacatgtgagtttgcagttaaaatctgtgaaaaatgtattttcatgctatgttttcatgatatcattaagaccaaatgcatttccttctctctctctctctctctctct

SEQ ID NO: 67250 - DNA, 4243 bp, Oryza sativa
ccgtaagttgtttctgagaactcattctttcaacatgcatcaactcctcttggtgatttccgcgattgcaaagccattttcattgatcattttacgcggtgaaatcgacttgtttcttccttctaacgttgttatggccctgacattgctgtgcttgatgctttcttggcagggaggggaatgcacattctgtacaaggatgtcaagtcttgccaggatgaggatgtgcatgttctatggtccatattggtggattcgcaccgtcacccagctctgatgaagctgaagctctagggttcttgaagaacagagcaaggatgatggcagctatgaattttctgtgattttgccgtttactcggccattacctctgtatagaacagcatgatttcaatggcatcaagattgaaggggcaaaaaaaatagaaggacaaaataggcagatgtttatatgcctttcttgtgtgtattgatgtttctgtcttgtggctttgtgagtgaggttgaaatgtcacctttggttgatgtgaatgcgagtgaggttgagtttaatgtatttgtatatacagatgctctgatgccttacctaatggtatgaagtttggtagcacgtatttttctctccctgtttttttgctgatttattttttataggttcaattgtgtttttggatgtattgtgtctggccaattccttcccactcccacacgtgttcatagtgcccataagaaaataacttggaaggatatgtttatataaaggcaaaattataaaggttctgtaccatataatactgcacatcaatgtcaaaactagtactattcttgaaccaatgcagtgcttattggcaagtattctatatgaaataatcctaacaccaacagtttggtctacaattgaaaaaatctagctactaagaatttgaggacttcaaaaggaagaacatagaataaacaaaattaattcctgcctaaatcctaaatcattctgcaggtgctaccctaactcaaaattgcatcttaaaagttccctagcgtgctcttgttagcctatcctccacaccaaaattaaaatcttggaacataatctttagagttgattttgaggtttgttcatggttgtctattttccagtattagcttttaaaccattactaatataaatacaaaagtttttacccataaattatttttcctttctttatgcatattttatggcttattaaagccatagatctaaaactgatgttcatcatgtcaaaaaagaaaaagaaaaggtgtcgctcaaataacaaaaccctacttgtacaatatagaaagagaaaatttaactatatgggccctcctccttcgtcggcccatttggcctattacaattcacaaatctggctcatttttccgaatcctccctacgacttgggcccgagactggtctcctctctctttcccccacaaaagcgaggacgcgaaggaggccgccgccgccgcagagaaggaagagagggagagatcgccggatcgccgcccgccgccgccacgatgtcgtcgatgctgtccgcgttctcgcagtggttcgtgaacccgcgccgcaacccgctcgcccgcctccacatgcaggcgatctcctcgcgcctccggaaatacggtagggtttgctgtctcgcctggatctgggtgtctcgattcggggggggtggggggctttcttgatctggaaatttgatgggattttgttcttgttattctgtatgtgtgattgatccgttgttaggcctgaggtacgacgatctgtacgacccgaagcatgatctggacatcaaggaggcgctcgagaggcttcccagggaggtggtcgacgcccgccaccagcgcctcaagcgcgccatggacctctccatgaagcaccagtacctctccgaaaacgaccaggtccgttcatttccctcctgccctgatctagtttttgcggcgatggtgtgcagattagggtggccgggtttctaggtttgtgttttttgagagcccacgcaacaaatacgtaaattataggttatcccgattattgcctgtaaagtgaaatgagtgtagagcaaaggggatcgatgcactcattttgggtatagtatgatgttgatgattcttttaggcggaaggttgtggatgcatgattcgggttaacatatgttacaaaacttgttccttgtttgtgaagagggtgtatattcgtcctacgaattcttgatttcggagttacagcttgttacacatgtattcttgtaaaatttcttacctaagaacctgaatacacaattaggccatctttcatctttagcagtgagccagtgattaccattacatttgtcattatctgtactaacccggtaaactgatgtgcttctgaaacattctctctatttgcacaggcgcaacagacaccattcagaggctatttgagtgacatgatggatctggtaagtgtatctgaagatgctctttgtcattgcacttgttcattgcacaaacgctctaattgaatgccaagttacattaagcattacccttataattcttagtatgaggtcttgttgcatttggttatacattagcatgccataatgtaatctatagccttgtaattttctcttgtgctgggtaaaatgtattcagattagtttgaaatggcagtctattaaattcatgtaaaaagggttttcctcttgacgccactctaagctgaagatattgtgtgtttataaatttgcttttgttcttgagtatcctcgagggtgcatgtcggcatgaatatcgatcaccttttttttcttgtttattatcttgctgggcatggtcgcttttagtattactgggttacaagaagcgtgatccctataaaatttgcagtcatgggttgtgactattattttctagtatccttctaactcctcaggggttgtatgcaatctaaccatgcaatacccactgcattcaattagttgtacatagaaaaaacaactgaaataactacctaagaaattcctaggccttaattttatggtttgccattacccattagccatttatgacgtgcagctaattttcatttgaagcttgtgctagtctaaatgccctttcccccccttgttgcaggtgaagaaggagagattagagcgtgaagaactgggagcccttccccttcaccagaggacccttccctgaagtcttatcttgataggccctgctgttttttcccaccacaatgcatcaaataaaatgcagtggatgactcatgatactgtctctcattttgaagttccattttcatatatattcgtgtgtgatgcattggtcgtcactgattacttcgcatccttttcaaatatgttaatttaacagcaacaatttttcttttacatcattgtcgtaaattcttcatgtattgtgcttcacatgagaagaatgtctgttgtttgctcagaatggcttttgttttaccacctattgttttgattatgccatggttcttggtcatggttgtttgtgcagagtcgcatttgagcgattattcatgtatattgtgcttcacctgagcaaagaattgctttatgtttacaactacacccactgtttcatattataatacgctttgactttttttctaatataaaaaaaatgtataatctcttacaacaccaaattagtttcattaaatctaacatgaaaaatattttgataatatatttgtttggtgtcaaaggtactgctatacttttataaacttagccaaacttaaacaattttgacttaaataaaaaagttaatatgccttataatgtaaaatgagataaaaatggagagagtattattttgcatatgtcatggatgattttgcagcctttcatttgagcagctactggttatgacaattgacgagcacgagctagtatagtaatagagcttccggcttgttcttcctaacgagttagggttcctcttattatttttggcgcggttaccgcacccccgcggtaagtcggttaccacggtaaccacgagacataccgtgtttcaaaaactgaaaaggttaccgcgcggttttgtaaacccctaaaatagcattagagctctcagcttgttcaagtccatgaaagtatcagcttttggttgtcaaatatactccggcacgatctagaatagtaatgagagcgtaatagagtcttggcctgttgaaatccataagagctaa

SEQ ID NO: 67251 - DNA, 5066 bp, Oryza sativa
aatctctgcaggatgagaggaggatatttacctgccatgtcttgatccgagctccattggtggtgccatagaggtgcacggtgtcgatgaagatgtcagacacctcagctctggagttgtcatctcctaagctcccaatgctaatcccatgcccgggcccacacaccagtctcgtgacgtgtaaaccgtgggtcccatcctcgatcgacacacagtcatcccctgcagagatcaacaacaaaaacctaatcagagtcatatccttttgaagattaaaaaaaaacatacccttttgggcttattcaagcttatgggcagggaattattgggccttccaaacaaggcctgatcatgtttctgtgcttaatttggcaattgattactcgctcagtttaatattataaatagtttttacttattttttctagttaattttttttaaatttaatcaaatttattttaaaaaatagtaatattttcaacataaaataaatactccctccctccataaaagttacacatattccacatttgagcttttccaaataagttgcacctatttgtaatctttatgcattcaagacttaaataaataaataaataaaatgtttgattagaatccaaggagacttctaaatactcattggttgcatgcttgcattacttcttgattttgtaacatccaagacaaattaatttcttattagtcttagtgataaaaataataggtataacttttgtggatggagggagtatattacaaaattatgttaaatgctatatttaatgaaactaattttgatggtttagatgctatatttggcaattgagtactaatttttttataaactagtttgactaaaaaaataaaacgatttataatataaaatagagggagtagttgcattacctgtcttaatggtgcagtcgctgacttggacgttcttgctgtgggtgatgtggatgccatctgtgttggggctcgtgccgggcgcagagattgacaggtgggccagctccaccccggtgcaatcctccactgacatgtggatctgctggctgttcaccatcttcagaccattcacgctcaggttgtcgcacgtgtggaaactcagcgcctgtattaattacaaacaaaatgaatcaaattaaaaggtactacaaaaattgagtaaatgaaatttggaaaaagaagagaaaaaaaatattgcatttcgcatgcatgcacgtaccgttggagctcccttgcatggctgaaaagtacagaggaaaaatgaactaggttagagagatccgtggccatcacaattgactaaattataaattgaattgaatatatatttgaatacgaaatgcacgagtagaaagtcaaggaccatgcgacgtgcaaacgaaaatttgaagcagccgccatgcataagtaaaccatcacatcaagaaaaacggcgcctactagaactagttataatttattaattaaccacctatctacgtgctagaaaagccaattcatagcgatttgaacttgaatttaatttcttgatcagtactgtaagtacacttacgagtgccctgttgatcttgcaggagttctcccaccacccctcgccgttgccgtcgatggtgccgccgccgccgacggcgagcccgtcgacgccgcggacgacgatccagtacctcctgttgctctcgttccagttcgacatgtccggcgacgccaccagcgtccccttcacctgcatattatccaaaaatcacgtcagaattacactaatttcagaaagattaatattaatggccgtgttaatcacttaatcagcttcagttccaagctgaattgcagctggatatggaagattaatcaactaatattctgtttgaattttttttaccatgagcttgatggtggattcgcaggggccggagagggtgacttgccggagcaggtagctcctgctctccgggacgagcacgacggccggcgccgccgaggcgcaggcggcgctccacgccctcgccagcgccgccgtgtcgtcgcgctcgccgtcgccgtgcgcgccgtagctgtcgaggctgaaaaccgcgctctgcgtcgtcgccgccgccgccgccgccgcctgcagcagcgacctgccgcctctaccgatcactgcagctccctctccaccaccaccgccatagatgctcggcgagccgccatttctgaccatggcggccgccgccgtggctgcgccgccggacaggagaaaggtcagcgcgagcagggcgcgtacggacgccatgaacgacgacctcacgagctttctcgcaccggacgccatgaattaattccacgcaaaagctcgaattaatcgctctcgatcacttacgctctgctactgtatattatcgatcacgagctagctagttaattagccagaacttgatcactacagatcgagctgtatggtttcagggctttgaattaagctattggattatggtggatcgatcgatcgatggagacgaaggtgcagccatggcgaggtatttatagattcggggtttgcatgggcgattgggcgggaaggatcgagttagcatgcatgcaatgcaagcacacgtagtacgtgcatgttgcgtttgcttccccggaagaagaaagaagcagcagctaattaagagggagatgcatggctgagttagttaattagctcgagccctaattaagtttggtacgtagctagatatgccttcaagcgtgtgtggctgcacacgcatcgtaggtacgtatcatcggtcgccatgcatgcacgcacacacaggacccctggtagaacacaaagattcttcgtgcacatgtcacaaattttgcctgcaattatgaagtgatcgtatagctaggtttaattttccgtggtgaaacctgtctatccggtttgtgtatctatagctatttttattcatacaatggtacaaggggagcagaggtggatccagcgtgggtgctggggggactcgagtccccctaccccgctggatcactaatgatagaaagggagatgaaaggagaacaatatagagaaaataaagagtagggagactgaagaagaaagaaggagatgagtcccaccttaaatattgttctggattcatccctgaagggggagcctccgccgtccgggttaactagcagaaactccatttaattttaatatttttaattgaattgataatgaaatttctatattaaataatggttataaacttataatgaagtttacccgggcttaatatttttctaactccgccatcgaaaaataccgaatgacagtaagatctgttgtggtgatttcaccaatcacaagatatatatatatatatatatatatataatactatgagtgtattaatctgtactctatcctacaaacaaaaaatgtgcctgaaattataatccacattagcggccggtgtcgtacgtcttggttgtatgcatgcagtgtagtacgcacttacctgcatgtgatcactgatcaggtcaactactcgatccatctctcttcctgaccgcgaaaataaaaagaaacaagaaacaagaaagcatttcatgcgtgtgtattactttctcggaagagaaaattaattaacgtcgacgtacgttcatgcgtgcctacgtacgtatcatgcatgtgcgttccatccatggatggcggctcaagctagctaagcgtacacaaaccacgtggttaacaccgacctaattaagctaatctaataattaatgatctagctaatctcttcctgctgcttgcgtcgattaatcactcgctttttccaacacacggaaaaagtgaaattaattagtagtcggaagatgattgatcgatcgatcgatatgacctagctagcggctggctggtgaatggtgatgacctgagatagagaggaccgagagaggctgacatgtgggcccggaatcccttttttaaggacaaaaggggacattccctgctttggttcgaagcaaaaacatcatagattggtcactttgtccctcaactaatcatagatcgcgatgtcaaaacgaaaccatcaaactgatcgagacacgtggcacacgtcaactgtcaattgacgcaatgcactgttaatgattggtgattataatttagttggttagttagttaaattaattaattcgtggacgacttctttgggttatctcgagtactatacgtacgtacgtctcgatcgttttgggtttgtaaatttgtcacagggaatttgacgagaaatatatttcataaaggactttaattaattaattagttactgcaaccactgaattgattatatatgtatatgtttcgcctaactagcaattaatcacacacgagaaattccacgtagcaatcattagtttttgttgcgaacggacgaaatcattaactttgtgatcgccaaacaagcaactcaagtaaacgccccccggatgcataaatatatgtatttccttcgaatttcaaatcaaaacgtgcgccgaaatatatacatacgaatccatgtatcgtaattacgtgttcgctcttgatccacaggtacaatgatacaacagtacaaaagagagatttaggggctttatagctagatttgtcaggattcatgaatgtcgtctactttcttttttaattaatacaaaaaacagcgtgcacgataagatttgtttgatttttgcgtagttagattagggtcacacacacgcaatcaattaattaattaagcacgaatcttagggcggaaacgtgtggacagatcgatcgattaggcatgatctgctcagctcaggcgtgatcggtgatctgactgcatgtgcgtaccatgctgccgctgacgtcatggctctcacgttttcaccttttcgcgtgcgattttgctatatctcactcgaaagattttatgtggcaagcgaactgggccggaacgtcaatgcgacagacgcgctgggcccacattttatgggccggaacaggactgtgagcagcgtgtggcccttatcaagcggaataagttcacttcatgaccct

SEQ ID NO: 67252 - DNA, 1895 bp, Oryza sativa
ataagactaatcatacatatcttgcacaacgttgtatattaaaaaacggagggaataatattttacgtacaatcgggaatgtgagcaccgtcatgtgtgactaacaaacaatcaaattttacacgccatgaatgtgtcatattccaacatatcaaggggatcctttcgaacaaacgaaaaaagagaggaatttatacaattgaaatcctatgcaaaatttttccaggtgttcctttgaaataatggaatgcgcacttgagattgctacaaaatttctaacatgaggttgtacctcatgggaagctttcgtcgggtctatctctcacccaaaatcctatactttctctatgaagcatccaaacaaaaaaatcacatagttcctacattttaaaattcctaagcatcaacttagatatgccacctcgattaattcctacgtttttttaatgtttgtgttttttattcctgcgtttgaaaagagctctgcttttcttcagtgtagtttattatgaaatttgtgtcgcgcgatcaacagataaaatgagaaaataacaacagacatgccagcagatgacgtgcttgtgttgtaaactttaccagatcctctctagaaccaacagcaagagttgtaactcatgaaataaactgtgtcgacgaacttgacccaaattacaagtattagttgctacgttgtacttgtacactgtcgatgaaatggaccaaacagtttgcagcttcttcacttcactcaccaaatgaccaaactaaaccacacgctatcagctagatcttaatctatacttaaccctgaatgcatcttgaatttgtacccattacactggcttggtacattaattgtacacttaatatacatacatatacatcggactcgatcgagcaggaataatttagaatgctctacctaacgagctaaagtttaattaagttgagcaactcaaaaagaagtgtatgcgtcaggcagacagatcaggcattatttttcagccaatcttctcagtgttggtgtcgtctgttggccagatgaccgtctccatgagccgctctcgcatcaacgccaggttctcgtcagatatcctctcgtacatcatcgcatggtcacatttctgaaagatcaaaaccagaatctcatttggttacaaacttcagagctttgtgatggattatctaagagtaccaaaaaggaatcaccttgatccatttgctgtacaagtgaagcctagttatcatcactcgctctgcaagctcctgcttctcctataaaccaaaatgaacattcatgcgtgtgcaatttttctttagttttcagtttacatttgtatcgttcgaaagtttaaacaactgtggagtagtttatatatttacctttccaagagcacgaaggaacactttgccatcggtaggcttgtttacagcaacgaagctgaaaccaatgagaagcaagaacacaaattcagtaatctgacagggattttgctgattgatttgtggaataaatgggtggcttacttgtataaccatcggtagcttggtgggttcatttcgtagagctgcgtgagcacggtcttgacggctttgtaggtgaacacattaatcagttgctgcgcaaacaagaatgaacaaaaaaccaaatcaatcgatctcctctactcatcccaaccatgaaaatctcatcaaaatcacagcattttatatatcagcagtagaacttcaactctttacgttaggatctgctaacatggattaattaattagattcggcatgtggggaatgattataagccgcaacgcttaatagcgaaaggaataatttttcgataaaactttgttatatacacatatattctttacgacttaaaaaaaaattcaaaatcaac

SEQ ID NO: 67253 - DNA, 1624 bp, Oryza sativa
tgattttcgaattttgggggtaagagaaaacgatatcccagtattccgttcatactggtcgcagcagcacgagccagagcgatgaaccgatgaaagtgaaaccaccacaaattcagaaacggcagcagcaaattcagagacggcagcacagcaaattcagagacggcagcatgattaccaacttcaggtcggagcaaaagttaaaatgatgcaacaggaagaaaaacatcaccgcactgaacttaagtggtggtggtagtagtatatggctgtatatcaaaacagccagatcatgatcagaaaattgaaaacaaaatggaaaattaaggatgctctaaaacaaaatgatcaaggctataaagccatatactgaccatgatctataaccgaacacaacgaccctgcacccagtcatcttcagatactttcaggacaaaatggatcgataacataataattatgcagcattcattgataaaagcagtatcacagtaccatgatccaaaacttgacaggaaatagaaacatccagacgcagcacaatccaaggatgacaaccggttcttaactattgtaaaacaaagtgcatcagacaagtccgagctagcaaagactctctttactccgccatcctaagcctctacgttctcgacaggtgcatcaatcataagagccttagtcggcttggccaagaggtcggtgtactcctggaatggagacttgacgaacttggtgtccctccagaagtcaggagtaaggaatccataagtcttcatcaggcagtcaaaggtggcctgcacaaaacagatcatttggttttaatagaggataaacttaccactaagaatacatcaatcaagcaaggcaaactaataagaaggcctcaagccatcacagagtatatataacacaatcaaaccaaagtaaaaacgactgggtgtagaagacatgaaaacatattacatattagatattaacactccctgtttgagtaggacttgatggcatcaatgtgcaaacagggcatacgaaatgtttaaagaaaagtttctattagatgatacaatgtgctgtgtgtataggcacgatatcaagcagacaggatacactaataagcactgtggcataaggtaatgaccaatgcacaaaaagattaaagatcaaacaattacagcagcagcgtaagtgtcaataatcaaatagacccatgaaatggttcattgacagcagacaatagtaaatccatactgatgggcagtaagcctgtaacaaagtaaaatattttgaacccaaccagtttaactgtatcgaattagatgagtagaatactatgaatcaccttcaaagatgcatgtgtatgtacactaagaacagtagtctcattgaacaattgatgctaatatacaaactgtgatatagtgagaaactatagcataatgcagttatattccacccaattcacatcagaaatcaacaatactatgcctacttgccaagcacacataaatctatcattcagtaccaaacactaaatactcatagtcagagaatagtatataaaataacaaaaggagggatgtgttataccttgacgaagttgccaagggtcttggtggatccacgg

SEQ ID NO: 67254 - DNA, 7587 bp, Oryza sativa
tcagccagctcttccgaacaggcccttaccatttgctgagcttgacaagtagcagcagcgtggctccgcttccactcgtgcggatccccactccctagggggtcggcagctctacttgccttccccggcctggccgagccatcctcctcctccttgttgtcgtcaatgtgcaccgctcatctctccgtcggacaccgtccttctcgccaccagctcctctcctatcggccaccgcccttctcctcgtcatccgctgtgccgtcattcctgtcggccattaccctacaggggattggaaagacaagggagggaggagagagaaaatgttagccacttatatggaggggtagtatgggtcccacgttgattcagcttgtcctgtcaactaaaataggatttcgaataatccaaatttgtaaaatgaggaagcccgttatatatagtatttcaatttagggatgaatttcaaactcgaccatgctagtgatccatctttggtgggccaaatggaggcccaaacctgatcggttgggctttaccttaggctgccgatggaagccttgcttctagcgttgggcttgctaataatacagcgtccggcgttcaatgccaacgagccctgatcccgttcctcacctcaccggcggcggcgaaacgcctccgactccgagcaattccacttcgtcggccggcggccggccgattacccacgcccgtttcagcagcgcagcgaccagaccatgtgcagcatcagcaacgacgccaacagcttcgacctcatcgatggtttcctataataaccttttttgccgacgcttgtgtccgcagaatcatggcttctctgttcgagcgtcgccgagatctcggaggagcccatgttccacacgccggaaaacaccagtgaaccaactgtaatggtggccaatccggttgataacatcatcaacgatcgatagcgacattacaggcaacaataaccatgacacaatgtttagctagatcacacgaaagttcaatgtccaaaacccaaatcaccaatgcagagttttacagacacgacgtctaagtagagcaattagcaaaccatgatccgaaaggagagctctgaatcgtagggggatcatcacgccttcaatggctggaccttgacctgatccagcacggggccgcacagcgagacgccgtcgctcaccttggtgtggtagtacgagctgtagaaggtcaccctggtgcgcacgccggcggcgacgaaccggaagctcgccggcttgaacccgccgtttccgacggactcgaacggcaccttctgcgtcacgttcccggcgaacgcctccaccagcatcgacccgtggcagccgttcttggcgtcgccgacgacgaacgataggttgtaggcgcggttcgccaccgtgcggatcacctgcgcgatggcgctctccctgccggcgacgagctccacggcgtactgccccgccgggacggagaagtgcgccgcgtcgatgaagcggacggccttgagcgactcgatgatccagcccgggagcggcgacgtcgcgtccttctgctttggcggaaggaggacgcccaccgtcgagttcttgaacacctgcggcccgatctcgaatccctcgttcttgatcaggttgtctgcagcccttgttcgtcagattaattaccagcagcaatccatcgttcagacaatgatgcggtctctcttacctttggttgggtatggcgttgggagctccttgatggcgacggcgtcgagcagggggccgcacgacgcgtcctcctggacgccggggttggagaaggtgacctgcgcggcggcggaggaggcgcggaagccccacgcccaggtgtcggcggtgtcggcgctgtagagcgtgcggacggcgacgtcggcgggcggcgagagcgacggcgcgacggcgacgcggagcgcctcgtcctgggcgcacgtgcgcgtggcggcgaaggtgagcgcgtagagcgcgccggggcgcacggacacgttctgggacgccgacgcgcggccgcccaggcggagagcgtgcacgccgtgcggcaccgcgaagaacatgccgccgggctgcggcccgccggagacgtactcgacgtgcccccgcagcgtccaccccggcagcgagtggcggccgacgatgagtgtcttgttcaccttcctcggcgccgtctcgaagttgccattgatgaggaggcctgggtcaccattaaaaaaatatatcaaaattcacttgtttgcttcaaatgtctacatgattgttgctttctttaggattcaacagctaaatatagcgctgaagactcttaaccaaaatcttgcaaaatgcaaatgcattacagatttacagtaccacaccattctggggaaatggattgagcaacatctaaaagtcacaaaaccgatggatcaaagtgatatgaatataagtgatgcacaagacacgaaaatgcagtgtgccagacacattcttgggctcttgccaagaacatttccacaggtcgaggtagtaatgtgcttgcatgaatgtgatactgaacttgaaacaaaaatgcagaaatgaaactgtaataactgaatctttctttgcttaaaagaaaactgaatctttcttcttagaacatttacatctgcaagaaaatgggatccaagaaaaaaccaagaagatgtgacagagaagagaacacagtgagctgagacctgagagaagaaccataccttcagcatctttaggttgaggaggtgcatgggcaggggcaggagctggaactggaactggaactggagctttgacggcgagtgtggcaccggcggaggaggcggcggcggcgacggcgagcagcaccagcagcagggcaccccgaggaagctccattggtaagctcactctccagcctccactgagttcagctctctttcgctttcactttggctgcttctcgctgacgctgagagttacaaggaagcaagcagccttctattttttttcctcctttattaccaaaaggagtgggaaattgcatacagaacctcccacgctgtcggaattacacatcagagactcattggatagatataattaatctctaaataaatcgtgaatcaatatttagttgggactttttgcaggcttgatgactgcactgtgagaaacaaaaacaaaactaagaaggattactaatagtgaaaaccgttcactctagggctagtgtgtgaatctcacatttacaagaagggttaagattgttgcattattatatctgactgtcccttctgatgcgaatgaatgtatggggggggggggggtgcccacggtcatggttcccgcgttttgtggtgtagttcccgcgcaatgttactgacgcgctctgcaaactagtacagacttgcataggacatgtactgatttactcctatgtgagtactgagtactatatactactactgctagagtgttagatccaccctaatgaatgactgaaactgtgaaattaacatgctaccgcaagcactactccatcatgcattagcactgttactactctactctactgtgttacatttacagaaggcaacagaggctaccagcagatgtatagtactagcagtaacaaaatatcacctagtacgatttttcatctagcagatgtatttcagtctctgttttctcactgggtcgaggagaaatttgcttgatgcagccctttgtacacttgcacgaagaggagcttctggagaaggcacagacatatcacatggccacatttgttaattagtagtactacactgtacccaggcaaagatacgtgcagtatactagcatcatctacgtatagtacgtgtacaccaagggaagggagacgagagcatccaaagctagaggagccggacgacacagatgttcttttctaccaaaaaaattgaatggtattagtatataattaattaagttttaatcattataaatataaaagtagatttgtttcatataacttatatacagaaagtttcgcagaagatggaccgtttaacattaaaatatgtgctagcacaaatcaacatatatatatatatatatatatatatatatatatatatataaaacctatatatatataacctatacttttttcgtcacaataaaaaaacaaacatagtattatctcttttccaaaatttagtgttccttccgatttatgttataagtggtttttacccttttaaagtcaaacttctaaaaagtttgagggaatttatgaaaaatatagtaatatttatagcaccaaatcagtttcattacatcaaacattgaatatattttagtatcttttttgttttgtgttaaaaatattattatatatttttataaatttgatcaaaactaaaatgtttgacttagaaaaaaataaaaataacttataatatgaaacggatgaataaataatttaggattggattaaacacatcactgccaatctagatagacagagtatctatccagagtaattactataaaacgttagattgctgtattccggtgacggaaggagcagccggagggagaggggcgacagtggcggccactgcagcactgggcccggatgataaaagccggttcggcgcatgtcatcggctgggatggggaagaaggccgcgggaacagtggccgcggccggtggtctcctcgtcgtcgtcgtcctcgccattgagccccgcaccctgcacgccctgctgctgcctgctgccgacgcacgcggcccggcgcatgcatggcccccgtcatggcgaccacgcagctgtgccatgtgggcccctccccctgcacattaagggtctgtttggttcaatgcttcaacttgccacaccacactttaggctgccacatctccacacttgtctaacattgtctaaagtgagttatgacaatgttagttaagaaccaaacagcctctaactttgctctacccaactcaacgcgccattgcattttgcaccgcagcgaatcagcgattgccgttgtcccggggatggatggatggacggacggacggacggccaggatgtgctttgcacttgcaacagaggagccgcgctgctgctgcatgctgatagtttaaaatttaaaataaactcggtccaaatttatttccaaatctaatctttttgttcaagcaagtccagattagcgggcctgctgcgcgcagagccggcccattgcgaaattcagggcttatgttagcccaagtgctcaacactctcccagttgttcagtttacagctcgcggtacgtgtatttatcatggaaagcgtatggccgcagtccaaaacgcactggttcgtgtacgtgcatccgatatgtgttaattgtacgtacgtatgcctccgtctaggtacgtactgtagatgaacaatatgcattgattaatacgtatgtgctgactaagatatatgcatgtcaacaatgaccatactgatccattttgtaaactgaacaaccacttctgtttaattagaccggatggttacgtgatcgtttatggctagatcagaagatcaagtattaatcccgtgatgttgtgtttgaactgaagattataggggttttggtttactccctcactttgacaaacgttgccacactttctaggatttttacttgtttcactttcaaagttgcggcattgacaaagtttttctattcaaagacccacatgtcatacacctatcttttatgtcatacaatcatcttttagccaaatcttgtttaagatgtgccatcaatttataagccacacatttggttaggtttggcgatatttggaagtgaatcaaacaacccattttttccactatggtttgaaggttatatcgatgtcgttctaggtggtgtcgagacggggtgtggcaacacgtcatcaccattgcaggaccagacatgccatgccatgagccgactcatcgtgtgggttgtaccggcacagcccggcccggtccatttgtccagtttcctctcccaaactcccctattttttccattgtttttcttttttttttcttattttccttttttaagcaatagaaggagataattaagcaatgtattgattattttcgtcacgacgacacatggcgacagtcatcatgctaatccatttattaattgaaccaaatttatttggacaggaatattttagatactctagccacgcatgagttaagagtgttgaattttactgaaacacggcaccgtgcatttaaatatgcctttaaaacaatattcttaagttaacgttatgtatatactactccctcgtatatactattccctctgtcctaagatataagaaactttagttggataagacacatatccaacctgtctagatttctcgtattaaaatatgtcatatccaactaaactttttatattttataggacggatggagtattggttaggaaactctagatgctgttaagataacattaaactgaatttttatatttctatcttattttatgtttccacgtgctttgctctcctactaatatactccaatactccatactactcaaacgaagagctcagatcggttgaccttgctgttattaatgatttttcattttttgctgttcaatttcataagcacgcgcactttgcgtgtcataggctcatagctgattacttcatggactatgtcggtgcttaagctaaagttgattttgaaattttaaattttaaatttagattattttaatttaggaggttttccattattttattttcagaaatatgtcacgagttattttatattaagatttgaagagagatttaccgtgcaagctacaaaacgacgaaggcatgttcggctgctggagctacgggcacgaacaataccgcactcattatacgcagtcgcagccgaagccattgtagccggcctgcctaataggcccatagtttagcaagggttatatatccatgacatgccttgtgggaccaaattcggcctaagctcagctgatggcaagaggctggtctctcgccatagtgtcgcctccgttaggacggagctcctgacaggtggggtttatctttataggtccacatgtcagtgaccatatccctctaactttacacgagtggagcctcttctcgcctcatccgttgtagaagtagctatgactacttccctctaaatctgggtttgttgattaaacaaacgattgttgtgcttcttttagattgtcaagcaaatatcgtttccattattttatcgactagctttgtaatggataaaccttccattgtatatatctttagaaaatacgcactgattgatttggattgaaacgagaggcgtatccttatgatgacggtacttagatataaaaataaattttttaagataacgtaactaaggattgcttggaagttttctttttataaaaaatatttgtggcttacaagccgaagacacatgtacaaagcaataaaaaaaactttagaatatgactttttatatttatactgcataaatttcacacaaaccctaagttttaggcc

SEQ ID NO: 67255 - DNA, 11462 bp, Oryza sativa
aggaatcagtaaatcagctttgattaagttaagacaacttgagttgatatgtatgcttagctttgattagtgtttagcatgcgatatcttgtgcagatcaacacacccacacacatctcaattttctctcagaaggtgtatatatatttgcagctgttgtctaatcgatctgcagactgaactgaagtataatgtcgaagacgagtgccctggatcttgcttcaggattaggagggaagatcagaaaggagcaagtcaaatcggccgtggatcagtactgcacatactttatttacccttctaatacgttaattaattatgcttgaatttatagtgatatagtaacaattaataaatttgagttaagtgcacttacggggcctacaggagattagggggggagagaagaaaatatgttttttttttaattttattatttttatatgaatgacatgtaggctccattaacacgtatgcgtcaacatggcatgtcatatcagtgcacgtagcaggttagactgttagaactcgtttgaatctggatacacctatgataatattaggaacctatataacatatccatttaagtttagacagaccactggtgtactgcactctaacaggttttgaccaactcgccagtcgtttctcgcttcgtttatgctgcccctttgttcaacaatcacacgctcaaatgttcaggtgttccatcgtgtcaggtatgagaatttttcatgaaatttatggaggtgaagtggaatcaaggacatccaactacgctgatttggtacctttttagctggagtagttgtttttcataataatttgcatatagctcatgtgaaatcgatcaattgaattagcaacgagaattttggaggttataaccaaactaattagtgccaaatttaatgcatcaggcaaacaagtattatgatcttgtcaccagtttctacgaatacggctggggagaatcattccatttcggcagcaggtcatgccataattttgccacgccataattttgccactaattaagtttgtttggatgggctttaggttattctgattttgtttttcttcgctgattatctttcagatggcaaggagaaactttacgcgaaagccttaagcgtcatgagcattttctggccttgcaactcggcctcaagagggcatgaaggtcaatgttatactactattaattcagttcaagaaaagagaataatctattaactataaatgtgattgtttctaatcttcatagtggagtcatttttccctgtgcatatattgcaggtcctagacgtggggtgtggcattggaggacccttgagagagattgcagattcaggtgacaatttcctgttgccaatttcacaaattcagagataaaaatcaagcgaactataattattccaatgctactaattatagctcagcatcggtgactggactgaacaacaatgcgtaccagatatcaaggggcaaggtaacgagttctgcattttatttaaccatgtgcatttcttttacagagttagatgtgaattatttgaaatatgttatgcatatattatcaagatgaagacatggatttttcaccatgagctagatcaacacttaaaagttaatttgatcttcattgtgcaggaactcaacttttctgtcggtttgagtgaaacctgcaactttgtcaaggtagagacatatatacatgccctccaatcaccaattcagttttaggtgacaaaagcaagaattgtcatgcaggctgacttcatgaacatgcctatccctgatgccaccttcgacgcagcctacgccatcgaggcgacatgccatgcccctgatgctgtatgcttagctcatttattttcctgtatcatatcactactcatttcgttccaaaaaaaaataaatctaaaaagggatacgatccctcatagtacaagtaacatggacagaattttgtttaagttcgttatacggatcacatctcccgcctaagtttagtattttttaggatagagaaagtatataggtaagtactattacttccgttctaaaatataactatctagataagtctaaaatatacgatattaggttgctatattttggaactgaggtactaggttggtaacatgaaaacttattatcttggtgaattaacttgtacatgtaggttggtgtctacagggagatctgccgagtgctgaaaccagggcagttgttcgcgttggacgagtggtgcatgaccgacaagtatgatccaggcaactcgaggcaccggagcatcaaggccgagatcgagctcggcaatggccttccagacatcagaaccaccaaacagtgcatccaggctctcaaagacgcgggctttgaggtgagctctactccaaatactacacatcacaacattaaaaataggagaaactcttttaatttcttgagggaagagatatctccttgtttgttcgaacaacattcaaataatcataaaaaaaatctaaaaaaatggactaacatttgtacaacatgtaactgtgatcgtttagggctagatcttaaatgagacctgaaaagagacgtccctccaaacatttatcttaaatgagatctgaagagagacgtccctccaaacatttattagtgtgagcgtattgaggattgaacacggaaccttagggttgacaccacacatccgttgtcactgcactatcaagtgcatctctttatagctagatcatcaaagatcaagatttatctttgtgatgatgtgtttgaaggttgtatcggtgaaggatctggcagaggattcgccgttgccatggtacctgcctcttgattccagccagttctcactcaatggcttccgtctcacccgtgtcggccgcttcatcactcacatgctggttcgtaacattttactgatataccatgtactccaatctagatttgtagtattatttgtgtcgaattcagttataagttactactacattttaagacggagcgagtacggaagtaaatgaattgttggtagagtgcaattgacgtcttaatttaccttcaaaaatcttcaggtaaagacgctcgagtgcctccatgttgccccacagggcagcctgagggtctccagctttcttgagaccgcggccgaagggcttgtgaagggcgccaagtaagttgatcggcctcgagcaaatctgaagcaagaaaattttgaatttgtgccgaatttatatcaatctccgaaacagtaatgctgctgaatgaatgctgcatctttttttaaacaacgctgcttaatgaagtgtgattttcatttccagggaagggatcttcacgcccattttcttcgtcttggctcggaaacctctggacaagcagccagagatctgaagaacagagcaaggtgtggtaattatcatcttcataagtgtgcaataaaaagaacaactgtttgatcagtgtgtacttctctgaacccagcgagatgtggtgttttatttggtcaattcgtgtcataaaaaagtagtaagtttgttcagtgtgtacgtaacagtttcgtctgggtatgaattcagtatttgtttttcagtcttatctttcttctctccagatagtctgcaagttcaacttcaacaacagatgggagtgtttgaatcaacactattttaccaaacgatcgagtagtaaaatgcttcaaagaccactagtctgagtacaaaatgtgtccatggttacatcgaagtcaaaaaaacaacaacaacaaaaaaaaaaaaacggttataaacccgcgggaaaacagtagagtgtctgaacacaatccacatatatctgaaatcgatcaagaaatcaaaaatcaacacaaaccacggtgaaagaatcgacaggagatagatgcatcgatcatggcgagagagagagaatcatcaaccggagatagatgcatcgatcaatgcatacgaacactggatcatatatcgaaattgattctactgtagcatcgccgtggcggcgaccagcgccaacgccacggcagcgaaggccgccttagcgccgccgccgccggcggcggcgctggcgttgggcgccggagcggtggtcgtggaggaggacgagctgtccgtggtgggggaggaggactccggcggcgacgacgagacggcgggggacggcgcggcggcggcgccgcgcttggaggcggcgggcgccggggaaggggcgtcagaggaggaggagcgctgtggcttgaggacgcggatgttgaccttctggccggcggcgcagtggccggggacgccgcagatgaagaagcggtggccggcggccttgatggcgatcttgtcgtcgccggaggtgtgcgtggcgatcggcgacgagttggtgcagctgtcgtagtccgccttcttcacctccaccacgttgtgaatcccctgcgggtacttgaactctgcccaaaataataaaattaaattaaaccattttttagaaaaaaaaaagctcccatcggatggcctaataagctaaagaaaaagccaaattttaaattttcaaacttaattttgatattgattttgagatattttcaacatagtttcttttttagcattggcttttaagtcaccaaaaacacatatataaaaattttacctataaatttattttattttctaataaaccgttttggcttattaggggaaaaactaaatgatggggcctaaaatttggcaccatgatcaactcgatgtagatttgctcgaaaagtacttccataatgccggatcgttaatggttactccctccgtttgatattataagttgtttgattttttcttcgtcaaagttcttaaggtttgactaaacttatcggaatatatagtaatatatcgaccacaccaaattagtttaatccaatttaacattaaatatgttttgataatatatttgttttgtattgaaaatgttattatatttttctataaatttggttaaatctaaagaagtttaaatgaaaaaaagtcaaacgaattataatatgaagcggagggagtagaattttataggtttataagaattttgtcctaaactataagcttttataaccggaggaagtactcaatttggtgccaaatcgatgtagatttgctcgaaatactgtcacaatatcgaaacctattagattttataaactcgttctaatataaaattagtagttgagattttaaaagtttgattgaaccttgtccttaacgtcaaatatatgtaaaccggaggaagtgctccatttgacgccatgatcatcacaagtccacaaggacagacgtagtgcaaattttatcttttttcaaacaagatatatcttttgaaattttcatcatcttttggtaccaaattgatcacgcgaaggcggcaggaagagaagtgtgaggaacgaaactaaaaacgtgcaacataaggtactgtatctacctgtcaaaaggattcatacaaagcacctctttttacaccaagagcaagttgtgaacaaagcatgcatttggatgcttctatactactcataggaaaaaagtgtcaaaagtgattagctttacaactaatcagtagttgacaaatagcatactgtcagatgaatagtatattgataagtagattgagctactggccatttgatacataagtataatttatctcctagagttttggatcaaaatttctatggcaactgaaataactacctcaataaaactaaaaaatttcagccggcattgttggatcatgtacaggacatccaggtacacgcaagttcaggatctgcaagatcctgtagccaatgtccaatgagcacaataaatgaaacagccacatatgccatggcctagtaattgtgctcaccaacactaccatttctgaggctttctgaatagcagttcagatggtccatgagaaaaatttatggatcatgctagttctatgcaaaggtagcagcacacggcgcaatattcgtgaaacgccttcaagactagaagtgtgaactgtgaagtgcaagaaagttgagataaattggccttctttttttaacccaaatttcgctgtcaatggcgtggttaaagtgagactcttcatctaaacgcaagacaaaagaggtaaggtgggttgtaaagtacaccggtgagggtgactgttcattaacattccatctctttgcagcagtaagctagcttgggtgaaggaaagaatggacaattactgcttaacatattaatagtccaattttattaattttctcgaacaatgctggcttattcacacatttcaccaacgaaaagaaaatcactgaaatacaaatgctaaactagctagaaactacttgtagtaagctgtagcgaatatatgcaatgaacaaaaggccgaagttactagcactggatctagcactgaaaaatttacacgatcaaaattaactagccttggcactgagcaaacattctacttctacatatacaaagcaaacaaaggttcattattcagatatttcaatgtgtataatccattaagaaccacagattgcatgtatttcaaatgtgtattgacacgcaagccttttgcatgttcgcgaaaaaaaaaaagataaaaactgcttgggaagaactgaaaattagagtgagaaatgagagagcttgcctatggtgtccccaacatggaaggtcttcttgacagcccagtcagtgtaattgacattgccgaggatggtccagccggaggtgtcgccgaccttgtagaccgccgccgacgatgtcgccgccattgcgagcccgagcatcagcaccagcacactgttcatggccattgccattgccgtgctacctagactgtgtggatggaggagatgaacagaggaggaggaagagatgctaagagcagagaagacgaaaagaatttagtactataaccttgcttgattgcttccaacaatgttatgccaatgaggaggattttatagtgccattgctcactttcagaactgaccattttgcccctgtacatttcctgtctgaaactggtatagctaaagtagatgagctatgtattatttttcatcttcttggatgatctatctattggtccttgagtaaagcaaacttaaaagctggccgtgtatccaagtcttgatcatgaggctggctgttcgatgaatggttaggtcagtgcagtgctcttcgccatgagtgagtggactctgctggtacgagatctcacatagactctcatagactcatacttgtttggagatctctttctttttgtcgaagcaaccaattgccaaacatgtgtgtatgtatgcgttgtttgttagtcgagatcgatcttccagttggtacccacttatctttttctttttcagctttgtttgagatgtgatgcacacacacatatagttttcagagtaatggaacttggggttcaataaaatttgagtttctttatctttctcttacccttttcttctcctttaatttaatcattacgatgtgcttgcagaagtctaatcaatagcaagcacctcgccgaacatgttcagaatttctgattggttgggatgctaatcatcagagctgatctactcaagctcagaacttaggatatctaagtatctaacactcatattgagatccattatctaaaaaaaacactcatattgagataatgctatcagtagttgaacagaaaactatttgtatttgcataaaaggttgtttctatttcgataaaaatcaggcacgtttggtaattaatcaaatgatccttgaaatttaatactacaaaattttatattaaaaaaaaaactttcttccatgtacatgtggattttttgactttttcaaatatgaatatgacaaaaaaatcgcatcgcttaaattggtatgagcattttttttccattaaactttgttatgttgtaagatatctaacattcaactgatttgtttatacatatttaattaaacgaaatttaattggtgtttaacaccacttatattttcttataatcagctgagattttcttatatgtctgccaactacctcggccatcaacctcggccatccgactgaaatcaaatggtcatcacattttcagcgtatgcgaaacgagacaagtcattagtgtatgactaggtgagtattaattattactaacttggaaaaatgatttatttgatattttaaaataacttttacgtagaaagttttcgcacgaaacacgtcggatagtagtttgagaaaagtgctagcaaaaccaaagaaaaaaatctacatctcaatcagaaaaaaaaaacaaggctgagcctttggatgaaccacaatcttatctcatcaaactgtcccgacaaacaacaatgtcatgtcgtgcattttgtcatggcttcccaagctaaggtggcaggattatgtcactggtttagggtgagggtggtcaagttagttggtgcagcgggtacgaaggtatgttgtagaggatgcatatcctctacattgctacacgctcactgacacaccagtgagtagtactgcatattgtagaggatctcgacgcatgttataggcaatggtgagagcaatccagtgaggtggaggtagcgccactgtaaccattattcatgaagaaggccagtggtgggtggatagtatcaatgttagggtcaatcgggacaggttacaaggcggcgagaaacaatagtcgatccaatagcgtaagccacaaaaaacggagaggtgaggaagcttattggcttgagcgctcttaaatagagagaaaaaaaaaagaagaaagtttgtcttagagcatgaagaagtttttatgcaccatcaagttgcaaacaaaaccgaccgacaaaagtgaaaatgcatccactatggttcaaatcctagtggttaacaggccatgaatatcacgtacacgtgcacacactttccataaagatttagtggactcggccaagaatatgtcgttagcccccgtcttttcaaacgtgtgttaggggtacactcatattgttatagtgtgatgtccgtgcccgacggtgtgggtacatgtgcgtttcccgtgtaataaaaaaataaaacctaccaagaaaagctaaaattcctataaccatatggcgatttttattacagagcatataggggaaaaaaaatccggatgggcgacgcgtggacgtgccgtggatccaaccgctcgctggcgtcggctccaagcggaagaaaaaccgagaggataatgcagaaagcccaaccctcccaagaatcgaagctccctctcctcccatggagctcctcctcctccatcctcctcccttcccctccctcctcctcctccacaaaccctaccacttcccctccaagctccgccatggccgcctgcaagaaccccgcgtcatggcgtccccgcaggcgcctcccctcccgctttcgtcgctccaagaatcgagaagcgctcgtatccgtatcccccgcgacgagccgaggccgacgccgcccgcgcgcagcagcagcagggaggagccccggttcgtcgcggagaccaaactcatcaccgtgcattcctgcgcggggcggctcggggacgcacgggaggtgttcgacggaatgggccgcagggacctgctcgcctggtcggccatgatcggcgcgtacgccatcaggggaatgtacagtgacgtcctcgcgctcgcggtgaccatggtcgaggaaggggtgctcccggacaggttcctgatcacgcggattttacaggcgtgcgcatatgccgaggaccttgagcttggtagggcgctccattccatggctatcaggagagggttcatggggagggtaaaggatgtgccggttgggaactcggtgcttgtgatgtatgccaaatgtggagatttggggtgggcgcgcaaggtgtttgacaagatggtgtgcagggacttgggcacatggaattcgatgatttttggttattgccggtctgctgagtgggaggaggcacggcatctgctcgactccatgaggcaggaaggtacgcagccaggggttgttacgtggaatacattgatttcgagctatgccaggttcggggatcttgatgtggcaatggaattgcttgggcagatggaggagtctggagttgcaccggatgtcgtcacatggactagccttgtctctggctttgttcatatggataggagtgatgaggcacttcgatgtttcattcggatgcgtcttgctggagttgaacctaacggcatgtcaattgcatgtgctatctcagcttgtgccagtttgaagttactaaaccaggcaaagcagctccatagccatgctattaaggttggcagtgttaacaacgtgctctcagggaactccttggttgacatgtatgcaaaatgtggagaaatagttgcagcttggagaatatttagtgggatacctgacaaggatatattatcctggaattcaatgatttcacggtatgcacaagcaagttattgtggcaaagcatactatctcttctgtaagatggaacaactatggtgttcggcaaattgtgataacctggaatacaatgatctcagggtacatacggaatggggatgatgagagagcttttgagctattccagatgatggaaagtcatggagtaaaaagggatacagcaacctggaacatactcattgctggatcagtgcataatggttattatgatagagccataagaatattccggcagatgcaggcacttctgaggaggcctgactacattaccatccttagcattattccagcattcacaaatctagttgcgtcctggaaagtacgggagatccatgcctgtatttttcaccacaatttagaactggatggcaaaattgcaaatgcacttatcaatgcatattcaaaatctggtaatcttgctagtgcgtgtgctgtgtttgatatgcattcatcaaggaacattatttcttggaactgtatcattctcgctcatgtgctgcatggttctccaaatgaagccttggatcttttctgtcaaatgaagcaagaaggtgttgtgccagatcatacaactttggtcactgttatcaaggcctatggtctcacgggaaaggtatctgaagggtctcagacatttttcaacatggccaatgattacaatataactccagaattagaccattatgcagcaatggtggatcttcttggtcggtcagggagactaaaagaagcatatgagcttattgacgagatgcctttgatacccaattcaacagtctgggacacatttcttactgcagctgtaatgcatggaaatgtaagactggctcacctggcagctagagaactgttgcgattgatcctggagatcccagagtccaaaggttaggttctagtgggctgcaggaat

SEQ ID NO: 67256 - DNA, 996 bp, Oryza sativa
ctgtcgccgtaggtcgcgccgccacctcgcgagtcccagcggtcgcctccacaccgtcttccacttcgtcctgctccggcacgagcgccgccgccggctagggttttgccgccgctggtcgccaggagctcggctctgataccatattgttcaatttggggaatttttctagggttagcctactcagctcaccccttcctcatgtattctattagcataacactttacagataggtccttggtacaatacatatttacaccaacaaacaccaatttagctaacgggcccacactgttagttagtctctgtttgtcactgagatgcaattgatagtacagtggcaaggtctgtgtgattttaactctgaaatccaatgttcagtcctcaacacgttcataatttttacttaaaaacaatatttggccgacgtttccccttcaaatctcttttttttttctttagtctgtctgtcactggcacaggcactcacacgcacacggcgtgaacagctttcacctcatcatgcaaactcatgcaatgcaggaggagcaggacgaagacgaccagagctttgcttgatctgcacttatcctccaatgccctttttcttcatcagtactaggctgaagattatgctccagctgcatgcctgcctgcatctgcatggcatcataaagcagagctactagctgtagcaacactgagtatccagcccaggggacaaaatgcttggcactgtcatgctctgtcagaatcccaatgtgagacacttgcttgtgctggacttaacctcgtagtgatgcttgttttggcctggctttagcttgtggaatattatatgcagagcaaaagttgaatgacacctaatcaacagcttgtttcaggttctttcaggagatcaaaaccagttagtttgcagttcaagggggttctcacttctgaacttgcaatgtcttcttttcacttcttatttttcttcatttcatttcatatct

SEQ ID NO: 67257 - DNA, 2200 bp, Oryza sativa
gatcattatgttaacatttcatacaagtcaagtccatggatcaccaacctacccacctctatgcatttcatgtcattgcgttgtgcatgtgcattcaaaggatccagatacgattaggtgataacatcttggacagcttctgtgtaccaaattcaattccactccccatgaatgaacccatgatgatcaagacaagagcaatgcagctagtgctttctaggtaagctgtactgcaggtgacaaccctgctgatggttacttaaccaaaaacatgcagcacatcaattatctgatgtcctaaattaacaaatttcgttagatggagctttctccttcgatcggatcgaccaaaccgaaaggaataatcaatcacccgtgcgtggacaggcacacgtggatggtggcttcaatcagatgatttctttttgcacgctttggattttgatttgtctctctcatatggaagcaaacgatgcatggtggattccttgttcgtacgtagtggtcttcttgtgcatcatgaaaggggaggactagctaactgatgcataaatttggtgaaaataattcaattttttttctccatttgtcctttcttttggaaaaacaaatcgtttcagcactggtgaagtataagtgaattgtccgtcttttctcattagtttaagcttctgggttaaattgattagtagtttaagctttttggcaactcaatagacgcaacatttgaaatacaattttgataattaattctcttgatatgagaatatgtataccatgatatgatatcatgttcagtacggtgcattgaaaaccagtgctaagtcctgtctctgtcagcaaaattatttttctgctctaactgaatttcagagaattcaggtcgacattcattgctggagcgaagatgtgagtaactcctgatctccgattcgatcgggcgaacgccattgcagtcttgcattgaaggagaagtcctttcagtctgttgagccgccatgacaacttgacgagcgatcttaagtatgcactggacgcgagctgttcctccccctttgtcaggtttgccaaaaaaaatgtaacagacttgccaacgttacttagttacttttttttaacttagctacagatttgctattttgaagaacagaacaccccccccccctcctctctctctctctcaagcaacctgttgattgcttttttttaaacaagtacaaaagaaattgaaagaaggattgctgatttttagccaggacagatgagcttggtttgcactttgtagttttcattgtaattctcccatttgcatgttctgttttttctgaacaacaattgtatcttgtgttacatttgtgccgaactgaaatcttcagtttgcgacctgaatcaattcgaaaaattgtggaagtgaagtcaaaaatgcctatatggaccatcccatacaagcccaaggccatctatgcagaacatcagagtgccacattgtgaaaatctgctaaaatatttggcccatttggaagaaaggaaatttcacctgaaactattcatgtaaaaaaaaacgagaaaaaaaatctctgaactttcaaaatccttttagccttctcctccttccactccagtgtgtcagcgtcagtaaaaagcatagtgaaagtcatcttcctggattgatccccggccattgctgtcatagaacactggttacagatggtctcttctgacaatctgatatggttgtactgtaagatttgttctctttttttcttcttcactcggctattaatttgtcattttatttggaatttggatcaaggaaaggaggaggaagaaatcactgtcggtttcaaggtgctgtgtcgtgtactaatcgacaaatgaacagtcgcaaatgctggccagattcagtcaggcacagccaagcgatggaatcctaaaacaaaattctgcatctagtagtatctattcatttctgcaatttgatcaaccaaaatatgcacatctagtagatctgaaaatatacaggaggttggttgaatgatattgtacatgaagaacacttggaccaaaccaatataaagaatatgagaatatagatggctatcatagagaacacctggatctaatacttgactatgaaaagaaatattctatcaaggtttctaacacattaaaatccatcgtagtagccaccaaatgatat

SEQ ID NO: 67258 - DNA, 1170 bp, Oryza sativa
cacccacatagacctcttctgatagatggataggcagaaatatattcttggtctcatcatctaggatacaatcatagggagaagggtgagatgcaggggtgaaatggtccatgttgatcatgatcaaactggcaccaaacaagaactgatcatccttaccaacaacagtgccatggtcactggtgaactcctccatgaagtaggaactcttgttgtcaggcaggagctcccactcatctaggctgattgcatccatggaagcagtacctctgctcatgtcaaactagttcagaagcgagcttggatcacagagagatatatagctgcccaaatgcttttaattttgatactcccttgatactgtggaagtggtcaagaatggatgctcaccaagaatcaataccagcagtgctgaggaaggatactttctttttttctggaggagaataaatggaacaagagggtacacttcttgcaccaggggagatgggtggcaatccaacttgaggggtttgtgtgtgtgtattggcttagtctttctgctaagtgacaaaggtgaaaatgttacctggggcctaccagtgatgactcctcctttcctagtttccttcctttctactcaattctttctaggtttgtgcaagaatcaagattagcagacggcaaacaattaattattcagcaaacatgattagagattgatttctataaagataggatatagtgtcggtgcagaactgtgaactagtctgaagtcagctggagcctcacattcagacatctcgtgtgtaaagagcattcagattaattaattcctctaatgaacatctgatgataataactcaaaatattcctacgaaccagcagtatgttactcagtaatcttacctggacggcagacaaaccttcattaaatatcttgacagtagctgtcgaaggattagggtgccacctaatctgaaaaggcttggaatgtcaatccttttcagtcgacttacgaaaaatgtttccaaaatacaggtccaatatacaagtcaatttgacacagcactggttagtagactggtaacactgtgtagatgataagaaaaggacttgataaacgaaataaacaggaactgatgaaggatagtgacacacaccacttaaacacggcaggcataggataat

SEQ ID NO: 67259 - DNA, 993 bp, Oryza sativa
aacccaaaaaaatctaatcatcaatagcatatccctgtttagttgattggacaatggaatcgattctatacaattaatggttgtctgcattcacaagcatcaatatttcatactaaaaaggttcgaaagattaaaacattatagtaagatggagatcctggtgtgtaatatcgagaaagcatcatggcaatcctaacaggtgcagctaattaccagcgagggaactgtatagtttccaaactaaatagcacccaaaggctatgttctcatttctgggtttaatatatttgaaagttgttacgattcttgtatgcaggaaaagaagagcaatgcttgtacctgtagtttctttatagaagtccaccagagagctgagatcttttgggccccagtatcgtaccattgtagtctcatttacaagaagaatggccgggaatccacggacaccatatcttgaaaacaaactacaataagcagaaacagcataataagcagacgagtcgacttaaaagggggcatgatgcctcacttaaagagacatatagacaacataggagtcaacatttacatacctaggcattgcagatgattcttcaacagtaaagtgatatatctgagggaacatagtgctgagagcttcaaatattggccggaacttgcttgaaaatggacaccaagcagcatagaagagaacggagtacgtaacacctctgtggcgaaggttcaactctttagcaatagcctctcctctcaccttcagtaagaaaaatgcataagttatttacagataaacaataactacaatccagaggtttcaaactttgcaatacggactatcgagcattatttacagtgccagcctggaagggtatttaattaccattgctagataatcaaatggggacaaactcttcagttaagaaaaaaaaatatcaatagtgactgacattaaagttggtttagagatatcctgaggaacattaatatggtcaa

SEQ ID NO: 67260 - DNA, 1260 bp, Oryza sativa
ctgcccgcccgtttcacctatgatgtagtccctccctaccgctagcacctgggcgccttgaatgtcgtttgcgctgccaatcattgttttgttaccttccctcaatcaattcccccgttaatcagctaattgttggcaacaaacaaacgcacatatgcacaaattaatggtgcaatatatttctaaccacaaatcgcacatctatccggtggtttgataacggatacacacaatacgccactgtcgtttgcccgcattttgacaagtagatattccacacgaagaggaacacgcgcagatactcgctgcttctagaacaacatgggataattgaattgacaagctatctgccggagaggaggtggggattggggaacacctacctctacaggcggggatggctcgatccggatgcaggggcagcgcgacgcgagcgcgtcgacgaaacccgggcccctccgcgcgcaggtcgacggggcctcctcctcctccccaccccccgccgccgccgcgccggcgacgaggagcacggccgcgacggcggcgacgacggcgcagcgcgtcatagcctctctctctctcctcgggaagggtgggtggtggtggatttggatttggatttgctcgtttttcttttttccctttttttctccttttttttgcgagatgagctaattttgggaggccgtgcgggtctatagtggttagtggttgtggtgggccacgtgtggcgcgacggttcgcctggctggcatcgtcgcgtgccgaccggggggtggcggggcccgcatgtcagtggctgtaggtcggtttgttacggtggatatggacgaccgacgggcgttctaatcttggtttgtgatctgttgtaatcatcctacgtggctgtatttggaaaaaatctgataccgtgggctgatttttcgcttgtttcggttcttgtttctgcatgggcctgttgttatcattgtactgttttttttttcagttcttttcattgtgtttttttttattggatgggatttaggagagagcttaacaaatgggatagatattcaaaatttcaaaagaaaagggagagatattcaaagtgtaaaatgagataacacacaatagtgttaataacgatatattgagcgtagcacaatatgttaaatttatagtgatacagcctgttcacggattagttttaaacttgacacgcgtgtgctcgtatttactgctaattattctttcagtaataaacgatgtatctatcaa

SEQ ID NO: 67261 - DNA, 1507 bp, Oryza sativa
taattaattcagggctttcttcatttgtaggtgaagcttggaaacgtaatacagagaagaggtgtgtgtgtttacatgtagttatgttttatttttgccttcaagtattgtggattactacttatcccatccctttggtcaaccttcaaggtcgcatttatcaggtatgcccatttgctatttgggttctgcatgagttttgtggtttatactttatgctcatgtatcttataagaacaagcaatctattatttcttttcttaacttgcttgtgctttggcaggtgataaaagcacaacattcacatcaaggtagaggaggagccactatacaggttttcatctcgttttgttcttttagttttttgcagcacacaacaccgtatagttcagcatcaaaataataagtaacaagtaacaagtaacagccaaaatagttaattttagagcacccctttttttaataacagaatattgcaaagctaatcaaataacaaaatatggatatcttattatactcccgatcatattttttcttcaattctttgatgctgcaggtggaattgagggatgttgacactggcaacaaaataactgaaagatttcgtaccgatgaggctcttgagagtatgaacatctttaaaaccaagacatatatgccttctatttttcagactaattttccttttacgatcatatcatatattacctgttcttgagatattctagcgtgattttaaacgttaatctctttatatttctatctacagatctaactatcaaagcaatacattcttctgaagtgttattacattacattcatgtgtcaagctaattttaggcagtcacagctcatttagagtgttaaacatataaattgtaatcatgctttttttgataggcattacatattttttctccaaaacattcaggagtttttgttgaggagaagtcattcacatatctttatcagaaggagacaatgtgactcttatggagtacgtttatttcctgttatcctatcattaaacagttgacatgctatacagtgattatctgagtatttactttacttcatttaaccatgatttcacctgaaacctttgttgtcaggcctgaaacgtttgagcaacttgaggtctcaaaggaactgtttggcaaaactgcagcatatctgaaaggtaaagattaacaatattaatctacgacaagcaggaacactggttgtcacaagtctaaatgctaaaatatgcttatggtttcgcttctgtatggcgaggttgtatttttcacttttatcgaaggcatcacctaggggatgccttggtgcagcaaggtcatgatgaccatattaccttgttttatgaggcagacctagtgtgagaaagcggcagtttcgtgacaagtagtccttgtttgttgtgactgtcgttgctcctcgccgcactgcttttggcatttactgttgtcataaactcataatcaaccagactgggcatgagggagcg

SEQ ID NO: 67262 - DNA, 1309 bp, Oryza sativa
atgatcaggagtacaccatccttctgttcagggaggttcagagctttcaaaattcaacacagattcatcagagaaatatagtactactgtacaatgcaaatgttgatgatccacatttgtgtagttctcttcgaaccaagtcaaaagaaaacacatcaaagaagcaaagggacaactaccattgcctacaggatttgagcattcatcaccagtagccaacaccgagtgcctcattagttatccaaaagcttattataagccataacagcttattgagataaaaaaaaatgtatatacatatatgtttttaatgacttaactaatactgaaaaaaaaaactatgttgaaaatatgttaaaatcaacttcaaagttaagtttaaaatttgaattttagctttgattttgtttttttaggcgcaccgatgaggctaagcccttgtttagttcctaactttttcttcaaacttctaacttttccatcacaccgaaacttttctactcacataaacttccaacttttccatcactcgttctaattttaaccaaacttccaattttaacgtgaaaaaaaacacaccctaagattcagaaacaattaaggagaagaagttggcctgaggagttatggcactggcaaacatggacctagtttcagaatggcccaaaatttcaagcatcttcacatgacacatatacaaactcctgcatatacaaacatgcccatttgaattgaggctgctctgcccccaaactggctctgaatctggacctggcctgtcaaacagcatggtctctttcaacccaccaaactggagcatatactatgaaacaagggcaaacaaaccagacctctagaaacactcctcaaccaataatgctcatctgcacatgactgttgatggcattaagatggtcaatgcaatgtacagtacctcttacaaatccttcttcatctgcaattgacaaaaatatacctgacatttatgctccccatgaatactagtactcacaatattcaacatactactatttaggtctgatgctttcatggttggcagaagagataaatggcacaacattttagttattttttgtgctttttatagcctactaccagatactcctccatgggaatggcatacaagttgctgagtaactgaatcctaccaattcctctttcctatacaccactgacattcaaaggaggtaaaggtgacatgagaaaaataaagcatggccctctgaccctttagttaagcccaagagagaagcttcataaccagaaagacaagtgaatctaccatata

SEQ ID NO: 67263 - DNA, 4165 bp, Oryza sativa
caatatatcaatatacagatgtcttcaattatcaatatacagatgtatttaagacatttgcaccgacatatctggacttcagtacacaggcattgtgcccatttagtactacaataggatgcctcgcattcatgttgtactaagcaaactatgtttgcactcattactcgtgctcaatggaaatgaaaaacagcttgctttctatcttgcactttgctcggcacttgcttgcttgctgaggtgaaaagtagcaatggttctttcttttggaaaacaatgaaactagagtaatcattaaggataagaaaggctgttgaggaagaaaaaaaaagtattatgaccacactaccacaggggcacagggtgaggaggaaactattttcaaagcccaaagggtatcagccaaggagcacgagtaagagcacagcagcaagtgggcagagagattctctggcctgcatgttttgtgacaactctgaacttactactactactactaagcgggggcatgtggtgagtaactgaatttctagtttaattttctagctcaccttccaaatcattatactgatatcgtattgggagccagagtagcttgagatggggaagatgctggctcccatggcgatctcactgtttatctgcacgaatcctgcacacaatacgttgtagcaccctgttgcctggtatgcatcgctctgcagaaacccaggtttaaacacaacgaattagacatcaatacaagcacatttcaccaattcttcaggctttaattcattctggaatgaacaaacaaaacttacagtccagtaagtgaacagcctcgtgttgttgtcgccgtagaggtcggggctaacctgaagaaaatcaaaggaaaacacaaaagcagattcagagctcgtgagtgacacagcacgcggggcatcgcggcagaaagggggtattgcaaccgcaagaacggtgccgcatttactcgccaatgcaaaagctcacgcatgagatgagatgaaatcatgaacatgaacatgagattagtttctttcggattgctacctgccatccagcctcgatgctgttgaggtcctcgccgaaggagccacccaagatccagagctgggacaagctgaactcgttgggctgctcgatcttgggcgcccagacattgatggttgccttggcgccgtagtacttgtcgccctggacgtacgcgatggcatgctgcaaaacaaagaaagataaattttcacccaggcaaatcagtaaatgagccattgctggtacccgcagtgcaacaacaaacattgcaagcatggaggtcatagcgcatcaatggcgaccccctctcattcctgggtgaatatgtgattgtgacgtacctggtggccgccctcgttgagcaggttggggtcgacggacatggggttgggcgccgggtgccgcttcttgccgtagcggcgcatggagctcgcccggagcaggtcgtcccgcttcgtacgccggattgggacggtgtcctccgggcacctgccgccctggtgccagagctggaccatgggcttctcgccgccgccgccgctcttggattcgtcgtacaggccatcgggatggtagttcggcctcatctgcggagagcatgatgatggtcaccgccattgttgcggaatccaacgaattgaggtttgtagatgccattgttgcagctgaaggtttacctggatggtgtggttcttgaggaagggatgatcgaaagctggctggtgtgagatgtgcacgcaatctatgatgtccccatctgggctctatttgattccacagttcgaaaatgacacaaatcagatgtgtttggtggggtaagaattgccagagatagctgcttgggtatccctatgaaaacttgctaaattttgcacaaagttaagcaagatagaagaacttgagaaaagaacaagcacaaagtgacagccaaaaggaaagtcacaaaatctttgctggtacaattttttgcatatttttcacccaatgtagccaaaaggaaggtaaaggttttgaacgaatggtaaagagagaaagtgaattcccccaagatcaaccacaaagagccacagaaaagacatcttctcttttgaatcagaataccaccttgcactttgaacgattagcccaagagcaaacctaccaccttgctcgtgcttcctcccaaatcctctccccccaaatgaagctacacacgcttaactttgaccaggacgacgaacccatgatagataccaattaaaaaaaagcaaattcaaaatcttcacacatgacgcacctcgatgctcttcaccgccggcttgttgagccgcttcaggtgccggtgcgccctccccgccggagacctcgccgccgccgccgcgcacgacaggcagaccaccgccaccaccaccaccagccaccccacgccgccaccgccgcgcgcggtggccatgtgcggctctcgcctcctcacgccgccaccgctccctcctcaaatcgcacttcacttcacaccccccccccccccttcctcttcaccgacgaactcacctcgccgccggtgaccgcgccgccgcagcccgagggccgatttgagaaattcgaaacaatgcggggggtgcagcagcaggagcagcagcagcagtggatgggtgggtgctggattcttgggcggctcgtcgtcttccgctacagcagcagcagccacgaggatccaagtgggcagtgaagcgaagacacacacacacacacactctctctatctctctctctctcagcttcatcagctttcgcagattacgagctttatttttggggcttctggactggaccaaaatgccctccatgattcgcaaattattacgggtaccgggcattccacgccaggaccacgggtaacgcccactgatttgtggggtccgaggaaagcctttctcaagaaatggagtaatagccgctgtgttagtgaaaaaaaaaaagagtgaattgtactttgggctatgttttattgcgatagtttcactttgaactaccctgtatacaatcttttcacgttggactaaataattttacctttgttgcataatggaccaccataaatcttttcgctagtgatgtctagcgtctctttcgacaaatgtatggcatgcatattggtatgaaagtttactggcatgtcgttaacaatttgctcgaagtcatcgaagaactgaagatatgttttggggtggttcattgtgcaacaaaggtaaagttacctagtccaacgtgaaaagattggacaaatggtagtccaaagtgaaaattttggcaataaaatatggcccaaagtgaaattaactcaaaaaataatgtactccgttccaatgctaaattatactacagctatttctaacttagtataccttgttttaaaataaaattatttctttatctgttctcttttttttaatcaatcacaatcattttctcattcatttatttacctactttctcttcgatcattttttatatactttttaatagccgtgtccaactaaaaatatacttaaattctgttgtgattctctaatcatttttatctactttattaatacatgtgtctacctagaaaatacttacattctcaaaccgaggaaatatgttgttttgcgatataaaatccaacactatctatattagtgagtgatactttaaagattatactatctatatctttagtgaccaccaaatttttacaaaatatattggggctcaagaaaaccacttcccacgataaggtataaatattagtttgttttttgaacttaccaattaatcgagtggtttcatgtatcagacaacatcgagtggtggccgtcaatatttgaaaccttcatattcgtttcgcaatccggcttaaatttgaataaatggaaatgttgttgtgaagaaaataggtagttagacataatttttgtaataaatataaatgttgttgtgaagaaaatgggcagttgactgtaatgtcgcacaatgataataagagttaaacattagaaaagtccacaccatcaacatgacaacatgcattaaatgtattaattatactaagattatccataatatgcactggcataagattaattactctaagtcaatgagacttttt

SEQ ID NO: 67264 - DNA, 3962 bp, Oryza sativa
gtagtattaaatatagtcgaaaaataactaattacacagattgcgtgtaaattgcgagacgaatcttttaagcctaattacgctatgatttgacaatgtggtgttacagtaaatatttgctaatgacggattaattagttaataaattcgtctcacggtttacaggcggattctgtaatttgttactgcgtttaatacttcaaatatatatccgtatatccgacgtgacacgccaaaactttacacccgtaacctaaacacagcctaaattagtcagaagtgagatgatgcactcgcagacccggacactgcaggagccttggtggtgctcacatgccaagcagttcctgtcttggacgtgtagcaagcaaaatgatgacggagtggcgtacacttgccggtgccggagacgacggactttccggcgagcggttgccatggatcgacggacttcccgatggccgaggatggctgaacagttgggctccaactcggcctgtcacgctaaaaacggcccacgacgacccactttctaagcaggccatttggaggcccaaaatagtccgacagccaccatttctcggcgcgtgaaattgctctcctactccactctaggcccaatacggatttcttggtgggccaaaacgaacccaaatttgtgaggtgggccgcgtttcttcgcttgggctccctcgtacagcccacgggcagcagcggtccatttactggtaggccaaatggaggcccaaattcctgcggcggcattgatcgaggcagcccgtggcaggccgggtttctcttcatgggctcccaattacggcccacgaccaccatctcggccctccccacaaaatgctcaatttcagcagcctgacgaggcgcctagacagattactgagtctgaaacgaaccaaagataacaacggtcgtaacataccaagcagaattattaacaggagtgagtgacacagcacaatccatcactccaacagaacttaaactgtaacacaagacttatggagaaggtcaaacaactctgcgaatttgatatatatttcaggagaaacagtctaaccatgaatccaggatcatgcccaggcatggcctgcacacggcgttctcttcaacatcaactaggattacaatatttgggattcagtagtaacctatttgaatggccagctggcctcaaatcttcctcccaacttggtgttactgttacaacaattgaggcaccaaaatgcaccatgcaccatacccaacaacctcccatcttctttctcaatcccaaatcatgatagactcatagaccatgcattgctgccttccatcttaagctctctctcttcgttttcatttactttcacttcagtggtgaccaaactccgcggtgcctttaaggtctgagctacaaacttgctagatcaggaatgatctaatatacaactatttcggtcgataggcttagttctagatgacgatttgtttggaacaacgaatgaacaaaaaaaggatggagatacaggggtggtgaaataaggatagtaggagagccggtgatcctccctctctaaattagccgctcagatctgtctagttaatgaatgaaccagcattgtacctaactgtctccagcaaaagtcaaaaaaaattgatcccgctctgtatttctattctgaatcactctcattgcaaagagccttcaatcctctagccctctgcaaaaagtttttccttgaattagcaaccatcaaactaaaatttggacaaggagctaaaaggaaaataacaacaaagctaggtttacctttctagcgcacttcttctctctaacttcatacctctcatgagacaaatcagacagccatgctcctggacttaccatctacaacaagcccaacaatgaacagaatatggaagggttaaaaaaaagtgagcatgatcacataaaagaacaaaattttgcagtaatctttgtgaaagaagggattacaagcaagcacttctgcatcaactttggcctcttcttcggcctctgtgggagcttgcatcccttcattgccatgaagtcctcttctttctccttgttggataatgaaatgaagaaccttggcagtgctgtggttcccttttcttccattccaccaccaaaatcaaacccatttccctcgaatgggaatggagaacccctagtggagtaatatcgatccttctctggcgagagtgacatggagtgcctgttatcgctcacaaatggctcggttttcctgctctcagacaatcagttaccttatattaggaagaattgctcgatatttccagtcgatgcgagtgtgttctatggcatactgaagctaccttcggttcagcgtgctcgggcgccgcggcgaacgaaacggggcaacatcaccgccaagcgggcgattcactcgtggtatggtgcgcctaagaacatcggtccgcgcaggtgatggcgagccgtcgtccctcgtcttgacacagcggagtcgtttccggctgccccattgcaggaaaagatttggttcgccgggagacctcgatggccttgagtccttcacctctggatccatctatgtcctgattcctgaagcagaaaaggctggaaattttcagcaacaaaatcattgacgggaaatcagtagatagcccaaaaaatggatatttaactacaggggcggatccaacttgggactgaaccaccaaacttttgggtgaacaaataaactgaattaagagaggtttaaggctatcaaattaaggaggaggagaagagcttcttccagatctagaagagaagctagtaggggttcacgaacgcaagcaaattccagtcccggtggggtggaagagagagatgaatcagaaagagagaggacgcggatgctcaccaggatcccctcccctccgctgctctgctctgctcgccagatggagctcgccgcccggcgctcccctgttcagccgcgactcgtcttggcggcggcgcaaggagcggaggagacaacgagagcgagacggcagatttctttttcttctacgcgatactcgactactccgcccttattatagatgcccacaaggtccaagcctgacggcccggcccaaacacggcacggcccgactgggggttgtgcccgtgccggcccggcccgaccgccgggccatgcttgggcttccccaccggcacgctgggccgggatggcacagccaagcctggtacgaagttcaggatacataacggactaattttcaaccatatgtaagacacagtaggagcaaaaatagacgtattatatggcacggccaaaagaatatggacataaaatatatttattttagttatatatatgtcacatcccaaagacccggcccgactgctagtgggtcgtgcctaggcctgaggtgtagcacgtgggccggcacggcccggcacaaagagccgaccgtgtcatgccggcctgattcttctttggccgtgccttgctcgtgcctgggccgggccataccaggagggccaaatggccatctatagcccttatctcaatatttttactattttattaaaagtagttactatttatttatataactggtgatccacgtatcatcaatacttaaaggaaaattaagcgattgtgtcaacaacaaattcctcataccaccaacaaacactaactgtcactctacgcaccaccaccaccactctttctccatgagccatcatcattcctcctcttgcctttacatgcgcagccttaccctctagtaaccgacatgtctttttaccctcccctatcgtgatgcacactattgttatggttgtcgttcaggtcggggaagtcaggcttgcagggactttgggaggcaggagctgacctgacgaagcgcgaaggcgctatatttgggctccttcttgctagatctattggttatccaactgt

SEQ ID NO: 67265 - DNA, 9397 bp, Oryza sativa
cgaactttaaattcttcatattccctctggattttggttttgcaacagacattaatgcgagattacaccaaaaaaaaaacaacaaaaaagtacacacatataaaccaaatttaccttcatggcacgacgatctttaacaaaagaagcctgaactttgtctttcaagtaatcaattttctgtgcaaagtaccactctggagctctgggttctatgctgtactttttacagaacggtacccattttctagcaaattctgaagtctcagcaagcgcatcaaatgttaacattgcagctccatcatcagacacatagcaagataccttatcaacagggtaatccacagcaaggatggagagcacagtattggcagtgacaagaggaggttctttcataggatccacagtactgacaaaaatgtcaacaggagccaattgagatggttcaccttcccggtcatacctgagagtgcaagtgatattttgttattgtcagtaatcagtactacagtgctaacgcaggaatggtgtatcagaggtaaatattgtacatcaccttaaagccagcctatccaggtaagtttcacggttgattggggaccacttggggaactgatccagaatccaggatagagcaaaccaaatctcacatatgacagagagcaaccatagcgggtatgcattacgcacaggatttgtgatacggtagtgcaagaatatacataggacaatcaatcggagcacaataaccatcctgtacggatttattctggatgacgaaattggcacttttctcgatagaggttggcgtgtttcatcattcctgtaatacagatagcacaacatttatagtggcaagctatatgataagtccgcattataaggttcagagatgtacaaccatttagaatctgatccattaaatgtgcatattgccttgcttaatagcaaggtatacttgtaaacacaaaataattatatttcgaattatgcaagaatttttcctatgttcttccaagtacaaactagtgcaagttagtacaccagatacaaggaatattaattactggtagaattcatagatgactaacggtggacaaaagcatatcagaactcacagtaaggcgtcctccatgttatagtcagtagatgcatcaatgtcaccaaccccacgaccttctgaaggagcaatgctagtaccattagccatgggaattgcacctttatccttcattttccagccatctactctctctttccatgcaacattgccaaggctaccagaaaactcccttgatgggtttgctgttgagcaacaaagaataattaaattttcccagtcgatgcaacgaaacatgagatcttgatgatagataaacttacgtgaatggttcacatagggaaatggatgcccacgtctgccaatgttcccaacgggagacatcatatgatcaggggacgctccaggaatttcacctgagatctatagaattaatcgagaggaagaaactaaatattagttcaatctttgcacataccctgaagggttaacgacttcacgctatcaacaaaaattctaacaaacctggctgtgagtgagcgatgggatatatatgcgagggatttcaccactgtcatacttgggatgaccaatctcaccactatcatacttagaatggacaatatcatcattcctcccagagttcatgcgccaggtgagcatcctctcggcaatcttgtgcttatggtcctggttgccggatgttggatagttcacatcactagcatcatccgcatcaacatcatcgctttcatccccaagtatcggcgggctccctgaagcaaagattaaatatcttgttaagctcaacaaattcactcacatttgcttctctcaatggaaataacccatacaggaaagaaattatgttgtcactggtcactaccaacttcgaatacagctcactaaagaacaggactctgtgctattaactcagcatattcactaagcatatatatatcttctctactattattgtctaaatgcaatatgcaacaacctgatgggttcacgagatgttcagtccaatgtagctgttctaaccaaagatgaagtatttaggtgaaatccaagagaaggatgaatggataatgtgcaacttatacccttgtggcgcttgtacttggtcttgcactgcgggcacgcctggctgccgtccttgcgctcgtactcgtagcatggccggcacaccgggaacccgcagacgtcgcaggcggtgaagagctcgccgtccgccgccgtgcccacgccgtcgccgcagatctggcagacatggcattgcttccccgatttcttcgccgcgcatacaacaacaccaaacgaaacaaacaaacaaaggcaaaagcttcagagctcagaccaacccaaacatccacgcaacaaattaaccaatctttgaatctttccccccgaaaatgcgactcaccgcaccgtccatggcgcacgaaccaagaactcacggccaagaaagtgtctccacgaacggactcccgccaattcaccgcattccgcggccgccccgatgaaaccaagaaaccccaactcccccccaccccaagtgaggcaaatcaatcagtcagacaccaaatcgcctcggattcaaggcgccccccgccaccgccaaagccgacctcgtagctagcagcacaagctggatgaggaggcttgcaagaatcaaacgggacaagaaaaggacgtggcaccagcgaggatgaggaaaccgcaagcgtgagcgtgaagtgaatcgaatccgctcgcgtatcactctactctactccggggtttagcggttgattggtaattaaaacccccgtaaaatttcgagatttttggcgtgcatttgagatgagatggttgggttgttgctggggttttgattactccacggggttcggggagaggagtgaagtgaagtgacggatgaggtgagctgggggtggggcccacctggcagtgacgggcggagtgcgcgtcggctggaccgtggtcgcatgcagacagaaagtgtgaccgggatgggcgtgtggggaccgtggggcctactgtcagtgagaaagggtggacagcttgtgaggttgtgatagacacaaatgccaactgcacgcagcctgtatcgcagtactctgttcttaaaaaggaaaaaacagagcactcctcgcgcatagtaatcccttctaaaaaaacgtttgaacctgaatacaatatagaattgggttttttgacgggtgaagtatatgtatttgtgttttaaaagcaaaattgtgttaaatgtttaaaactttgaccgttagttttgcattaaaacaaatggtttgtaaaatataaggagtttataatgctatgatcgtatttttgaaataaaatttacggcacaccatttttctttcctttaaacgataagtattgtatatgaaactactccctccgttgtaggttataagatctttttgactttgatcaaagtcaaaacgtcttgtaacctgaaacggatggagtatttgtgatcaaaatatcaaaagcttgactaattttatccaaaacataagatatttatgatggaaggaaaaaaatactgtggcaatctgagaagcctaggtgcgagcaatcgttacgctagtgatatgaactcaaccaagaaagtatctcgtaatcacatccatatgaacacatataaacactcgtacttataaacggatccgcgcacaccctatccatatgaacacatttaaaagatggggccccgcatattttaaaatcgataaatatattatctacctcttaaagaataattagccataaatgtaaatgcatgtgtcaaatctataagtttaaatcagataaactgattccaccacggtaatcctaatcagtttacactcagcgatagactgcaaatctgtaacaggagcatcaacaaagtagtgctgaaatgacaatctcatgatcatacaccacatacatatggtacgcaaacaacgatagttgtctcctcgacagtttaggatagtgtcccacgcatgcgtccacgagtcctcgacgcaacgttcccgccatccacgcgaccacgcatgcacggggggcgcgcgcggttgatgcactggacgtcgagcggaaaaacgccctgatcgatctggtgtcctgagcccccgaggattcactagctcttgccaattgtatccatggccgccgccacggcggacggacatggcgggaggcggcggctgagggtgttcttcctcccattcttcgcgcgtggccacctcatccccatgaccgacctcgcgtgcctcatggcggcggcgagcactgatgccgtggaggtggaggcgacgatggcggtgacgccggccaacgccgccgccatcgccgccacggtcgccgggaacgccgccgtgcgcgtcgtctgctacccgttccccgacgtcggcctggcccgcggggtcgagtgcctcggcgccgccgccgcgcacgacacctggagggtgtaccgcgccgtcgacctgtcgcggcccgcccatgagtcgctgctccggcaccaccgccccgacgccatcgtcgccgacgtgccgttctggtgggccaccggcgtcgccgccgagctcggcgtcccgcgcctcacgttcaaccccgtcggcgtgttcccgcagctcgccatgaacaacctcgtcgccgtccgccccgacatcgtccggggaggcgccgacggcccgccggtgaccgtgccggggatgcccggtggcagggagatcaccatcccggtgtccgagctcccggacttcctggtccaggacgaccacctctccatgtcgtgggaccgcatcaaggcgtcccagctcgccggcttcggcgtcgtggtcaacaccttcgccgcgctcgaggcgccctactgcgacgagttcagccgcgtcgacgcgcgccgcgcctacttcgtcggccccgtcagccagccatcgcgcgccgccgccgccgccgtgcgccgcggcggcgacggcgacgtggactgccttaggtggctgtccaccaagccgagccagtccgtggtgtacgtctgcttcgggagctgggcccatttctcagtgacacaaactcgcgaactcgcgctggggctcgaggcctcgaaccagccattcctgtgggtgatccgctccgactccggcgacggcggcggcgagcggtgggagccggagggatgggagcggcgcatggaggggcgcggcatggtggtccgcgggtgggccccgcagctggcggtgctggcccacccgtcggtgggcgcgttcgtgacccactgcgggtggaactcggtgctggaggcggcggcggccggcgtgccggcgctgacatggccgctggtgttcgagcaattcatcaacgagcggctggtcaccgaggtggccgcgttcggcgcgcgcgtctgggaggacggcggcgggaagcgcggcgtgagggcgcgcgaggcggagaccgtgcccgccggcgtgatcgcgcgggcggtggccggattcatggcgggcggcggcgggcggagggagagggcggcggccatggcgacggcgctggcggagagcgcgcgcgtggcggtcggcgagaacgggtcgtcgtggagagatatccgccgcctgatccaggatctgacggacgcgactgcatctcagccttgaccatgacttccattccggctcatttcattatcgtcgcaatcactttttgaaaaattttgtagaaaaaaatcgagtgaaaagctatgatgacctttgtatgcttcttccgttctgtatcatcaacatttgtttgtcccatcactcaactatcttaaacttatcgttacatcaaaatattttctcatttagttctaatatatgctaaattacctagaaaatttctattttagaacaaaggattagtgtgtgtatatataagaaactcttttaattcctcaaaagatattcccttatttcttacacgtcatgattattaaaaaataacacgataaaatgaatgtgaagaaatgtgaacaagtgtggtcatctaaatgcgagattagaaatacatatcggggacattcgagattagacatttcaaaccaagtaacacaagtgtgacaacttttgccgggtccggttggctaatctattttgggccacctcaccggcccatgaaaatattctcatttttatcgggccaagaaattctctgtcggacaacgaggcctagcccacggcccgttcctcaagaatctggataaggacatcaagaaatggcccgtttggtaaaatttcaacttcgaatggtcagtttagattggtgtcattttaaactatacaattgcttgttaaaattgataaatttatcactgtatttagtttgttatcaaatattggtaatacatagaaaattttggcacaacatatttattccgttctaccaaaattttggcgatactgccaacttaccaaaaatttggcaatgccaaattttagaaaatctgattttggtagtaatataaacagaccctaaaaatctgattttggtagtaatataaacagaccctaaatttaactataggagttggatatgaagtaaattataaaacagtctaaactcaactcaacttctctatttaattttgtgagagcgcttcagccagtttccgttctattttaagtgaagctaaaactgtttgattagtagcttcagaaatcaaaataaatggagctaaagctgaagccgtgtcaaactagcccctaaaagtggccgtcgccatcaaatcggtctggactccggcggatatgccagcgagaccgaccccgccgcgtggcacccccgccattgttgatgctgacggccgcggctcgcgaggaagaagaagaagatgccatattccctcgtctactcttgccgacgctaatctcccccggttccgttaattatccccggtcaaatcccaccaatctctttcatgcctcctcctcattccctgtatcgaattcatctttaaaaaaaattcaatggcgttatcatgaggaaaagggcgaaacctactgacgtgtagctcagggcgagtgctccctttctccgtctctctctcgaggttgccgtccaacgtccatcagtcatcgtgatgattgagattgacatccaatgtccacacgtagtactcacagtaatcgaattgatttggtaccattgctttgagaaattgagctagattgatccatggagagctgaagaaaaatgaagtgctagtactagtgtcgaactgaatgtttgcaagatttgagcaaacaaaccatttatgccgtatggataatacaagccaggggaaaaacaagggccactctgtgatcacaagcagcagagggcaacagcagcaacagcaaatatacaacttgttttaaaatcttttttacaattaggttctcggatgcgcacagctaagcaaacatcacacgaagaacggcagctagattaatccagcacacaaaaggcactgaaagaaacagagcagcagcagatcgatcaagatcgaaggtttgcagaggctggctgcaggaagctagaagaaggatcgcttggtaggcaccctcccaacagccttcatgaagttggcgagctcgagcaccttggcgagcttgaggcctctcttcgcctccgccgacgccctcttctcctccgccttgcgccgcgccttcgcgatgtcgttctgcgtcctctccagcgccttggcgcgctgctcgtccagctttctctgcgttagttgttcagtcatcaagaacacctacgtgagtaacattttggagtacatagcagttgctgctaagcactattcagtaatcagatatgctttctaaaagataaaactgcactatgcaaaagcatgatttgcagagcatgtaatggagagagaaaaaaaggcttttaaaagctggattctgacaaagaccgctctcctaacgttgcatgattgagtagtggttaactcatctgatgtcgcatgcctacatccaaaaaggatagatagtactagtgctactctgaacattttcttgcaagaacagataccctgctactctgctttgagttaatcaccaagaacaaagttggattccctttgctcggaatcaaaatctatcagctataatttcagatttttgcaaagcctaaacggacaacaagaattagatgaaaaatctgcaaacttgagagtcataaataaattcataatcagttattgagttacctcgatcttcttgagccatgcggatgctttctcgacctgctcggtctcccacccgttgatgacaacctcctccctcttgaaccggttgttgatcttggccacctccgccgtctgccacgccgacaccttcgtctccacctcctccttcttcacctgcctcgcctccaccggcggcgccggcgatggccctgccgcggggacaacctccagctgggacgccctgctcctggccggcgtggcgatcgggtggctgtccggcacaattgccagcgggttggtctcctccagctcgtcctcgccgatgctggtgagctggtcaccgccgttgttgccgtcgttggggccagtctgcatggtcgtcccggcggcgaccatggccgtgaactcccggctcatcgtcatgaactgctcctcggacgacacggaccggtggctgctggccgtgtcccacgagtacgcggcggacccgagccgcgtgggtggcgtcgtcgtcgtcgtcggcgacggcggcgtcagagggtggatgtcgcggtacgtggtgacgacggtgacctcctcgtcgtcgcctgcagcgacatcgtcggcggcggtggcgggcgccgacagctgtagcgaaacctccggctccggctgcggcggcggcgcgtgctgctcatgcaacatgtgctacccgcgcggcggcgatggcggtggtcgtcgtggaggctccgccgccgtgcatccgaagcgccgccgtggttgctgctggcgagctgaggtggtgcgtcgtgtcatggagtatgtgcgcgcgtattatatggcgggagatgggcatggagggggggaagcgatggggccgggtgtggttttgtccattggcgccaagggggtgacacgtacttgtctcgcggtgcggtgcgttcgccattggcgccaggttaaagctggtgcatgcactgcgcctgcgcgatgtgggctttggtcaaggcgagagcgagtgttttggtgcacctggagatcggcgaatttgcaagttggggcgcttgtttaatccaacaggatgggttggggaatgtttcttttggttgattaattgattggcaaatggcacagcgtggcct

SEQ ID NO: 67266 - DNA, 8674 bp, Oryza sativa
agtgcttccatacgcaaaagatactactactactggacaacacaaaatcccagtatacgtccaatccgaagactccaaacacgtacgaaggcaagggtttgtgaaccaaactaccaatgaccacaggttgcgatcgattgcgccctcaataatctcaaatccaatatcctcacgtcttaacctctaccggtctctttacggtcgaacgggtcatccagtgcagtacaggacaattgccagaagtcgacacgacgaattactacctgtacagtagttcgtcatctgaactggcgatgttactattggctggtcatcggtttaattcgcgagcaagtatgctctgctcatcgtcgacgtgttcatcgtgcaggacgtggaagtcccgggttggggatggacagctaagagtgggtggtggtggcgacgcgtcgctttcacccggataagagcctgtccgcttcctccgcctcaagctgatcaagctagcacacatcagcaaaagaaaagaggagtacatgcaatccgcgcccaaacccaacccgcgccgcgcacctgtccccgcctgccgctttcgcccacgtcttctcttccccccctccatatttcatatcgtctcattcccctcgcgcgcgcggacgggcagcgcggcgcatacacagacacaatacagggcgcgaggccgagtcgcgcggcgacgtgacgtgcctttcgttgcgtggctttgcgcaccgttatctgcgcggcacgtgtgcgcggcgtcggattcacggcttctggagtacgatcttttttctttttcctacccgcaggcgcaggcggcgacgggggcgcagcggggcaaatttgcggcacgggtggatgactggatggtgaacaagaatactaaaaggcacgcgaggagatgggccgtggaatgcgttatgcgtagcgcgttgaggtgaagagtatcgccagcggaacgtgattcaatctatgttattacaatacaacttccaaatctagataagtcttacaatatgaaacagaagaattagctactttagaatgaaatagaagggttctatttacttaatttattatattttggatcgagtttaaattttatgtaagtgtttaaatttatacggagagatacacactaacacacgtagtgaaaataaaaggctatagctaaagttttatttttaccggttcctagacaccaccctcgtacgtatacgctctccgtccgtccgatgtgttgcgctccaagaaagtgacccctcctttcgccatcgatcgatcgatagaattgtttacgttaaaggttggtttcaaccagcctgttccaaagaaatttactactccttgtaacttggaagcaagagattatatagtagtatatcttttggtaggctttgtaatcacgcttgatgggtttgtcaaaatcaaactcaaatcctatttatgttgtgtggaggaaataaaatcttatcccttctcgtacatgcatgttagtaatatgtatgagtggctagtgcagaggatcagagtccacgttatataagtttatacctcacagtcagctaaccagcatgggtctgagaaaccgatgttacatacacagccaccttcattttcctctctagcaagtcataccagctcacttgtaggtcctaatcatgcacgtcgtcttggagctactgatgaggtagcatgtttacaactaacccgactcccaactattgtactactcaattagctaattaattcattctagaaacttggggtcattagtactagtacccatcaattaactttatcaatactcttttttttgtgtgtggtttgtgatctatatatatagtggctgactagggagcgccactaattaggagaaagaaaactaaattaaaaaataaacaagattgatggggatgaagatgcatggccattggaagtgcaaccatgcatggcaaatcagacagccggttagtgctaggcagctactatatcacttcactttgtagctttcccggattttagcaagataatcaactctggccacctactagaaaaataaagaaggttagttaagcactgtgtgtgtgcttgctcaactcaattaatcgctgggatggtatgagtggatttgcagaatcctcgctatcacgatgtgcttcgctttctcttttctttttttcttttcttctttgtcataatacactttctttagctttatgtctccatctctctggctggaccaagtattgttattttactcattttcgtccatgtcataccgaacttgacaaaattgttttgttaatttggtcctacagagacacgcgtgattggaacaactggagctaatataattaattaactagcaccagaactctcatgtgtacagtagtgttatcttttccatttctcccaagatgatatagtaccagttttaaccatatacatgaggtgtccgtgtcccctccgattgcggatcgctgcctccgtcggtcggacaaatcgccgtacgttgaagcaaacgagccaaccggtgagcccctttataggcaaaattcctctgttaattcctccgttctcaaataattcagtgtaggttatctgagatcggaggcagctcagcattaggcttattagtttgattgttttgcttcgatattcagggaaactattctaactttcatgaacattcactagttatttacatatcaactaaatgatttatactacctccttttttaatagataacgctattgactttttctcacatgtttgaccattcgtcttattcaaaaaatttacgtaattataatttattttgttatgagttgttttatcactcatattactttaagtgtgatttatatcttatacatttacataaaattttttaataagacgaatggtcaaacatgtgagaaaaaatcaacggcgtcatctattaaaaaacggaggtagtaattttttttaacaagatagattaatactcctatgtgataaattaaatcattccacaaacttgtaaagttttaacgaaaaaaaaaatcaaggattctgaaattttcagggctgcagagattcgtgtcaatagatcgatagagaggatttggaaatttttcaaggctgcagattttcgcatagccagaatgggcaaatgcaaagatggcccaggagaactagggctgatgccatatggatttggaatttattcgggccttcaatcacacacaagcttctactaatgtcagtccgattagtagcatttagccaattcaaaaacagcagagcaccctttacaagcgactgaagatgcgttgcttcagctcagagagtcgtgtctccaactactgtaagatctcaattgaatgctctaaaactaaccaacaatttcgtgcgcctcgatcaaattgagacaaatattgcagaaatttaaactatctacagcttgaatcgcagcctaaaattccgcagcagcttcctcaggcaactcctcgccttcgtctcgcggcacttggctcctcctccgccgccgccgccgccgtcgccggagaagattgctcggagccggcccagatgccgcgggctcctcccctcgtacgccgccgcctccggattctcctgaaaccgccaaaacaaacgatcgaggtaagaacagctcaccgagaagaagacattcgcgattcggaaggatgcagcaatggcggcgcaccagtatgtagttcttccagtcggcctgcttggcgacgaccacgcggcggcgagggtcgtagctgaaccgggggtggttcttgatccggctcgccgcctcgaactcccgccggaactcgcccagccgccgctggagctcctccacggggaagccggacccggtggcggcgttcaactcggcgcggatggatgaccagtcctcgccggtgagctcgcccacgtttctcgcgccgccgccggcggccgtgtggcgcagcagcaggtcgaggaacttggcgtcgtgctggctcgtccacgcgtccacctgcagccgcgacaggatcttgcggagcgcgcgccgcgacaccggcttcctcttgatcgccttctcctcgtcgtcggcggcgacatggacatgcaactgctgctgctgctgctgatgcatttcttgcttcgccgtcgccgtctccggctgcatcaaccgcacattatgcatctccgtcctgccatagatcgatcgatcgatcggttcgtcaaaacaaaatcgtaagaatgctcgccgtcgtcgttgtgaaatttgcacgtactgataggcgtcggtggcgaggcggaggctgaggaagacgacggagtcgtgacgcacgccgtagtccgcgagcgtgcggtggtcgtcgtcgaggcaccggccggcgaagaacagccgctgcatggccaccgcgatgcgctcccgggccatgaccatgcccttgacctgcgccaccgtcgtcgtggcgccgtccacgtcgagcgccacccggtccccgcgcagcgtgcgcaccatgatcctcatcgtccccgacaacgtacacaccgagctcaccctcagctcaggcgacaggtctcatccggattcccgtgcgagaaaagatagcgaggaagaggaagaagttgttaggttgagatgagaaaaataatggagatctagcgcgaagaagaagggattggctggcatggcaatggcatgcatgcacgatggctacgagagggaataaagcggtttggatcgatgatgatgacgacctttgggcgccaacgtgaaggaaagtattttcttcttcggagcgctgacctgtgtacccaactgtccatgcagttcaggcgttggaagatctgggccgagacagctaatgggctgcttgtgggcaatgtcagaacctggcctggcccagggatggcctgtgcaacccaatggaaaagaacaaaagttttaatcagctttcaacaattcgtagggttaaaatgatctttttatagcactgaacggagtgctgttaatgaaaatctaatgacgatgatatttatggaacaaagacgattgtacaatgacatttttaggaatatatgttcatcgatggcatttcttgaatttggatgtttatcggtggtattttctggattttctcatatgataaagttgtgtttttgagcttttgactctcaaattattctctaggttgtacaactatagattcacaaactatgggcaggaatttataatgtttaaaatagttggagatcattcaaaaagggcatgcggactagtatagttgttggaaaaaaaatgcagatgacaaaaaattgtggcaaggggcattatggtttgatattcccttttggatatacggattgaatgcaacataaagatcaagtgaactgaatgcacaatcacatggacctcgcaggcgacgcatggcgtttagccgctcgccatccggtcgattcaatacgcgcctgcagagttgttcagcttgccggaaatggcgacgagcatggtaaagtcgcgggaaagcattcaggcgcatcaccaacctccttgacctcccccacctacaaaaatggccgccattgccaacctcgagctcagcactcacacacacactcacacgcaacgcgtttgttcaatcgatcggccgtcaccgcgagcgcacgatggcgagcgctcgtcgcagccgcggcgtggcggcggtggggatcgcggtgtttgtggctgtcgtggtggtggggcgggcgccgggggcgcggcggcggtgtcgtgcggcgacgcggtgagcgcgctggcgccgtgcgggccgttcctgctgggcggcgcggcgcggccgggcgatcggtgctgcggcggcgcgagggcgctgcgcgggatggcggcacggcggaggcgcggcgcgcgctgtgcaggtgcctgagcagtccgggccgtcgttcggcgtgctccccgaccgcgcgcggcgcctcccggcgctctgcaagctcggactcgccatccccgtcggcgccgccaccgactgcagcaagtaataattaaaaaaaagttgattagattggtctcatggcgcattagtttgcatttactgaattgtttgttcatctcggttcgatccattgcaggatatcctaagtggcagcggcggcgacgacgacgccgctacatggcgtgagttcgtcgcgatcggtgcatgatcgaacatgcatggtgttgacgcgggagaagagtgatttggcttttgcgcatggtgtaatctgatctgatctaatccgtgcatgaataagtactagacatgcttgtaataactcatgagctaaatatcactcagatgagatctcagatttgagattttcttagccactgtttaactgttacagagttactcctacatacataacatccactgagcagagctgatgcaagtttggatcgcaaacttgggccttcatgggccgctcgaacatttcacggttggatcatcaatgcgcggcccagatagcaatttatctgatcattttgcacatcttggagataaactggttcagatatttcatctagaacagcgaatgagaatcgatagcaaccaccatatatataggtcatcatcaggaattcaggacaagacaaagccaaagccaaggaggcgcatcagcagtggaaatttcttggtttgttctcttcagaggtcagagatctgacctcacctgagactcctgtggctctgagctagtatatcgtcttcttctagagtgaacagttcatgaaccaatggatgcatgcatgcatcagcatcttaatttgtatagtttcaccatcctgtggtctagaagattgaaaatgcagctaacatgtttgtattcctgcgcccttcaattttctcctgggagaagaatatgcaacctgcacgccggttcagtttgccgtcagagaatataatggtgacaccgccaacaacaaaaaaaaagaaaagaaagaaaaactggtttcagtgctagtagagctggtacaatagcagactattagccaactataaatatattttaatgagataaaagatgagagagaagagcagcgggctgcaacacggactctaagacgcaatgtgtgtataacaggtgggaccatatattaatagtatagtaagcaactattgtatgaattggctattagatcggctatagatgaattggagctagtagtgggctgtactattaaacttgctcgtagtagaaaagagggaaaaaaagattcttatgaattttatgcgatgtgtcttatgatttatggtagaacccaattttttttaaaaaaaaataaaaggagggattaggagattaaaattccgacccccttcacctgtttttttccttcactacttcagtgcatgtttctctctcagccacatccacacatctctcttctcattctcatgcattcacaacgaacctaacatgggcacacatgctgaactaatcgattgattgttcagaacagtccttttcattttccatgttcattctctgaaatctcaacatgtttctgctaacgaagtgcaaacagtttatgagccatttggtacatgcagcaccaccatttttcggtttagaagattgaaatgcagcatgctggtatgccggtttcagttttgccgtcaaaagatagaacggtgacacctccaagaaaaatataaaatggaagttccagttttagctgctaggtacttctctttccgatcggcacctcttcttttggggggataatttgatcgataaccaccttagaaacaaaagttcagtcctttttccttgttcattctcggagatctcaacattttctttccaatcaagcataattaggattaccatgcatgcgtgcaaacattcatttctgaagccgaagccggagagcagagctctggtcatatccaaagggggtcggagttttgaactccgatccccttcgacctctttctttctcacgctcctgtgatctagaagcttaaaatgcagcatgttggtaatgcctgcgcctgtgctttactgcttttcttctgaaagaggaatatatgaatcagttttcagtttgccgacagaaaacataacaatgacaccgccaacaaaaggaaaaacaatagtttcagacttttaagtgctagtagaaaggataaaaggaacatttgtatgaattttatataacattcttatgatttatttattcctttatggcagtagaacccagcatacaaaaaagaaaaagtaaacttcagagaggggttcggagagttaaatttcggtgcatgtctctcgctcagccacacccacacacctctctctgtctcttctcctttgtcgtgcatgctttgatgcacacacggtgaactactcgatcgatcaacagttgagcttcaggaccttaagaagaaaaatgcagtccttgattccctgaaatgtcaacatttttctgccgacgaagcgtaaaaaaacatgcaatgcttgcgaggcaaacatcgtttttctgaaggcgaagacagagagcagccgagccgttgtcagatgcagaaggggtcggaaattaacccctttgatttcgtttttgctcgctttctgctcaatctgcatggttatcttattctccacaaggtttaggacgtaagtggcgtcgaagctgctgtgtcacttggg

SEQ ID NO: 67267 - DNA, 1101 bp, Oryza sativa
ttgatcagatggttattgccgttcttaggctgcgttcgtttggagaacaaagggagtgagttgtttctgttttccgcgcgcacgcttcccaaactactaaatggtgtgttttttgcaaaaaaaaaaaaattctataggaaagttgctttaaaaaatcatattaatccatttttaaagtttaaaatagttaatactcaattaatcatgcgctaatgacttacctcgttttgcgtaccttcccaatcttctctatctccttctcctcaaacacacccttagtaaggatagcgtgaaccttcttggtggcatacccgcagatatctggtccaaacatgatgctgcaatttcaaaagaaaccgatcaatcaaagatgttgcgctctgaaatgagcacacagaagggaatgcaaggtgatcaaaccatcacctgtacggtgtctcgccaccaaacttcttctggtcaacatcgccgccaagcaatttcacgtagccgccgccgcagtcgagcttctgctcgtgcttcaccgagaactgcagcacgagggtcttgtccttgttgctgaactcagggtactcagccgaaatggcgtagaatctgtagtcctctgatgtctggatacctgcacagagaagcagagtaacttcgcacatgccggaacagaaaagaaaaaacgaaatcagcagcgtggtgtgtgcatcgatcctcacccttgttgttggtgtcgccgttccacttgccggccgtgtggttccactcgccgactgtgttgtcctccttcttccactcagatttgacccaccgatcctcccatccatctgttttcacacacaattcagaattcagaaaccaaccaattctagtttctctgaaaaccatatatgtgtacatcacatttcagacaaagctgaaaaggaatgccggtaccaacaacaggatcgaagttctcaaaaaaaaaaaaaaaagaggatcggattcgattaacaaagaacgcacatacacacaaatttgcaattgcttgcttccacaaaaagaaagagatctccaaacaagtaccagagttctcgtacctttagctaaacactttatctcaactatagctat

SEQ ID NO: 67268 - DNA, 3923 bp, Oryza sativa
tgagatcactcgatgtgagtgattgatgatttgcgggtggagacatgagcgccacccgccacacacaaaccttctgcgaaaccaaaacttaatacaacaaaaccatttcgactggggcggcatgcatagaatatgggtgggtctggaaacggttagtcgccgaccctagtcagttatggaccgagtcaggaagctatacgagaaacgaacagagtacgaccgcatttcttcagtgggtatagaccagcggattaggaagctcttgtggggcgacacctcagtcatggttagttctgtataagtgtgttgtgatgagtgcagtgtcggaaaggtaaaggccatggtataaacttaaaatgaaccctataactatatatataatataatatccccaattccctggagcgccaggactcccctcactatccagcagaggggttaggagtgccggggcgcaatgggggttcatagtccttggagcgggtgccgaaatacaagagcgactgaaaagctgtgccgtggcaagtcttatatgttgggactaggcttatgtgttgggcaagccacggagtgcgggattaaaagcgtacatccactgcagtgtgagtaaatctatctattcgaatagctgtgctcgcggttaatgagcgccgagacctgtactactcttgactagacttatagattttaatactgcttagagtagttatgagagacatgtgaaccttgcccatagagtgggaaggtcagtatagtagagttaataagacgaaatgtgagggtaaaccgaactaagcagggcttggagaggtggatgaaacctaaataattacaacttcaacaataacgttgtttttcagttaaaactgctatgccaataggcttgtgaaatgaatcgtgaaaactagccttatgcaaataaactaagccatccttgaaccctgtgtgcattagattcattttgtagtggtggcttgctgagtacgtatgtactaactcttgcttaattaaatcttttagaaagaagttggcgtcgattagatttatgccatgctgctgtcaagaacgtgttgaagatgatggattagggaccataggttcaccagtcgttgcttgtggagttcgatggaccgccgttgcttcgcttccgctgttctatctattgctttggtattttgtattgtaagtgatcatgcttggtctatttcgggacccaataaggttacccttatattattattatagaaacaccggtaaacgatgtcagttataatattatactgtgctatgtgtgtaccacctactgatccaggaagtggtactgtataacacatgggattaccggtgtccccacaaccaaggtcgagcgtgaggcggaagtgtccatgatggcatcgacgcagccaagcaccaggcacggtccgccacagaacgcctccaccgccgccgcctccgatggcacacgcagtgcgccctccgggcccaacctgtactatccctggcagccgctgtagatcttcacccggccaccaatgcagattgcagaacgtcagaaacagagtccgttttctgctcgaactctttttttcttcttttttatggctgaaattgtttcaattactgctcaagtttgattacgaactgtcgaactgtcaatgatgtgcttacacatcgatcgctgaagcagatgattggccctggcaacgatgtcttcagtgcttcttttttgaccatgaaactatggaaggttgttgctgcctcgtctgcaacgacgatggcgacatgcacccagatggggctagtgagcagcacgatgggcagagcacgacgacggtgctggtgagcgtgagcctggtcgggagcaggaggacggtgagcgtgaggaagccaacgacctgggtggagttgggccgggcgcgtgcgtttgcacccgccagagcagtgtcgtagacgacgagtccgccgccgcgggagcttacccatggcgctgtgtcggacgtgcgcgtgctgctgccgatctaccattctcgcggagtcgcggtcgacctaggaggatgggaccatcgccgccgccacctcttctcttcccccatctcccaccatccacctcatttacatgtaggcctcataatcttttgtttttttattttgctgactcaacaaaaccagagacccaaattatacggttttattatataataaggcaaaattggttatatagcatcgaaagttcacgttttttgatttatagcaccgaaagataccggttcactttaataacactcaaagttcaccccgttcccatttttaacacttccgtcaattctcgatcgttttccgtccgtcttatcctagccaggcacacgatatggcgtttctaccctcattgacatgcattctacttgtacttgtgacgggtatataattaaggggtaaagatttctaatattagattagggatgttatacaaagtcggcataaagtcattccttttctggactgtggcttgtgggccacaaaagtagcaaggtctactacaaccaacaaaacgagattctgaacaggcccgtgacaagagcgatgggcgacacgtgggtatcgtacggtcaagaaaaactgctgaaacctactacctccgtcccaaaataagtgcagtcgtggatatccgtgcccaacgtttgaccgtctatcttatttgaaaaatttgtgaaaaaattgaaaatatttaatcacacataaaggactattcatattttatcatctaatagcaataaaaatgctaatcataaaaaaaaattcaaataagacgaacggttaaacgttgaacgtgaatagtgcaaaactgcacttatttttgggacggagggagtatttgtgaaaactcaggagcatttcagctgcaagaagcagtggctgccacattaaggtcctattaaattagaaattgagtctgcaagtttagaatatagtcttgaatatttttttgagtgtaaatatagtttttaattattagagtctacattgtacaagtaatgtcagctttttttttggttagaaatcaagagtctatgtataatgatatactatgttagggacaaatctagagaaaatacagagcatcagcatcagacgagatcaatcaagaagaaatattcaatcctttaacactgcctctcaatgcctctagtttttccatcctagtctataattatccctctagttcttccatcccagtcaattttcgtatccaccttctaatacctctgtcccttttgacaaggttgtctggccatcctcaatgtggtaatattcccgatgtgaaccaacacgcagatcaacttgatgaatcagtttaatggcaagtgaaattctttttatagtcaatagaaatgatcaaattgtgagcataaatttgtgagatactaagttgctaactatttggaacaattaacaaaaggtaaaagatgtgtgattggtaccaaactgtgtcttgaatgatggaatggagtaaccaccagtactgtctcccaagccgttcaaaataaacctaaactgaagctggaatagcatcagaacagtctccttttctgataccacatagtactggatatttttgtctgggggtgaattgatggataggctatcctccaagtgtttgaattctacaaggataagtaatcctgtcaacaaaactatgtatgtgacaaacaaaattcaaccccaaggaaactcctggagtgaatctgacaaaatggatattacctgttcaagaggttagcagcgtgtaatcctgcaaaaggacactggccaagatattttacccagtagacataaactagtcgtattcatcattcaccaataatcttcacaatagcattttccatcctaaaacttatgcaaacactttggatccttgatcagta

SEQ ID NO: 67269 - DNA, 3493 bp, Oryza sativa
aagtcatcatcaatgtgtgactgcgtatgaacatttgcaggagatggttcaaaatcggtgtgtgtccaataccaagttcttccaagcacaaaagctgtatgtaatctttgattagtactaatctgatgatccgagattctgaatcatcaaaccaaacctggtctaggtactactacacgtagtctttgtagggactaatatgtaattaaatttttatccagggtcatttatgaaacttcccacaactttttctcccttcatttatgacatccaacgccagcgcgagccgcgaatccgccgccggtgatccgccgacgagtcagcgccgcctcacgccggccgccggttcgttcgtccccggcggtgctggtcggagagagagagagagagagggatttccccttggctccgcgtcgatacgatccgagaggaggcggattcgggtcggatcggaggcgggtagggaaaaaaaacccgatccgcttaccctaccctcctcctccggtattttttcccctcacttccgcgactaattttcctcccttggtttggacacagattgagagcaagcagcgtggcgacgcccaaatcgcgcgattcgatcgaggcaaccctccccaattccctcaaatcccctatccgaaatccgccaattggccgcgtccgccacgccaagaggtgcgaatttctcgcttttggatttgggagggggctttccctctccctttattgatccgaatttagtgtgatttatgcctagtgattttggcgttcttgggcgtttgggggggggggggggatcgtttggttctgtatgcgggtgtggagttcgtggatcggggggtatgaaatggtaattccgagcgagtcttttgatttggtggactgtccttcgcttgcgacttggggggagaagaggcgcccgcgctaattggagggaggaattgcggatatgattgggggaattaatgtgaggatcatggtgtgcaattctactcgttagctcgaggataaggtgtgagtgtgtccgcttgttcttaggttgggggaaggtgtttgattttgattccaccaattcacactttctgtttatccaagtgaaggatagtagggggggagaaaaactgtatttgcaaagtaggagtaagttttttcagaatattgtactaagttttagctttgatcggttggttgctgtgaggatgggagatggaaaaaaaaaagtgttggccatgctatgtttctcgagtaataagagatatagtgaaaaaacgatgatcagttgggtcttctgctgccttctccctttctctttgatataaaagttgcatactaaggcgttatagaatgctacagaatgtggtatattgttttgctataccccacagcaaggatatttgttacacaagacaagtttgcttggacttaaagttatcattggtcttattgttatcgggaaggatatttctttgatattttggctttcctgttgtagaaaaagcaactttattaacttcaatttgtataacactagatgttatagaaagcatacacaccaaaggaaatgaatgaaaaataaaagatgatatcctttaaaatgcttccaaactaggcacatacaatggtcttgagttccattaataatccatacttctgtttcatatatgtatgcatgcttttttccagaataaaggaaaacatcggcgtatcaacaagtgaagctgcattttcttagagctcagatgaagcggcctcgaaggcgtctgtggtgggatgactgatgagggatgatagtgacattgatgaacttgttacgggcatgctggagaccatcatccaaccagcatgcccgggcaggctcagatgttgccggcaggcaggatggacttctatggtacaaggacactggtcagcatgtaaatggggaattctctatggctgtggtccaggccaacaacttacttgaggatcagtgccagattgaatcgggtccattgagctttcttgactctggtccatacggaactttcgtcggggtttatgatggacatggtggcccagagacggcttgctatatcaacgatcacctattccaccatctgaaaagtaattgatactgacagtatgcactagtgttgttttgcactacttccatactgtgttttagagcaattccatgaccatttcattcttccatggcttatattgcagggtttgcatctgaacagaattcgatatctgctgatgtgctgaagaaagcatatgaagctacagaagatgggttcttctctgttgtcaccaagcaatggcctgtgaagcctcaaatagctgctgttggctcgtgctgcctggttggtgtaatctgtggtggcattctttatgttgctaatgttggggattcccgtgttgttttaggcagacatgtcaaagccacgggagaagttctggctgtccaactctcagcagagcataacgtaagcattgagtcagtgagaaaagaattgcagtcaatgcacccggaagataggcatattgttgttctcaagcacaacgtttggcgtgtaaaaggtctaattcaggtgagttctctatcactatgaacacagttttgctttgaagaagtttgattgaaggatcatttcatattgcctcctgcatctgccattattcccatcatcaccttccggatggtaatcggcttattaaactcatctgcatttgtaatgttaagacaaaaccaagtagattcgaggtggttacaccattggaaataaatgcaataaagtcttcttctgctcatggatgagagatgtcatctgtgattgatgattgtgatatcactcctatattttgtgccagtgaggagcttgagaataatcgaaggttttgcattgtctgttgtttaattgcatgttcatctacttaattgagagattttttttttcgtggtacagatagctgctggttgaagaaatactttgtttgctatttatctgttaggttcatgccatccctcaaataaccatttgttagtgaaaaacattttatgaatatccctccaatctccactcttcagagcttgatacacccttcactaggctaccatgataaggcatccaaatgtttgatgagtttttattgtacagtttacaaatctggcaatacttgctgctttatttatgtttcttccaaggtctaagtgaagattgttgggttttcctttaatttgttatatattttgcaggtctgcagatcaattggtgatgcctatctcaaaagatcagagttcaaccgggaacctttgtatgcaaaattccgcctccgggaaccttttcacaagcccatactagttcagaaccatcgattagtgtgcaacccctacaaccacatgatcaatttctcatatttgcatctgatggtctatgggagcacttaaccaatcaagaggccgttgacattgttcacagtagccctcgcaatgtaagtgcttgct

SEQ ID NO: 67270 - DNA, 1520 bp, Oryza sativa
ttactgtcttagagaagtaccatcggtcaattttgagagtaccctcatcagtaggctcctgcttggtgccatcaaagcacagattagggtggcatgtccagagcattctccagtttcttgacacaaggctcgctctagccgcatctctgagtggcataaaagatactataagctgctgaatatcctgtcattacaagagaaaacaaacgaaggcatgctcaatcaatttgtaggtgctttgattctataataatagaactcatccgtgcaataaggcccaatgtttcatctatgtgaaaaatcacacaggcaggcaaggcatggcaggtgttgatagatgataggggaaaaaatgaacttttttttttaccccggatagagagaagtcagggaaatttagagttttttttgggaatacgcaagatgcgcatctttgtattaagagaaataaagagtatttacacgaacccaaacaagaaaataagagggggacgggaagataggagaaggacccaaagatcttaagcctattctcacgccagcatatggaaacgacctaaaccaagacctaaatgattagcaccggtagcaccgcatgtgtcaaccgccagagagttgcttccgccgccatagctcgggctatctctgaccagggcctttgctgagagttgaaaaccctattgtttctctctttccagattgtccatgcagttagagttgcaattgtgtcaaatccccttctgctagccgctcccactttaaggcgggagttgcaaagccagagataaaaggagtcttcattcagggggagacactgcggtagaccaatgctggaaaggacagcccatcaaagtggcgagactctgggcaagcgacaagatgtgatcaatagtctttcatgttgatcacaaaggacacatctatccgggtgaggcaaccccctagaacgcaggcggtccgccgtctagtagcgcctttttgtgaccaaccaggcaaagaaccggcatctcggggagggggggcgaaggtcttccagatgggctcggattggaaaggaaccctacctagaaagagtgcccggtatgccgaacgcgaagagtagactcccgatgcttcccacttccaaataaaagagtcggggtggtcagagagccgcacagaggacctcaggatgctccagagctgaaggtactcaagaatagcctgcaaacccagcgcccctgtgcagtctctaatccatctcctgtcttgaagggcctcggcgaccgtcctgcgacggcgaagacgtgccgggacagccgcccaaacagccggagcaatgcagcgaatggaggaaccctctagccaaatgtcttcccaaaaaagaatggactccccattgcccagaacgcagactgttgaagccgtcgcaaagtttcgctcgttcaaggaaaccgggatgttgaggccgtgccatggcttatcggcgaagtgcgctgcaaccagacccatctcgatcttaaggcgatgcccatgcgatc

SEQ ID NO: 67271 - DNA, 764 bp, Oryza sativa
cttggacggccctagtcaatgagtatggtcttcaagaggagaatgcatatctccaaaaggcgcagatgttaatagacgatgaaacgaagcccaatgattcacaggtaatttattttaatatatttttggttcacgttcagctccagttctggatttgtcactcctgctcttaacattttccacttgtttttttttcgtaggagatagatacagaccgtaaagatgtcaagagggaggtggaggctcctaagttgatcatttctcgtcatagtgatgataaattctcatcctagtgatgagaaatgagactcgcccaccgtctgaatagcaaacatgaggcaacatgcaagtaccagccgaaaatcaactctctgatggtgtgatatggttgccagccatcggtcaaataagcagccattttgtgtttttacatttatgaatcacaatcgtactgtaataataaactagttacatctatatttatatttatagatcgtttttactttaattagcatatgtttcatttatattatgctaaactcctatgatatgtggatgagccaattcaccgatattttgtttcctttcagacttcacttaagagatctactcttccaattcagcatattaaacttctaaaagcgcatctaaaacactgtggaaagaaattgaatttaatctaaatcggcacatatggaaaaacatggtggaaataataatacacagtacacacatttaaattttagatatacttaaaatccatg

SEQ ID NO: 67272 - DNA, 727 bp, Oryza sativa
tttccttttctatcaatagtggacaaaggtgagagctgatatttattatatcctgttagccattcagaaagtgctttccatgacattccaaacgaaatgatatttttctcatgttcagtcggccatgcatcttcagtttaactaaacaagtcaaaaaaaaaaaacttatatccaacataagatatatatgccctatgagcataaacgcactcagtgataaaatatactagtaagaggtaaagctaaggtgaatgctgacaagagacaagcccatctgtccctcaaagataacaaatactactactgactgaaacaaaattaaagcatgatagccacttctgaatttctgaatggctgaaggggaaaaaaattgaacaggatactgcatgctgatcgagttgaacaagtaagaaaaggtgttcatctttgcagagacaagatctaacacatttctaactgcagaggtagttcatagcatccatcgatcacctacacacaatatcctctctcatgcctgacccctgcacaaacgcacaccggattgcaaatacacataatttagatctttctaatgattttgtatcgtcagataatcttgcttgttttggtcgaccttcagaattgagttgatgaagttcgtcgcagtgagctctttgtaggcatcaccagtgcagcaacctcctgtttcagctgtccaagcaaaagtacaagtgctcgtcacatgaat

SEQ ID NO: 67273 - DNA, 1684 bp, Oryza sativa
tcgccattgattacatgtcaagctcaacatatatttgatgttatgttactcaaacactacacaccacagttacatgccaacaaaataataaagaagatatatagccacatatctgtggtgcaaattgtaaggttgtgtgcatattgctattgctcgatggatcgctttcgtgttccttgtgatgtgttgctttatcttttctcctttccagtgtgtgccagaaagaggacacctttctcttcttggcttttggatcttgtttcttgccttgcaagagctagcttcccctaataatctctctctctctctccattgctagctatatagctacattcctgggtcgatccctatataagaggagaggcatgaactcaaatgaaatttccaataagctccacatgtcgtgagagcagagcaccggccggttgatcgagataacacagttggagagttttttctccttttctttttttctgtttaattcatccggcgagtcagatgaggtcttcgtcgtcaccttcgttggctaaatccatatttagcctcggaactcgtaagtagacacttgctatacatgtatagcatctttgaattcaacagttttatactggaagcttattataaaattctgccaatgtttaaactttttttaagtagcaacatgcatgcatgacctcataataaaatccatatttgtcagctcttgtgtgtttcggttttggtcagtttgcgcaaatcgttttgaaagatcaaactacctacaatgttccactcgccttaattcatactcgttaaataatccctacatttgcatcagaacaaaagttatggtaggcaagcctgcagctagctagaatcaaactttaatcaagaagcacacacacaattattcacttaaaataactatggtgggtaagccaattagtcctgtgtaatttagattattgagtaggttgttgctacggattattcacttgattatatataaaaagtataaaaattttgagatacaaacttagcaaataacttaatacaattggtataagcaatacaacagagattttttttcttttcttcagaaatgtattttctgaagcgtagagcaaataatctgtttcaataatcggacaaataatctgaaaactaaacagggtacatttaggccggttaaccgacctacaaatgcatgcttttcctcaagtttcatctgctagctaagctatagccaatagcttgtacacgttgcacactagagagtcaatggtagtgtagctaaattgcacacttgcatcacaagcaacagcaagctatagagatagctgtgctcccaaagagactcatctccatttcttgacgctttcgcgctctcatgcttgctcttccgcgttgtttgccgccttaatttaattaatttgctgctttaactaactactaataacttactaacttggtcgtcgtcttcctcatcttcgcgccaatgctgcagagggagccatgatcgagagaagcaactccaccccttccgccactccggcgaggccaccgctcgcgtcgacgaggagtacaaccaggccttccgctccaagtccttcctcgacctatggtctcacgcccaccaccacctcacccacaccttctcctccttcaagctctccacctccaccccctgcgccggccgcggcgg

SEQ ID NO: 67274 - DNA, 1586 bp, Oryza sativa
ccatgtcgaagtgcggccgcggcgggttgcaccagccgccgtcgtcgctggggagcgcgtagttgggcgggcagaagttggtggccgtcaccgtcaccgacgcccccgcgcggcaccaccgcgggtccgccctcgcgtcgcaggtcagcgcgtagcactgcccgcacgacgcgccgtcgtcgaacagcgccgtgctcagcgccgccgtccgcgtcccgtacccttgcgtgtacaggttgccgtacccgcacgcaccgcctgcaatgcacgcacaccgcactctgtcagtcagtccaagcacgcgtcgcgacgcgacgcaacggacgaacacataggtacgtacccatggtgccggaggcgtcgctgccgccgtagaaggtggcggtgcccttgctccagcccgacgccgcgaacgcctccaccgtcgtcgaggcggcggcgagcagcgcgtagctgacgaacgccaccacggcgaacacatggccacggcgcgccatctccgaattccgatcgatttcgcctagctctctgctcgttgcaacctgtgctagcttagctactatggtgaactgaatctgattgctgcatacgtgagctgtatatatacacgcgagagatagctttgcacatgcagagccatggcttgcgggcgaaattaaaatttgtcatgtcacgatcaatccgtcccatattctgctcgatacatccatctcgcccaagaagaacagggaggacgtacggtcgtacgtacgctttctatctcgctttaattcgagccaagttattacggctttctctgctgcttctgcaccgaccatgcatgcctctgccgtcatcaggttcagagctagctgcaccattaaacttgaagatgttaaagtcggtgccaaccttgttaggttagctatatagtccatgctcaggagattgagagacagacatgctgatttccttggagaggcattcgtaatactgccattaaacaggttgcaaacactgccgctagctctgcttcagaggcagcaagccgatttagattaggcaccttccgaaatctgcctgtgtttctttcttcagtatggcaaggaagcatacaactatagtagaagatatcaagagcacaaaaatggccggtatatttgcaaatctgcctgacaactaactgcagattaacaagcattaattgcttcagaaagaacacgcactgtgtggttggttgggtgcagtaatactagcagagcagctgcagatcactgcagtatggtccggacactgaagtgaaggaggccagccgagcacatggacaatctgagactgagacgggagatgaattgagcggtgcacatggtctccttccaaatctttctgcatctgctgccaccacaaaacagtaaactccaaaaatgatattacacatcaatttgtttaggatatcttgcttttatattttatttttaacctcatctcaatttgagggcatgatgaactgcctgcaaagacaagaaacagcagaacatctagacaaattcttcagttgcagtgcagtgtggattggttcgtgttgagtgaggctgcgtttgagtgtg

SEQ ID NO: 67275 - DNA, 1413 bp, Oryza sativa
tagttttttagctcttttttgccccattggtcttggctgttcatcaagttcatctacatataaagggctactatcctctccttccttctccttgcctaacccctttgttgctattctttttcttgctgctttcaggccattgttgtatgtgatccactttgcttcagttttaactgtgttccatacttccatcaacacaaaaggacctagattgagtttctcattgtcttttatatagaatacatgggccttctcaatccacatttgatcattatagccacttgtataaatcattctagccttcaaccaagcactatggaaaaggtcagtccacttatttaccttatgaaagcggtccttgatttgcttggcatttcttctcctatgacttggtgtagtctcattgtaagtagcctcaacatcagtccaatattgttcattcttcctatcagcaccaacggttgagtccgttgaattgagcagccaagagctcatctgtaaatgttaattagcatatattatcacttggactgttatggtaagtaaaaaaactataaacacagtgaatttacagtgagactcaccatcctaacatcttcttcttgagtccaaaagattcttttctcagtcctaggtgtctcatcaccactgtcaacattaacatatgtattgtccctagctgaaataggagtcgagtaatcatcttctgactgattttggtctccaacaaaattaaattgttgagacaagttaggctggatcaagtttatgaagcctccaagaggtgttgcattgtttcccctgccatattttacacatatatatgagcaatgaaagcaactagggactaatgttatgtgtaaagtaggaactaatgtttgtttcagtgcttcatcctctttgatgttatacagtggataaaaactagttacatagctttattaaactatcaaagaaatctgcaccagtgcaatcaatctttgcatcaaccacaatactgaaactcatgacagtgtatcccaaatcttgtataagcgagggaagtgcaaataacatctaaaattaattcctagccatatgattcccatcattgagctcatcacagaagcaaagttcagagatagtaccatgttgcaggatctgaagattaagaactccatggttgaccactagggctttggccggcgttgccgaagaagccgccggcactgccgttgaagaagcagctgccgtcggtgaaggagcttggtggtggactagccgcgccatatctcgaactccggtgctctggcacacgcgccgccaaccctgaactgctctgctccggcaccatcgacgccgcccgagctcctccctgggccttccgcatcggcgccgccgcaccctttcgagattgcgatgcagctggcttgc

SEQ ID NO: 67276 - DNA, 939 bp, Oryza sativa
aatgtgatgattgttagtggatgatgatgtggcatcttgttaattagtgaatgatgatgtggcatcttgtcagtggatgatgatgtggcatctttgcatgttaagcttaaggagttagtgggggataactttatagtaagacaggatgcctatcgagccatcgcgaacctgagcggcctacctctatgctcgggtcaccgacatgtgggacccacttgtcagctccatctccttccgacctgtccgtcccatctatctactctactagcttgccatcattcatggcggacatgcgccggtttcttctcgctggtagcgcattgaagcctctccgcaggtaacaaagatgctactagatggatttcttgattgccgatcgaatctctatccttcccgatcgattcgagtcgggttcaaaatatgataaaccctatcccttgttaagttgttgttacactctgtccaggtttctcccttccccgtctctcctctactgctactgctaacctgcgtctccctcgctccccctgcagcgtatggaatggagtatccgacgaccaccaaggtgaggaggttggagcaccaccgcagtgtcagcgactcactcaggccgccgccatctttccagatacaagacctccctgaggtaaaactctaaattggggcgccgggggagacgatctggcacaggcgtggtgtccgtcagggggatcctatctcccctatgatcttcatcctcgccatggattctctgagctccctctttgttaaggtagaagagttggggctcctccagccgctggggatccctcactgggtctccctctatgctgatgacgtggtcgctttcgtcaggccgacggttgccgatttggaggccgccacaacagtgccgcgcatctttggcgaagcttccggtctccacacgaacttcaacaa

SEQ ID NO: 67277 - DNA, 722 bp, Oryza sativa
cacttttggagaggtgagtggctatctcgacctgttgcatcaactctttgggtaaaaaattgatcccagttagacagggcattgacaattcgaagaaacaaaggcttattcatccgaaacctcctccgaaactgctcatcagtatagataggatttgctgaaaaataattagcaactaaatcttcatgtcccttttctcttggcctaggtatgtaccttctaggtccactttgacgctggcgacgacgaggtggaccagaagaagatccttcgattttggccttcaatttatcgccaatcttccttcgaaatgattccattatttcatcttcggcgagaaaatcttcaagtgtatatacttccgctggatcgatttcttcaaggacagtatcttcatcgcctccatctccaccagaggcgaagaactcgccaccagacccctcatcgtcgccaccaggatgctcgccaccagaggcaccagaggcctccatcgccacaattgtgatgcatacaagtcacagagcagttgattttatatacaaatgcatacacggcattgccttatcatttcacattccatttcacatcatatcagttcacattgcaatgacccatcagttcacattccattgacacgtttcagttcacaaaaaacagttcacaatagccaaaaaaaaaacaatcccagaaacagaacatagcaaaacagagactacttccaa

SEQ ID NO: 67278 - DNA, 1687 bp, Oryza sativa
aacttcgaagtagactctggactgggacagctcaatgcaaaaactgtgtcagctactcagctctttgataattatccaattataatcaagctgtaatgacccagaagagcagaaatgatttaagccagtctaccaagtatatccaggagattgatatgcgatggtgtccaaggggcgatatatatttatatattatatattatacatcagatgatcagcacaagccagttcagagttttgagaggtatgttacataaggagaaaggagtgagtagatagaaatatagatatatatgtagatagttcaaccaaaaagatagagcatgtagcaatataagcagaaacaaaatgctctatagattaagggttttctatatatatagagagagagagagatgtcagtcttcttctctaagaacagcaacactgatggacaactcgatcgcagcacacagcaagaaagcagagcagcctcctcctccttctgctacaactatagcagtgatcaccatggccgtcgtcgtcgtcgatctcacagcttcctccggcacaacgggcaggatccatgcttgatcaaccagccgtcgatgcacggcacatggaacacgtgccagcaatccggcaagctcctcaccttctcacctgtctggaaatcctgcagtagtaagaggagccaaatgtttcagaattcacaggattcagtaatcagtgagaattcatgcaaagatctggcacatcaatgagaagcacacggttttgatacgagacagtgataaattaaatatggatgcaatgtactctcatcaattggttgcaaggtaatgtgcaagcaataatgcagagatgttcaatttaggtacagtgagtttgagaaatggtaaaagtttcagacctggaggcaaactgaacatcccgagaggtcaccaatggcgttcctcctgtactcctcagtgatcctgacctccgggagcttgtcgatggatgcccgtggcatgccgttggtgccctcgatctcgaacaggtcaggggactccctgaagggcgatgaatccactgcattcatctgaattcagaggcaatctcgtcagacaaatctgtaactgaagctgctactgcatatttctgaatcagacgcaaccatgtatgcaggggcagattcatgagacgaccaaactgacctggctccggaccacccgctgcaccgccggatcgaccttctcgcggacaagcctgccggtcaggaggctgtagatcacattaagctgcattttgtgcagagagatttgtgttaggtttaacaagccaacaaaaaaaaattagcaaaatgtaaggctgtgagcacgtatatatgacagatgaagcagaagagatgttcagagatcccgtttgtgcagatatttgttgcacaatctacctagggagcttccccccccccaccccccctaaaagtggtactgagaatacatgagcaggttaattagattgtaaagaatgcacaaattgctttggaaaacatcatctgaactattcttttttgtacgaaataatcatctgaactttcaagacagcaaggtttgacaagttgtatcatctcataaaagaggcagttagctttgaccctttgttttaaaataaacacaaacaggttatatgaattaagcaaggcctagttcatataaataaatta

SEQ ID NO: 67279 - DNA, 1702 bp, Oryza sativa
atgaataaatgtgcgcacagcattttcaagattcttctgaatcctgcaaaaaatatagaaattaagacactgactctcatatgaagatgatctaggacaagaaagtcaccttgggtagcattggcacaagtcatgtgcgagttcagagcataactccaaatatgatcgaaatgtatgtgcatctcaggagagctcagggtcttcatagaatcaacaattgctccataatatggtatattgttccgctcgaagctgattaaaaaacagatcagatgctgctttgatttcataagccataaaacatatttcctaagaatgatagatttttaccttcttaaaaagtcgaggaacatgtgttccagcttttggtcttttccactcatgaaataagacgcaaaatccgctctcactgttccaggagagggaggcctggtttctagctgcgcattggtgggtgatggccttggcttaacactggagctgctaccatgttctcctgccatacgggaatgccgtactggaggaggaccttggcttgactcaagtgacgagcttacgctctagaacagagaaaaaaaaatgatgaaggcattttgctagatcaaatcaactagatgaatatattacatggttatagcaatatgagtgtttacaggtaacatcaaaaagaccgtgacaatagaagtggctttgaacacagtagatttgccactaaaatcctacaatcaaaggaatgcatatttctagcaacatgctgaagtagacatggcaattctacatttagaacaacaatgtgctaagcatgggatagcagttaacatttaaggcaacaaaaacgtacatgatgctgggtttgcctggcactggaggcttcttcttaaagctttgcttagcaccttcaaaataattgccacttttcaacacagaatgttggtcccttgagattgtgatatcatgaaccaacacaccgctttcaccaggctaattatttttaaacaaaaaaggtcagtaattaaaaaaatgcactgcttaacaaagaaagtggcagaattactaagggcttacagaatcaacagatcgccaaatattttggtagttccggaagcccacatctgattccagaacaaaaaatcttccatggtactgaaaagaagaaaatagaatgaaaactagcataccaagcttatttaaaaaaaggcaggtatcacaactcgtaaattacaataccttgtatacaacgttgaagtgctcgttttgaaagaaaatgaacaacttcctatcaggagttgctgctttcaaagtgtgtaaactgtgattttaaaaaaaaatgtcaatagaagaaacaaaatgacaattgtatttacctatagctagcatgcatacccaaactctgtgacttgtccaggattatctttcaagaacgtgtgaatcaactcatctacaaataaacaatttaaaaacagagcattagcgatcaaagaaagaaacatatttgcatccgtaaatagttgacaggtgaaaaatgtaagatcgttacatcttctagtttcagcagcatctatcataaaatcagcatctttctttgagttgtatttagccctatcgatattcagctgattgtatgaacgtccatcaactgcattcaataaaatggtgtcttcctgttcacaaacataccacagaagaaaaaattaggcaaaac

SEQ ID NO: 67280 - DNA, 1061 bp, Oryza sativa
cgacgctcccccgtccgaccgagcggaggacctcgccgcgaccgatcttggcggcggatctcgcgaatgtttttttttttctttttcttttttttcgagaggaactcgcatgaacctaaaccctaggaggcggcggcgtttggtttgaatggtggagttggctcgagtggaatggcatgacctagtagggtagtaggtgcgaggaggcgactgcagtctactgaagtcggcctgtgggctgtggtccgaacggaccaagacggcccgcgtcttggactacggagtgttcagttgagctgcaagttttacaggatttttttattattgtttttctaaagatttataaaaattactctaatataaattatcgttccaaagttttgcaaaaatactctccttcggcatataaatcaccctacaataagaccatctatgtgacgtggcaccccgtagaaggggcacatcgcgacaattttgcaggcctcccgttgggcgatttatcgtcgggaggggccacctgcaaaattgtgaaactttgaaatgattttttttacaatagggtgggaggagtatatttctataaaacttcaaaatgaaataaatataaatattaaaaaaatgttttacaaagagtaaattttacctagactcatgtattattatactttaagttacacaagaccacactattgatcatttcgacttttatttatcacagttttgaattctacaataacatctcaaatttatgtgttctttattcatcatataaatgatctacatccatgtaactatagccttttaaaattttgatatgtgaatatgtcaaactgattagtgacgtggttttatggaacttggaccattaatatcttaagttatatgtcacgtgccaaattttatgtggttttgtgcaactttgaccattataggtgaggttttgtaaaatttactcttacaatctagccttctaagaaaaacttactccgtatttcatgaaaataccattagtaagacttatttctggaaatgtgttgatacctcggtgccaacgttggtat

SEQ ID NO: 67281 - DNA, 1304 bp, Oryza sativa
acccccacccctcccaacccacccccgtgcaccccaaccaccggcgccccctacccctcccaaatatactagtaaattgtttactatcgaatctacatgctatatatatatagactagcaaaagtgaccgtgcgttgcaccgggtgtttacggagtgtgtatagcgatcaaaaagtattgtttggtttagagaactaatctgctcaaaaaaaattgtttgtttttagataaataatatgctctatatttgcgcacagagtgatgtcacgatggataaaatttaactgaacaattttttaaacagtctagtatttcaataataatcacaaagttttttttaaaatattccactttacatgtgtatgatatgagcgatgttcctgacgcgttagcgtaacgattgtactacggtggataaatttaactgatcgatttttaagcagtttagtattaaaaaataataatcacaaatgtttttttacagttattccacgtatacgtggatgatataaatgttgtacctgatgcattggcgtaatctctaatttcgaaatctctgccgattcgcgtgcaaacaacccctccacgtggcacaatacgattccagcgttagtcctctccctcagccgtcggatcgatgatcaacggtgtggaatagctgcggtggacctctttgtaatatgtgaggttttaggggtctttttgaaaaagttataccctgctatgcccttctctccgccggcagccccgcccccgcttcctccgcctcattcgtcggaggtcgacctacgccgatgtcgccgcctcttcctcctcctcacgctccagctccagctccacctccgcccctccggcgcccgaggccgaccctcccacgcgccggcgcgctgttctgtgcgtctctcccctcaagctcggcggcagtggcacagattcacctcgtcgctggatgtggcgatgaattcggttgccgtgcttggggatggggagggtgaaatcacgtgcatcgctacgtccgtctttgcctgccttttgattcgccagccgcctctctccccaagccgcggcaccgaggggatcttggacggaggccactggccgtgccgcaaagggcgtggctgaggaccgcgctaccgctgccggatgacgtcatgcaggagcaggagctccctcccctgcttccctatgtgttcacaccacaggtgattaattccacctgtaaacggaatcggaatcggaatatataaagcggcgcacatggggcgagcgaagaggggtgccacgtaaggattttgctacagtat

SEQ ID NO: 67282 - DNA, 1226 bp, Oryza sativa
  unsure (1)..(1226): unsure at all n locations
taaggtttgcagcgtgcataatgatgtgcggttgaagttgaactcagttttgtgttccttttttgatatttcgattttcttcttttcatagaaagaatggattggagtaaatcagcagcggtgtggattgtgctctgacctcggcaggggcggatacaagaacacagcgatgagatccgtgcggtttgtggcggaccaagcatgccggccgatggagatggttctctgcatctacgcattccccaccaacatgccgcccttcaggtacaaatcaagtctgataaaacactgccatccttcttgtgttacatgttctgtgttacatggtggcctcctcctccaccacagcggcggtgtcggcaaacagatttgagaggtaaaaacatcccttcttgtgttgctttacggccatatttgagaggagaatggcatgatgctgcagtttgatttcaccggctttcctgcttgccgtatttgtaatctcaactttcatttcaagtgattgttggggccaaacctatggtggctagtcgctgaggtggtgtcattaatggaggcaaagagtggcaagtggtgaccaaagcggaaggacctggtgtgttgcgcgtgcgccggccactggcggtgcgaggccacggcgacggtcatgctgccattgtccaagtatggctgctgaccaatttcttccctgaagtaggtgaggttagcccgataggaacacataccacctatattgtgatatttggagctagggcacattcagtcctgttatttgatctgtagcatcaaggttgtaaaattatcagttttgcagaggatttttggtcatcaaattggagttgatgatattttttgagacactgaattaactaatatcaaatatataatctggatttcccttcaactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 67283 - DNA, 727 bp, Oryza sativa
ctaaacggtgtgtttttgtaaaaaatttatatacgaaagttgcttaaaaaatcaaattaatctatttttaaaaaaaatagctaatacttaattaatcacgtgctaatggattgctccgttttccgtgcgggatatttgggttgggaacctggggtgctgaactgagccttaaagctcccaccaacatattttgcaaagataaatacagcaaagtatcgtattttctgtttcccagtttcatgcggcggcaaacactataggcatgaaacattaatctttagggcaagaactggacgttaaagcaaatggagttatctcggggagatcttgtatccgtaaagatggtgacaacctgaccgcctaagtctgagtacaccgctgatgctgcggtggtgcttcaacctcctcttccatacgctacaacctgagataagataagacgggggaatgagatccgtcagagatgcacatgcacagtactctgacttgggatatttttagccgttcgatctgcagcgaacaaacgagatcgattgctacattatgttacaataatatccaaacagtaactttgaacagtatatttcaatactacgccttttctactgtaacgcgtgactcaggatactgtgctcctctgacgtgactcaggatactgtggcgacgtaccatcccaaagtcacaggagttgatcattagcagtagtcgagttaagattttggaaatg

SEQ ID NO: 67284 - DNA, 746 bp, Oryza sativa
actcatcaggatcctcctcagcaagttttctaatcatgtcaagagctttgcggattagtttcttcttgatggtcttcaggctgctatgttgttggagcatttctcgtgatacattgagaggcaatgtgtccgagtcgacgagaccctacagataatagcttataggtttaggctgcataagtcaatgaatggaataccgtgtcgttcatgaaatagtaatctagtaccttcaaaaagctgagatacttcggaagaagctcatcaaattcatcagagatgaaaacccttctaacatacaacttaaggtttgacttgttagagttgtagtaactctcatagagatcatgtggagccttgggaggaacaaagagcaaagctttgaactcaacatctccctcagcagtgaagtggctccaagacaagggcttgtcatcaccaaagtcctacaaaataatttgatattaaatgaggttacttgctttcttctgcaaggcttacataaaatgttatgctcctgtaaattcatcactgcagtctgtgtaccttagcaagtgagtggtaaactttgtgtattcttcttcagtaacctccttagggctacgaagccatatagccttcacatcattcagaagctcccactcagtagtggtttcctttactgtctttgtcttgggcttcttctcttcactctcttctgtctcttcttcctctgtagactcaggggctgccaagaaaagggctgcagg

SEQ ID NO: 67285 - DNA, 1529 bp, Oryza sativa
aacctgttcatgatttgatcgagctgcgacaattaactgaattactactgaatttgttgctgcagctcctactacaacatcagcatcacgtcgatgagcgtcggggacaagaacttgccgttggggttctacgccattgctgactccggcacgtccttcacctacctcaacgacccggcctacacggcctacaccaccaatgtatagtactaacttgtcctacatgttcactgacagttttcttatagccacttaatggatcatgtctctgaaactctgatgtgagctagatattgattatacttaagacttaagaaagcccaagttggtgactggctttctttagtttttgtagaccaagtcagattaatcgggtggagtactatatagaatggtcctgaagagttgatcaaaaatgcaattacaaaaagaatgcaatgaacagagtgtacaaagttaaatgaggtcaacttgctcatcatttctgtttattcattctgtatcgcagttcaacgcgcagatcagcgagaggagggccaacttcagcggcagtactcgttctggtccatttcctttcgagtactgctactcgttgaggtaacaattctgcatctaagcctctacaaatttaagttgcaagattgtttcatctcgcaagtcgcagcacaaatcgttctgatggtgtttgggaaaatgcagtcctgatcaaacaacggtggaactgcctgttgtgagcctgacgaccaatggaggagccgtgttcccggtgaccagccctgtttaccccatcgcggctcagatgacaaacggagaggtaaattacagaaaagatcaccatgtagtcagtagtcatggaacaagaagcaccaattgcatcgtcatctctgaatctctctgacatttagtactagttgaagttgattattcaactaatcgaatgtgattcttcttaccgtgacaagcagattcgtatcattggttactgcctggctgtcatcaagagcgatctccccatcgacatcattggccgtacgttgttaactgtgtttttctgcttgctgcacgcactgtttcagtcttcagttaataatgctgaatgtgttgcgtgcagagaacttcatgaccgggctcaaggtcgtcttcaaccgtgagaaatccgtcctgggctggcaaaagttcgactgtaagttacctcattcatctcgatcccctgcagctagcaagaattaacgatgacattttttctttctgcatctgatcgatcactggctcactgctgcgaatgactgaaattgaatttgttcaggttacaaggacgagaagatgacagacgacgggtcgagcgtcgggagcccgagcccatcgccggggccgaccactcacgtcttcccgcagccgcaggagagcgactcgccggcgggcagaacgcccatccccggcgcggcgccggtgccgcggtcgagcagcgcggcagctggcggccgtgcaggttccggctcctgtcgtccatggcgctcttgctgctggct

SEQ ID NO: 67286 - DNA, 1681 bp, Oryza sativa
cgcaacggcgggtagattgaccgcatgcatcttcattcagtcgtgccctagtaatcgttaagactaaatgaagatgtgcttagtcttaatgttccttctattatgtactgtgatgccctcctatgatgtaatcctatatacctatacaaatcatccccactactagaattctctgcttcctggtgcttccacgtcccccattttctccccaccgttcgatctcaatcaagcggtcgcatcgctcctctcctctcccacatctcgctgcttcaccggccccacgcgcatcaacccctctctcccgcatcgctcctctcctctcctctcccctcgcacgctcgcatcgattccctctcccgcatctcgctccgccgcccccttcgtatcaatctcgccgtgatcctctccatctcccacatcgtgctcgcccgtaccggcgctggcatgtcatccgcctcccgtgccacacagaggcaggatgagggtgtggcgcttcccttcccgtcgcccccatggcagctcgtgcgctgcttccccttcctctcccatgtctaaggttgttcgcctctttaggttgccatgattaatgaaaaccgttgacaaccaccgaggaaaacacttcacggctgttatcaagtaaatccattaatggcttaatgcgttttcttctcctcttatccctttatcagttctgcatctatatccaatttatcatctcgcttattcgtcgatctaccacactctaccaggctgctggcattttactaccgttcttgcaactctgcttgctggattcatatgcagccctcacctgtcgatcctctccaattacttcaatgatctaacacaggttacctaccgatttcccctttccttatgttcaataaatctgatacccagcagagaattttattgttgttgtatcctctttttccaggtttcaggttcttggctactgatttagttgattcatattctttatttatcctgaattatagaccacttctcattcttaagtggttgaagacgtggcaaatatgcatctattggttgatttgtcgtcacccgatcagatctaagaactcatcgagctaagtaacaatcatatgggctgctaagcggatggagctttcttcttttggtattttaattatggtctttaactggtgaagctatatatatctcggtacatctatgtcgttgatgtgcttttcacttttgataaggtccttatcaagaatgatgtcagattctccacacacagacacacaggtttgctcttaaatagattaggttgtcttccgtctcaaagttcattttattttctgatcatgtatactctagatatgtttttaagtatcttttgtcactcttgaattagcttggtgatataaatatttttggagttttctgaaagctaaaatcactccaaagagttaatcaaggatgagtacttaattatatatatgaggtaataatccttttcccaacttcccatatcttactcaagcatgaaaattttctaccattattatataatagtttgacaccttagttatgatttccttgctatcagtgataattggactatatttgtagatgtttaaaaatataaaatattgatgtttcagttatggttattatcagttttgtaattgtaaagtagtcatcactcatcacc

SEQ ID NO: 67287 - DNA, 1110 bp, Oryza sativa
ttgtttattaatacttgctctatccggtcaacagccatatatatgagttgtaattctgttagttgcattggccaaccactgctacctggggagatactccatcatgtaatatttagttataattaccactgtatatactccatcaattatatggtaataagtagttttttttttcttttttcttctcaaatgttatgcacatattgcatgttgaaagttatttattatgtccgcagcaacgcgcggggtattatctagttaagttaatggatgaaccatctacatctgtttaatcctaaatggatgcttcagtattgaaaatctggttgtttcggttctgcctatgaatttttgctgctgttgtttctgaatggatgccattgctgctgtttatgaactgactagtgtctactagttgcccatgtggaagctgatgaaatctgatgtttgttacactgatgaaagctggtgtttgtttcactgatgaaagctggtgtttctgcttctgccgcataacatatttggcactgatacacttactagcatggatatttgggatttaaacacaagtacaaatccaggaacacaacatgtgagctttgcattcactgattaatagatgcaatttaactgaaacagccagatttaaacacaagtacaaatccaggcacacaacatgtgagctttgcattcaataccgatgcagtttaacaacaagctgggcaaaatcaacccctaatccataagaaagtttgcaaatacaaaatgcagtacttctggtgcaatacaggtttggaacaggtctgcaaataacaagaagctggacaaaatcaacccctaatccataagaaggatggctagcggcgctgctctgtccgggatggctggcggtgacggaaagaaaggtgctcgggcggcgggcaacggcggtggcacctgtgctcggccggctatggtcgggcggtggcggctgtggtcgggcgccggcggaactgctacggcggacgacgactcgtgctggacttgaagggattgtttcgcctgctttggcggtgccgaccgagtggcccaacgagcgaatgcctccttttttccgatcgagcccctcct

SEQ ID NO: 67288 - DNA, 1088 bp, Oryza sativa
agacgaccaatatagagagaatattgcccaccagaggtggcaaaaatattggtggtagtgaagatagtgataccaatcaaaagtgatgaagttgcacaaccgtgaaggcaaagaaaccagtcggcagcagtcaggtcagccagcaatgaagatgaaggcgcccagcgataaagttgtgtagccatgacaacgaaataatcagtcggtgacagacgatgcagttggtgaagaagatgaagatgcccattagtggcgacataataagccatccataaaggcgaggataccggtcggtgatgacgaaagcaagccgacggtgaagatgtagacacgcatcaaaggcgatgacgaaatccaccaatcatgaagatgaagaaaatagtcggcggcgacaaacgcaaccgatagtaatgatgataagcagcaatcatagatgatcaaatataatgacgaagttgcccatcaatagcagtagagtgggctatgttgaagaggctatgttgaatagggatattgatgaagatgacgatgtcgatgatccagtcaatagcagtgtagcaaccgatgataatgacgaagacgctcatcagcgtttgcatagtaggtcaaccgtgaaggcgaaataacaagtcggcaatgacggaagcaactggagacgaagacatagtcatccattagcaacggcagagatgtcagggccgatgaattagaggtgctggtgatgaagtcaatgacaataatctatcaaactgttgagaagatatcgaagctcgagtagtttttttggcgcgagagtgtgtataacgaagattgatgcaaagctccttgatttataaagatggcagtagaatttggtgttatagctgttgcagattcttcacttggaggaaagtagatgctgttgcccaactcatcaaaactgaacttattggttgataactccaaactcccgaacatgtagattaaatttcaaaattgatactggaaatatttggagtagattgtgacggcgtgaagaagccaaaattgccggtgtaataattggagtcgctgaaattaaatgacggttctgaagcgtagacgaagat

SEQ ID NO: 67289 - DNA, 1546 bp, Oryza sativa
aaatattgaagattggaccaccacttgttgtaataatataacacggcatcatatttggtgacgcatgccgagatgtcgaagctcctgtagacgtcgtggttggtgaagtaggaaagcggtagtgaagacatataattgtgaagataaaagcaccagccggcggcggcataaccagtcggcgacggaagacgatgatgtccatcagtagtggtagctgtataaaccagacgtagaggcgagggcactagtcaacagcagacgagacgaccggcgatgaagacgataaggccaatcaacactagcagaatcatgcagccatggaagtgaataaaccagtcggcagcagacgtaggcagcttgtgttgaagatgctgacgcctattagcggtgacggcgatgtagccagccgtgaagaagatagcatcagttggcgtcataacaggccagccgtgcaggcggtgacaccagtcggcggcggatgaggcggccggtcagtgaagcggccggtcggtgaagacgtagacgcccaacaacggtggcataatagccagccgtgcaggcggaaacaccagtcggcggcggacgaggcggccggtcggtgaagacgtagacgcccaacaacggcggcataataggccaaccgtgcaggcggaaacaccagttggtggcggacgaggcggccggtcggtgaagacgtagacgcccaacaacggtgttgtgaccaaccaaccgtatagacgaagacaccagtcggcggcggcgacggcaagccagtggtgatgttctgactgatccattcctggggcgtaagagataagcttaaagccatgaatcccttttatgcatatctggatctggatcctgcagaacgaacatataggatgagtagtatctgatgtaaatataatacttcgagaaaaattcaagtattttaaaatatttataaatatgtatttcttctcttgtcaattttgattcccccgagcagatgactcattacgtttaaacactctgcccgactagtcatagccatcaagcaccgggagtcggcctaagcacttcccaaacatgcatatgagtgacatgagttcgtcattaatggaacaaagtttcatgggtcggagtttactactcgggtacttttgcaattattaagagcagaaaataaattatcttatctctatgcttttgatttattccgaataatacttagcaccttgcgttattcggtccatccaacaagcccctaggtgctaggaatcggcccaaaggcaactatccattggcaaaccaaacggaaagcataggaagatggaactccataactcgataggcacttttgtattcagaatatgtcgcaagcaatcaagataaatattatgaaaattgtttaaaaaatatgatataacatctgtagcccccgactcactagtcaacggcgaaccagttgatgtagtgaggcaaaggaaaaggcaaaatatcatataaagaataaaataaatgatgacttagctttgtcatattccccttgattatggcagaggtg

SEQ ID NO: 67290 - DNA, 811 bp, Oryza sativa
aggaggtacctcaatgaagatgtgtccttctgtcgggacatcgccatcagccaacacaaggattccatcaagtatctggagatggagatcgtttcgccaagaacggtgaccaccaccatacccacctccacctctgcagatcctacttcataccttgaatgggttcgccgcagcagagaacctcagccgacacggcgacgctccgtgttccaccctggttcgtggagaatcactacatggagcatgcctatcccggtcacttcatgggacgactggcgccgtgactgcactgctgaatcgcgtgaagtccatcttgacaccaacccaagtcaccattacgagttgcttcatagcctcatgctcagcaacagcagtgatgaacacagggaggaggctcaaggtcaaggggcaacctcttccttgtccctaggtcgcctgcgtttgtgttacccggccttgagttgcatcgatgatgatgttgtttacctcttgggcaacgctgctggcaggggtgctaagacgggaggaatgatggtcgctgttgacgtcaggaacaaggagctgcgaggagtggccaagcttgaccccgaaaagaacaccctctactccatgcgatgctaccttgcaactgggatctccaaacgcctcaacactaccacaggtacttaattaccgctcgtattccagaacaaatgcagcaccatgtgcatatgggtaataaaatgccatttaaggatctagggctgatcattatagttctttgtttatgatggtccgaatgaccaaactaggactagaatgtagtaacttt

SEQ ID NO: 67291 - DNA, 739 bp, Oryza sativa
atatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttgaactcaactttgctttgttttgcacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacatgcttatttgcgaccggatgagtgttttgtactaacatttcattcttaactgtaggcggaccttctgcaccctgacgctgatgatta

SEQ ID NO: 67292 - DNA, 1836 bp, Oryza sativa
gtcctcttctttttttttccttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgagtagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcctagatattagttcttttttgtttcagcttttgcacgaatgtgtcaccattttttaactgcacgtttcctcatcgcaggacctcgtatgccttcgagcgcgttcgcaggcacgaccggcgcttccgcgagctccgcaggggcgttcgccacctcttcgggcgcgttcgccagctcttcctctcacggagcgtcgatccctcgcccacacggtacttaagattttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccat

SEQ ID NO: 67293 - DNA, 1225 bp, Oryza sativa
gaaaacaataactgcgttaacctcgcatttctgtactacgccctaagttacattctctacaatattgttctctaaatttctaaaagtaggttacattctccagatcaaactaaactacatcttacaattaacactattgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctttcgtttttttggatttttagtgaatataatgaaatttcacaggggaggggctgggctttataggggggaggcaaaaatcgccctcccccagggcggcaagggggccgcctgcaaaattccatgccccctcgccgcccatttgcaggcggccccccgcacagtagaaaatcgccctcgcggagggcggcaagggggccgcctgcaaatttcgttgacggccgtcgcccgagagcgaacggccgtctgccacgtcattttcgccgccctctgggagggcgatttttaaaatcgccctcccagagggcggtaggcgactatttccgttaattttcaaaatggaaaattatttttgtaaaacttttaataaaaaaaattataaataaaaaaaattccttgacgagaagggcaccatcgtgatcaatcatctgtctggtgggcccaccaccatagactcgggaggcccaagttgatcccaagccgcacgatcaaagccgatgcgcgtcatgattggatttttgcctttgcccctgccccctcgctcctcgtggtggggtgcacatgacacgactgcttccgcgtttcttctcggcgacgcaccccacacacgcacacacacacctccattcgctccccgccacacaacacgagaaaccccccgccttcgctcgccgccgccgccgccgccttccgccgcctcgaaccggaccaaccaacgacggctcgcttccctccgaggcggtaggccacctcctcccggcggctcccccatctggccgcccggcgccgagctggggatccatccgcccgcgattcctctcgccggtaacgactccctatcttcgctgcttggatttgcg

SEQ ID NO: 67294 - DNA, 1692 bp, Oryza sativa
ttcagcacatatattacaagcaacagtagcagtagtgcagcacaccgatgactcgtgaaaaaaagaaaacaagagaagacatctgcaaaaactagctgggatggattggggcagagcttctattagtcaggaacgttccaacactgggttgatcgttgaggacgaactatttcttttgctttgcacgatagtcagcagctgctgctttgatggtagacttggcgagtgaggttggctttaggacgctcttcgggttcaaggcctgccgaatcttgaacactgcccatgctgtcccgattgcgtggcctgctgcatccatcccttcattggtcgcagccgcggctttctccccatatctgcagagcagacccaatgtaagagcttaagaagaatctctattgatcatttgatcaattccactacataaggaagaattagagaaaaaggatgtgcatatgatgtgcttcagatatggatgtaggacacgtaagaagtagtagaaatctacatataaagagaggagaaatgagtggaaaggagaataactcgtacttgtgggatacaagaccggtagtcacagttgatgatgtggacagaacattcgttccagccacttcgactgcgtcgcaaatcttccctgttggcatgaattaacgatatgtaagaaagacaatgttaccataatccaaagtgattagctccaacgagccaaattaccataagaaattactgcttcaaagaatgtgttcgggtaaatctgtatattttgttaactgttatactgaagtagatatatcgcataagagatataaagtactatttcatcggaaagcatggcggcaaacagaatatgtccctaaatgtatctaacatgttgagctaaggtcaaccagcatcagaaatgaaaaatagcataatcagtggttggaagtacaaagtggcagcagctgatttaatatgagctgatccagaaggagcatgccaaattaaacagaggaaatggagagccaagaaaaagaattgtatttcattccaaatttaagtcaccagagtacatgcttcttatgctaacttcagatttggcaaaaatttgtatccatcaagttatgcaaattcacaggatatatgcgaccaaaaaacccaagcaaagccttacctacgtcagataattatgacttatataatgcaacccacagggatattcaaattagaaacagaaaaaaaatctgctcatgagtcatgacacaggtgttgtctaggtgagtttaagaataacataaatttattaaattatgaaaccaggtttcatgtctgaataaagcaaacatatcaacactcattataccattaaaaaaaacaataatgcaaagcagacccattatgtaacactaaccagatacaatagaaaagttaaagaatcataccgaatccatcaagcgaagcaagaacaatctctccaggtaacaaattaaagaacttcttgccagcttttgagttagctattgagtttgtaaaatagccagtaacctttacaactccggatagtattccagttgccactttctcagacatttttgtcaccatcttgaccctggcaacaatcacaagcatgaattccttgaagcggaaaattgttaatgcttgatttaacacaatatctccctgcaacgtctattctcatagacactaaaa

SEQ ID NO: 67295 - DNA, 939 bp, Oryza sativa
acgggggtggccggagacgccggggacatcggcgacgagggggaggaggggcctatctggacgggcgcgagatcggccatgctgagcgtggggtagagcggcggagcggagggagcagggctagggttagggttagggttagggttggaggtgttgccgtagtagcagtaggaagccatgggagcgcgccacgggggggaatatacgccgccggggacggtggaggggcggcggctcgccggcgacgtggcgcttgtatagggagagccggccgcgtacgtggcgacggagcccggtgggacccacgcggtttgggggaggtgggtcccgcatggctgtgtttaactaattgggtggttagttttcccatttatggcgatgcttctcgtcaatgacttgtggggtccgttgaaagtgttaactggtggaccatgttttcctggacccacctgtcggtgggtagctttgggtgaagagtaaccggcccacgaggaggtcacgctacccgatgccgatatcggcggagggagctgacgagaagctacgctatttatctttctgacgtgtgggcccatattggccgtcctatccacagcagctttcctccatgagtaagcaacctcgcggccatagcaacagcatccaatccatccatgcccaatgcggtaagtaatctggttaatgatctagtagtaggcttcgtttggaatatgattactacgtgtaacaacttttagttggatggaatgtatcccaataatataaatctggatataccatgtctagatttacagtaatacgttccatccaagcaaaatttactatattttgatatggagggagtagcttttttaatgtaattttcagcttccatatagttcaaattcagaaaataagctaccctttagaaccggaggactgaaaatctagctttttgca

SEQ ID NO: 67296 - DNA, 743 bp, Oryza sativa
ctactagctttaaaatttgacatctcatttgtagctaatccaatagcctaatgtatactacatcattaatatttggtcacctcatgtacaaacatcattaatatttggtcacctcatgtacaaacactattttggagtctttgctgcagcaaatctatagaccgttttcatctctttttctcctttacacgtgcttatagctttcggataggtgttctatccagtatccactgaataattcagatcaaatgaaacataaattaaactgtttcatctggaacttttgacaaattttctacaaaattcatgtgtccaaatgggtagcagttctatactcaaaagcttgttgcatttactggaactatttctcatgaacttttcatcacaatcttcaggcttttgattgcggtaaatctaattggagaggcctctccaattattcttaaccagagacacccacgtgctagtactttagaagtttttgttgctattaatccattgagcaagtagtggaaatatccctatcatctatgcttcaaataaaattttctcttaaattactcatccgatttacaatccgattacaccgttgtgttcgtaataattaaatctttacaacaagatctcacatgattatattttgatgaaaaatcacaaattacttttatgatatgtctaaattacttttagatttcactaagttacttcttatacatataaaagtaaattcagtaaagcctaaa

SEQ ID NO: 67297 - DNA, 728 bp, Oryza sativa
ggaaattgacttcatggcatctgctgtgggcacgtgtagattaagctggataaggagaagaagattctctccattcgggataggggtattggtatgaccaaggaagatctcattaagaaccttgggaccattgccaaatctggaacttcaggtattactcctttgtactgatttctcttaaagttatgtgtattctcttgctaaaactttagtattatctatttgtttgtaaagagaattttaccaagtgccatttaacttaaacttgagtgataccaattccttgaaatttttgcagcttttgtggaaaagatgcagactgggggtgacctcaatctcattgggcaattcggtgttggtttctattcagtatacttggttgctgactatgttgaagtgatcagcaagcacaatgacgacaaacagtaagacaccactgaaatacagcggctacatattgtgtttttggttcatcttcttttccttcactggcatgacaacctacttcatgttctgctgttgcactttttctctgataggcatgtctgggagtccaaagctgatggatcattcgctatctctgaggatacatggaatgaacccctgggccgtggaactgaaataagactgcacctccgagatgaagccaaggagtacgtggaagaagacaagctaaaggtattaccatcattactgtcaattggcttcatgctgtgacatcaaatatg

SEQ ID NO: 67298 - DNA, 750 bp, Oryza sativa
tcctgcagcctgcaacttaagttgcacgtatttataactaaagttgtgcatatttataacttaagttgcacatgattgcattttttttattcttagaaaaatcacaaaaataggtaaaatacctagaggaaaatttcctagatacacaacagtggcaagtattcaagggtgcggaaataaaaaaaattactctaggtacctagatacacaatgcagcaagcattcaagggtggcaaaataaaaaaaaagaaaacaaaatgcaaaaagcacaagcagttcggaactggccctacagccatttttctgatatataacattactgagaacattcaaatttttagttttcgaaaacttgcagctaaatcctaaaaagttgcaaaagtttttgctaaaaatttgcacattccaaaaaagcaatgggtataaaaatcgactgacagattgaagattttcaatcacctgcaaaataacaaagcagtttttttctgtatgttaagttttccttataaattataatgttttccagttctattttgatctaaggtatagctagcatgtttatatatacccaatataatgcctcctaaatttcttatcatcaaatttgctaacagaagttttataccaattcccgcagcaacgcgcaggaaatcatctgtttaagtatggtgacctcatggtcaccgtcaccgaggcaacgtatggtgacctcatggtcaccgtcaccgaggcaacgggtagacgggttca

SEQ ID NO: 67299 - DNA, 899 bp, Oryza sativa
ccaccaggagtactaccagatggcggcggcggcggcggtggcgtggccaaggagccggacagcccgcaactgagcatcatgagcggctgcagctccctcttctccatctccaccctgaaggacgacgacgacggcggcggcgtccgcctcgccggcgccgcgctgcccgccacgccggtgtcgctcgccgggatcgccggcggcgccagtacccccggcggcgacgaggtggacatggaggtgcggcagcagagcggcggcagcggcgacgaccggaggaccatccggatgatgaggaaccgggagtccgcgcttcgctccagggcgcgcaagagggtacgtacgtatatacaataccaaatacgtataattatacgtatcatactacagtatttatgtacgtatgtgtttataacgtacggtatgaattactactgatcatcaacaaatgttctcatatgtactctctccgatcaatattacttgtgctttccgacaaagcaattccgttctattaaacgcaggccaatttaattgtctgaaacggccggcatgtacttaattatgtccggagggagtaattaacatggaaatttctcttttcaaaaactgaatataattagaatttaattaaaactggatctttcacaaaaataaaatgctgctaataagtcgatcacttataaggtcattgttggaatgcgataatttaattattaggttttcaatagaagtttgtagcaggcgaaattatataatttgcacattgaattatcagtaaattgcagtcacgtcgttattcatcgttaagtttttgagctgagctgaactggttagtttacacaactgaatatatatgagcaaatttcattacatttcataaaggagttagtctatat

SEQ ID NO: 67300 - DNA, 719 bp, Oryza sativa
aacgaagtcactataagcgtgactaaaagcacaaagccgttaaatcctggaaaattcactctcacgggaagtcgaacccaggacctaagatgctactgagactcttgtaaccaatagactatagattataaatcacaaaacttattaacaacttaaaataatattttacaggtaaatttttatatatagcgagttaatatatagaaaaaaaccataatgaaaacatcaaaactaacaacaaaataaattttaaattttaagttttaggtgagattaataaactaacaacaacataattagcagtcattgcctcatcggtcacggttaggtatgtattcaggtcaggtcaggtcaggtgtgagctcagcaggtgtaaaaactggactactccgtagacagtaaacaatcgggtgaaagagaaaggggaaacacagaaattttggcagctcactcgcttgcttcttccgtcagccatggcggccatgaccacgcatttcgtgtacggaccagtattttatttgtgtggctaatggtctggtttatttctcatggtacctggcagaaacgcgctaactccaaacaggagtcaggtttcgattgtgattgtttcttgcctaattaaaacacttgactttcactcgctgttaattacacccctccgtccaagaacatttaatttctggttacgtacttagacaaggcgaaaataagttatttta

SEQ ID NO: 67301 - DNA, 3740 bp, Oryza sativa
gtcggcccatttggttggagggagtttttagtagggattgggagtttagagggatggggctattaagtgtcttgtttggttgggagacataagaattttggtgagatggagatgaggaattgaggaaggaactcctccttttcaatagctgggtaggggcaggtaattgggaggaaattcctcctttactttgtctaagcaaatctcgaccatccgtttttattaatgatctaatctccaactaaactccttatcaatttccatcacctctaccaaacaagatattgggattaaaaatcaaattcccatcttaatctcatcatcaattccctcgtgtaaacaagccgagtgtgttagaggttagtgaaacagaaaataaagagtcagcgggttagtgagttagtgcaacagaacaacaaagggttagatgttaggggttagacgtccaaaagttagtcgttctcaggtcattcaatggcgcggcggccttcctgtcctcttgctcaactgaggcccagccggagccggctgtggcggagcaagcggagaggtggcaggcagcttgtgcgcgagatggaggagtggcaatggcagagctcgagttgggagaagggagaagaaatggagaggagccgagctgctgctgtctttggtagggtttatatagctttgctggctgcctgagcatgggaggcaatgtgagggtgggcagggagcagtgccgaaacgtcgacatcgccacagtaccaggtacgcatggcccattgtacttggctttgccacttttcggtgtgaacttggtgttgctcttctcagtgaacttggttctgtggtggcatgtatttagtggagggttttgtggattgggttcatggtgaatgtgttgctgctgttgtggagggacccctgtcatttggtagctgcaaaagtaggttcaattcactgtggtggcttgtggtcaattgatcgaacacgttctgtgcatgcaggtgttcggctgagggaataggacagcaatacatgcatgtttttttcggtgaactcggtttatcatcttagtgtggatttgtgtctcctgtgttgttggtgctttggggagggtcctgtgaattgggatcatgggtgcatgggatgttgtttgggagggaccctggtatttattagctactgttgtgagccggcaaaggtgggtgcaaagtgctgtagtgtcttgtgggcttatgtagagcacctcctgtgcatgtctgttggttgttttgggcagggcaggcaaagcagactttgggtggttgactgagcaagcgcacaggggtgggctgtcagtcggctgggggaggaataatggacttgtgtggtgaaatgggctgtgctagcagagggggagatggcccaagtgtaataggagcttttgtattttgtagggattcgaaaggaatggcgtctgtatttgagctggcacacatcagtgtatttgtaatgggactgtaatttgaacatttattttggctctgtactcagactgtatatatggaactgtacaattggactggacttggatcggtattagaaatagaatatgcacaaggattggattattgaactgcaatacgagatttggtttgcttggatgatacaccgcatcttcgaacagggaattagggatacgcccgataaacaattccatcggcagtcttaggatttcgtcgtgagcgctttgcacgaacgggcgacggaaacaaaacagtgatttttgggacgacgcatggcatacaaatctaatcgtcgcggtaggaatagaattgaatatatttgaattgacacacaataaataaatacgccgatcaattgtagacattcgaaggatttattgagttgaattaatagaacggtttgaaataaccggagggtaagaattgagaaagatatatcgtgctgcgacataagggaagattttcaggttaaatattctgtgatttggtagcacttaataaatcagaccgtgaagataagggaaagaaaggacgttggactgagggcgtccctttaggagatatgatttaatcgagatctttagcacacaacctaaatacacacaaatgcataataaatcccagcatgcaaaaaggttttaaaaagatttttgattattctgagtttttaattccgtatttcagaatcgaaattttcgggatgttacaaccttcttcgccagccgcgttttgggaagaaaagagaagaaagaggaggatagctgtcatgtgggctcccacgtattttttttgttatctttatttgctgagtaggatgtcaaatcaacgaaactggacatatatgttagagtatatggtagttagagtcatattaggatatgattgatttgtgtagactccttccatatctgtaattcttccttatctcctctccatgtactcttatatataccagccccctgaggctcaatacagtcaatccacgattcgcaatatcctctctccctatactatccaacatggtatcagagcttcggcttccacttcgtcgttctaccccgcgcatcatcggcttgatcacccgttcaaacggccggctacgacgacaccttgctgctaatcatcttcgactacgcgtctacgccatcaagcttcgggctgccgctgcgtcgcccccctcgggccgcagttccgctgcctgtggtccacacctccactggttgttgcagtgctgacaggcgccctccttagcatggctacatcaccggtggacttctcgccgctgcatcgacatggaactgcagttgtgttgtcttctcgaaccacaactttgccgctttcgtcgttttcatcgtcgttagcgcttcgacaccctcgtcgtccgcattggtcatcgtcagccactcggatcttctttgtctacttcgagcatcgccgccgcgtctccaagttgccaccgtcgccgctctaggccggtagtccagctacctctacatggctactgacgttgccgtccaggccgttggttccgctacttcgccttctttttcgtccatcatgattcatcgccagtgtcgccgtatcttcctcgactacactttgctcttctccgacaactacgtgctgctccggcaattctccctctacgtcgttctcgcgttgcgaccgtccagaggtcttctctgctagtctccttcaacattcggcttatgattcatggtggtcccctgcctcgcccacgcggtattggaaacactggcgtgcgcgttcgtcctgagttgtcccggggtctggcaaaccctgtgtgacgtctcgtccttcacggttcgactacattggcttttcggcgtcatcttcctcaacgattgccgtgattgtgtcaccgtcttcgtctccagtgcatcctcacgcaccttggtccatgacgcccctcccatgtgtccatgaccactctacggcgccctatgcgcgtcctgcggctcggctacctcgacatcagcttcctgacttcggctacaacgaccacggctactctacacacggcttcatcgactacggctcccttgcacccttcgctttggctacattgactacggcacacagggctatcatccgtattgagtactcttgccggtttcttctccagtccaagtgtccacgctgctcacgcttggactgtgggggatgttagagtcatattaggatatgattgatttgtgtagactcctatatctgtaatccttccttatc

SEQ ID NO: 67302 - DNA, 3654 bp, Oryza sativa
  unsure (1)..(3654): unsure at all n locations
cttcaccggcgcaatcccggacagctatggcgacctcgccgcgctcgagtaccttggactcaacggcaacacgctctccggccatgtccccgtctccctctcccgcctcacccgcctccgcgagatgtacatcggatactacaaccagtacgacggcggcgtcccgccggagttcggcgacctcggcgcgctcctccgcctcgacatgagcagctgcaacctcaccggccccgtcccgccggagctcggccgactccagcgcctcgacacgctcttcctgcagtggaaccgcctctccggcgagataccgccgcagctcggcgatctcagcagcctcgcgtcgctcgacctctccgtcaacgacctcgccggcgagatccctcccagcctcgccaacctctccaacctcaagctcctcaacctcttccggaaccacctccgcggcagcataccggacttcgtcgccggcttcgcgcagctcgaggtgctgcagctgtgggacaacaacctcaccggcaacatccccgccgggctcgggaagaacggccgcctcaagacgctcgacctggccaccaaccacctcaccggccccatcccggcggacctctgcgccggccggcggctggagatgctcgtgctcatggagaacggcctgttcggccccatcccggactcgctcggcgactgcaagacgctcacgcgcgtccgcctcgccaagaacttcttgaccggcccggttcccgccgggctcttcaacctcccgcaggccaacatggtggagctcaccgacaacctgctcaccggcgagctcccggacgtgatcggcggcgacaagatcggcatgctgctgctggggaacaatgggatcggtggccgcatccctccggccatcggcaacctcccggcgctgcagacgctgtcgctggagtccaacaacttctccggagcgctgccaccggagatcggcaatctcaagaacctgtccaggctcaacgtcagcggcaacgcgctcaccggcgccattccagacgagctcatccgntgcgcctccctcgccgccgtcgacctcagccgtaacggcttctccggcgagataccggagagcatcacgtcgctcaagatactgtgcacgctgaacgtgtccaggaacaggctcaccggcgagctcccgccggagatgtccaacatgacgagcctcacgacgctcgacgtgtcgtacaacagcctctcgggccccgtgccgatgcaggggcagttcttggtgttcaacgagagctcgttcgtcggcaacccggggctgtgcggcggccccgtggccgacgcgtgccctccgtccatggccggcggcggcggcggcgcggggtcccagctgcggctgcggtgggactcgaagaagatgctggtggcgctggtggcggcgttccggcggtggcggtggcgttcctgggcgcgaggaaggggtgctcggcgtggcggtcggcggcgcggcggcggtcgggggcgtggaagatgacggcgttccagaagctggagttctcggcggaggacgtggtggagtgcgtgaaggaggacaacatcatcgggaagggcggcgcggggatcgtgtaccacggcgtgacgcgcggggcggagctggcgatcaagcggttggtggggcgcggcggcggcgagcacgaccgggggttctcggcggaggtgacacgctggggaggatcaggcaccggaactcgtgaggctgctggggttcgtgtcgaacagggagacgaacctgctgctgtacgagtacatgccgaatgggtcgctgggggagatgctccatggcgggaagggggggcacctcgggtgggaggcgagggcgcgggtggggcggaggcggcgtgcggcctctgctacctccaccatgactgcgccccgaggatcatccaccgcgacgtcaagtccaacaacatcctcctcgactccgccttcgaggcgcacgtcgccgacttcggcctcgccaagttcctcggcggcgccacctccgagtgcatgtccgccattgctggctcctacggctacatcgcgccaggtaaccacccaaaataatttctccatattatttttagcctatttcttattactattctttttcaatgcgaaccactacagtactgtagtactaaatttaccgaaatgaatctgtttgaaaaatattgaattccaagacccaacaagtttatcctgatccatgtgttgaaagaacaaactttttttttctgatccatgtgttgaatgaacaaaccttttctgtttaaccatgacaaggaacaaactttatatctggaccatgacaaagaacaaacttttaatgtgcttaaaataaataatggttctaactataactaatataattgaaatgatctgatacgattatacgaagtgtcattgaaaaattgtaaactttacgtagaggcaataatagagggggcccctgcatggagatgcagccacgttccatccactggaactgcactagtactgtactgcagcttgtgctttcctctgagcacaatccttgttgccttgtgcacggtcaactggggagaggacaaatgttacctttgggccaaagtgtgaacttttttttttctgcagacagcaaacaaaagttacagctacagttcttgccgttgcatggctgtagcagtgattgtgattaatggtcagttcagttttctgctctgtttctttggattctacagaagcagatcttgcagccatatgtatggtcaatggcaggcaaggcaatttggctacctttggattaatggatagtctcctgcctttggagtactagcattcatattgtgtcgtcttgttgcctcgtgtgtggcacactggcactctcttggataattggaggagatactgttctactgtagctgtatcacgttcgtatcttggctgtatctccatggtagatctgctccttattgacttgtcagtccactcttaaatggtgttgttggtgaagtacgtagcttcaggataacctgtctttcaaacgattcgagtgtgatgcactaccctgaaaaatgaaaattctgtctagtggctgtggttacattcagttatgcaaatgtgcagctctaatggctgtagttacattcagttatgcgcgttgggaaaggatcggtacactaatatctttttgattgataatctaaaaatggtatgttaggtatcatctaactgattcatcaatcctatgtactatttgtgtttgcagagtacgcatacacgctgcgagtggacgagaagagcgacgtgtatagcttcggtgtggtgctattggagctcatcaccggacgccgccccgtgggcgggttcggtgacggcgtggacatcgtgcactgggtccgcaaggtgaccgccgagctgccggacaactccgacacggcggccgtcctcgccgtggccgaccgccgcctgacgccggagccggtggcgctgatggtgaacctgtacaaggtggccatggcgtgcgtggaggaggcgagcacggcccggcccaccatgcgcgaggtcgtccacatgctctccaacccaaactcggcccagcccaatagtggtgacctcctcgtcaccttctgaaccccaaacttaacggtattg

SEQ ID NO: 67303 - DNA, 1625 bp, Oryza sativa
atcatattttacaaagcagtcggtatatcactcggatcatgttattcagggattcatactgcatatgctatatattaatattaagtcacttgtttgactacgattatcaaaaccactcagttggtgcatctattaggtacatctactcgatgcacctgactttatttttcagccctccacagtcttcatatttggtaaaagtactcgggagatcatggcgaggatgattgaagcactcggctttggagtaatctagttcgagagaagattatctttccgactgtgaaggtctcaggggctactgtggagattatgggtaccccatacccacacggcatggttatccgactagtcataggggatagcttatatctatggaatatttaaccgatcatgacttgggtattacgtttccttttatattatgaagcagcctaaagtcctgatttgataatattgtaaaatagatttaggaaaccgataccgtattggttaaggtttctatcttgtaatcctgccccccatcctatataaggtggacaggaggccctctagggggcatgacacaaactgatcgtcagatcaatatacacccggcgaattcaaatccccaaacaggagtagggtattacctctcatcgagagggcctgaacctgtctaaatcctttgtctccgcatccatccacttttaggtctcgtatgctacccccttttcatattgccgaaaatttgtttcgacaatgagcttatccagcaacccatgatgggctgtgttgtcgacgacatggaaatcatgcaagttagctgtgcagtcagggcgccagtcctcccatgaagtgaccgggataggcatggtccatgtagtgagcctccactggccaggccgccggacggaggagcgctgccgtgtcgtcggctgaggctgaggttctctgctccggcgaacccattcgaggaacgaatcaggaggatcatctgcaggcatggtgcgatcaccggaggatattatggttttggtcacaactcttggcatggtgatttccatctcggcgtacttgatgaagtccttgtgttggctgacggtgatgtcccgatagaaggactcgctgtcactgaggtatcttgtccagttgcccttggccggccatggcagcggcatgtcgcggagctttgggggagacatttcgtcgagcaggtcgcagaggaggatgccacgccagagatcgacccagccgacggtgcccttcgcgcctccgagcgcgatggtcttggtggtgatgtggtacacgggcctctcagctgagtcagggatcgggcacaccctgtccctcaccgcctcctccacaaacacctcctcgcacgtccaatttccggcgatctcatcaccatcgccaccaccagaagaagatttgtaccggtgcagcgcgaattgactgggcaggttgatcatctcgagggcggcaacgacgtactgctgcttgtcgccgcagatgctaacgatggcgaaatcgtcgtcgcgtaagcaatattgctggcacggcctggggagcagatctagcctggcgggttgatggtgatggtagacgaagtagtcgtcctgacggaagagactcttgccgccggg

SEQ ID NO: 67304 - DNA, 2917 bp, Oryza sativa
aatatcatctcatgtgtgtggctggatcaataacgattaagacggacggaaaaattgatggaagtgctaaaaatgggaacaaggtgaactttggatgctattaaagtgaaccggtaactttcggtgctataaaaccaaaaacgtgaactttcgatgctatataaccaacttagcctttttttaaatgttgcacgatgttccaccaggtatatcgaaattgtctcactaagtacatcgaaaatgtttcactcgtttaaatcgggtgttgtttcaccttatataaaaacaatgtttcagcaaatagcgaaagaatgttttagtttactgcaacatttgatccatacatagtgaaacattataagtacactaggtgaaacatttttcgatggaacaaaaaataaaacgaattcccttaatagggggtttccaaaatatgtgggtttttttgttgcaatggaatatctcagtttactgcaacattagatctatacatagtgaaacattgtgagtgcactaggttaaatatttttggtggaaaaaaataaaccaaattttcttaatagagagtttccaaaatatatggttaatttgttgcaggggcaggcactgtggtgggccagacacatggtgggccagcggcatgcaggcgcatggccgcgcgcggggagcggggccggggggagcacccgattttgctcccccgtccagtcacccagatagcagcatttccccggtatttttataaaggaaaaatataatactggaattgatcatgcgtaaataatatgtctcgtttttttcctcagactgatttgtctgtctacacggtatgatgtgttggatggattgaactttcaagtttaggccgtgttcagttagttggccaattttttttatgtatactgacacatatttgaagtattaaacgtagattaatgacaaaacaaattatagattccgcctgtaaactgcgatacaaatttattaagcttgattaatctgccattagtaaatgtttactatagcaccacattgtcaaatcaggacacaattaggctcaaaatatttgtctcgcaatttacatacaaactgtatagttggtttttttcgtccacatttaatgatccatgcatgtgtctaaatatttgatgcgatgttttttgccaaatttttttaaaatctaaacacagccttgttgttgttttggaattcaaattcgtatgattagcgagcctcatgttgatttgggagtagtagaacagctttcacctggcactccgtacaaccgctcatcctagccgaacgtgtatgacctcgaatgctttcgacaaggacaatcattaaccatgtttgtttcagggccctggcaaatggatcacaacgatttcacatcacttcgtaaaccgtttactccgtcctaaaaaatccaacctaatactctatccgtctcagaatatagtaacctaggagcggatgacgtatcctctctccgtctcagaatatactaacctaggagcggatgacgtatcctagtactggatacgatacaacctaattctataaatttctattcagatttgtttcgttgtgttagaatatgtcatatttcttcattattttttttacgaagagagtagtagatctcacatctcggtagtctattcaaatcaaccttggccgccgtcctatccacggcgagccccacggcccccaaacccgccggccgccggtgggccaccgctccccccacaacaattaattactaactcctcattactaaatgatctctttattaatcccttgtacacctgtaaccactccacagtccaccccaacccagcgtaacgtccactcatcgcgagccgctcaatccaaatccaacggcatcccgcaacccacgtgtccctcaccgcgcgcgagtttgaatttcccaacggctctctcgaccgttgctgccacgctcctgaaaaaaaccaaaaaaaaaaataaaaaaaacacgcatctgtttttattctctcccatctctcccgatctctcgcccatttgcctctgatcccgaaacaaacagttggcggcggcggcggcgcgaggcgatggcggcgacggcgttcacggaggaggagaaggcggtggatgactcgctcggctaccccaaggcctacgcgcgcctctgccgcggcggcggcggtggcggcggtggactcccgtacggccacggcccgccgcacggcttcctcccctacgtcctccacccgcacgaggtaatgggtgctcgtcgaggtgatggtcgcggctgctggtgcggtggtgagctgattggggtggttgtgttgggtggtggtgcaggcgatgcgggcgaaggatctgaacgagatgttcccggtggccgacgcggaggcggcgccgacggcgaacccgcgggggttcgcgaacctgctgtggaagcagctcgaccacctcggcaacgccgggttcgacccggcgctgttccgcgtcgacgcctacggcaacgtgctctacctccacgccgactccgcctcgcctctcgcgtgggacatcgaccactggttcccctgcgcccgtaagaaacgcagatcgaacgaactcatcccaacatccgcttccacatcattccttcgatctctaacgagattgttttttttgtatttgctcgcaggaggtgggaggacggtgccgagcaacctgaggatcgtgcaggcgcaggtgtgcaggaagaagcacaacaagctggagttcctcgtcccgtggtgggatctgcagctcggcatctccgtcaaccagttcctctccatcttcgcctccaagaacgccgacttcaggttcgcccatccgcatcgaacagcttaatgtgtctctgcgggtttttttttaccgatgcatcatggatcgaatcctt

SEQ ID NO: 67305 - DNA, 1076 bp, Oryza sativa
cggaggagatccatggccgcgggcggcgccgggcggcggcggaggaggaggagcgcggcggcggctagggttttgggggtggagacggcgaggcgacgaggtggggggagggtggaagaggggaggagtgattagattagagatggaagaagaggggttaagttggtattggtaggggcaggagacttgtacgggaggcgatttaaacacgggggttagtttggcttttgccggcgcatttattgtcttgtttttagattttctttcagaaaaggcacaaatactacccctctgtcccataatataaaggattttaagattttacttgcactgtttaaccactcatcttattcaaaaaattttagaactattatttatttttttgatttacattattatccaaagtactttaagcacaacttttcgttttttatatttacataaatttttttaataaaacgagtggtcaaacactacgagcaaaaactcaaaattccttatattataggacggagggagtacttctttgtttgatattatattttgtttttttctaatcaagtttcattaagtttgattaagtttataaagaaaaccaaattagtttcactaaaactaatatttaatatattatgataatatatttgttttgttttgaaaatgttgctatatttttttataaacttgatcaaactcaaaaaggattggctataaaatatcaacacggcttataatagtaaccagggataaatatgtgaaacaaaatgatacatccatctatccctaatgattttttttcccaattacaccggggacttttttttttgcaaagtctgtgttcttccccagtatacccaactcacctctcccgttctccacgcgcacgcttttcaaactgctaaacagtgtattttaaaaaaaattatataagaaagctgttttaaaaaatcatattaatcatttttaaaaaaaagttaatacttaattaatcatacaataatacgtatttttcgttttgcctgttgaggatgaagggttcacaacccctcctgcccgaatacaaactaagaacagtt

SEQ ID NO: 67306 - DNA, 2965 bp, Oryza sativa
atgataaataagcatcgatccgaaggttaaagcacacatcggctggaggtccgatgtcatgaaatctacaagattagattaaacagtgaaacctttgttgtcatcggcgaaatccaacttatatgtatgtgtaatccttatgagccgatgcaacgtccagataactcaccggctgaaaccccgatgaaacccttattggcaatcaagaagcaggctagagattatggttctaagcacgacttagtagatcaaacttaaccgatgcagcactaagtatgaaaagaaacataatatctagatttttaggatggtaaatgtctgagctaatctaatctagcaacgcgatttagctgatatcggcagaaaccctaaaacgagaagcagccgatagagctaaattgatatgctaggactagattaatagagacatatgataaataggtaggcaaatatatcatccaaactagagcaatccaagaggtcgaatgtgctgatgcagccttgaatgacgccgatgtagatgagacaattgcctgggccgacggaacattggacttatcccttcgtcggagatcgaagacgatgcagccccgcgtcgggtgccaagttccgccggaacataaaaaacaaaagtagaagtaaaaagggtagcgatgcaccaaattgtattgatcgtagagatagattacatagaccccgggtgtacatatttatacccatgggttgatacaagtccttgtcggataagaaagaaactaacctaaagataaaaggaaaatataaagtccttatcggacactaaacacactttcctaaagataaaaggaaactaacaaactattcttaattaatagataaactgccatgccgcatcctttttaaactcgttcaattagggataagcttcctttagtagattgatttccttaaccgaatatagcaggaatccgactattggcgacttgataactcccatcggctgattccgagatgctgcagccgataatgattctaagccgatgacgtctttgccgattaccaaatttcactgttaacaccctttgaatcacagggtagaaaaaacagaggaataggaaaaacacaggattctgacaggaattaaaatgtaaaacaaaggattgcaaaacacataaaaaaacaggaatggtcgtttgattggagcgcagtaaaaacgcaggaatcggatgagagagatagactcaaaagaatttttccaagaggttggagctcttgctaaatttcctccaaaatccacatgcaatgtgccattccataggaatttcataggatttggaaagcttcaatcctttgaatcaaataaccaaataggaaaattttctatataatttaaatcctataaaattcctatataaattctttgatttaaagcggtcctaagtaagggtggggaggttgctagctccatgtcgaacagaaagaagcaagagtctcgagtctcccactaggcgagggaaggagacacaggtggcacccctggtggccgcggaatgacggttgtgcccctggtggcgaggggtggcgtggggggcaggacggtaaatctgcagtggagggggaggcgactgggcggtgagctgatgagggaggggggcagactggtcgctgacacgtcgtcggcgagcgcattgaccgttcctcccctgccacccgccacgtggcccgtcgcctgtcacgatgtcacatgccccgccctactgtcctctcctgccctgccctaccggtacgtgctccgtctgtcccttaaaaaaattccatgatattttgagacaaatgaatactccctccgtatcaaatgtttgacattgttgactttttagcacatgtttaaccgttcatcttattcaaaagaatctgtgaaatatgtaaaactatgtgtgtacatgaaaatatatttaataatgaatcaaacgatgtgaaaagaataaataattacttaaattttttaaataagacgaatggtcaaacacgtactaaaaagtcaacggtgtcaaacattatgaaatggatggagtagtatttacgcttttaatcttaaaataaaccaagtcttgtatatgaaaataatactgatagatattatcttcgttccaaataggtactccctccgtactcatcaagatagtaacacagtctccaaaacacaactttgacttattgtttctataaaaatatttattgaaaaatgatatatgtatacttttatgaaagtatttttcaagacaaatctattcatatattttttacatttttaaactcaacaacttaagagttattcatgatttatatttctaaggtttgactcaaacattgtcctaaacgacttcctttacgagtacggagggaatatatgttagtgaccatgtcagagaaatcctttctatagaaaagaggggtaaaaaggtaagaatattatgctcgaattggatcaaacatctatatatatatatatatatatatatgcttggtttgtactcataatatactgtggacaaatattgtgaaatggggtagatttatttgacagggagaagtagttctttttcttggtttgtgctaacaaagtataaataagctgcggaaaatattgtgaaatggaggaagtaattaataagatagatattatgagttatatatgtgtgtgttttgtcataaaaaataatcaatatattggatataaacattaatttaaattttcattacaatactatttgatttttggcaactcattctccatctaattaatagtacaaaacttgtgtcgatatacattattgaacctaactaatatccctcgcatcctccatgctctaccccttcctttccccacttgcttcatcccttgcttcatctactccacttattacatcccctcgaaaatttggctccatcgagatattttattcttttatttatagtgaggttg

SEQ ID NO: 67307 - DNA, 4105 bp, Oryza sativa
ccttaatttatgctaaactaacaaaaaaaaacaattattttgggatgaagggagtataacctaacggagatcctctgcagggtagtgctactcactgggcacaagggtttatgccttatagatccacgtgtcagtgaacagtactgcagagaatcctctttcaatataaccttattctactaagataagcatattatactgctgatgttggtcatcggagatgatcagcaaacatttactaaagtttcaaagaaggaaaagaataataaagctttaatactactactacacatttggtcctggatgaatggggaaattagggcttatttgaattaaaggatttttatgatgaggaaaaaaatggaggaatccaattcaaaagaaattctcctactatatgagcagtttagtttggatcatacgattgtttcaaagggatttcaagggataggaaaagtctctccacatcttcgaggaattctagcatggggtctaacctcgttgtttcgaattcttttgtgatttttaaggcatgttctctcctcctctctctagcaaattaaacatgtaatctcaattttctctcacccgttcgatatatccaaacacttgtgtttgaatgattcctgtagtttgattgcttggaggatttttcatgtcgtgacatttcaatcctaagttttcctcttcctgtattttgagtcatgttccaaaggaacccttaaagtggacttataactttcatcaatacatatttggtaactcatggtaaggagattggaaatttagagtaataagctaatgaagggattgatcctgtaagtttcatttttaatctctgtcgtttgataggagatatgagaattatgatgaatttgagtgagaaatgaattttaagtgatgatatactaacttatttttttctctcagttacctgcctctacccaaatattgaaaagacgagagttcgctcttaaaactcctcacccctcaaacttccatcatcttcaaacattccccctccctcctaaccaaacactccctcagcgttctgaatgcaacgtgctattcaattaatcacagaatataactttgactgacttacaaacttagtaccagaaggggataagaagtgaaatccgagtagaaatagggagattcaaaatcacatataggaaagtaagaataaccaacaccttcactcttggataaacgttgtcacaaaatacgtaccgtcaaattttaaaaccttaaatggccaattaataaaaacatcaaagttttacacaatgatgaaatatgtctgttatacctattgatagtgagacatctacatgattttctttattaaagatatgttggtgcaatctctgaaggtgctctatgcacaagtgtacatataagtgcatgcatctgtcatgtgttaaaaaaaagctcagagatgatgagatatgttcattacattaccaaaacaaagcataacaatgaattaagtaccagataaatcttggcaattgggctcttgaaaacctggtgcacagtctcatcatctctactgttctacagaatcacctcccttatcttacctgcatgacaaatgcctcgagaaaaaaaatatagccacgatggcagtagcgaaatatcgtgcaaaaggaggggcagtttcgaccgaggagctacagtgagccgcaagtacgcttttttctgcaggctcatcaatccatgcacactcattattagccctagaactgtagcatcatttcacatttattttctttctctctctctcggccttaatcgcatataacgataattgatatggataattggattggattatatgcagctgtatcacaaattcacaatcccacaatctcattttcttttttactcggtgaaccactaaaacagtgtgaaatgggcagctgtttggcgttttcaagaaagaaaatattgttaaactgaccttttttgacagtcatcttcagttttttttttttgtttaagcccttcctctcctcactcacactgccctgttcatctctttcttttttattcgattcctctattccattccacacgcattgccgctggtagtagaagtatagtatctctccgcgaccgaagattttaaaaaggaagcaatttgcctcttttttttttttggcgcacctcgattagtagtagattttagaggcgaatgtgagcggtcaaatccttcttttttagcttgtgcgcgttgtgttttgtgctctccttttgtcagttcctgaggcgctctctcctgtgcctttgtgtttagcgtgcgtgaccgcgagcgaggtcgaggagtgagagggagtgaggcggcggcggcggcggccatggcgcagcagcagcagcagcagagtgcgtgggaagcggagaagatgtgagctttctcctatctctcttctgttcttcgttgcttcatcattccttagtttgttattgcgatcagattggtttgatgttcttcgcacattcttttttcccttttttttatgttggtgaaatgttctccgttttgtcttgagatttttttgtcattccatttggttctcttggtgtccgcatggttatctttccccaagattagtttcttgttttcctctgggaggggtttcggattcgtttcttggcggtttagatcgtctttttttctggtgatttttgcaagaatcttgtccttcatcttcccttgttgttgtatttcagagggctgcagacgcttgagattctgtttgagttccctgaaatttctgcattttccgttctgcattttggtttctccttttgcaaaagccatgcctcttttttttttcttgttcctcttgttccttttatttttctcggatacagtactagtttggtttattgcttgctagcttttcaactgccttttccttttaccttgcattgcaactgccttttcatttctcgaaatttatttgctctttcacactttaatctgcattttacctttttattttctcatgaaaactttcgatcccctccttcctgttgctgctgtgcttgcatgcaaacccccatgtttccttttttacttattatatatccccgcactgaacttatccatgtctgttcttggaagcaggttggacgtgtacatccatgattatcttttgaagaggaacctgcagagcactgccaaggcattccaagcagaaggcagcgtgtcttccgatcctgttggtcagtgcatcaatttctgaattttgtcatactactgtagtttgcaatctttgctctttctgcattaggaccagatagtttgttcctcagactgccattgttcttgggccaataggatggttacaaattgatcatttgattagcttgattagtactacacttacatttgtgcatgtgcgagacacgagtattattagctactcgtaccgggcagatacaaaggaacaatactacagccacattgttttgtctgatttatgcatgccagtctctgatgtttctgcattgtaatgaatgcgattttaatcttcttgtactgaaagatgtcagcttttgttttgcaaaaaaagcaattgatgccccagggggtttcctcttggagtggtggtctgtcttctgggacatcttcattgcaaggacgaacgagaagcactctgatgttgctgcttcgtacattgaggttcttgtagcacatgcatcttggttattacttgtccttgttgtttgcttgcactcacttggtacagtggtttactgcttatcttacaataaacatgtgtaaatgcttgaattgtgtcagtcatagagatcatgttcactgtaaaaggatttagttttttgcctaaagcaaatggatttaaattccacacaaacattgaaaaccaaattcaagaactttccatgtcactcttgaaaaaaaagaagaaaatgcctaattcatctatgtaggaaaaacttgttatggtggatatttttttttaaaaaaaaaatcaaatgtttccccatatttccaaacaaaacatgctgcatcatatcacacaattatagaagaacatgtgtcttaatcattttagaaggtacagaatgcaaa

SEQ ID NO: 67308 - DNA, 1934 bp, Oryza sativa
tgcaataacagctcaggcttcagggtaccaactgctcaataatgcttgctaatcatttacttctcttttttttttttttgggggggggggggagtgtggggtggggatgggaggtttggagcgcaaaataaataccatatcagtcttaaatacagcctataatgtgtgatctaataggatttcctaccatgcttgaattgtgtttaccgcctttgtttttacctaactattttgcggtcttcaaattgcaactttgaccattaattcttattgtacactaaaatgtgctaataaaaactattatattactttcatattattcacaataaatctatccagcatgtagtagctgtttgactaaatttccgtaatcaatgctatcttgatggttcatactgtaatggctgtttaacggcaattatctctagcttctgttttcctgttagcgtgtgtgtattgatttgctttgatcaattgtttttaggcaaattttccatggatcaactggtggcgtgtcaggtactttgcaacaggttcaggcccggaaccaacaactccaggcatcaacacaggtagtcttatttcagatgtataatctcatgcattattgtctataactagacgagtcaaatttgtttcaggaaataaaggtagacacaaatgctgctgtacacatgagagctgcaggggcagatggatcattaattggagtaccaggtttttttgctttgaactctactaatttttgttgtttctggctgctaactggaaattcttagacctgctgtactgtttattcatgtacttagtgccattgtttgataccctgttgtctggcaggcgctaacccagcagggaacaatttgacgttgaaagggtggcctcttactgtgagttcttcacatcattccttaactggcattctaagctataaattaggagcaagtttgaatacagcaccttctttttttttttgtttttatgatgttttaccatttgattataacttttcagggcttagaccagcttagatctgggtttctccaacagaaatcttttatgcagtctccccaaccattgcaccatctacaatttctcactccacaacaacagcagcttctgcttcaagcacaacaaaatatgacatcttcacctggagagatggacagcagaaggcttcggatgcttttgagtagccgaaacattgttcctgggagggatggtcaatcaaatgcctacacggaagttattcctagtgttggcccttcattgcaaaatatgtgctcacctgtgcagcgcatggagacagatatgctgatgaaggtaagtttcacttgtatgttttactatattcatgcatttatttatttgcgaggatacattggatgtaagtaatagtaccttgtaaaccaccgggttatgcataattttgttctcaattgatatcttatatgtacatagattatattgtttaattcttgtcagtgatcagtaatagaatttcatttaaatttatcatgcttgttcttgttatgttatgttgccaagtttgcataacacagtaccatttactttctactatagcatagtgattaaatcatgaaaatatcggtcttggtccttgtgtaatataatcttttgaacagaggaactcatactatttggatttcataatgatctagctgctattaatacatgctcacatgttttctgaagctacctttttcaagataacttctacatctttggttttcgaccttaacacctcgtcattatatgtagtagaagatagcagctatacagcagcaccagcaaagcagcaatcagcaacagctccttcagcattctttacttagccagcaaccaccaatctctaatcaccttccaggccagcaggaaaaaatgggagctggaagtgttactattgatggaag

SEQ ID NO: 67309 - DNA, 2399 bp, Oryza sativa
ctggtctcaaaaggagatgccttgtaggatacactgtttcttgatttatttgtttccaatccctttgtagggaggatcaagccagctgagatttcaaccacgtcatgggggatatcttgcagtagcttcggagaatgctgtctctatacttgatgtggagactcaagcttgccttaggagatttgaggtttgtagagactttctaccttgcagttggcacgtgcattctgatcttctaaattcactgaggttccagtaacatatataccgaccaacaaatctatgtgcaaggatgtatttacttttcaaatctcgtttttagagtgagttttggatactgcaaatctatctatttattttgtaattagctttgtggtgttcatttcccttgatggttagttgtccttgcttggttgtttacatattttcaaagtcgcatcgtgctagctgtagccagtgttcacttccatgttaatctttagagtttccgagtgatggtaaccaatcactttaatctgtcctctttattgggaactgcagggccacacaaagcatgtcgattcagtatgctgggatcccagtggcgaatatgttgtatctgtcagtgaagacacggtgaaggtgtggtctgtgaatgctgggagcgatgatcgctgcgtgcaagagcttagctgtaccgggagcaagtttcactcgtgtgctttccacccttcatattcatctatgcttatcattggttgttaccaggcaagtactttatattcgtggatctcttttatgctcatgcgtcacgattcattcaaaactaatctgcactgatcatcctaattcctaagtagctggttaaaaatgactttttctagatcaactcatgactactcactcacactgaggatcattccacaacttgaatttcagtacatcattacacatatatcaagttcctcaaatattccttcatgatacacatgcaattattttgaagatttactgcaatgaaatacttttcctatttaagaacaagcattcggccatagagaccacttatgttttcaccgcggttcatgtttacaatgcctgtagtacgcttacctctggttttgtgtttgaatgccgcagtctcttgagctgtgggacatgtcggagaacagaacgatgacgctcgcagctcatgacagcctcatcacagccctggcgtcgtcaagctccggtttggtcgcttccacgagccacgacaagttcgtcaagctgtggaaatgatgtgctttcaagctagccgcgccctctaaccctcttctaaggatgggcctttttcttcctcattttttggtcacaccatcagctctgaagagctattgtgtgatgatggtataaacactctatatggtataatatcccccacaaagtagctggctactgaatgactgatgaaaatattgctatcctagtataccttttgctgaccctgggaaagtagcattttgtacagaacatgaactatgctttagtattaatcatagtctatctgaactactgaagtgtttatggtctgaattctaagaagttattctgctgcatctctgctatgaatatgaagaatgtgatgaatgtggcattctcgtaggaatttcaagggactttttttgtaagaagtatgctcaattccagcaagaaattggaaattttcttactgaattttacaaacgtggtttcgtcacggatgcttggtgtctggggaaagcaatgaatcggcatctctggcctgcaataaacgaatgtatttgccctgtttgcatgttcagtctttgcacggctcttagattccccagcctgtccaaaaatacccatgacacggtttgatcgatcgattgcaacacaaatctgtgaacagatcattggttcctgatcagagatgttcagttacttctctgaacattgatttttcttcttatcagatagggaatgtgcatctttctctctgatcttcagtttggaagaacactgcatcctgtagggctttcacaatgatagctacacctacatgggaatttttgagaagagtcatatgcatcttcatcagaatgatcagaggtaaatacaatgcttagttgttgcaaccatcatcacaggtttaacaggttctcagattctgttttgtttagtttaccacttgactttataggtttataacctggagaaaaatgtatttctcgttcataaagtgaggaggataaaatgccgtccgagtagatggaaaatactggtttagtaatccaaaataatctagaggttctaaccgtttctaaaacaggctgggtggaatgtcatctaatccaactttacagaactttttatcggttttgagtagcggaaatgcctatccgtataattatcaggag

SEQ ID NO: 67310 - DNA, 998 bp, Oryza sativa
ttggtgaattgtttgttatgtgatatctgtatgctagttatttgtaattagaatagttgcctatgtcctggatttagatctatatagttgtattttctctgttctgtattcccatgatggcaaatagatgaatgcgttgaccatctttactaatccgggttttctacaatttataggagtggagggaggtttcactgatcaagaacccgaatacgatgaggcttttgaaattgttatcttgcctgaatttacttctctcccttttccatcaattgacttgccagagaaggtaactgtgcttgacataagagattgtacttacttactacatagtagttacttactactctacaactccacaggttaggattgcagttgacaaagttatacttgccgaaagtgctgatcgaaaacaacaattggcttcttgggttgctgacaagaaaaaagtcagtgcacatgctatggatctgaagcagctagacaatggtgtcattgtgccacctacaggatggaagtgcagcaagtgtgataaaactgagaatctctggttaaatttaactgatggcatgatcctatgtgggaggcggctttgggatggaagtggggggaataatcatgctattgaacactacgaacagactaaatatcctcttgcggtaaagcttggaacaattactgctgatttagaagcagcaggtaatgctactcgtggaccttttacatatttaggcttcctcttctattatcgaatacaacttacggtgacattgggttgtcgcctgtgaaaaattgaactaaaccccttttaacctctcacaaactgtatcctttgtaatatctaaattaaaagtgtcatatatatgatgctcaacttggaatgcacttttagaatactatactccctctagttttaaatatacaaaacggtggaccttttaaattcgtttgactatttgtcttctctagaaatatttgtgcaaataaacaaacatata

SEQ ID NO: 67311 - DNA, 1541 bp, Oryza sativa
gctatcaaacatggtgtaaacatggaatcctacccacatgtttggaagtttaatactattgtggatttcaactcagccaatattcactgattggatgcacaaattctttaacttctattccttcaattctatgcaattttaaccactggtcactttcaatatgaatcgagaccctgtctggaataatggaattactcacgatatagttcaatcctatggaatctgaaaatgtttggcgttcctaacagggcccaaggtcgggagtaccatatacttactatacctgctaagttttctgatacataatgtgatcagcagatctcattttgatcctattctcattttttgatacttacagcctgaatagtacttttggacacacttttgaatactcctaatttttatgttccatattgatagggacaagaaggaatacaccctcgtatgtttaagacagttattgctgcaaagcatcccgaattttccagtatgaggcaacaggtactttggacctggaatcacacatttttggttgaggagctacttatttgaattttcctttgcatcattaactgcaattttgggtacaattttttccaaatagtcattttaactcatctctttgtccaggatgcgcttgatttcttccttcatcttattgaccaagttgatcaggcaaacaccggaaaccatgagctgaatccttttacagggttcaaattcttcattgaggagcgtcttcaatgcccttctggaaaagtctcctataacaaacgttctgactacattctttctttgaacataccgttacatgaagctactaacaaaggtgactttaaaacctttttccctgttgtattataaagttagtgcatatatccttgacacctgtgagatatgcagagcagctagaagcatttcatgagaagaaagctgcaatggatttggatggaaaggaagtgtaagttgttcatagctcatgcactgtctaatgagcacgacttatgtttcactttgcttccataaaacaggtctaatgaggaaattgtgaggcctagagtcccactggaggcatgcttagcaagtttttcaggcgcggaggaagtgcctgaattttacagcactgcattgaattcaaagacaacagcaattaagtatgcatatcttcattgccatttggttctattatatacatggaaatgtggtacagccttattgattgaataagaaatatttcaaaatgcaagcaaactcatatctgtggcatgttcagtttgtaaaagactgaatctctcaaacttgccttatatgtaacttggctagctgtaattcaactcaatatagcagatgaaatgtaatgcctgagcaattcaacattaacacattactgtgactgggtgtactgctataatttagtcgtactatcttaagaccattaccgagacacttaatagggaacttccagtccttgtttttttaatttctcagtgtgaggtgtcatgaccttggtttttatttttgaacatgattcctctgcttat

SEQ ID NO: 67312 - DNA, 1117 bp, Oryza sativa
tccatgatagttgatcttttacattttcttgtacagttcgcaatgttgaatacctctcagaaagttgatatttgcttattttcatataatgacctttcaaaactgtcttagggtgttcctttcccgttgtctgcaaccaacctttttgatcggaggcttatgttttgtacttctaatgtgatagggtggaaatatcgagagagcaacagactggatttttagccaccctgaggcttttagctcagtacctactgattcttcaacaagcaatatggaagatgatgatgcacacataccagatggaagtggcagtaagtttttctaccccttctgttttactgtttctagtgccaagcttccaatctcatgagctaatttcattaacattctgaactgttaatgttgaatttgtagtttgcaacatttgaaagatgactttgtacatgccctgagcatttctgaataacgatggcacattatcgtcaagaaatggatgtggatttacaattatatgacccatgtcccatctaagtttccaagaaaacttacttttttaatttttttttcttttaagatatatgtaaagaaatccatggtagtgaatgattagccaaaccatataaaagtaagctccaaacttgtctcagactgtaggtgtttccaaaccattgggttcaatacttctagatggttgattatctatcttcagtatgtgtgtgtgttttgcagttcttggtttattaacattgctctatgctctgcaggatacaaattgatggcgtttgtgagccatatgggcacctctacccattgtgggcactacgttgcccatgtcctcaaagacgggaggtgggtaatattcaatgatagtaaggttgctgcctctgtcgacttgcccaaggatatgggatacctgtatttctttcaaaggatataaagcattagcagctgaaagacttcacaggcaagaaatacattcgctcgctgacttgagtcttagttatgggcacctatgatcaaaagcacggcggatagtcggtgaacttgcatgcagatggacttagagcgagtgttggtcacatcctgtcgtgctgacttatagggggatccactagtt

SEQ ID NO: 67313 - DNA, 7124 bp, Oryza sativa
atttaatttcccggttttgaccaatttcaatgtctcttatttaatttcgcatattttgttaatacaagtacaaaacaaatatgcaagtacaaaacaattgtacattagaaatgcggatattttgggaaggagggaccgagggagtagtactggtaattaaaatcttcgggttgcttgggctgtcatcgttgcgacccagctgctagttgtcatctgaagcaacccttttttcccagcattccgtgcctgtccagcttcagctttccaaccgccatgggcctcacgctgttcgatcgacaaacataatgtagatggagacgtacatatatctgtttgacgaagactaattaacactagttgacccaggcttaagctaatcaaccacccaatcagttcaaaacacgcaagccacatacgtgtggtgtctgatccgagcacgtagtagctgctgctgctgctgctgctgcaactttagacatattaatgctgacaatgctgggtaactgaagcttttgttcgatgtttttggtttgtccaacgctattagcatgtgcttaattaatcgtgtagtcagccagtaggctacgtgtccatgtcgttggctcgatctgcctgcgtgtgtgtaccaacactaggacaaaccaacactaggacgattaattctaaggtgtgttttggtcctttttgagacagcttcctttatgaggtccatctgaaggctgccaactgtagtcagccattgtttttttttctttttttttttaaaaaaacttgtagtcagtcgtgattcgaatttaagacctctaggcttgatatgcatctggctgacacaaaataattgcagttttcacgtcagctgtagtattgtattgaaatataagtgaattgctcgtcttttcttgtcatcttaatattcaagatgaactagatcggtacatgcaactctataatttgcaaactcattattgtgcagtcaccctgctagaaacaagtagagcagcaggtaggaaccactctagtatgtgtccattgcattgcatgcatgcagtgacctacagtatgatgcaagttcatctttttggaatttgtgtcagttccatttgtatgcatacactgttttctttctgccactgataagcactgctcgttgaaaagtacatcccaaattataagaatcttttttatacgtcttcaattatatattttgattattaatttattttattttatgctctccacgaatatgaaattagtatcacatgaaaatattttaaaatatgaatatagtgatataacattcataatacttagcctatatatgattagtatgcttactagttaaaagttgtcaaaaattatcaagtttgattttccttaaaaagagtgtcttataatttgggatggatggagtagtagtattgtgcagtactccctacatactcgtaaaagaagtcgtttaggacagcgacacgagtctccaaaacataactttgacttcttttttctataaaaatatttattgaaaagtgatatatgtatacttttatgaaagtatttttcaagacaaatctattcatataatttttatattttcaaactcaacaactttattcatgatttatattccaaggtttgacttaaacattgtcctaaacggctttatttatgagtatgctttagagcacccgcaatggtaaagtaaggtgttatctataaaacatgtacatctcagcaatagactagattaatagtaaatcatctcaatagtatgtctacatgggtatctatagctctctaatacattgcctcgtttttctctatagactatctccaggttagtagatagctttgctctctctcttcatttaatctcttccaagtaggaaaatatgctgacatggatctcttatatagagcctatagataaccattgtgggtacccttatgagtatgcagggagtactcctgcatgagaggcgaacacaataatgattcactgcatgtctctgcatccattccaaggagggtagataacccaatactgtatcgggcattgtcattggattgcattgctttgctactagctagcatagcaagcccagccccagccctgcaacattcagatgttcagaacggcatctgcatctgcattacatgcatgatgcagctttccccagtgcaatggagttgatgatgcctctcgaccagccagctatcagcagcagctgcagctagcagcatccggcactgttccttccatcgctaaccacctgactgttcatctatggatgatcatatccgatccccatcttgtttggaatgtacagtttgtatatctgaatctgatagattgatctggagccaaaaccaacatacagtagctgtagcattacacatcaacaccactgtccccctgcagtagcactgttgcttagcctaggctagctgcagctgccggtgccccccaacctgactgattaaacatcgatgatattatccctgtccctcccggccaacccttctgcagtgaaaaggccatgccatggattctagctagagtacctcgctagctaccaagatcaagccattcatgcatgctgtctgcattatggagtggattgaataatactattagttttcgaggatttttgtcggaatcgaactggttcatgtgaaaatcctgtaagattcctgaaggagaggctttagtctatcacatccttttgtttctttggagaggatcgatgttatcctgggaattaaacgctggaccaggttggtggatcaacattaatcagaagttcagaacagaggagcattatggagtggatcatcatgtatgcactcagcatatgccaattcagataatttcagagaccattacgcttttgccgtgctgggtgatcgatcgaaatcatggttgtgtgtgtcatctgccatatgatcgtgccagaaaaccctgatcctgggtggtcctctttggggtcgcagctcatcttgttcatggccaaaggtagaagaaagaggagagatctagagttattattactgcgtcgccattaactgcgcgtggtgattaagaagaaatcaatgtgcctcgtttgtcctcccgtcttaattgtgaaatttacggccgtatttacacaccggcaatgtgtatgtattgctgactgtcatggtcagtcacacacacacacacacaaagaacagtagacaacgacgatggcatcaaagtggcagcaacttcttttactgtttctgaaccaccatccttttacagcttgaaaaggagaataattcaacgtgaaaccatctctccctgtttcattccagctagcagtctgtctgccgttgtatttgcatcgtggtttttagtgagatgtcaaataccgctggacgatgcttgggagaggtcaaatcccagcctctgcatcgcgagatgcacataaccagccagtagttagattcgttcgggctctaaaagttatttttggctccgttatactaaagccaaccaatagatatcaaatacttaatgcagttagatttatctgggctctaaaagtttactcggttctgtcacgacaaccagcgtcatatcgtttcgatcgtttgtagttagatttatccgggctctaaaagttcactcggttttgccacaacaactagcgttatgtcgtttgtagttagatttgtccggactctaaaagtttactcggttttgccaccataactaacgttatatcatcttgtagttagatttgtccgggctctaaaatctttctaggttccgccacgacagccagtgccatgtcgtcgcgcctggctgtcgttggcggagtagagctcactccatctccagcatcctatcctacccttctactggttttgagctttgaggcagggttgagttgcgtgtgctcgaggcggccggccggccatcgttatcctccatgtggtgtcacaccatgaaaccaagcagcaatccaaattcccaatccggcacaaacaccttcatgcgaaaaacgggatagctactactacttgctactaatggtaggagactatgatcttttccagggagtaattaattgcacgtttgtacgagtgccatattgtggatttttttaaaaggtttatatatatattcaggcccggattggttggttccagatgaggttcagtaaagatcagaaagcgaagattaacctgcaaagaaatcatcatatatccggtttttcacccatatccatcttgccttacacatggttgcacctcctccttacaagtgttccaacctagctcccttccatacctctagctttcaccatggcacctgaactacaactacatgcatataaatccagccacgcgactctccgcgtggcggatccaggaattttctagagcctagacaaatactacacgcggattccggtttacggatagtgttagataatgaagcccggaaaaatacaggccatatatcacagtggcgcgactcgctggcgagcctagttggcatgcctactctgcaagaagataacaacaaatcgttgtctgaaaaaagatgataaaaaaaatggagatgaggagatgaaaaatgaggtggcaatggcaaaatgccgcgggcgccgtcggtgtccggggctccggctcgcccggccggcgtactgtggaggtcgcggtgcctgtccgggctccgggtagacagaaaggccccaatggagcccgccgtatctgctctgctacacctacccatccatgtcaccatccatagatagacgatggcgacgaagacggtgagctctttattatataattttatttatgttttcttgaggggagaagtttgattgatccaaatttgatcgaaaaccgacggttttttaatttctttgctgtgcagggatgcgtgcggatcaaaaataaaaaatcggtggcattaattcttggaattgattcactggacggacagtgaatattgcatgcaacaactgatcatcccctgcaatggcttaatattgccctgtgttcagtgacttggctgccgtgctgcatgccagctatggagggagagagatgaaatgaaatgatctcaatgggaggaagagaatgatgccgagaaattaaaatctctcttgtgttcatgcattcaatttgcttctgcacatgctcattcactcatccagtcagtcgctcactcactcactgggctcagtgacctagctttgctactactagctcactcatcattctctttgcttccttcaccaaacttcagatttccagtcccctggattggcttcctctgcaaccatcacataaatttcctctgcctccatgtctgtactgactgcctctctaactactcagcttttgtgtgtgtgatggagatagagatggcatctgatttggcattggcactagtagtactttgtactagatttgcttgcaagttgcagcctctgaaaatctgaatgttagttgaggaggcctggccctgtgtcctaactcctaatgcacatatgcatggcatcttctctggttttgcatcattcattcatgcatgcatgcatgcaaatgagggggtagtagtcagtagatcatagatgtgtccaggctgaaatgcaaaaagtaaaaagggatccctgcagagatctccaatttctttcactctttcagaacaaaaggggctcccttgtggccttgtgcttgcaggaaaagcccaaaccctgcatctttcaggctcttgccccacatgtattatgtacatgattcgtaaacacacagctagcacatagtgttcccggcataaaaaaaagaaaaaaaaagaaaaaaagaaaaaaaaagaagctagcacatagtgtagccctgtttcgaggagcttctcggagccatggcttctctcgaaatcttcgactccctcaaacagaatcctaattaattctttaacaaaattccaagaatttatagttgtaaaatctaaaaaaataaactagaaatcaggaaatacaaaatccagtttagttttactttttcagattcattcattcatacaaaatccagctagctactcatcttagctgcttctcagaatttcgagcttccctgaacatataaccatgtactatttcttgcttgttcttctcttcttctacatcttgcattgtatccgtgtggatcatgcatgcattgtctggcccatctggtttgttaacttgttgagagcatgcttgcttgcacaacagtacaaagccagatgtgtcctacaaagttgcagacttgtagctgcactagcttacacatccatggcctattccactgtaggaatataaatatacatacacacacacatctatacaaatacatgtctagctatactagctagtggttctcatcacttgcatatatacatacatgccagtacaggatcaggttcaattgcttaaattgtacaagttcctatcattgaccagcctggctatagcttagctcgagccaaaatgccaaacagattagtttaatcaattagatgcataactaactaataatcagtaacgacaagcttgcagcaacaaaacaaagcacttaatcagcagccagggtacaactagaagagacaacacagcatgtccttttcgttttcttttccttcttcttcgatcctcttctctcttgcttgaagatcttgattctttttctacatctagataaaattaagcctaaccaataattaattaaccacactttttttttcagttctgaaatcagaataataatcttaattattgcatgcttaattagattaattaattaattaattatctccatctagctgtctgcttctctgctcttgtaattcttgcagctgcagatgctagctttgcatgcatgcatgcaaaccattttgcatggaggaaaccttaaacacaagtaccaccattttctcttctttttttttttgctctattaattgtttctttttttttttgcgtgagatcgaggtagctagtagctatagcttatgcgtggacgtcggcggcggcggcgacgtcgtcgtgttcgtcggcggcggcggcggcgtcggtggagaccatcttgagggcggagccgccggtggc

SEQ ID NO: 67314 - DNA, 4591 bp, Oryza sativa
tagtcgtcgccggacttgggccagaggcggcggagctcggagcggagggaggaaggggagaaggtgtagccctcggaccacatgagcttggagaagaaggaggagatgggcggcgagccgtagccgcagggctcgccggggccgcggacggcgcgcatcttctccgacgccggcagggagaacacgcgggcgacgcgctcctcgacgcgcgacagcagcgccgccggcacgccgtgcccgaccagaaggaacgcgccccactgctccgccgcccgcgccacccgcgccgccgcgtcgcccgccccgacgtccaccaccggcaccgcgtcctcgccgccgccgccgccgccgtccaccaccgggtggtcgtccagccccggccacgcgtgcgtctccggcacccgcctcgccgcccggaagtcgaagcagagcgggttcttcaagtgcgacggcgtcggcatcgcgacgacgacgacgatgaccagagagcaacacactcgcgcgctcgctcgtctcgtctggcagaaagccagtaacaataacaacactaattttttctctctatataaattttttctatgactttacaatagtggaatgagtagtaaagtgagacgagtgtaagaactggacaagtacaagggagaggtatatatagggagagaagttttggagcgtagtggaagaaaaaaaaagagagaattaattggtgaataaatcagtgatgaagaattgaaatggatcattaattaatagatttggagaggaaaaaatgtggtgattgggacagagggtttggagtgatgtggagcacacaaggccaccagcttagctacacaacacaaatctagctagtatgctcatcaccaccccctggctggctagtggcactgccacccaattaataacacacatattcatacaaattaagttatgttatagtaaagtaaaatcacaatgtgaaataagcaccagagtaatttttaattatcacattacataaaacagattaggtaattaaacataggaatttcacaggaacagtagcgtcctccgttgccgtggtgtttttttttaattcgtctgtctgctttagaaccaaacattctcacatgcagccacttctaattaattatgattaccgtataattctcatacacgtcgaatttcattcgatattttactttcagtagcaagatcttcatgctagttcccatatacagtactacatccgtttcaggttataagacgtcttgactttagtcaaaatcaaactgctttaagtttgactaattttatagaaaaagtagtaatatttttaactcaagacaaatttattatgaaaatatatttaattaactaatttagtattataaatattattatatttgtctataaaattagtcaaacttgaaacaacatgactttgactaaagtcaaatcattttataatctgaaacgataggattacgtcctaatttgtcgagcacagtacaattaccaagattcaaaccgtgttatctacttcttcttttttcaatatatttactaagaagactaaccttatattacaactacaaaaataaacaaaacaaaacaaatataaacagtaaattgtttagaaaacagcacacagattctagaacagcaaacaagagaaaagacagcactagtctgcagccacgagtaaaaacagaggacagaggccatgatcatcatcatccatccatccatgaatggttgctaatacattacaaaattaacacagagacagagagagagagagagagagagagagagagagaggatgcattgggtctggaggtaggcggcgatggaatggccggccgtgcgtggaagggaagggacagggggatgatcgagagatggcggcgactaggggcggcggacgatcggcggcgaggtgtcgccggcgccttctggatgcgttgtcgggatcgatggagcagagggcgcgtcgccattgggtgggatccgtgcagccccgccgccgcccgccgcttcccacgcgctctccaccaatttctcccttttctctctttaggctacgtacggcgccgccctggaaccattcttatttcttatttaaatataaacaaataataatgcggtagtatataaaaatttgtatataaggattcgagtccactctagttcctgaatatatgtctaatcctcatcatgattttttctgcactatatttcttttattttagtaacaataataatgcaatggtctaggttttaccttttctttgcaaaataatgttgattattatgctaaatattaagaaatgattacaaccatattttttttagataattgattttcattagtccggcctctatatctacgagggatatacaaaatcaaaatgatacaagaacaattagactcacatctcaacaaagagaacacaaaaccaaaaaaaaagggaaaaaaaaacactacgacctctatacatccctgcttccccacatcctctcttgaagtggccaaattcaacgagtggaagtcatctaattgccatcacccctagtgcgttgtcgctacgaaattccgctggtgctatcttcatccgcttcaagtgagctgacgccacgtgacgccggttaaaccccactcatccatcgtcatacagtcagaactagccgaccagatgtgagccaaaaggatcagcttctgcttcattggattcctagacctccatcgacatcagaatcctcctccgcctctcagacccctagcccgttgccgccgctattggagtcctcaacagctgtcaccgaggatatcctctttcgtcctgactccgaggcctttgccgcccctagctagggccactgccaccgccgggatcggcctcctcctcactaagatccttgtaccggcacttaggccaccgccgcccctagggccgcagttaccgaagctgaggaggtcttctacccggactcgcaggccgctatcgcccctagggtcgctactgcctacgaaaccacctttaccggattcgccttcttcttgccgaggactattcgtcgacgcttaggacgccgccatcctccgccgcacccttcgctgtcgtgctccgcagcacctgccacccaaagagacatcgtcgccaacgtcttgctgctacctgccgcagcgccgccctcctgaccttctccgctgcaacgcgtggcccaccgccgcccatggccccgctgactacaaccatatgttattacatggggaaaattcagacatgctagtcatacgcacacagataccccgtatcttagaatgccacgagagatgtattttgtttcgaacgtaaagggggccatttgccggtacatttcccatatttcacaatcaatggagctccggcgaaaagtcccgttgggcctttctcctatggggaatggaaagttgtaaaccaaatatcttttacaagtcatatacagctcaaggcaggagtgtggaattggtgaggaaaaggccaaaagaatgggagtcttgcacctttttcttgttttggtaaatacattgcataactaacacgtattgtgctcttatatgctaaacgcgccaaatgatcaaacaattacgtcaagggcagtccaatatccctattttattgttagggttaaaatagatgtacatctccttatgcatgttgggaattctatgggaacatcttccaaaattaatgtgcaaaatgattaacccaatcggcttgacgaatagctttcggggccactctattttttcccctacaattttgctcatttcaacaatttatttatcataaaacctatactaaatgtttaaccctcctaagctccataactaatcacttctgcacggaaaacggagtggtctattaacgtgtgattaattaagtattagtagtttttttttcaaaaatagatcaatatgagtttttaaagcaactttcatataaaaatctttaaaaaatacaccgtttagcaatttgaaaagcatacgtatgaaaaagagaggtacgagttgggagctatgggtactgaactcagcctaattgtatttatacacacatgccttttccctccttttaattgagtattcccactaacaatttatccattattggttcatattcgctgaaaggagcccaacaaatcgtgtgatagctcagcggctaattacaacaatttccatagataccatggatgatcttatttttctttacctaaacatgtactctctccatcccataatataagggattttgaaattttgcttgcactgtttgaccactcatattatttaaaaaatttatgtaaatataaaaagtaaaaagttgtgcttaaaatactttagataataaagtaagtaaaaaagtaaataataattctaaaagttttttataagacgaatggtaaaacagtacaagtaaaatgtttaaatccttatattaggggacggagggagcataacaccctgaaattatctattaattgtgagtgagaggtgacaagctgctagttgctgctatccaactcacaaaactcttctgaaacaacgaggagaagaaagaca

SEQ ID NO: 67315 - DNA, 907 bp, Oryza sativa
tagccttatataggaatatttgcttctatactaactgtagctttgaaaaatggcagcaatttgcaaaccagaacatcacattaggggaggcaatactcactggatatggattattcaaggagaaatactggttctggattggggttggagcattgtttggttatgcaattgttttgaacttcttattcacattgttcttgactcttctcaaccgtaagtttgtgctaacttcatggacccagacaacttagaactgcaatcaaaatagtttctcattctcacaactggtgctccttcacagctattgggaatatacaagctgttgtgtccaaagatgatattcagcatagggctcctaggaggaagaatggcaaattagccctagagctaagatcttacctgcactcagcttcattgaatggtaatgctagataatgaatccctgtacttacatcacaattcatttttacccttttactaagtcttcatattaactgtgttccagggcataatctcaaggaccagaagggcatggtgttaccatttcaacccctttctatgtgctttaagaacatcaactactacgttgatgtaccagcggtatgtcagggggaggccggtttatatggctgaaatttcttttaaaaatctatgtatattgattcataatcaagttttgcctagcaggaattgaaaagtcaaggtatagtagaagaccgcctacagttgcttattgatgtcactggagcatttaggccagggatactaacagcacttgttggagtaagtggagctggcaaaaccaccctcatggatgttttagctggccggaaaactggaggactaatagaaggaagcatcactatatctgggtatcctaaaaaccaagagactttcactaggatct

SEQ ID NO: 67316 - DNA, 2158 bp, Oryza sativa
gccaaggacatgccgttttcttgtagcgtattgactctcagaatatatctaacaaaactgccgttcgtgcacatgtatttaattacgttgtaaattgacaatccattctctcttctctctaatcgtaaactaaaaacatgtgtgttaattagactatgattttaaaaaacaactcaatacttagaaaattattttcacagctccctttatttttacaaatgggctaaaagaagattcacttgtgaaaatatataggactctcacagtcaacaccgggccggcgctgtattttagacgaccaagacgcaccaacacatacgttatattaaaataaaggagcacgaacaccaacaacaccttgcttctcacattttccttaaactctccacacttccctctcctcttcgttttttctttccacagcacagaggacactgccttggctcctccttcccctcttgtagatggcggccggcctcaagagcaacgacgaaaatgacaacaaccttaggagcggcggcggccttgggagcgcgcgatggatccatcgccactggcctcggttggggcagatccccagcgtgcatgggagcgacgttgatgatgaccgcgctagccttgggagaggcatatccaacgacgggagtccagggatggcatcaacaaagtcggtggcggccattatggggatggttgcggcgatgatgacgaattgcaatggcggcgatttcgattggggattggggctatggtttctgtaactttttggattttttatatttttcgccaaaaaactttttgtagtcagggttgaaaatccgttccgtcatacggttatgatgcccgcaatagaaaatcttgacttttgcataaattgtcttaggtgggtgctccatctatctaggaaaggtggttttggtcggctgaaaaaggccggtctgtagtggggatttactgttagtttctatcagtatatttcagatacccctcaatattacaattaatactgggaaagcagaggcacttttcgcagcaaatatcaacatatacatgtgtcgacgtttgatgtcgcgattccggtatttgcatagtatgagaatcgttggtactagaatatatgcgagattgtaataaaagagatgtggacgaggatttttatacaggtttgggccccctgaattgtcaggtaataaccctactcctgttggccgaagccggtcgttactcttattcaccataatcacaccagcataatatttagggtaacctatctaactgttgtcgacttgacggtctgaagtgttgactcgtagtcgacaacagggtagccttcctcctcaaatccgtatccggcgagattaaagacagcgttatgtctctcctgagagtatccgtagacatcgtaggggactaaccatgcttatctctgaagttgatatccgacgtcttgtcttggcacatgttggcttgtatgttgatcttgtgtcttgatctattgttccgtgtcccctctcctcctaggggccttgtatttatacccataggtgtccccttgtccaagtagaactaggaaaaccattatggataaatccgagtagttcttgtcgtttccatgtagaactctattcatccttcattatgcataactcctcgtatatccgaaggttgtttccgtataagacatggtatgtggtgggtcctaccgagatttagtcaactactattaggtatgtgatattcataaccctaacaacatgtgtgcactgtgcaagtgcaccagacattgacacaaaacaattcgtcgatagacaagaaaattcacacgcagagacatgcacacaccacatgctctttcttcgaaggaaagaaatacacatgactcgatctgcaggtgctgccaaggcatcacacgcaagcagagacgcaccacatacgtacatctaaggtgcttacttccaagatgcgtgaaaaggcatctctctctcaatgtggtcttcaagaaaaaaacaaaccaaggtaatatttctctcggatttttacaggtatattatgcgtgtatattaccgaattgtcgttagttcactacacgagaaagtgactgaattgtcctaagtaatataaaatatgtagggaacgaggaaaaacagctgcaggaatt

SEQ ID NO: 67317 - DNA, 2321 bp, Oryza sativa
ttagtgtcggaaataatgcttagattttttgtaaatttaatcatactttaaaaagctgacttaggaaaaacttatttaaaaaccttattatatgaaactgatgtagtaatggtcaaagtcacctattcttagtcgaaaggatatttccgctcacttggtttatcaattaagcttttgcaaagtcaaggtaaatacacatacaacatatatgcatgacaccatgtacaaccatatatagatgaacaggagtatacatacctacgttgcttaggtagcaccttgatttaatcaaatgctagctagttgatgccaggtggcacactgcggacggatttgtttgtcagtttccctgcattacacattgtacaggagtgtactacatccacatacaatgaacagtagtagtagcagcagctatatactccagttgcctagtcgtacacaaagtataattaatcacaaaattttcattttatcatggaaaataagtaggcattcataatgcacgtacactccgcacccatacaatgaacagtagtagtagctactagatagttgcctagttgtacacgcagcataattaatcacaagattttcatttttcctaaaaaaaaacaagcagacgtataatgcgcgcacactcatcctacctttaatgagtatcttcagaagattgagcctgttgtcgtcgagaggtacagggtatgtcatctatcactcaaagaataactagtcgtaaatacgagtaccgggttgctgtcaaggggtataggttacgttggctatctcttaaagaataatttgccgtaaatgcgaataccatcaagcctaagacttgcatccatataggctagttacaccacaaaacctaacgtgttaagctacgctccctccacacaaaattttcatttttacccagcaaaaataaatgaatactgaagcatgcagcgctgtacacgagcttcttgtttatcattgcgtatttgtcatcatctaaaaaaaattgcgtatttgtacgcgtacatgcacgtttccatccacaatttcacatccatacgcgggtgacatatattatgcagctctcgtgggcatagctcgccagccaagaacgagctgaagctctcgtgcgcggcgcggccatgaaggcgtcgtcgtcgtcgcaggggcagagcccgaggacgccgtcgccgcgcgccacctccgccaccgccgagcacacgcggtcctcctcggagccgtggctcgtggcggcggcggtggcgagcacctgcgacgactcgtgcgtcaacgacgtcgagaacttcgcgcgcaccgtcgccgccgccaagtctaggcagctggtgggctcgtcggcggcgtcgcgccccgacatgctcgcgtccgtgctgtcccactacgccgccaagtggctccccgacgtggtggccgcgtcgtcgtcgtcctcgtcgccggcgacgtcggcgtcggggcggttcctgcccccggagagccccaccgccacgtggctcaagaagcggctcctcctggagtccctcgtcgccgcgctcccgcctgacccgccggctcccgccggcggcggaggagcggccgacgacggcatcacgtgcgacttcctgctcaagctgctccgggcggggagcatggtgggcgccgacgcggcgctgctgcaggagctggagtccagggcggcgcggcggctggaccaggcgacgctgggcgccgtgatgataccggcgttcgggcacgggtacgcgtgcgggacgctgctcgacgtgccgctggtgctgcgcctggtgcgcggcttcctcaaggacgccggcgccggcgggggcggcgccgccaaggcaggcggtggcggaggcgccgccgccgcgagggtggcgaggctggtcgacgcctacctcgccgaggcggcgctcgaggccgggctgcggccggccgagttcgaggagctcgcgcgcgccgtgcccgcgcacgcgcgccccgccgacgacgcgctctaccgcgccgtcgatacctacctcaaggtcacccacacgtactcctccttccatctccactaattttacgtttccgtttactactaaaaaaaaaagctaccaatgtagctttgcatattgtgtctcgatataccgataaggtcttttttacaccttatggacaaatttgatgtcgcaatcttttcggtttcaaaaaattgatatcaccatcttctacatatcgtcaaaacaattgtgaattattttgggaccagctagctacattttaatattcatggcgttacaatttaagaaaaaattgtcaaaattttattacactgt

SEQ ID NO: 67318 - DNA, 3095 bp, Oryza sativa
tggtgtttactgtagtgtccaaactataaagttactaatatctgaagattgttcagccaaatcacttgtagtttttttttctgaaaaaaaaataaatcgtaactcggagtacttctatgaagtagggtaagaacaaagcgtagggaagagatcacgtgagctccaaactgctaaagaacaaaggtttacctgtatttacacatgggaataggtgctttgtggatatcaaatccttcttgtcccttagcttgctgcctgctgttctcatcaacacttgtgctttgtcctggtgcgagtgactaacaagcagttttactgtagctgcgcgtttcaacaaacaaaaaaaaccacatttgtacttaattatttttagttgtttcattcaattttatcaaccgagcaaacgagtgtccaaagagtactaagagagaagatcatactcctaggcctggtttagattcaaagtttgaacccaaatatgtcacatcgaacttttctacacacacaaactttcaactttttttcgtcacatcgtttcaatttcaatgaaacttccgattttgacgtgtaactaaacacaccttagtactctaaaaacgtgtggatgattgaaattgccagataaacatgcaagtatcagagatcttgcaggcatgaacagtcatgcaggtggtacttattaacagtctttaacaaccatcgtaccagactactgtataacagagccaggagattcatctttcaatttcatggctctacatgtcaggacttgacagtgctgagagtttcagatccaaatgacaccaaacaaaaatcatgtggaattctgtttctgctgttctctgcgcttttacagatcccctgttcatcagaaatgccagcaactcagcattgttgctgctgtctgcaaatgaaagattctcaatgtcaaaaccaatcatatgttaggcagttaggccatgcaagttcatgccaatggcactatgccaaatatcaagatgccatcttttgttcagttctgttcttcaaaattttttgtctagaataaatttacactttgttgagcaaaaagtgctgtgaaatcatgggagaaatgatttttcaagtgcaaaaaatattttttaaaaagaaaaaaaggccgtttgtggttcgctgttggcgccacttgttttgggggccttttgggagtataggattttaaacccctcaacctccctagcgataggagtttttccctcttagtagctagtactccctccgtattttaatgtataacgctgttgactttttgaccaacgtttgaccactcgtcttattcaaaatttttatgcaaatataaaaatacttatgtcttgcttaaagaatatttgatgataaatcaagtcacaataaaataaattataattacataaattttttgaataaaacgaaaggtcaaacgtttataaaaaagacaacgacgtcatacattaaaatacggaaggagtaacatttttgtttgttacttgttttcggttcttctatccttgtccactgacaacagccttctgctgcttgtgttgtgtaattaaactttacttttcttcttcttctattttacttttcttcttcttctattatattgatatgtaatcattttgcgcattagtgaaaaaagaaaaataatctatctattatattattaaaacagtcttgaaaggaggcaccacgttcgctgtggaagctagaaattctcacattaatcggagaaaaagaaaaggagagtccaagtagaaatacaattcaaaaatagctgaaattcggaattaaaaataagcgatattgaaagatgtgtccatataagaacccaatacaaaattaatcaaaattcgaaataaaaataaaataaaatccgaaattagaaaataaaataaaagttcaagtaggaatacaatttaaaattaactgaaattcggaattaaaaataaggaacattgagagaagagtacatataagaacccaatacgagattagttaatattcggaataaaaataaaaataaaatccgaaattagcaaaaagaaaataagagttcaagtaggaatacaatttaaaattaactgaaattcggaattaaaaataagcaatattaaaagaaggatccatataataacccaatacgagattaattaaaattcagaataaagaaataaaataatatccaaaattagaaaaactaaaagagagttcaagtaagaatacaattttgaaacaactaaaattcaaaaataaaaaataaaaatattaaaagaatgctatatggtattaaataatttttttaaaaaataaattctaaaataagaaaaataaaaaatatttcaattaggaatacaatttataaataactaaaattggtgataaaaataaagactattgaaaaaaaagaccatataaaacatacgatgagataaattaagtaacaagcctataaaagagtagagtggtggcggttgatacgacatataaaaactattagtaaaacaccaaatagaatcttaataatgattaaaaggagggatgataggcaggccatgaagcaaacgtgtaagatggttgccggacttctagaaagtgaaaaaaaaaccccattgataatcatattcgattttcaaaatctcaatgacaataaaaaagagaagcagcgggcatgatgtataggattatagttccagagccaccgatggttggcgggacttctagaaaataaaaaatgaattgaaacgatagttatgttcgaatttcagaatcccaataacaataaagagtaggcggcgaatgggtcgtagaggagtatagtggcatcatttgacgtcacttctaaaaattataattaaaaaatgaaacccaacaagacaataaattgtaaaaactacaaggtccaatttttaaaggttcggaacttctaaaaagtaaaaaaaaaaacccaatgataatcatgtataattttaaaatctcaatgagaataaagaagggagacaccgggtgagccataaaggagtacaatggcaaagccactgacggtttggcgggacttatagaaagtaaaaaaataaact

SEQ ID NO: 67319 - DNA, 1584 bp, Oryza sativa
tgctgcatcatggtgcaaagaattgtttatttgttcactgctttcttgatggcttgcttgcacctggtgaggaacttgctgctgcttgtggacactgaatcttcatagccgtatctgccattgtcgtcgccgaccaccttgggcttcctgctcatgcactccacaccccttctcattccaaggatcttggaaggtgaggaaggcagagacctgaaacccctggagctgtcagaccttgggaaccagatcttcttctcctctcccctctccttgatctcaaagctgttcctgcacctgtcctgctgctcagtagcaccatcgccaccgacctcgacgatctcatcggagcattcggtgatctcattcctgcagctctcatcatcaattctgctttgcatttggtgctcgtctgaagcgatttcatcagcagtgttgtgatcttcagaagaatgatatgctgctgcaggatcttcttgctgctgctgatcctccatgagcatttgaagccacttatccacagttcctttgccggtgtggttcatgtttgcgtcgccttcggatcgaccgacgccttgccgatgaatcacattattctttttcaatagcaccgatttctctgcaggatatctaggtgttccatacatgccagttactctgtaaggaggacttggaggaactgaggatgtccttggcactgaaactgtctgagatctttcagtctcagactcacattgcaccatggctgctttgcccttgccattgccatctcttgacctcacaggagtgctagttgcccttgatccccttgatgacatggtcctttctctccttctgccgcgctgccgttctttgatcgccagatgctccagcttctccctcactgatgctcttcctctctcagtgtcaactgtgttgtcttccatggacctccttgggaagtttatcaccttgaaaggtgaattcctgaaatttcccattgttgaagtttcacctgcaatttcctcttcctctagggagatgtatgcatctgaagccctctggtcctcctccaggaaaaccctcagctcctgcttgagagggtttctgctcctcagtcttattcctggaaaatacttcaccctttcactgtgcctttcttctaagctgtgcctttcctctagcaatccatcatcgtcaacacgataccgcttccttgcttgatcggtgaaaggcttgatctgcttctccagttcatccttctgctggtacttcctccggagctcggtttcggatgagtcacacattgctctctgggcctcgagtctcgccatgagagtgctcgttgcagcttggttcatcctaagctgctccttgtacacaacagacctgcacattttgcaccacaatcaacaattagcacaaacaatcgacattgaaatcaactgcatgagagttcttggctcttgctgcatagattcatccttactggtgcatggcgtctctgatcatcttctccagcacagccttgtaattcgactgagcctccgccaagcggcggcacttctcgacgcgccgccgcctcttgatgaggagggcctccatgtc

SEQ ID NO: 67320 - DNA, 1324 bp, Oryza sativa
ttttcctcaatggaggcaagtgtagcactcgtacttacttccttagtgtgtgtgtgtgtgtatatatatatatatatatatatatatatatataaagacaaaccctacatttttgtgtcgttgaccatccgtcttattttaaaaaaactatgaaaaaaattaaaaagacaagtcacgcataaagtattaatcatgttttatcatctaacaataataaaattactaattataaaaaaaattcatataagacggatagccaaacgttggacatggaaacttagggtttgtctttttctggaacggagggagtagtgcactgcatccgtggctccgtgtcacaaaatttggtaaagtaacaaattaaataatttattatcattgacaccttagtaaattttggtattttcaaaaactttttcctataaaaaatactaccaaattttgatcaggctatcaactaaacttatccaacattatcgaaatttggtaccgttaaaatgtgccaaacatttaagaataaaaaatttaataatgttgattttgacatcctcctgaacaaatgttgtgtttagttacttttaaacttctaacttttccgtcactttaaatgtttggacacatgcatggagcattaattgtggatgaaaaaaaccaatcgcacagtttacatgtaaattgcgagacgaattttttagcctaattacgccatgatttgacaatgtggtgctacagtaaacatttgctaatgacgaattaattaggcttaatagattcgtctcgcagtttacaggcggaatctataatttgttttgttattagttacatttaattcttcaaatgtgtgtccttgtactttaaaaaaattaaaatggaactaaacacggccaaagtcataaacatagggttgccctgagttgggaacctttccctccaacataaaaaaacgaaacagctcattagcatataattaattaaggattaactaaagctaacttaaaaaaaataaagtaatatgattttaaaagtagcttttctatagattttttcaaaaaaaaatacacaccttttaaccgattaaaaaactcgcacggggaaaacatgggtaaaagttgggaaagctcactgccaaaggcagcctaatttccagccttcgagtgttttgtgagtgctgaaatttcccaaaattcatcatcattacgggtgtgttcggacctccaggttcccaacccaaatcactagtttttcacatgcatgtttttcaaactgctaaacggtgtattttttacaaaaagtttctatacaaagttgaataaaaatcaaatta

SEQ ID NO: 67321 - DNA, 3661 bp, Oryza sativa
tacggagggtagtagttagttatctaatcagcatagccaaatttgaagtttacagtagaacctagttttaaagttgattttgagtccttttaatgttggattttaaaccgtttaaaaatatatatatatatataaaagttttacatatggattactcattttctagggtttattagtctcaaatcaaacaatcggaggcatgttttccggcacgagctttcaaacaatcagagccaagtttgtaatttgctttttctactgcttatcggctgaagctgggtcttgtctcagttttcatcattttactactggctcaaacttgcaaatactcgtatttctttgactctgaaagtatatatccaggagtattcccgtgtgagtgcgtgacaggaaaagttcagacctgttttctgcctgcagaaaacaatacaaaaaccaaaaccatcgcctcgcccgtgtagtactagtaaatgttcaggcttcagagttcacaagcgatgaaaatgtcttcttggcaatgtgaatgtgtgatggaacgaccagaaaaggacggtgatcctgttcttcttcgtttgatacacgcacctgaacttctctgaactgatgataggatacgagaagaaaagaagcacatcaaaagctcagagtttcagtccccgcaaaaaaaaaaaaaaggaaggaaaaagttcagagtttcagagaagcccattaattcgcaaatggtctcggactaacatggccgctctgttcaggcccaccgtttcttgcaggaaacatcttgggctgggctaacatgttaagcctatttagcgtatttaagcctatagagtacctaggccttagtaccttttctcatctccaaactttaactttctcgcttttcgaactactaaatagtgtgcttttactaaaagtttctatgtagaaattgtttaaaagaatcacataaatctatgtttcaattttataatagttaatacttaattaattatgtgctactgagttttcttgtttcgagtgcgctgaaaatatacctgcatagtgcataccattgaatcaagaggagcctaaggccctgtttgggggagcttatcccagctgcagcttttcccaaaagctgcttctgctagaagctgccccaaacagttcacagcttctgagaatctgtagttacatattctgaaaaatgaattaagaagccagaagctggagaaacggggtttcagagcttttccagattctcagaagctggctaccaaacaactgcttctcagaatctaaagctccccaaacaagccctaagctgtgtttgaggaaaatggaaaagagatacgtaaaacgaggtaagttattggtatatgattaattaagtattaattattttaaagttaaaaatggattgatatgattttttaaaacaacttttctatagaaaagttttccaaaaaaatataccatttagtagttcggaaagcgtctgcgcgaaaaagatgtgttttctctctcaatctcccagcaacgaaagcagcctaagtgtttcatataagtcgttttttttttttttcatattttttaagtttgaataagtttatagaaaaatataaaaaattccacacaaaatattaaatattaggtttagtaaaattaatttggtgttgtatgcgttgtcatttttttaatttaaagaagtttgattagaaaaaaaataaaagtagaaggcttaagaatccattatttttccaaaaaaaaaacctaacttttcctcaggccggcggcggggagccggccggcgaagcgagggttcctgccgcagtccgcgtggcggcgtcgatccatggagctagccgacgactctctctctctctctctccattgcgattctgacgaagcagacgtcatggcgccgacgcctttcgcggcgttccaagcaggaggaggaaggctgcggcgccgagaatttcctcccgcccaatcatcaccaccaagaacagccacgagaatgagattgattggatcgatttggactgagacgccggatgaactgcagctcacagacagtcatcagatcagatgctgcaagcctggagactggagtagctgtaaaattctcttctcttcccccgggagcagagtaaattcctgcgtaatcccaggaaacctaggtgcaggtggagcaggaggaggaaaggagaatcaaatcaaccgggagttcagggacaagcagttgggaatgtgctttgtttttttcctgacatgatttggtgtgtgtgtgtgtgtgtgtgtgtgagagagagagagagagagagagagagacttcctctgaacttctgaagagaaaagtagaaaagagaacaatttctgattacatttcaggcttttaccatctttcattttttgagtcgtgatgttttgttcctgcatatatgttcgtttgctcctgcttacaagttaaaaattgccaaatggttctctcattcgcaggaattcagagcaatttcgaaatcccgaagtgaaacgtggcgattttggcggtataccggattactggttcgatcttgtagtaactggagtgcatatagttgttgttactcctagtactgcagtattaaggctatacgcaaagagaccgtgtaatttatcattacagtgctgtgcagttcagtagcaaatcaactcagatttttttttcctggcgagctgatcagctgaagagatattttctgtcaaatggcagcacggtaagtgatgaatttctctatcatgttcagcaggggtgggctaagagagcaatgtgcatgccatgaacatgatgaagatcgatggcatgagcatctgacactctgactaaccaaagttacagtacttagtactactattactgcagggtagaaacctcctatgtgcagtgaatacatgaaggttcttcgtgcagtaaactgtaattctgtataacactgaaagctaggtgagctaaactgaagtttggattggcccaggaaaaatgcagcagccagagcgtgtctgaacttctgaagcagcatggtgtggtaatctccttttttactttatatccttgtcctgctatgtttgtctttacctcttcacagcagcatatgtggttaaatcccatcgaagaaccctctcatctaccaacacacactagcagatcataagtacattgtgcaatgtactatatagccttattcacaaaccaaaaaaacaatctaaaaattcagagatggccatttgcctctcacatatacgtggggtgaaaaactgctaaataattcagtaaatacagctagggatcatgctgaactttgctcaaattaaatacttgtctgcctagtcataggcttccttgataattttgcttacccgtgtttatatcctttcatctacctggtgttggctggtgctctcagttggcatgcatgcatgcacaattgcacatcatagttcaaccaaaccagtgtgagtgtggcacacctgaaccgtgacccccaaaatgtaagcaagcatgcgtgagaattttatagattctaatgcacatgtctcatgagcaatcaaaatctggtggttcttgctccccttttgaccacccaactaatcaatgacactaggggaaactgttttaaacactcgggtggatgtccacccg

SEQ ID NO: 67322 - DNA, 3864 bp, Oryza sativa
  unsure (1)..(3864): unsure at all n locations
gcatctgggagagaggaagccgggtggcgaagcggcggcggcaatggcgccggggacgaaggcggaggcggcggcggcggggaggagggggtgcatcaggtcgacgcgggggccgtggacggtgcggcggagggggcgtggcggcggggtgacgacgtcgctgcggcacccgacggcgcgggagcgggagaacaaccggcagcgggagcggcggcggcggcaggtggcgacgaggatctacgccggcctgcgcgccggcgccgggtacgcgctgcccaagcacgccgaccagaacgacgtcctccgggcgctctgcgccgaggccggctacctcgtcgacgacgacggcaacgtctcgcgccgccacgacgaggtcagagcgtgtgtgttaatttgagttcatcgatctcttgtcttctcttttgcattcattttggacacaagaacatatattttgtgtttagttcttgaatttggcacaccaatttggtttatttcctcatcattttcttttatctcttgacctaaggcccccatcgtttgacgttatatttgcaaataaaaaataatttgtgaataaaacttttatatacgtgttcttagtgaaaagtaaataataaaaaataaatttcgatgaaaaaaaaactccaaaatcataaagttgaaaatttaaattttggttgataagtgtaagtataagcaaaaagatgggcttttagtaactctgttgttaattgccaagaaaagaaaaactctgttttctgctatggtccttttcagtgctatgcatgacagtgtgctggtctgtactgcatgctatctgtatcgaactgaacaacagcaacagcaaaaggaataataataaaatgtcaagatcacattgttctagtactagttatgatagtaaaaagtgtttttgtcttttaaaaaagcaacataactggtcactgtaattttcttcatttgtttctcttcttgaaattgttttcagcgtttagccggcgccggcgccggcggaggcggcagctccgatcagctgcaggtgtcctcctacagtggagcaacagaggcagcagtggctatccagcatcaggagcaggagcaagagatatcactcgagctgacactctcattcacctacatgtaggtagaatgcttaatttgtttaaacaccaaccaacaactaggtgcattatattcagttattcacttggcagaagttaagcacaaatcagtgtagtaattaactaactagcaagcaagcttgcttgacagaattgtcaaacaagaagactgctaattaatcatcttagcatcgttgacaatctataataatcaaataatatcattgtctagttacctattggaaacttggaatgtgttcaccaagagcacgcaatatcggaaagtaatttgtcagcacgaacactttgtgtcacataagctgaacacacacacaagaagtgcagaaatgtgaacaaagagctataagaaactaaaactttattgaacttgtagtagagtacatttggatatcataagaagaatctgaagatctaattaagaagaaataaagaagaagaagaagaagaagaagaagaagaagaagaagaagaagaacatcataaaaacctaagaaagcaacaagagaagactactgagtaattaagagaggcgattgatcgatgaggtgtagcagtgtagctagctagctcaagctggcgtcgcggcggaggccatggccgacgccctcgttgacgccggcgacgagctcggcctcgaagttggccgacgacatggacggcagtcgctcgtacacccgcgacccgaggtgctgcagcttcttctgctgcgtcttcaccgtcttgctgatgatcttgtagttccaccgctgctgcacgtacaccgccgcggcgagcgcgacggcggcgagcgggatggcgacgtcgccggacctggagtagaagtcgaggctggtgttcacgaactcgtactcctccgcgaagtaggggttgatcgccggcgccctcacgtagtcgtacacgtgcggcagcagcctcaccgccgtcaagccggcgtagtaccccgtcttcagcggccggcagttgatccgccacaccacgttcccgatcacctgcggcagcaggaacatgtcctgggcgagcccgatgtactcctccagcgtcaccgcccactcccggagcgcgtgcgcctcgccgcgcgcgtccatgtacgacgcctccgacctcaccggccgcgccagcacgctcacgtagtgcgccgcgaggaccaccgcgaagccgacgaggtgcgcgccggaggtgtagacgaggaccttcttgtcgctgggcacgcgccctggctccagcggcgagcgggtgaggaggcggatgcgggagcgccacaccttctgcaccagccggagcgtgaggaggaacgcggcgaggatgaggatcttgacgacgcagtcgatggtccagtagagctggctcttgtccacctcgtacgacggcggcggcgtcgcgccgccgtcgccgctcgacgcggcgatgcgcgcgaacagcgcctccgcgccggtgatgagcggcacgctgtagccgactgcctggacgcccagcatcaccaccgacacgtacggcatcacgtcggtgtgggactgatgtacatgagctggctgaactcggcggcgatcgccgccgccagcgtcacgacgcggaggatcccctccacgctccgccgcgacaggatgtcctgccgctgttcccggtacaggatcggcagcgtctggagcgccgtcgcgttgaaccgcagcgggtcgtcgccgccgccgcgcgtgctcgcgatgtgcaccttcgccgtcgggttgatcagccaccgcgccgtcgtcggcgggtactccaccctcacctcgatcgagcagtccatgccttcctcgacgccgcccatcgccgagaaggctcgccacggcgcctggattctctcggcagccgtatganggtacatccgcgccatcccaccgggttgtactancgctcttnccaaggacntagcgtcnngnacactgttcacntgtacgctgtcntgcccggagtantcgtnncagctcctcgccgcacatcgttgaggaantacgccgtcgcccatctcagcnnttcgttcggtcagtcgacganncngantgantgantgcccantgcttatgccccctaccagncagcnntggcggtcccccgggataacgttcgcccggcgaggcnnccggcccgacgagcnngatctcgagcgagagcccaccctcaagctgaaggaanntggccgctcgaatcgtccgcgtgggaacggatccggcacggcggcgacgtggagcgtgagctcctcggcgaggttggagaggctcgtcgtctcgtcggcggcgtcgccggatttcctcgggtagctcagcagcgacttggcgatgacggtgccgaagtcgaacggctcgcttcgccggaggaactcgccggcctgcttggtcttggtgtagctgtacgccaagctcagcggctcgccgccggtgacgccgaaccggctccacagctccatcgggtgcaccgtccgctggaacgtcagcggcgggaagtgggcggcaccgccgccgatgctggtgatctggcccaccgtgatgctgcggcgagtggcggagaaggtggtctgcaggtagaggcacacgcgggagtggcacgccttggcgccgacgccgaggcacgccaccatgcagagctggccggaggacgcgcgccacacgccctcggcggacatcgtcgcgccgccgagcccgctgcgcttcgccgccgtgtacgcgtgctcccacggcgggacggcgcg

SEQ ID NO: 67323 - DNA, 4069 bp, Oryza sativa
gtcagcgtcttggggtagcggagcacgaggaggatgttgccgtccttggtgatcggcggctggaacctgtcgcggtcggagtgcttggcccagccccacgggttggcggcgtcgccgccgcgcgccggcaggacggcgtcgccgaccatgcacagcacgctctcgccgtcgtcgttctcggtgtacaccccctcgagcagcaccttcagctcggtgttcccgggccacaccttgaactccggcgacacgtacggccccatctccggcccggtgccgttgcgggagatggcgacgccgagcacgccgctcacgttcagcgccgtcctcccgcgccgcgccgcgtcgacgtgcgtgagcgagaacgacgcgagcggcagcgggtcgcgcgccgccccggcggcggcgtcctccgccacgtcggtgccgtcgaatggcagcagcggcgcgccgccgccgccgtcgccgtcgccgtcgtgcttccagtcacccttgacgaaggacagctccggcatgaggccgttggcgcggttggcgtcgaacgtgagctccgccgcggaggagagcacggacttgcactgccgcttcacgtcggcgaagcggacgtactcgtgggggatgaaggggccctgcccggcgccgccgcccatggggttcgcatcacggtggaacggatcaaacgacgacacgacggcgagcagcggcagcagcaacgcgccgacaagctgcagacttcttgacaccattgctgcgcaaaaccaaacccaatgtcacaaactcgcaatctgaactcagatgaatttagcaacgctgctttggatcaaatttgaccaagtgagtgattgacatcaaaatcttcacacttcttggcaacttggatgaacacaacaatgcagtaaaactaatccttttcagcttgcatgatcagatcagtatcaacttggatgaacacaactatgcagtaacacttgcagaagaatgcaaaaaatctaataaaatttctgcagcatatctaactaatcctgttcagcttgcatgatcagatgatcagatcactgacctcaacatagaaatttcttcagtgctcctcaagctgggagacctcgatgagagtgaggtgagtgtcgaagaactgttcaccaaggacggctctagtacagactagagcagcatggatctctgaatttgaccagaatgtggtgtcagatctagaaaaaattcccggaccagattggatcagctggaatctaatctaccaccactgaacaacactgatggatggatgcttcccccgcattatctttttccacaccttaattccccttctgcatcatcgaatcaatcaagggttctagtatagtattgggggttgactttgcgacgaagtgacccagaaacagagggttacacccttgatcaccgagaatgcccctgatcagagtgacttatcacaggattgccactgtgagaggatcgtctcggtacaaacgagcagtggcatttcggagattatctcgcaactgtgagggttacagcgaggtgaggatgggggagttgacgaagcgacgcaggtggcgcgcgcggccgccgcggcgggcatcgcggccggccggccgctcgccgcacggggaagcccgtgccatgtcagggcggctgaggccacgagagggacgtcgcgccgtcacatggccgcacgtggccgtggagagagatatttaattacttctagagttatgtgtgttgcagtgttgctatccacctcgatcttggccggcgccggaggagacggccgcgccgcgtctggagcgggacggcggctcgccggagtacggagaccgttgggttgcagcgacgaatctagtttgtttgagaggagaggatgtgagaagatcgtaaatgatgagtagttagcgtattcaaattttaaaagatatattaatatagttttttaattttttaataaaaacgtactgttaaatcatttgaaaaacgtacccgcgaaaaatgttagttttcctctcaatctttcggtgccgaatataaagcgttgttatttgatcggacaggtgggatgagggcatcatgctcaactcgtttcggcccagaaatagtagtatatgcatgtgtttttcttgggaaataaattatattctctctctcatttcttgattcttattgaatcgtctccctcaattgtaacaacgggtataatgtcttctccgacttaaaaaaaattagtgcaaatcgactcatttaatagtttgggaagcaatttcacctagcacggtaggttgaccacggatgactcgttgattgagcgcttgggacccacatgtcaataacttacctcatttgctaacccacctttctccccttttcttcctctccgacctttcaacagcaagaggacggtggtggtggcgaactggactccggagagggctttggtggtggcaagtcggactgacgagccgaggaaggtggtaccctctctcgtcatagacggtagcagagacgagacatgttggaggatgcaattggaacccttgcgtcgccaccctcttctcatctcctacctcgtcaccatcactgcacctttctaggtttggctcgccaccatagtcgcttggatgattccttcgatgtgggaggagagcctcttgttgatcaactacaccgccttggggctattatggccgtcgtacacgccgacaaggccaccacctgcgcctggtcctcgagtgcctcgttgacctgggccatggcgacaaagtagtctcccaatgcaggaagagaagagggtggggacaaagcagtctcccactgtagggagagaaggaggggaataaaggagagccctgacacgtgggctctacctgttgatgctgccaacataccacgtcagtagaaaccgtttctaaaaccaacaaagaagtcaatttgaaccggttttcgaagatggtagatgtattatacctggttttacggttgagggaagcaattcaatcaggagcgagagtgaggaagtcatgataaacttattccttttctgagacggctgttaaatacggcctggcccataatggtccatcactagtatagctaaaactgtattcatgggcctgcagttgattgcaggctaaaaccgctgtaatactgcgtaatcatcaaagttcatttttaaaagtgtaataatcaaagttcttgcaaataaaagagtcaaccgagttgatatgtttgtctccaaaaatattctcctatagtcaaaatatggtgaaaagggtgttatttatgcgaagaattaataaagaactaaattaactttgaccagtagacttttataaaacatcaagaatctgaatagccatcgcaaaaattcctgaaaatcgatgcggctgttgcttttcaaagtgtcaggattgcttctacagcggtaaagctgcaatatattccctggacgataatactatatgacgtttcggacaaacaaaataacttgcgcttaatggattttagctgtcggaaatatcaagtaatctttgccggatggagtacttaggctgcgttcagaaccctatgttcccagcacaagctgtgcacacgaaaaacggaacggtccattagcgcatgattaattaagtatttactattttttttaaaaaaatgattaatatgattttttaagcaatttcgtatagaaattttttgaaaaaatacacctattaacagtttagaaaaacgtgggcgcgaaaaacgagaagagaagttggaacaaaggttctgaacacagccttggtaccaccaagcatatcattatcccattggaaaatttaatgtcatatgctatatttgtgcataccaaaacataacaactactattaattagaaccattcacatataatcacattaattgcagaagcaaaccctgcattatgcattattggtggctcttcacaattctcaacttaacaacaacaacaaacataatctcccaaacaattacatctagctcatatttaatctctccaccatcacataaatttgatattactactaggactaccggattat

SEQ ID NO: 67324 - DNA, 761 bp, Oryza sativa
gacttcttaggggtagaaacgtcatatcgtgtgtgtgactggatcaagacggacggaaaacgatcgagaattgacggaagtgttaaaaatgggaacatggtaaactttgggtgctattaaagtgaaccggtaactttcggtgctataaaaccaaaaacgtgaactttcgatgctatataaccaattttgccttaaaagtaattcaataataagctaatttttttcatcggaatatatccatgtgtaatcttgttttgaagatttaattgcaacgaatttaatggtgcaatcggatcatgatttggataagtaatttaaaagaaaaatcagtttaaagtagttttacacgtaaatcggaggcgattttactccgaattgatcgggcgcccgagcctaggctgccccaaaataccgtttaggagtttagcaatttgctaacgaaaaacaagaaaattgtaagtcgtcgttggaggttagaatggggcctaagccgaagtgtcagatttggagcccatctggagaacgccgtgcatgatgggccgcggtctgtcatttatgggcctatctagagcggcccatagccccgataccgggccaggccaaagctgactatgtgggctgcatggcccactcgccgaatttcccccctctctctctctctctctctcacggcccatgtgctcgcaattaccaaaactttgcattgtggcctcgtcctgtaaatgacaagggatcagatcaagcgctgcacaaagcacatg

SEQ ID NO: 67325 - DNA, 3500 bp, Oryza sativa
agaatcaaaagaacttacttttgccaccaagtattcccaaccattctttgctcaatatgctgcttgcttatggaagcagaacctgtcgtactggagaaatcctcaatacactgcggtccgattcttctacaccgtcatcatttccttgatgttcgggacaatctgctggaaatttgggtctcgaaggtatgtccactgatgattctgtctccacttttcttcctgtacttggctggccttatagcgaacatgtggctttgtttgacagggagacccaacatgacatattcaatgccatgggtgccatgtacgcagcagtactcttcataggaatcactaacgccacctctgttcaacctgtgatttccatcgaaagatttgtctcgtacagagagagggcagctgggatgtactcggcactgccttttgcattctccctggtaattttccctgtcaaaaactcctgtcatctcatcatgttttgatgctcgtagtagtaccataataaggctaacaatcgaactgttcttcggcatgcaggttacagtggagttcccttacattcttgtgcagtcacttatctacggcacgattttctacagcttgggctcgttcgagtggacagcagtgaagttcttgtggtacctgttcttcatgtacttcaccttgctgtacttcactttctatggcatgatgacaacggcgatcactcccaaccacactgttgcgcctattattgctgctccattctacacgctgtggaatctcttctgtgggttcatgatcccaagaaaggtacggaaggaacaggaaccccatgcataatttgcacctaacgtcctctaattgtactggacccatgatctgttttccccataatccatattccagtgcacattatccatatctttattttttttgtcacattagcatatatagctatggaaatagtgtttccaatccataaggccacttccagtgcacattatccatatctttatttttttttgtcacattaacatatatagctatggaaatagtgtttccaatgcatattatttattactggggccaaaaatgaattatctcccttcgcaaatttcatcagaaattcttagaggagatatctattttcctggtttgaatatatatgcaatgtctcatccgagacactcttttttctttataattccttagcacatcatctaaaatgctgctatgttgcatagtagtttttagtttctattaacattgtactataatggagcatgagtgccctgatataccagtgcccctaataatttcaccaaacccaccagtaactttttttgtcctacagtgaccacttgtcatgtactagaaccactttagcaattgggaagcaataatggtttgtttaaattaggacgtgattaaagtggctaatgattaatgggcttaaacataatgcagaggattcctgcgtggtggaggtggtattactgggccaacccggtgtcatggaccctgtacggcctgctaacctcccagttcggcgacctggatcagccgctgctgctcgccgacggcatcaccaccaccaccgccgtcgacttcctccgggaccacttcggcttccgccacgacttcctcggcgtcgtcgccggcatggtcgccggcttctgcgtgctcttcgccgtcgtcttcgccctggccatcaagtacctcaacttccagagaagatgagacgacgacgagcgagaagcgagctatagggagcacgacgtacaccaccattaattctctggccagctatagcgctcaaatgtgtactgcaactactatgcatgcatcaatccatttcgtttcttcagaactgcacgcgtctcttctctctgtcgtcacgatgaattcctcccggtcacgggagatgctggagctagcagagatcagagaccagcagaaaaaaggagacaagtgtatagctaagctacctgttgcaagcctgtttggcagatctccaacaactagatctaactcggagctaaagtgaagctgtggaacagccgaaacctcgcctcattctaatttttttcagattattttagcctgtttgagctgaaactgtttggttggatagagttggagcgggagctctatcaaacaggcaagtgctccttgattggcttgatcgttatactgcgtacgtagtggctggtgcggcagcagtgcaatattcggcgagcattttgcagcagccacggtgagccaatgggaggtcgacacctgcaagccttttgactgctgcaaccggcgtccctccatgggggtactcttttggaagtagcagcagcagcagcagctagctatagcagattctgcgtcccctggcctctgctgctgctgcctccgaggactgcaaaacaacaacctagctagagcagcaactactactaacaagaaagaaagaaaaaaaaaagaaaaggaaaaggaaaggtatgaggagtactgtactgagtactaaccatttggtgatcgatcgatggtgcgtggcgatgagagatggagaagaaacgggattgattgatggattgaagatctaacaccttcaaaaggggggcagtaggagcatcttctacctgcatcgcaggtacgcaacaacacatgcatggatcgatccactcgtcccagctttttattactaccatctttccttcctttttttttccctttagagcaagataataatagagcacactttctattattagctcatcttaaagccaacatatataatagattagctataagattgactataattttcttctcatctctctatctctcacttatatatttaatgcatttgtcttagagctagtgataagctagctcttgcatgagagccaacattcttaatttttcgctacctctctcctccatctaagcttatagtaggcttatagctcactattatacttgctcttagtgagtgtttggcaaatgggaaagggaaatgatttcccacccatctttaaatactaaccattcattctccctcttccatttaatcctaaccctttattcattttccaatcccaatcccaccccctattttccattatccaaacacatccttatatcttctacttctcgagaggaatatatatgcagctactagctatagctagacattcgtgtccggacgtataggaaggtattcccagcatcattcatccgtgccgtgtgcagcatactgttttcttaagcccaaaccaccaatagcgtttcacgatgatcgatcaatttttttatatattgatgacagtttgtaataaagaaagaagcaacgaatcgatcaaattttacatatgttaatggcagttcgtaaatggtaatggtcgagctgtctccaccagtgtgtatacatatacatacgtacagtggtggaggcagcttgatctgctgctaatgtatatacaaatatatttggtttgttctctctatatacatacgtatat

SEQ ID NO: 67326 - DNA, 1929 bp, Oryza sativa
tgtaggataaatcaaatcctcagtaatattttagaacaaaaataataatagtaggatggtatatcatggtttggccccgttggttagattcctaaattaatttattttgaagcggaagaaatagtagctcaataattgcaatggtcgattcataccattcctagctacctatgtatacacgttgattctgatcgattgggcgacgatggattacacatgcagctagtgtgtgtcgtatatacttatagtatactatatgtactatcttcgttttcaatagatgatgttattgactttaatatattgtttgatcactcattttattgaaaaaaaatataaagatattattttttatgacttgttttcgttattaaagaagtacttttgcatgtatgcatcaattttaaaatctgacaagtggtacaccaaatttaaggatatcatctatttaaaaaaggagagggtatatacgtatatgcaacttggggtgggctgaggaagatcaacatcgagaccgaaaagaccgtagttttttctgtttatgtttatgtttagcgtttgaccgtccgctttatttgaaattcttttatgattagtatttttattattattagataataaaacataaataatactttatgtgtgactaattgttttctaaattttttcataaattttttaaataagacgtacggtcaaatgttagacacaaaaacctactacacatgagacggaggtagtgctacgtactttttctttttaaacaacatatacttatatatgaacgtacttgctcagttattggacgtatctggcaggcaggatgcaggtatacatatactatactactagtagtaacaaataattaacacatcgaagttgtctcatcacgtcaaatatatgaagaggggggtcgtcacgccaggcgatgctagagtccacgggagttgaatttgtctgtccgattcctggagctttccagattgaatcgggtgttgtttaacctgcagtctaggccgggtcaatctaggtctctggtgcaatcctttatacaagaacttagggtttggtcttgacctcggtgtagatcgattcgctttggtgtctgctgcgtcgtctgcagtcggggaagtccagcatatagatcaaattggttcttggcaatatggcatcccatgaagatccgcgcgatcgtcatcgtgatgaaggtggtgcaacaaccgatgaggaaccgattgaagatctgggcggggcttcggaggaggaagacgatgaagatgcaattgtggtagactttgatgaggctaaaaagcatattgatacacagtatgtggccattgggaagttcttctcaaggaggactttcagcgcaaagggactgtttgaagccatgcaaaaggcatggggcttgagacaaggcatggagtacaaacgcctgcatgataaccgatttctactggaattccaatctgcaggggatttcaggtttgcgactggaggcggtccttggatctatcaaggggatgctttcctgatcacggagtatgatggcaagtctagaccttcggatgtgaaactgaactcgctaccagtttgggtgagaatttacgatctacccctgtctatgatgactgaaacaatgggtaaattgattggtgcaaggctgggtgaggttcgtaaggtggcggtggatgatcagggaagagcatgggatgattttatgagagttcgggcggagcaccctgtggataaaccactgacgtgttggctgaaactgaaagacaaggagtcatcttcggtggttcagaggtatgatgtcaagtatgagaggatccctcggttttgcttttactgtggccacattggtcacatggagagggaatgtgatttaccctcggataagcaaacggtgaggtttggccttaatct

SEQ ID NO: 67327 - DNA, 2941 bp, Oryza sativa
aacgatccatgaagatatctctcttataaaccagcttagagatgaggaacttggtgagggacataaggaaaatatcgatgatggggtaaaacctgtgctaggaaagaggagtatggataaatctctccttggcccaggatatgatggaccttcgtttgatgttctagttggaggtgatagtaagaggagtaagagtttgtctctatagacagcaaagtcgatccacctgacgggcattccaaaggaagcccgtcaggagcaatgaatattttaagctagaactgccgaggatcagggaggcctcggacagttcaagatcttgtttgcctagtgcaaacacacaagcccaagctggtttttttgtctgaaacacatcaaaatatagaaagagtgtgtggcttaaaatagagattggggctgcggaattgtgtagcagtgcctggagaaggaacggggaggggggggatggactagccctcttttgggatgacacagtacaagtggatcttctatcctacaacttcagatatattgatgtgctcattaaggacgaaagctgccctgtgcaatggcgatgcacctttgtgtatggtgagcccaaagctagcgaaaggcataacatgtggactcttcttcgtcgcatcaaatcaaattctactgctccatggtgcttagtgggcgactttaatgaagctatgtggcagtttgagcatttttctgaccacaagagaagggagaagcagattatggatttccgggaagtcttgtcgcactgcgatgtgtttgatttaggtttcacgggtgccccctggacttttgataacaagcaaaaaggaaggaataatgtgcgagttcgactggatcgtgcagtagcaagccagagttggtcttctctctttcctgctgcagaagtgattcaccttactgtgtccagttctgatcacagtcctattcttctccaagcctcccgagtggatcgcatcaagaaaggggatcggtgtctgcggtatgaaattatgtgggagagggatgagcatctgacagatgagattaaatctgcttggcaactacagggacatatatcagacttaggctcagtggcaagccgcttaaagtctgtgatgggagcactgcagacttggagccgtgataaatttggttaagttagcaaagatattaaagaaacaaggaatcgattggcagagcttcagatggcaggcaggtgtgctagtgatcaagactatctcgatatatccaggaagctggatactcttgtatagggaggaaatgcaatggctgcagagatcaagaatctcttggttgaaggaaggtgaccgaaacacatccttttttcataggaaagcggcttggcgccacaagaaaaacaagattaataggctgcagagaagtgatggaacctggtgtgataagagggaggagatggaagatatgacatcaaatttcttcaaagagctttacactaatgacccttctgtcgagccagaaccattacttgatttggtacagcccagagtcacgtcggagatgaataagctgctttgtaaagaattctctgatgacgaaatttcaaatgctttgttccagatgggtccgttaaaagcgccggggccagatggttttccggcaaggttctttcagaagaattgggatgtattgaaacgggacattattgcggctgttaagctgttctttgaacagagaagaatgccacaaggtgtaaatgacactgccattgtgttaattccgaaaaagaaagagccaaaggatttgaaagattacagaccaataagcctttgtaatgtgatttacaaggtgattgctaagtgtttggtgaataggatgcggccgttacttcaggatgttatcgtgccagcgcaaagcgccttcattcccggccagatgttcactgacaatgctctcatagcttttgagtgcttccatgccatcaatcggtgtaaatcggttgagtctcaattctgtgcttacaagttggaccttacaaaggcgtatgatagggtggattggagatacctagagggagctcttcttaaggttggtttttgttctcaatgggttcagctattgatgacatgtgttacctctgttagctatgctgttcgcttcaacggatctatgcttgaatccttcaaaccgaccagaggcctccgacagggtgatcccctgtcgccctatttgttcctctttgtggcagacggtttatcaacggcgctgagtgaagctgaaagatcaggacggttacaacctctaaaagtctgcaggagagcccctggaatttcccatctcttgtttgcagatgatagcctgttgttctttaaatcaaatatggaacagactaatgtggttaagagtgctcttactttgtatgagcaaagcacaggccaactcctgagcccggccaaatgttctttgatgtttggaaagcattgtggggatgctctgcagtctgacatcagatcccttttgcaagttcaacacacttcctttgaagataaatatcttggtctgcctacaccgatgggtagactgaaggcaggaagacaccaatctttgaaggagagatttgagaaaagattaacggattggaatgagaaatacctctctatgggagggaaggaagttttaattaaatcagtcctacaggccattccgacctatgtgatgagtgtgtttaagcttccagcagggctctgtgaggaatatatgcagctgatccggaaattttggtggggagaagaccgttagaaaaggaaagtccattggatctcgtggcagcaactgattaaacccaaaggacaagggggaattggtttcagggacttaaagctttttaaccaggctctgctagcttggcaagcatggcggctgatccagtttcccaacagtttgtgtgctcaaattt

SEQ ID NO: 67328 - DNA, 1207 bp, Oryza sativa
cggccgctgaggaaattttgtgtatccaatgccacatagccctgaagaggacttcattgcttggcactatgataaggtgggtatgttcactgttttttctgcttacaaattagccctacaggcccagatcagagctgacgaagaggttgcacaatgctcaaatggcgatggtgataggaagttgtggaagaacatttggaatgtgcaagtgccgcagaaaataaggatttttgcctggagagtatcaagagattgtctagccacacaacataataaacatcgacgacagattgtacaaaagccaaactgtgagatatgtggggcagaagtggaagatgcgtttcatgctacggttgcatgcacgaaagcagctgcgctgagggcagagatgcggcagaatcggtggctaccgggggaacaggagttctctcagttaggacctgactggctgctacatcttataaaccgtgccgacgatcagacgagggcgttaatattcctgctgttatggtgagcctggtttttacgaaacaatatagtgcataatgacggccatgcttcagtcactagttctgtggtgtttcttcggagttatgctgaatcattgtttctcaaccggcaaccaagagctgacagaaaagggaaggctttgtgtcgccctgaacaggggaaggagtcaggtccaactcgggcctttccatagcaacgtgtttgttggcttatgtctgtgaatggctgggctaaaatcaatgtcgatggagctttcaatcctgaaaatggtaatggggcacttggacttgtaatcaggaattcgaggggcgaagttctgttgtcttcttggaagtttctcaggcgatgtgtgtcagcggaggaagcagagctgcttgcgtgctatgaagggctgaagctagctgctgaatggattcccatgccagttatgcttgaatatgactgtgccacagcgattgcgaggttgttgtccactactgaagagagatcaagatggtcttttctgctgcgagcagcaagatcagttatagggttaattaaggaagtgcgtttgatgcactgtaatagagagtgtaatagggtcgcacatgaacttgctcagattgctatccgttcggggcaaagcgcggtttggcgtaataatgcaccgaattgtgttatgcaatgtctgcagcatgactgtaatcctgttacgtaa

SEQ ID NO: 67329 - DNA, 1449 bp, Oryza sativa
taatacttatgcaggtgttcaaacgttcgatgtgacagggtgtaaattttttggcagggatctaaacaggcccttagtcaatctcagatatattaataaggatgtgaaaaaatgaatacgcctttcattaactgtatgcttctcctaagctttgatgctcgactaaggctgtgttcgttaccggggttgggaacccatctcctccgcacgaaaaacggagcggtccaatagcacgtgattaattaagtattagctatttttttaaaaaaatagattaatttgattattaagcaactttttatatagaaactttttacaaaaaccgtaccgtttaacaatttgaaaagcatacctacggaaaacgagatgaaagggttcggaacaggctgaaacgaacgcaacctttaactcttcacatggccaagctctaattaatgatatttgcaacttactattggaggtggggacgacggtaatcaagggagataaaaacgaggataataaagtgggccaatcgacacacgcctaaaaataaggtcttttagggtgaagcgaatagatagtaggttgtcataagaaatttaatatgaattactagtgcatgttttaagaccataaaagttgtacgaaaatactagcaaatgacttacagtacatttgcaatcaaagtaaatattcattctgtttcaatttacttgtcgtattagataatttcacactaaactaggtggtgtggaaggggctaccctcattaattacatgctaaccatcgtacgtcttctcaaagccagcaataaaattagaaaatgctacacgtacgtccgaaatgtccgactcctgtacgactgcaacgtccgtccatggcttgatccccgcgctgtttaatcctccaactcattgagcctcacgccgttgtgcatttgctgttttgacgtttagtcgtacgtcggtgggacaagaaagtcggatgtatagcagtctctccaagttaaaatttagaaattttagcaaaaaaatctcattccaacagcctctctacttgaatggctaaactagatggatggccaaacttcacctcccactagccaaacttggccagccaaactgactggccaattgtgggccccacgcctttccccccactctatcgatctatccccgtccctctccgcattgctcgtctctgcccgtcatgccaggttgcgaggagggaagagggcgcgtcggtagggcaacacgactatgagcgtcgcctcggcctctggctcgccgttgtcacgacgacgagcgtcgcctccggcctctagcggaattttctccgccacgagatccgcacgtggctgtgcagaggaaaaacccagggaaaagggcgacgacagggcggcacaacggcaagcctcgccgtcggcctccagcgccgatttctgccgccttgccactgtcctctgg

SEQ ID NO: 67330 - DNA, 2441 bp, Oryza sativa
agttaattgaaacggagggagtaacgaatatgaattggcaaaattaaatcttgtgtgcacctacagtatattttgaactatacagtaacattttgtattaccaaatgtccatgtccaagtacctttgactaatctctcctacagatgcaaaaggaggtcaaggaaatgaagaaacttctgcatcgacgatcatgataaccggcatattttcataaagatattctaactgctttctttcacaacgatcacttcacaatttcaaccaacagtcctgtctttgatcgatggtgcttgagaaactacaaagccggtctcctcttttttgtttacctaagggatctatctatcctagctatccaaaaagctaattagctagtgtatgttgtacatgtgccatgtcctacacatgaacggttttaatttagtacccaaacaattaggtttccccagtgctgaattaaattcttgtatagcaatagcattgttcatacatgctgcacatatatatgcatctccactgagctatcagtgctggtcgtcttgtcaactaagatacactacactccatccattcccctattctcctttgtggctaccaaccagcaccctcacagcctcaccaaaggacatcacattacacccctcaacacccaccaccctcacacaacatgttgtcctaatgtttcctagtgttgacaccctaagtgtgtgcaggtgcatcagtatgtacacaaaaaatgcttccattggtgggagtttgtcccatggaccatgatttttgtaccattccgtatagatgcggccaatcccatatatatacacatgcatgcatcatgtgtgtgataagcattttcattttatcatcgagttgcatgcaccgaccggttggattacttgatcgcgttgctagatggcaatatatgcatgccatatgtgtaatggtggagccagcggtattatcgagcatggatagttaatagtattttttgacaaccagctagtttttacgggcatcgatggtaattgtagtggtaacagtagagcttgggtggacatccgacatgccaagaactgccttctgcgccattgcatatgtttatgttgacgtgtacgcgcctcctcggttgttcatactttcgattgactatgcttttgcactgtaattttaggtaggtgttaccccacatcatgtgacattcacatggtagacaagagtctcctaacttcaattcatcttgtcatatttggccagccctggcctgacaatgtccctagacaatatgtgttgggggtttggaataaatgccgacatggtgagcctccatttagaactcatttggttaatttgtgtactatttatatagcaatgtgttttagttttcttttatttgatagtaaaactacacatacttcctctattccaaaaaaaataaagaatatgatacattacagtacaacaaatttataaaaaaaacttgtacaaattcattgcattaaaataggtcgcatcatatcatattctagtcttagttttttttccttatacaaggagtatatagctgggtcgatctgactaagggggtgtttggaagagaggggcccctaactgtgccctgccatatggttctccataaatgcctgctgtagcatccatgattgaaccatgtgtaacaaaagatggagcaggctagccaatcaaacaaaggaatccaggaggatatatgctactgacatgctagctcatcacacactgctctgctatgggtacccccccaccccccaacacacacacaaaatcgacgagggttatctatagtactgcacagttgtatcattaatatgtgggactatagatctacctgctcgccgcttccacaacaggggcggtactgtagaggatccgtgtcagagaaaaaaaaactttcatattttcctctctaaattaatttgagaataaaaatgttatacagggcctgtcgtttataggttttctttttatgcatccagaaaaaccccatgtcggtcatagtatatctgtatatgttactaagtaattgactggtatttttagcggaatgtgacatgaattggattagcttgacaaggagatcgtgccggaggaaaaggacaaatgatatttcatgatagaagatgctctacatatctatcgaaattatgcatttggtggctagctagctaggtccccttacgttctaaaaggtcatttttactcgttttccttttcctttaagttgcgtttctttcttgacctgaaaattatcagcagagatagcccaatgcaggaattttgcctgattattgtgaggaatgaattatttcctatgaaatttcttcaaaaattctgaatacgtgatatatatattataaatttatataccaaatgagtcaaaataaaagaaatgaaactgttttcgttatat

SEQ ID NO: 67331 - DNA, 710 bp, Oryza sativa
tatggcacaaatctttctgtgaccactttatataggagtatcccctactagctacctttgcagcaaatttcagagtccaactgctgtcatttctgaacacacattgcatccatccatccttactactgtttttgtttttgtgagagggattaaagtttagccccactttagtccctccaaccaaacaccaccttactgctgttctctttacctcatgccaccaatcacttgtcgcattgcctcttggaacctagagtatggactgcaggagacagaagcttgggctcataaacccaagccaatcatttggagatagatactgccatggctggctgcaaacaagaggtatagctaaagaaaacaaaacaaaacaaaatgcttactactcgctctgttccaaaatacaccatccgtcctagaaagaataaacttctaggctcagaagttgttgttgtctcgtttaaaacaaagggagtttggagtattaaggatttataggttgtttagaaaatactaagtttagggcaattttttttgtcattttagttgtcaatttttaaattttgaattgcatagattctctttccaagcatctaattggctttggaattattgaaatgatgggaattgtagaaatcagagaaggaatgcttatatgagtattaaaaactaaatactagaaatcctgatattttgaaacggagggagta

SEQ ID NO: 67332 - DNA, 820 bp, Oryza sativa
caccgcggtgttttgtcgctctccaactagggatccccccattttctactttgtgttatacaaggatgtctagttcctttggtgtacttaaatacttgcctatttgttactggagaaaagatgatgtgctcatggcaatctcccaagtcccaatcattggtgctgcaaatccttcttctccattttattccactcttttctttatccagaagactgattggaaaaaaacaacccatgctcaagcaagccaagcatgtccataaagcatttagcttagggtttcctattgatcaaattcgttaagaccctattgtatttgaaatttcctgtggagaaaacagtctcaagttgtgaattccttctggaatatttttaatagggtgtgttatgctgggttacctggaatatgtactgaatgctggaaagaggtatccaaaagaatgaaagagaattagtgcctgcttacgttagcagtcatgattactgcttaatgatatttcctacttagttgcttcttttatcatcacataagactagttagaaactgtcttatctatttgaactttgcctgcataagagatattatagcattaaaatgatttaatgggagcacttatggaacttgattaattgccctttcaggtatgtcccatctgtgctacaagggttggagtggacttgataggtcacttgacaatgcagcatggaagttactttaagatatccttttttcttctctataatgctggcaatgaacatatgcaattttacatttttacatcatattcagttgaagatacatggcattattggtacttgg

SEQ ID NO: 67333 - DNA, 1532 bp, Oryza sativa
  unsure (1)..(1532): unsure at all n locations
cttcctcggctggagccagcagttcagttgttcggctgccgccacccctgttgccaggctccctacgaaggccacgagcctggnttggnaaacnnaaatcatgnacttnatagtttggtttgcattatgcattaagagaagtgatatgttatgtattgtaggaggtagtgtgcatactagttccatttcattagaacagtaggctagtaatgcagctcgtgttgcacaaacagcacaaaagttagtaaaacaagattagcggcaagttagttaggagcatgcaggattagtggagcacgttgtggcgtggctcgcggtcagcccggaggagcgaatcttggcgtaagatgcgcagatcgttgtatgagtgagtggctcgtagtcgtgcgtgcgacccggccgggctgttagctatgtgcatgtacgggaggctatataagccgtgtaatcatcagttagttttagcagatcagcaatatcagagaagccagcaaagacgtgcgtcgccgacggaatctgttgtgtgtgtgtccacccaatttgctgctcgtgtgtgttctcccgtgagtttgttgcttacgtgagtttgtgattttcttgggccaaagctaacagagcccacgacagcgcctggggcgagggacgacagcacgcggaaggcctcctgtagcccgttgacctcgcgcctcctggtcatcgacgccgcccaaggcaccatgcccactggatttgtgcgtgacgaggccaagggaggcaaatctggtggcgtcgcgcccctccgccgcccggcggcacatgtcccgtgctccttcaccgctaggagtgcttcgagcaagaataggggtggaggagtgctcgcgacaagaagtctacgaaaaggcaccgacaccggcgagaggtggcaagaagtgctgtaacgcatgtctttcaggctctcatcactcacctctcgtctcgctagcaatgtcacaccaaatcctcaacacctcagcacacattcaccaccgcgccctgcatcggcgacttgccagtcacggccaagccttccaggatgttagcagggaaaatcaccattggcctcttcggcgacgaggtccccgccggtgcgtcccggctcctgtcgcttggtgtcggctagttaagatagtgtggggctacatgcaagcaggacggtgtggtgtcacacccggccatcccggcgctgaccgaccggctagcggcgaagatggacgccgcacgcgcgcgcaatgcgatggggacaggagtggcgtccacccaactcccacggcatatggtgacggccggcgaggcagcggcggctgaacaactgagcttctagcttccgtcgaggaagaagcgaccgaacgggagagggagagagagaggaggaagagagaagcgaggaaaaagaaaaaaaaacaaataagtgccacgtaggacatgtggggttattgttttttcttttcactgacatgcgggtcccctaagtgccacataggatgaaaccgctatcaaacagccgagggactcat

SEQ ID NO: 67334 - DNA, 1694 bp, Oryza sativa
cccttcagtcccctccccccgcaagcacaaggaactgcctactgtcatcgatctgtgtacgcatgtcttccactccacatgcttgatgagcccatgactcatcatcatgtcaattaataaccgctgccaccaccgctaacccgatcagcgtcttaattaactttctatgttttaaaatatagctatcactaaaaaaaaatatagctgccattttaagttcaaagttgaactatatattttaagatggagaaagcacatttataaatatttgacgtttagagtagggttcgatcaaagttttaaaatttaaaccgtcgaaagtttctcaaatgtgtagtttaaaaccaaatgaaattgtatatatatagatttacctcgaaaagtactaccgtgatattataaacctattgaatcttataattaaactgattctaatatgaaattgatagaagtgaattttaaagtttgaccaaaacttactgtaaacgtcaattattcattgccggagggtgtatttcaatttcttgttcattttcactagctatatatactatgtcgttgcttggtaatttggaagaaatcaaatcaataaaaatttcagtatagtccgttttagcgatatttcaataattcaattctgcatataacctaagccatacgtcacaattaccagaaccagacagaactcgtctaccatggtagaaaaacaagcacttaatttgatacgaatcattctcatgcgagctcaaagctcactggaagcaactgagacatccaaagtacatcaaggtccagcatagtcaacaaaactaggctggaaacttaagaacttaaccaattaatcgatgtccagtttaggtgtgatttgtgcacactccaacacaggaccaagtctaggaaactagtgaggggtagttggttcttgtgtaccaaacacctgcacagaatggccattacccatgtcatgcatggtttttatagcaattgggactagcttgcaatcatctcccagtgatccatatgcctctgcctgaatattaactcaccaaatggttcaagggatcacattttgcttcatattcagtagccatccagagttccccaagaagcaaggctgccatgcttctttaatccagtgctgcattttataagcagctttgttgccaattcagttgcataacctgcacatataaagagggactgcaggctaggtgtgctagaagcagaatctcaagctgtgagggagtagtaactgaattttgatcagttcattcagttgcatgtccttgcatgccatggcctgtctcaagctcagacatgtgtgcctcactgtggtgctcttctccattggtatctccagctgtagaggtaattaatctatcttagatccacttttaattaacatatgggatgcatggcttcttgtctttttgttcaaaagtaggactttggtcttgtttggaaatgatcagctttaaatttgaaaatgccatagttttaacgtttccagataggggtattgagggatttttcagcatatataatctgaaggaattttacgatccttgcattggaagtatcatcactccatctgtttggttctaagtaattaagtaactgtatttatctgaacaatgcagggcaaggaggagggggagcaggtggtggtggtgcagtagttccagggacacagg

SEQ ID NO: 67335 - DNA, 1897 bp, Oryza sativa
aaatagacacactattaactttttttgaaaacaaacaatgctcatagccaaaaaggtttattttttttataataagttatcagatgttcaattcgctttttccataattacagcgtggacaattgttctacaatttggtcagcttaggataaaattaacataatagtaatactgcattttttttcttatatttaacattattattacaaattatgcatggccggtgatctcctctgtctgtatattaccagtgtcagtgacttttgagtgtcgtacgttcgctcatcacccaactaaatgaagaaaaaaaacgtttaattatattaattaatcttgtggcaggtgatcaacgggtgcctgcaatcgatgggcatcaacgtcaccaccacaaccggtggcagcggcgccaccacgtcggctccggcggcggcgaacgggtcggcggcggcgaccatgtgcagcgcgccgtgcttcgggcagatgaccatgatgatggggtgcgtgaacggcatcttcggcaacttcgccggctacagcccgggcctcatgcagggagtccaggccgtcttccagatggcctgcggcaacgtcaatggccagggcggcgccggcgccgccgccggtggcggtggcggtggcagtgcaggagcctccggcggtagtggtggtggtggcggcggcgccggcggtgctactggtggtggcgctggatcggggaatgcttctcctaattcaggtaaaaatgttgggctagcagattaccagctaattagttactcttaactctccatttagaaatatattcgatgtttgataagatttgattaaatctttaaaattttgacctgtttaagacaagaaataaaaagagtaaaatcggcttgaaaatcactatcattactccatccgtcccaatatgtcacgtctggagatgtagcggcaatttaaaattccaatcaaatttgttataaatatcaaataatatttctgaaggaagggttatttgtttttactatgctttacactggtcatctaaacattggtgtttgatgaatatgtgcccatgtaggctcacacgtggcggtaaagcgtccgggttatccgaccagcggagcagctgggcccactgtcagcctcacgagggtgttttcctctctgctaatcgtctgggctggaacaaggctgatggcctgattgattgctgctgttcgagcagcttttgactggacacaggcaaacgttgctgaagagttcaaagatgtgttgtgttttctttttaatttcctgaatagtgaatagtactgtagcatattgatattgatttctacaacccacgcaccagtgctgatttcatgtaacaacaatctgtaatttgtacgtcttttgatttgatgaataataaatttgatgcgtgtttgtttccttcaccttaatatcgacggttgagaaccggttttcttgatcgtccattcaggtcgaaaagtcgaattgatcttgtatttttgtattgcaatatgatacacaactctccaatagtacaatgcaaaagaaaggagttgaccttgttaatcatatttaccacatctttttcctcaaaaaaaatagaacatatttatccacggatataaacatatttattaagtgccacataaaaataatacaaatataaatcattctcaaaaggaaaaagtacaccgaaggtattgttccccaaccacaaaaacagatatatgacattccttaacttataaaaccgttcaccacaggtcttttggtgggtttgaccccgattttatctgatgtggtagctgagtcagcgtaggatccacgtggaccctaccagtgaacacatcatcatgctctccttctttcttctgtctctctcttgctctctttt
